United States Patent 7,745,391 (HUMAN THROMBOSPONDIN POLYPEPTIDE) - sequence listing, part 288

SEQ ID NO: 912067 - protein, 828 aa, Homo sapiens
MAAPTKCQLRGRLVLLCSLLGMLWEARASQIRYSVPEETEKGYIVGNISKDLALEPRELAERRVRIVSRGRTQLFSLNPRSGTLVTAGRIDREELCAQSPRCLVNFKVLVEDRVKLYGIEIEVTDINDSAPKFQAESLEVKINEIAVPGARYPLPEAIDPDVGVNSLQSYQLSPNHHFSLNVQTGDNGAINPELVLERALDREEATAHHLVLTASDGGEPRRSSTVRIHVTVLDTNDNAPVFAQRIYRVKVLENVPPGTWLLTATASDLDEGINGKVAYKFWKINEKQSLLFQLNENTGEISTAKSLDYEECSFYEMEIQAEDGGGLKGWTKVLISVEDVNDNRPEVTITSLFSPVREDAPQGTVILLFNAHDRDSGKNGQVVCSIQENLSFTLENSEEDYYRLLTAQILDREKASEYNITVTATDRGTPPLSTEIHITLQVTDINDNPPAFSQASYSVYLPENNARGTSIFSVIAYDPDSNENSRVIYSLAEDTIQGSPLSTYVSINSDTGVLYALCSFDYEQFRDLQMQVTASDSGSPPLSSNVSLRLFVLDQNDNAPEILYPALPTDGSTGVELAPRSAEPGYLVTKVVAVDRDSGQNAWLSYRLFKASEPGLFSVGLHTGEVRTARALLDRDALKQSLVVAVQDHGQPPLSATVTLTVAIADSIPDILADLGSLQIPADLEASDLTLYLVVAVAVVSCVFLTFVITLLALRLRHWHSSHLLRATSDGLAGVPTSHFVGVDGVRAFLQTYSQEFSLTADSRKSHLIFPQPNYADTLISQQSCEKNEPLCVSVDSKFPIEDTPLVPVSSFFFFLSFLFLFFVLFCF

SEQ ID NO: 912068 - protein, 810 aa, Homo sapiens
MQRAREAEMMKSQVLFPFLLSLFCGAISQQIRYTIPEELANGSRVGKLAKDLGLSVRELPTRKLRVSAEDYFNVSLESGDLLVNGRIDREKICGRKLECALEFETVAENPMNVFHVVVVIQDINDNAPRFVAKGIDLEICESALPGVKFSLDSAQDADVEGNSLKLYTINPNQYFSLSTKESPDGSKYPVLLLEKPLDREHQSSHRLILTAMDGGDPPLSGTTHIWIRVTDANDNAPVFSQEVYRVSLQENVPWGTSVLRVMATDQDEGINAEITYAFLNSPISTSLFNLNPNTGDITTNGTLDFEETSRYVLSVEAKDGGVHTAHCNVQIEIVDENDNAPEVTFMSFSNQIPEDSDLGTVIALIKVRDKDSGQNGMVTCYTQEEVPFKLESTSKNYYKLVIAGALNREQTADYNVTIIATDKGKPALSSRTSITLHISDINDNAPVFHQASYVVHVSENNPPGASIAQVSASDPDLGPNGRVSYSILASDLEPRELLSYVSVSPQSGVVFAQRAFDHEQLRAFELTLQARDQGSPALSANVSLRVLVGDLNDNAPRVLYPALGPDGSALFDMVPRAAEPGYLVTKVVAVDADSGHNAWLSYHVLQASEPGLFSLGLRTGEVRTARALGDRDAARQRLLVAVRDGGQPPLSATATLHLIFADSLQEVLPDLSDRPEPSDPQTELQFYLVVALALISVLFLLAVILAIALRLRRSSSLDTEGCFQTGLCSKSGPGVPPNHSEGTLPYSYNLCIASHSAKTEFNSLNLTPEMAPPQDLLCDDPSMVVCASNEDHKIAYDPSLSSHVSFCKSS

SEQ ID NO: 912069 - protein, 823 aa, Homo sapiens
MKIQKKLTGCSRLMLLCLSLELLLEAGAGNIHYSVPEETDKGSFVGNIAKDLGLQPQELADGGVRIVSRGRMPLFALNPRSGSLITARRIDREELCAQSMPCLVSFNILVEDKMKLFPVEVEIIDINDNTPQFQLEELEFKMNEITTPGTRVSLPFGQDLDVGMNSLQSYQLSSNPHFSLDVQQGADGPQHPEMVLQSPLDREEEAVHHLILTASDGGEPVRSGTLRIYIQVVDANDNPPAFTQAQYHINVPENVPLGTQLLMVNATDPDEGANGEVTYSFHNVDHRVAQIFRLDSYTGEISNKEPLDFEEYKMYSMEVQAQDGAGLMAKVKVLIKVLDVNDNAPEVTITSVTTAVPENFPPGTIIALISVHDQDSGDNGYTTCFIPGNLPFKLEKLVDNYYRLVTERTLDRELISGYNITITAIDQGTPALSTETHISLLVTDINDNSPVFHQDSYSAYIPENNPRGASIFSVRAHDLDSNENAQITYSLIEDTIQGAPLSAYLSINSDTGVLYALRSFDYEQFRDMQLKVMARDSGDPPLSSNVSLSLFLLDQNDNAPEILYPALPTDGSTGVELAPLSAEPGYLVTKVVAVDRDSGQNAWLSYRLLKASEPGLFSVGLHTGEVRTARALLDRDALKQSLVVAVQDHGQPPLSATVTLTVAVADRISDILADLGSLEPSAKPNDSDLTLYLVVAAAAVSCVFLAFVIVLLAHRLRRWHKSRLLQASGGGLASMPGSHFVGVDGVRAFLQTYSHEVSLTADSRKSHLIFPQPNYADTLISQESCEKKGFLSAPQSLLEDKKEPFSQVNFCDECISYLEKNNS

SEQ ID NO: 912070 - protein, 818 aa, Homo sapiens
MAPPQRHPQRSEQVLLLTLLGTLWGAAAAQIRYSIPEELEKGSFVGNIVKDLGLEPQELAEHGVRIVSRGRMQLFSLNPRNGSLVTAGRIDREELCAQSPRCLVSFNILVEDKLNLYPVEVEIVDINDNTPRFLKEELEVKILENAAPSSRFPLMEVYDPDVGMNSLQGFKLSGNSHFSVDVQSEAHGPKYPELVLEGTLDREGEAVYRLVLTAMDGGDPVRSSVAQILVTVLDVNDNTPMFTQPVYRVSVPENLPVGTPVLAVTATDQDEGVHGEVTYSFVKITEKISQIFCLNVLTGEISTSANLDYEDSSFYELGVEARDGPGLRDRAKVLITILDVNDNVPEVVVTSGSRTIAESAPPGTVIALFQVFDRDSGLNGLVTCSIPRSLPFELEKSVGNYYRLVTNAALDREEVFLYNITVTATDKGTPPLSTETIISLNVADTNDNPPTFPHSSYSVYVLENNPRGASIFSVNALDPDVDQNAQVSYSLAEDTLQGAPLSSYVSINSDTGILYALRSFDYEQLRDLQLWVTASDSGDPPLSSNVSLSLFVLDQNDNAPEILYPALPTDGSTGVELAPRSAEPGYLVTKVVAVDRDSGQNAWLSYRLLKASEPGLFSVGLHTGEVRTARALLDRDALKQSLVVAVQDHGQPPLSATVTLTVAVADRIPDILADLGSLEPSAKPNDSDLTLYLVVAVAAVSCVFLAFVIVLLALRLQRWHKSRLLQASGGGLASMPGSHFVGVEGVRAFLQTYSHEVSLTADSRKSHLIFPQPNYADTLINQESYEKSEPLLITQDLLETKGEPRQLQVSFFPPKREE

SEQ ID NO: 912071 - protein, 507 aa, Homo sapiens
MGPKTLPQLAGKWQVLCMLSLCCWGWVSGQLRYSVVEESEPGTLVGNVAQDLGLKMTDLLSRRLQLGSEENGRYFSLSLMSGALAVNQKIDRESLCGASTSCLLPVQVVTEHPLELIRVEVEILDLNDNSPSFATPEREMRISESAASGARFPLDSAQDPDVGTNTVSFYTLSPNSHFSLNVKTLKDGKPFPELVLEQQLDREAQARHQLVLTAVDGGTPARSGTTLISVIVLDINDNAPTFQSSVLRVGIPENAPIGTLLLRLNATDPDEGTNGQLDYSFGDHTSEAVRNLFGLDPSSGAIHVLGPIDFEESRFYEIHARARDQGQPAMEGHCVIQVDVGDVNDNAPEVLLASLANPVLESTPVGTVVGLFNVRDRDSGRNGEVSLDISPDLPFQIKPSENHYSLLTSQPLDREATSHYIIELLASDAGSPSLHKHLTIRLNISDVNDNAPHHNLQHLQQFIVKGTLGKDPSILWVDIHKGGGWGSLNLISYNGVGEAGIIPSVWI

SEQ ID NO: 912072 - protein, 849 aa, Homo sapiens
MFVNDRLDREELCGTLPSCTVTLELVVENPLELFSVEVVIQDINDNNPAFPTQEMKLEISEAVAPGTRFPLESAHDPDVGSNSLQTYELSRNEYFALRVQTREDSTKYAELVLERALDREREPSLQLVLTALDGGTPALSASLPIHIKVLDANDNAPVFNQSLYRARVLEDAPSGTRVVQVLATDLDEGPNGEIIYSFGSHNRAGVRQLFALDLVTGMLTIKGRLDFEDTKLHEIYIQAKDKGANPEGAHCKVLVEVVDVNDNAPEITVTSVYSPVPEDAPLGTVIALLSVTDLDAGENGLVTCEVPPGLPFSLTSSLKNYFTLKTSADLDRETVPEYNLSITARDAGTPSLSALTIVRVQVSDINDNPPQSSQSSYDVYIEENNLPGAPILNLSVWDPDAPQNARLSFFLLEQGAETGLVGRYFTINRDNGIVSSLVPLDYEDRREFELTAHISDGGTPVLATNISVNIFVTDRNDNAPQVLYPRPGGSSVEMLPRGTSAGHLVSRVVGWDADAGHNAWLSYSLLGSPNQSLFAIGLHTGQISTARPVQDTDSPRQTLTVLIKDNGEPSLSTTATLTVSVTEDSPEARAEFPSGSAPREQKKNLTFYLLLSLILVSVGFVVTVFGVIIFKVYKWKQSRDLYRAPVSSLYRTPGPSLHADAVRGGLMSPHLYHQVYLTTDSRRSDPLLKKPGAASPLASRQNTLRSCDPVFYRQVLGAESAPPGQQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 912073 - protein, 806 aa, Homo sapiens
MVPEAWRSGLEMKLEISEAVAPGTRFPLESAHDPDVGSNSLQTYELSRNEYFALRVQTREDSTKYAELVLERALDREREPSLQLVLTALDGGTPALSASLPIHIKVLDANDNAPVFNQSLYRARVLEDAPSGTRVVQVLATDLDEGPNGEIIYSFGSHNRAGVRQLFALDLVTGMLTIKGRLDFEDTKLHEIYIQAKDKGANPEGAHCKVLVEVVDVNDNAPEITVTSVYSPVPEDAPLGTVIALLSVTDLDAGENGLVTCEVPPGLPFSLTSSLKNYFTLKTSADLDRETVPEYNLSITARDAGTPSLSALTIVRVQVSDINDNPPQSSQSSYDVYIEENNLPGAPILNLSVWDPDAPQNARLSFFLLEQGAETGLVGRYFTINRDNGIVSSLVPLDYEDRREFELTAHISDGGTPVLATNISVNIFVTDRNDNAPQVLYPRPGGSSVEMLPRGTSAGHLVSRVVGWDADAGHNAWLSYSLLGSPNQSLFAIGLHTGQISTARPVQDTDSPRQTLTVLIKDNGEPSLSTTATLTVSVTEDSPEARAEFPSGSAPREQKKNLTFYLLLSLILVSVGFVVTVFGVIIFKVYKWKQSRDLYRAPVSSLYRTPGPSLHADAVRGGLMSPHLYHQVYLTTDSRRSDPLLKKPGAASPLASRQNTLRSCDPVFYRQVLGAESAPPGQQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 912074 - protein, 134 aa, Homo sapiens
MVPEAWRSGLQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 912075 - protein, 185 aa, Homo sapiens
MVPEAWRSGLVYLTTDSRRSDPLLKKPGAASPLASRQNTLRSCDPVFYRQVLGAESAPPGQQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 912076 - protein, 2575 aa, Homo sapiens
MGSGAGELGRAERLPVLFLFLLSLFCPALCEQIRYRIPEEMPKGSVVGNLATDLGFSVQELPTRKLRVSSEKPYFTVSAESGELLVSSRLDREEICGKKPACALEFEAVAENPLNFYHVNVEIEDINDHTPKFTQNSFELQISESAQPGTRFILGSAHDADIGSNTLQNYQLSPSDHFSLINKEKSDGSKYPEMVLKTPLDREKQKSYHLTLTALDFGAPPLSSTAQIHVLVTDANDNAPVFSQDVYRVSLSENVYPGTTVLQVTATDQDEGVNAEITFSFSEASQITQFDLNSNTGEITVLNTLDFEEVKEYSIVLEARDGGGMIAQCTVEVEVIDENDNAPEVIFQSLPNLIMEDAELGTHIALLKVRDKDSRHNGEVTCKLEGDVPFKILTSSRNTYKLVTDAVLDREQNPEYNITVTATDRGKPPLSSSSSITLHIGDVNDNAPVFSQSSYIVHVAENNPPGASISQVRASDPDLGPNGQVSYCIMASDLEQRELSSYVSISAESGVVFAQRAFDHEQLRAFELTLQARDQGSPALSANVSLRVLVDDRNDNAPRVLYPALGPDGSALFDMVPHAAEPGYLVTKVVAVDADSGHNAWLSYHVLQASEPGLFSLGLRTGEVRTARALGDRDAVRQRLLVAVRDGGQPPLSATATLHLVFADSLQEVLPDITDRPDPSDLQAELQFYLVVALALISVLFLVAMILAIALRLRRSSSPASWSCFQPGLCVKSESVVPPNYSEGTLPYSYNLCVAHTGKTEFNFLKCSEQLSSGQDILCGDSSGALFPLCNSSELTSHQVVSFKYNLMLIAYPFLHIHKKIYIFAGKYIIFRCHGSFLESCSQLKSCHIILQRRSKVGAIVWPNICLFFSQAEIYKAMRGGFNHKVKVLDSCWLSPEKVNEIFPIHFPSCCLIYDEYFFQLGYTINIKIIKPKNLSKNSTLFLTNLTGMVSIVVHCFVSCVNFPFVSKALRIRSQLDFYVHGPLVIICSVRCVCVCVCVCVREILLLRKRSTMLIEDQKQILLTCNIGVSGLICIQAHSISFIKEKTMFCVCCPSHTQPYYIMCNCLICSPKLIIARGLLIILLPLGKKYSLENCQSGVHTKYIQNTKEHYMSLLLGISKQLLQLMATLQIAERRKRLSILFVFLFFFFETESLSVTQAVVQWHNDSSLQPQTPGLKHSFCISLLTSWNSGSCHQTWLIFLFSVEKIFSFTNLTGMVSIVYPVFHMHKKIYSQENIKFSDFMSGFKKVLVSEKTIIPVFKGRVKKFICYVAQAGLEEETDFFVVILILWLLSKYYIVITFCSFLDQSVNVGKVNFRIYVKVKSALNLIISLVKGMGWSFAFYHIFICTFQVFKKKNINNVNKMQNNVISHKTAMVKAFILLKFHNFYLKILSTCNSSGIEKNNLKATTLEKACKMIKYFKPNKTISESVISSEVYFSLKINSFLVTTEVLSYLLVYIGDIYNKAESTMGNESIMFFLRPNVLQKCENLIRCYNLIILIYSDHLITLNKTFISHSLAVSFKIWVYWINQINSKQSNKQMIFFSQKSSRVLHLEVICISVQELFRTEAPLFTYWKTNATENTQISHLTKTRRCHKLTAGLQRNPTPVWRHSRFPEDCHLHSCGKKLNKTHLCTVKILRGFCSKTTMAAPQSRPRRGELILLCALLGTLWEIGRGQIRYSVPEETDKGSFVGNISKDLGLDPRKLAKHGVRIVSRGRTQLFALNPRSGSLITAGRIDREELCAQSPRCLININTLVEDKGKLFGVEIEIIDINDNNPKFQVEDLEVKINEIAVPGARYPLPEAVDPDVGVNSLQSYQLSPNHHFSLDVQTGDNGAINPELVLERALDREEEAAHHLVLTASDGGKPPRSSTVRIHVTVLDTNDNAPVFPHPIYRVKVLENMPPGTRLLTVTASDPDEGINGKVAYKFRKINEKQTPLFQLNENTGEISIAKSLDYEECSFYEMEIQAEDVGALLGRTKLLISVEDVNDNRPEVIITSLFSPVLENSLPGTVIAFLSVHDQDSGKNGQVVCYTRDNLPFKLEKSIGNYYRLVTRKYLDRENVSIYNITVMASDLGTPPLSTETQIALHVADINDNPPTFPHASYSAYILENNLRGASIFSLTAHDPDSQENAQVTYSVTEDTLQGAPLSSYISINSDTGVLYALQSFDYEQIRDLQLLVTASDSGDPPLSSNMSLSLFVLDQNDNAPEILYPALPTDGSTGVELAPRSAERGYLVTKVVAVDRDSGQNAWLSYRLLKASEPGLFSVGLHTGEVRTARALLDRDALKQSLVVAVQDHGQPPLSATVTLTVAVADSIPEVLTELGSLKPSVDPNDSSLTLYLVVAVAAISCVFLAFVAVLLGLRLRRWHKSRLLQDSGGRLVGVPASHFVGVEEVQAFLQTYSQEVSLTADSRKSHLIFPQPNYADMLISQEGCEKNDSLLTSVDFHEYKNEADHGQQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 912077 - protein, 2575 aa, Homo sapiens; identical to SEQ ID NO: 912076

SEQ ID NO: 912078 - protein, 2575 aa, Homo sapiens; identical to SEQ ID NO: 912076

SEQ ID NO: 912079 - protein, 2575 aa, Homo sapiens; identical to SEQ ID NO: 912076

SEQ ID NO: 912080 - protein, 871 aa, Homo sapiens
MLRKVRSWTEIWRWATLLFLFYHLGYVCGQIRYPVPEESQEGTFVGNVAQDFLLDTDSLSARRLQVAGEVNQRHFRVDLDSGALLIKNPIDREALCGLSASCIVPLEFVTEGPLEMYRAEVEIVDVNDHAPRFPRQQLDLEIGEAAPPGQRFPLEKAQDADVGSNSISSYRLSSNEHFALDVKKRSDGSLVPELLLEKPLDREKQSDYRLVLTAVDGGNPPRSGTAELRVSVLDVNDNAPAFQQSSYRISVLESAPAGMVLIQLNASDPDLGPSGNVTFYFSGHTPDRVRNLFSLHPTTGKLTLLGPLDFESENYYEFDVRARDGGSPAMEQHCSLRVDLLDVNDNAPYITVTSELGTLPESAEPGTVVALISVQDPDSGSNGDVSLRIPDHLPFALKSAFRNQFSLVTAGPLDREAKSSYDIMVTASDAGNPPLSTHRTIFLNISDVNDNPPSFFQRSHEVFVPENNRPGDLLCSLAASDPDSGLNALISYSLLEPRNRDVSASSFISLNPQTGAVHATRSFDYEQTQTLQFEVQARDRGNPPLSSTVTVRLFVLDLNDNAPAVLRPRARPGSLCPQALPPSVGAGHLITKVTAVDLDSGYNAWVSYQLLEAPDPSLFAVSRYAGEVRTAVPIPADLPPQKLVIVVKDSGSPPLSTSVTLLVSLEEDTHPVVPDLRESSAPREGESRLTLYLAVSLVAICFVSFGSFVALLSKCLRGAACGVTCFPAGTCACLTRSRRREGLPPSNGILRIQLGSDDPIKFVDVGGHSHGCTPLASAPTRSDSFMMVKSPSAPMAGEPVRPSCPPSDLLYGLEVRPLQAQQMLEGYSDPGIWLGHVLESTGLSVSAHSDVTIFVRGNYVVDAVLCNCFVN

SEQ ID NO: 912081 - protein, 685 aa, Homo sapiens
MVPEAWRSGLVSTGRVVGVLLLLGALNKASTVIHYEIPEEREKGFAVGNVVANLGLDLGSLSARRFRVVSGASRRFFEVNRETGEMFVNDRLDREELCGTLPSCTVTLELVVENPLELFSVEVVIQDINDNNPAFPTQEMKLEISEAVAPGTRFPLESAHDPDVGSNSLQTYELSRNEYFALRVQTREDSTKYAELVLERALDREREPSLQLVLTALDGGTPALSASLPIHIKVLDANDNAPVFNQSLYRARVLEDAPSGTRVVQVLATDLDEGPNGEIIYSFGSHNRAGVRQLFALDLVTGMLTIKGRLDFEDTKLHEIYIQAKDKGANPEGAHCKVLVEVVDVNDNAPEITVTSVYSPVPEDAPLGTVIALLSVTDLDAGENGLVTCEVPPGLPFSLTSSLKNYFTLKTSADLDRETVPEYNLSITARDAGTPSLSALTIVRVQVSDINDNPPQSSQSSYDVYIEENNLPGAPILNLSVWDPDAPQNARLSFFLLEQGAETGLVGRYFTINRDNGIVSSLVPLDYEDRREFELTAHISDGGTPVLATNISVNIFVTDRNDNAPQVLYPRPGGSSVEMLPRGTSAGHLVSRVVGWDADAGHNAWLSYSLLGSPNQSLFAIGLHTGQISTARPVQDTDSPRQTLTVLIKDNGEPSLSTTATLTVSVTEDSPEARAEFPSGSAPRS

SEQ ID NO: 912082 - protein, 237 aa, Homo sapiens
SSKSIRPIHPMPPSLSTTATLTVSVTEDSPEARAEFPSGSAPREQKKNLTFYLLLSLILVSVGFVVTVFGVIIFKVYKWKQSRDLYRAPVSSLYRTPGPSLHADAVRGGLMSPHLYHQVYLTTDSRRSDPLLKKPGAASPLASRQNTLRSCDPVFYRQVLGAESAPPGQQAPPNTDWRFSQAQRPGTSGSQNGDDTGTWPNNQFDTEMLQAMILASASAPSFGWCRIASSVVRCAFT

SEQ ID NO: 912083 - protein, 934 aa, Homo sapiens
MVPEAWRSGLVSTGRVVGVLLLLGALNKASTVIHYEIPEEREKGFAVGNVVANLGLDLGSLSARRFRVVSGASRRFFEVNRETGEMFVNDRLDREELCGTLPSCTVTLELVVENPLELFSVEVVIQDINDNNPAFPTQEMKLEISEAVAPGTRFPLESAHDPDVGSNSLQTYELSRNEYFALRVQTREDSTKYAELVLERALDREREPSLQLVLTALDGGTPALSASLPIHIKVLDANDNAPVFNQSLYRARVLEDAPSGTRVVQVLATDLDEGPNGEIIYSFGSHNRAGVRQLFALDLVTGMLTIKGRLDFEDTKLHEIYIQAKDKGANPEGAHCKVLVEVVDVNDNAPEITVTSVYSPVPEDAPLGTVIALLSVTDLDAGENGLVTCEVPPGLPFSLTSSLKNYFTLKTSADLDRETVPEYNLSITARDAGTPSLSALTIVRVQVSDINDNPPQSSQSSYDVYIEENNLPGAPILNLSVWDPDAPQNARLSFFLLEQGAETGLVGRYFTINRDNGIVSSLVPLDYEDRREFELTAHISDGGTPVLATNISVNIFVTDRNDNAPQVLYPRPGGSSVEMLPRGTSAGHLVSRVVGWDADAGHNAWLSYSLLGSPNQSLFAIGLHTGQISTARPVQDTDSPRQTLTVLIKDNGEPSLSTTATLTVSVTEDSPEARAEFPSGSAPREQKKNLTFYLLLSLILVSVGFVVTVFGVIIFKVYKWKQSRDLYRAPVSSLYRTPGPSLHADAVRGGLMSPHLYHQVYLTTDSRRSDPLLKKPGAASPLASRQNTLRSCDPVFYRQVLGAESAPPGQQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 912084 - protein, 931 aa, Homo sapiens
MKASSGRCGLVRWLQVLLPFLLSLFPGALPVQIRYSIPEELAKNSVVGNLAKDLGLSVRDLPARKLRVSAEKEYFTVNPESGDLLVSDRIDREQICGKQPLCVLDFDTVAENPLNIFYIAVIVQDINDNTPLFKQTKINLKIGESTKPGTTFPLDPALDSDVGPNSLQRYHLNDNEYFDLAEKQTPDGRKYPELILKHSLDREEHSLHQLVLTAVDGGDPPQSGTTQIRIKVTDANDNPPVFSQDVYRVTLREDVPPGFFVLQVTATDRDEGINAEITYSFHNVDEQVKHFFNLNEKTGEITTKDDLDFEIASSYTLSIEAKDPGDLAAHCSIQVEILDDNDCAPEVIVTSVSTPLPEDSPPGTVIALIKTRDRDSGENGEVYCQVLGNAKFILKSSSKNYYKLVTDGALDREEIPEYNLTITATDGGKPPLSSSIIVTLHISDVNDNAPVFQQTSYMVHVAENNPPGASIAQISASDPDLGPSGQVSYSIVASDLKPREILSYVSVSAQSGVVFAQRAFDHEQLRAFELTLQARDQGSPALSANVSLRVLVGDLNDNAPRVLYPALGPDGSALFDMVPRAAEPGYLVTKVVAVDADSGHNAWLSYHVLQASEPGLFSLGLRTGEVRTARALGDRDAARQRLLVAVRDGGQPPLSATATLHLIFADSLQEVLPDLSDRREPSDPQAKLQFYLVVALALISVLFFLAVILAISLRLRLSSRSDAWDCFQPGLSSKPGPGVLPNYSEGTLPYSYNLCVASQSAKTEFNFLNITPELVPAQDLVCDNASWEQNTNHGAAGVPFASDTILKQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 912085 - protein, 936 aa, Homo sapiens
MAAQRNRSKESKDCSGLVLLCLFFGIPWEAGARQISYSIPEELEKGSFVGNISKDLGLAPRELAERGVRIVSRGRTQLFSLNPRSGSLITAGRIDREELCAQSARCVVSFNILVEDRVKLFGIEIEVTDINDNAPKFQAENLDVKINENVAAGMRFPLPEAIDPDVGVNSLQSYQLSPNKHFSLRVQSRANGVKYPELVLEHSLDREEEAIHHLVLTASDGGDPLRSGTVLVSVTVFDANDNAPVFTLPEYRVSVPENLPVGTQLLTVTATDRDEGANGEVTYSFRKLPDTQLLKFQLNKYTGEIKISENLDYEETGFYEIEIQAEDGGAYLATAKVLITVEDVNDNSPELTITSLFSPVTEDSPLGTVVALLNVHDLDSEQNGQVTCSILAYLPFKLEKSIDSYYRLVIHRALDREQVSSYNITVTATDGGSPPLSTEAHFMLQVADINDNPPTFSQVSYFTYIPENNARGASIFSVTALDPDSKENAQIIYSLAEDTIQGVPLSSYISINSDTGVLYALRSFDYEQFHELQMQVTASDSGDPPLSSNVSLSLFVLDQNDNAPEILYPALPTDGSTGVELAPRSAEPGYLVTKVVAVDRDSGQNAWLSYRLLKASEPGLFAVGEHTGEVRTARALLDRDALKQSLVVAVQDHGQPPLSATVTLTVAVADSIPQVLADLGSFESPANSETSDLTLYLVVAVAAVSCVFLAFVIVLLAHRLRRWHKSRLLQASGGGLTGVSGSHFVGVDGVRAFLQTYSHEVSLTADSRKSHLIFPQPNYADTLISQESCEKNDPLSLLDDSKFPIEDTPLVPQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 912086 - protein, 938 aa, Homo sapiens
MLRKVRSWTEIWRWATLLFLFYHLGYVCGQIRYPVPEESQEGTFVGNVAQDFLLDTDSLSARRLQVAGEVNQRHFRVDLDSGALLIKNPIDREALCGLSASCIVPLEFVTEGPLEMYRAEVEIVDVNDHAPRFPRQQLDLEIGEAAPPGQRFPLEKAQDADVGSNSISSYRLSSNEHFALDVKKRSDGSLVPELLLEKPLDREKQSDYRLVLTAVDGGNPPRSGTAELRVSVLDVNDNAPAFQQSSYRISVLESAPAGMVLIQLNASDPDLGPSGNVTFYFSGHTPDRVRNLFSLHPTTGKLTLLGPLDFESENYYEFDVRARDGGSPAMEQHCSLRVDLLDVNDNAPYITVTSELGTLPESAEPGTVVALISVQDPDSGSNGDVSLRIPDHLPFALKSAFRNQFSLVTAGPLDREAKSSYDIMVTASDAGNPPLSTHRTIFLNISDVNDNPPSFFQRSHEVFVPENNRPGDLLCSLAASDPDSGLNALISYSLLEPRNRDVSASSFISLNPQTGAVHATRSFDYEQTQTLQFEVQARDRGNPPLSSTVTVRLFVLDLNDNAPAVLRPRARPGSLCPQALPPSVGAGHLITKVTAVDLDSGYNAWVSYQLLEAPDPSLFAVSRYAGEVRTAVPIPADLPPQKLVIVVKDSGSPPLSTSVTLLVSLEEDTHPVVPDLRESSAPREGESRLTLYLAVSLVAICFVSFGSFVALLSKCLRGAACGVTCFPAGTCACLTRSRRREGLPPSNGILRIQLGSDDPIKFVDVGGHSHGCTPLASAPTRSDSFMMVKSPSAPMAGEPVRPSCPPSDLLYGLEQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 912087 - protein, 935 aa, Homo sapiens
MANRLQRGDRSRLLLLLCIFLGTLRGFRARQIRYSVPEETEKGSFVGNISKDLGLEPRELAKRGVRIVSRGKTQLFAVNPRSGSLITAGRIDREELCETVSSCFLNMELLVEDTLKIYGVEVEIIDINDNAPSFQEDEVEIKVSEHAIPGARFALPNARDPDVGVNSLQSYQLSPNNYFSLQLRGRTDGAKNPELVLEGSLDREKEAAHLLLLTALDGGDPIRKGAVPIRVVVLDVNDHIPMFTQSVYRVSVPENISSGTRVLMVNATDPDEGINGEVMYSFRNMESKASEIFQLDSQTGEVQVRGSLDFEKYRFYEMEIQGQDGGGLFTTTTMLITVVDVNDNAPEITITSSINSILENSPPGTVIALLNVQDQDSGENGQVSCFIPNHLPFKLEKTYGNYYKLITSRVLDRELVQSYNITLTATDQGSPPLSAETHVWLNVADDNDNPPVFPHSSYSAYIPENNPRGASIFSVTALDPDSKQNALVTYSLTDDTVQGVPLSSYVSINSNTGVLYALQSFDYEQFRDLELRVIARDSGDPPLSSNVSLSLFVLDQNDNAPEILYPALPTDGSTGVELAPRSAEPGYLVTKVVAVDKDSGQNAWLSYRLLKASEPGLFAVGEHTGEVRTARALLDRDALKQSLVVAVQDHGQPPLSATVTLTVAVADSIPEVLADLGSLESLANSETSDLSLYLVVAVAAVSCIFLVFVIVLLALRLWRWHKSRLLQASEGGLAGMPTSHFVGVDGVQAFLQTYSHEVSLIADSQKSHLIFPQPNYGDTLISQESCEKSEPLLIAEDSAIILGKCDPTSNQQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 912088 - protein, 932 aa, Homo sapiens
MAAPTKCQLRGRLVLLCSLLGMLWEARASQIRYSVPEETEKGYIVGNISKDLALEPRELAERRVRIVSRGRTQLFSLNPRSGTLVTAGRIDREELCAQSPRCLVNFKVLVEDRVKLYGIEIEVTDINDSAPKFQAESLEVKINEIAVPGARYPLPEAIDPDVGVNSLQSYQLSPNHHFSLNVQTGDNGAINPELVLERALDREEATAHHLVLTASDGGEPRRSSTVRIHVTVLDTNDNAPVFAQRIYRVKVLENVPPGTWLLTATASDLDEGINGKVAYKFWKINEKQSLLFQLNENTGEISTAKSLDYEECSFYEMEIQAEDGGGLKGWTKVLISVEDVNDNRPEVTITSLFSPVREDAPQGTVILLFNAHDRDSGKNGQVVCSIQENLSFTLENSEEDYYRLLTAQILDREKASEYNITVTATDRGTPPLSTEIHITLQVTDINDNPPAFSQASYSVYLPENNARGTSIFSVIAYDPDSNENSRVIYSLAEDTIQGSPLSTYVSINSDTGVLYALCSFDYEQFRDLQMQVTASDSGSPPLSSNVSLRLFVLDQNDNAPEILYPALPTDGSTGVELAPRSAEPGYLVTKVVAVDRDSGQNAWLSYRLFKASEPGLFSVGLHTGEVRTARALLDRDALKQSLVVAVQDHGQPPLSATVTLTVAIADSIPDILADLGSLQIPADLEASDLTLYLVVAVAVVSCVFLTFVITLLALRLRHWHSSHLLRATSDGLAGVPTSHFVGVDGVRAFLQTYSQEFSLTADSRKSHLIFPQPNYADTLISQQSCEKNEPLCVSVDSKFPIEDTPLVPQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 912089 - protein, 927 aa, Homo sapiens
MQRAREAEMMKSQVLFPFLLSLFCGAISQQIRYTIPEELANGSRVGKLAKDLGLSVRELPTRKLRVSAEDYFNVSLESGDLLVNGRIDREKICGRKLECALEFETVAENPMNVFHVVVVIQDINDNAPRFVAKGIDLEICESALPGVKFSLDSAQDADVEGNSLKLYTINPNQYFSLSTKESPDGSKYPVLLLEKPLDREHQSSHRLILTAMDGGDPPLSGTTHIWIRVTDANDNAPVFSQEVYRVSLQENVPWGTSVLRVMATDQDEGINAEITYAFLNSPISTSLFNLNPNTGDITTNGTLDFEETSRYVLSVEAKDGGVHTAHCNVQIEIVDENDNAPEVTFMSFSNQIPEDSDLGTVIALIKVRDKDSGQNGMVTCYTQEEVPFKLESTSKNYYKLVIAGALNREQTADYNVTIIATDKGKPALSSRTSITLHISDINDNAPVFHQASYVVHVSENNPPGASIAQVSASDPDLGPNGRVSYSILASDLEPRELLSYVSVSPQSGVVFAQRAFDHEQLRAFELTLQARDQGSPALSANVSLRVLVGDLNDNAPRVLYPALGPDGSALFDMVPRAAEPGYLVTKVVAVDADSGHNAWLSYHVLQASEPGLFSLGLRTGEVRTARALGDRDAARQRLLVAVRDGGQPPLSATATLHLIFADSLQEVLPDLSDRPEPSDPQTELQFYLVVALALISVLFLLAVILAIALRLRRSSSLDTEGCFQTGLCSKSGPGVPPNHSEGTLPYSYNLCIASHSAKTEFNSLNLTPEMAPPQDLLCDDPSMVVCASNEDHKIAYDPSLSSHQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 912090 - protein, 944 aa, Homo sapiens
MGPKTLPQLAGKWQVLCMLSLCCWGWVSGQLRYSVVEESEPGTLVGNVAQDLGLKMTDLLSRRLQLGSEENGRYFSLSLMSGALAVNQKIDRESLCGASTSCLLPVQVVTEHPLELIRVEVEILDLNDNSPSFATPEREMRISESAASGARFPLDSAQDPDVGTNTVSFYTLSPNSHFSLNVKTLKDGKPFPELVLEQQLDREAQARHQLVLTAVDGGTPARSGTTLISVIVLDINDNAPTFQSSVLRVGIPENAPIGTLLLRLNATDPDEGTNGQLDYSFGDHTSEAVRNLFGLDPSSGAIHVLGPIDFEESRFYEIHARARDQGQPAMEGHCVIQVDVGDVNDNAPEVLLASLANPVLESTPVGTVVGLFNVRDRDSGRNGEVSLDISPDLPFQIKPSENHYSLLTSQPLDREATSHYIIELLASDAGSPSLHKHLTIRLNISDVNDNAPRFNQQLYTAYILENRPPGSLLCTVAASDPDTGDNARLTYSIVGNQVQGAPASSFVYVNPEDGRIFAQRTFDYELLQMLQIVVGVRDSGSPPLHANTSLHVFVLDENDNAPAVLHPRPDWEHSAPQRLPRSAPPGSLVTKVTAVDADAGHNAWLSYSLLPQSTAPGLFLVSTHTGEVRTARALLEDDSDTQQVVVLVRDNGDPSLSSTATVLLVLEDEDPEEMPKSSDFLIHPPERSDLTLYLIVALATVSLLSLVTFTFLSAKCLQGNADGDGGGGQCCRRQDSPSPDFYKQSSPNLQVSSDGTLKYMEVTLRPTDSQSHCYRTCFSPASDGSDFTFLRPLSVQQPTALALEPDAIRSRSNTLRERSQQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 912091 - protein, 932 aa, Homo sapiens
MAPPQRHPQRSEQVLLLTLLGTLWGAAAAQIRYSIPEELEKGSFVGNIVKDLGLEPQELAEHGVRIVSRGRMQLFSLNPRNGSLVTAGRIDREELCAQSPRCLVSFNILVEDKLNLYPVEVEIVDINDNTPRFLKEELEVKILENAAPSSRFPLMEVYDPDVGMNSLQGFKLSGNSHFSVDVQSEAHGPKYPELVLEGTLDREGEAVYRLVLTAMDGGDPVRSSVAQILVTVLDVNDNTPMFTQPVYRVSVPENLPVGTPVLAVTATDQDEGVHGEVTYSFVKITEKISQIFCLNVLTGEISTSANLDYEDSSFYELGVEARDGPGLRDRAKVLITILDVNDNVPEVVVTSGSRTIAESAPPGTVIALFQVFDRDSGLNGLVTCSIPRSLPFELEKSVGNYYRLVTNAALDREEVFLYNITVTATDKGTPPLSTETIISLNVADTNDNPPTFPHSSYSVYVLENNPRGASIFSVNALDPDVDQNAQVSYSLAEDTLQGAPLSSYVSINSDTGILYALRSFDYEQLRDLQLWVTASDSGDPPLSSNVSLSLFVLDQNDNAPEILYPALPTDGSTGVELAPRSAEPGYLVTKVVAVDRDSGQNAWLSYRLLKASEPGLFSVGLHTGEVRTARALLDRDALKQSLVVAVQDHGQPPLSATVTLTVAVADRIPDILADLGSLEPSAKPNDSDLTLYLVVAVAAVSCVFLAFVIVLLALRLQRWHKSRLLQASGGGLASMPGSHFVGVEGVRAFLQTYSHEVSLTADSRKSHLIFPQPNYADTLINQESYEKSEPLLITQDLLETKGEPRQLQQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 912092 - protein, 134 aa, Homo sapiens; identical to SEQ ID NO: 912074

SEQ ID NO: 912093 - protein, 2541 aa, Homo sapiens
MGSGAGELGRAERLPVLFLFLLSLFCPALCEQIRYRIPEEMPKGSVVGNLATDLGFSVQELPTRKLRVSSEKPYFTVSAESGELLVSSRLDREEICGKKPACALEFEAVAENPLNFYHVNVEIEDINDHTPKFTQNSFELQISESAQPGTRFILGSAHDADIGSNTLQNYQLSPSDHFSLINKEKSDGSKYPEMVLKTPLDREKQKSYHLTLTALDFGAPPLSSTAQIHVLVTDANDNAPVFSQDVYRVSLSENVYPGTTVLQVTATDQDEGVNAEITFSFSEASQITQFDLNSNTGEITVLNTLDFEEVKEYSIVLEARDGGGMIAQCTVEVEVIDENDNAPEVIFQSLPNLIMEDAELGTHIALLKVRDKDSRHNGEVTCKLEGDVPFKILTSSRNTYKLVTDAVLDREQNPEYNITVTATDRGKPPLSSSSSITLHIGDVNDNAPVFSQSSYIVHVAENNPPGASISQVRASDPDLGPNGQVSYCIMASDLEQRELSSYVSISAESGVVFAQRAFDHEQLRAFELTLQARDQGSPALSANVSLRVLVDDRNDNAPRVLYPALGPDGSALFDMVPHAAEPGYLVTKVVAVDADSGHNAWLSYHVLQASEPGLFSLGLRTGEVRTARALGDRDAVRQRLLVAVRDGGQPPLSATATLHLVFADSLQEVLPDITDRPDPSDLQAELQFYLVVALALISVLFLVAMILAIALRLRRSSSPASWSCFQPGLCVKSESVVPPNYSEGTLPYSYNLCVAHTGKTEFNFLKCSEQLSSGQDILCGDSSGALFPLCNSSELTSHQVVSFKYNLMLIAYPFLHIHKKIYIFAGKYIIFRCHGSFLESCSQLKSCHIILQRRSKVGAIVWPNICLFFSQAEIYKAMRGGFNHKVKVLDSCWLSPEKVNEIFPIHFPSCCLIYDEYFFQLGYTINIKIIKPKNLSKNSTLFLTNLTGMVSIVVHCFVSCVNFPFVSKALRIRSQLDFYVHGPLVIICSVRCVCVCVCVCVREILLLRKRSTMLIEDQKQILLTCNIGVSGLICIQAHSISFIKEKTMFCVCCPSHTQPYYIMCNCLICSPKLIIARGLLIILLPLGKKYSLENCQSGVHTKYIQNTKEHYMSLLLGISKQLLQLMATLQIAERRKRLSILFVFLFFFFETESLSVTQAVVQWHNDSSLQPQTPGLKHSFCISLLTSWNSGSCHQTWLIFLFSVEKIFSFTNLTGMVSIVYPVFHMHKKIYSQENIKFSDFMSGFKKVLVSEKTIIPVFKGRVKKFICYVAQAGLEEETDFFVVILILWLLSKYYIVITFCSFLDQSVNVGKVNFRIYVKVKSALNLIISLVKGMGWSFAFYHIFICTFQVFKKKNINNVNKMQNNVISHKTAMVKAFILLKFHNFYLKILSTCNSSGIEKNNLKATTLEKACKMIKYFKPNKTISESVISSEVYFSLKINSFLVTTEVLSYLLVYIGDIYNKAESTMGNESIMFFLRPNVLQKCENLIRCYNLIILIYSDHLITLNKTFISHSLAVSFKIWVYWINQINSKQSNKQMIFFSQKSSRVLHLEVICISVQELFRTEAPLFTYWKTNATENTQISHLTKTRRCHKLTAGLQRNPTPVWRHSRFPEDCHLHSCGKKLNKTHLCTVKILRGFCSKTTMAAPQSRPRRGELILLCALLGTLWEIGRGQIRYSVPEETDKGSFVGNISKDLGLDPRKLAKHGVRIVSRGRTQLFALNPRSGSLITAGRIDREELCAQSPRCLININTLVEDKGKLFGVEIEIIDINDNNPKFQVEDLEVKINEIAVPGARYPLPEAVDPDVGVNSLQSYQLSPNHHFSLDVQTGDNGAINPELVLERALDREEEAAHHLVLTASDGGKPPRSSTVRIHVTVLDTNDNAPVFPHPIYRVKVLENMPPGTRLLTVTASDPDEGINGKVAYKFRKINEKQTPLFQLNENTGEISIAKSLDYEECSFYEMEIQAEDVGALLGRTKLLISVEDVNDNRPEVIITSLFSPVLENSLPGTVIAFLSVHDQDSGKNGQVVCYTRDNLPFKLEKSIGNYYRLVTRKYLDRENVSIYNITVMASDLGTPPLSTETQIALHVADINDNPPTFPHASYSAYILENNLRGASIFSLTAHDPDSQENAQVTYSVTEDTLQGAPLSSYISINSDTGVLYALQSFDYEQIRDLQLLVTASDSGDPPLSSNMSLSLFVLDQNDNAPEILYPALPTDGSTGVELAPRSAERGYLVTKVVAVDRDSGQNAWLSYRLLKASEPGLFSVGLHTGEVRTARALLDRDALKQSLVVAVQDHGQPPLSATVTLTVAVADSIPEVLTELGSLKPSVDPNDSSLTLYLVVAVAAISCVFLAFVAVLLGLRLRRWHKSRLLQDSGGRLVGVPASHFVGVEEVQAFLQTYSQEVSLTADSRKSHLIFPQPNYADMLISQEGCEKNDSLLTSVDFHEYKNEADHGQVSLVLCLLLISRRILFGINYVLKNIVKIVENNFLRCITEFWVYFGGVTIKLNSNSHRLLFHLLLNDLEKIVQPFEAFQYFIPIITHSLKK

SEQ ID NO: 912094 - protein, 900 aa, Homo sapiens
MIPARLHRDYKGLVLLGILLGTLWETGCTQIRYSVPEELEKGSRVGDISRDLGLEPRELAERGVRIIPRGRTQLFALNPRSGSLVTAGRIDREELCMGAIKCQLNLDILMEDKVKIYGVEVEVRDINDNAPYFRESELEIKISENAATEMRFPLPHAWDPDIGKNSLQSYELSPNTHFSLIVQNGADGSKYPELVLKRALDREEKAAHHLVLTASDGGDPVRTGTARIRVMVLDANDNAPAFAQPEYRASVPENLALGTQLLVVNATDPDEGVNAEVRYSFRYVDDKAAQVFKLDCNSGTISTIGELDHEESGFYQMEVQAMDNAGYSARAKVLITVLDVNDNAPEVVLTSLASSVPENSPRGTLIALLNVNDQDSEENGQVICFIQGNLPFKLEKSYGNYYSLVTDIVLDREQVPSYNITVTATDRGTPPLSTETHISLNVADTNDNPPVFPQASYSAYIPENNPRGVSLVSVTAHDPDCEENAQITYSLAENTIQGASLSSYVSINSDTGVLYALSSFDYEQFRDLQVKVMARDNGHPPLSSNVSLSLFVLDQNDNAPEILYPALPTDGSTGVELAPRSAEPGYLVTKVVAVDRDSGQNAWLSYRLLKASEPGLFSVGLHTGEVRTARALLDRDALKQSLVVAVQDHGQPPLSATVTLTVAVADSIPQVLADLGSLESPANSETSDLTLYLVVAVAAVSCVFLAFVILLLALRLRRWHKSRLLQASGGGLTGAPASHFVGVDGVQAFLQTYSHEVSLTTDSRKSHLIFPQPNYADMLVSQESFEKSEPLLLSGDSVFSKDSHGLIEVSLYQIFFLFFFNCSVSQAGMQRYDHSSLQPQTPRLKQLSHLCLRCNRDYRCKPPTVCLSIYLSIYLSIYLSIYYFLACNPSTLGGRGGWIT

SEQ ID NO: 912095 - protein, 823 aa, Homo sapiens
MAALQKLPHCRKLVLLCFLLATLWEARAGQIRYSVREEIDRGSFVGNIAKDLGLEPLALAEQGVRIVSRGRSQLFALNPRSGSLVTANRIDREELCAQSAPCLLNFNILLEDKLTIYSVEVEITDINDNAPRFGVEELELKISETTTPGFRIPLKNAHDADVGENALQKYALNPNDHFSLDVRRGADGNKYPELVLERSLDREEEAVHHLVLVASDGGDPVLSGTSRICVKVLDANDNAPVFTQPEYRISIPENTLVGTRILTVTATDADEGYYAQVVYFLEKSPGETSEVFELKSTSGELTIIKDLDYEDATFHEIDIEAQDGPGLLTRAKVIVTVLDVNDNAPEFYMTSATSSVSEDSLPGTIIGLFNVHDRDSGQNAFTTCSLPEDLPFKLEKSVDNYYRLVTTRALDREQFSFYNITLTAKDGGNPSLSTDAHILLQVADINDNAPAFSRTSYSTYIPENNPRGASVFSVTAHDPDSNDNAHVTYSFAEDTVQGAPLSSYISINSDTGVLYALRSFDYEQLRDLQVWVIARDSGNPPLSSNVSLSLFVLDQNDNAPEILYPAFPTDGSTGVELAPRSAEPGYLVTKVVAVDRDSGQNAWLSYHLLKASEPGLFSVGLHTGEVRTARALLDRDALKQSLVVAIQDHGQPPLSATVTLTVAVADRIPDILADLGSLEPSAIPNDSDLTLYLVVAVAAVSCVFLAFVIVLLAHRLRRWHKSRLLQASGGSLTGMQSSHFVGVDGVRAFLQTYSHEVSLTADSRKSHLIFPQPNYADTLISQESCEKKDFLSAPQSLLEEEREETFSQVIYLFTTYVLASLLK

SEQ ID NO: 912096 - protein, 817 aa, Homo sapiens
MAAQPRGGDYRGFFLLSILLGTPWEAWAGRILYSVSEETDKGSFVGDIAKDLGLEPRELAERGVRIISRGRTQLFALNQRSGSLVTAGRIDREEICAQSARCLVNFNILMEDKMNLYPIDVEIIDINDNVPRFLTEEINVKIMENTAPGVRFPLSEAGDPDVGTNSLQSYQLSPNRHFSLAVQSGDDETKYPELVLERVLDREEERVHHLVLTASDGGDPPRSSTAHIQVTVVDVNDHTPVFSLPQYQVTVPENVPVGTRLLTVHAIDLDEGVNGEVTYSFRKITPKLPKMFHLNSLTGEISTLEGLDYEETAFYEMEVQAQDGPGSLTKAKVLITVLDVNDNAPEVTMTSLSSSIPEDTPLGTVIALFYLQDRDSGKNGEVTCTIPENLPFKLEKSIDNYYRLVTTKNLDRETLSLYNITLKATDGGTPPLSRETHIFMQVADTNDNPPTFPHSSYSVYIAENNPRGASIFLVTAQDHDSEDNAQITYSLAEDTIQGAPVSSYVSINSDTGVLYALQSFDYEQLRELQLRVTAHDSGDPPLSSNMSLSLFVLDQNDNPPEILYPALPTDGSTGMELAPRSAEPGYLVTKVVAVDKDSGQNAWLSYLLLKASEPGLFAVGLYTGEVRTARALLDRDALKQSLVVAVQDHGQPPLSATVTLTVAVADSIPEVLADLGSLEPSDGPYNYDLTLYLVVAVATVSCVFLAFVLVLLALRLRRWHKSRLLQASEGGLANVPTSHFVGMDGVQAFLQTYSHEVSLTADSRKSHLIFPQPNYVDMLISQESCEKNDSLLTSVDFQECKENLPSIQVSPALPLFP

SEQ ID NO: 912097 - protein, 820 aa, Homo sapiens
MGGSCAQRRRAGPRQVLFPLLLPLFYPTLSEPIRYSIPEELAKGSVVGNLAKDLGLSVLDVSARKLRVSAEKLHFSVDAESGDLLVKNRIDREQICKERRRCELQLEAVVENPLNIFHVIVVIEDVNDHAPQFDKKEIHLEIFESASAGTRLSLDPATDPDININSIKDYKINSNPYFSLMVRVNSDGGKYPELSLEKLLDREEQRSHSLILTALDGGDPPRSATAHIEISVKDTNDNPPVFSRDEYRISLSENLPPGSPVLQVTATDQDEGVNAEINYYFRSTAQSTKHMFSLDEKTGMIKNNQSFDFEDVERYTMEVEAKDGGGLSTQCKVIIEILDENDNSPEIIITSLSDQILENSPPGMVVALFKTRDLDFGGNGEVRCNIETDIPFKIYSSSNNYYKLVTDGALDREQTPEYNVTIVATDRGKPPLSSSRSITLYVADINDNAPVFDQTSYVVHVAENNPPGASIAQVSASDPDLGLNGHISYSIVASDLEPLAVSSYVSVSAQSGVVFAQRAFDHEQLRAFALTLQARDHGSPTLSANVSLRVLVGDRNDNAPRVLYPALGPDGSAFFDMVPRSAEPGYLVTKVVAVDADSGHNAWLSYHVLQASEPGLFSLGLRTGEVRTARALGDRDAARQRLLVAVRDGGQPPLSATATLHLVFADNLQEILPDLSDRPVLSDPQAELQFYLVVALALISVLFLLAVILAIALRLRRSLSPATWDCFHPGLCVKSGPVVPPNYSEGTLPYSYNLCIAHTGTKEFNFLKCSVPLHSNEDMVCSVSPGALIPPHGGEDLTSHPETLTSVSFSFLCVIYLIVY

SEQ ID NO: 912098 - protein, 829 aa, Homo sapiens
MTNCLSFRNGRGLALLCALLGTLCETGSGQIRYSVSEELDKGSFVGNIANDLGLEPRELAERGVRIVSRGRTQLFSLNPQSGSLVTAERIDREELCAQIPLCLVKINILVEDKLKIFEVEIEIKDINDNAPNFPTEELEIKIGELTVPGTRFPIKTAFDPDVGINSLQNYKLSPNDYFSLAVNSVSEGAKYPELVLERALDREKKEIHQLVLVASDGGDPVHSGNLHIQVIVLDANDNPPMFTQPEYRVSVWENVPVGTRLLTVNATDPDEGFNAQVSYILDKMPGKIAEIFHLNSVSGEVSILKSLDYEDAMFYEIKIEAQDGPGLLSRAKILVTVLDVNDNAPEITITSLTSSVPEEGTVGREIALIDVHDRDSGQNGQVEVFVLGNLPFKLEKSIDQYYRLVTATSLDREQISEYNISLRASDGGSPPLSTETHITLHVIDINDNPPTFPHLSYSAYIPENNPRGASIFSVTAQDPDSNNNARITYALTEDTLQGAPLSSFVSINSNTGVLYALRSFDYEQFRDLKLLVTASDSGNPPLSSNVSLNLFVLDQNDNAPEILYPALPTDGSTGVELAPRSAEPGYLVTKVVAVDRDSGQNAWLSYRLLKASEPGLFSVGLHTGEVRTARALLDRDALKQSLVVAVQDHGQPPLSATVTLTVAVADRIPDILADLGSLEPSAKPNDSDLTLYLVVAVAAVSCVFLAFVIVLLALRLRRWHKSRLLQASGGGLASTPGSHFVGADGVRAFLQTYSHEVSLTADSRKSHLIFPQPNYADTLISQESCEKSEPLLITQDLLEMKGDSNLLQVSLFISLIIKNKYENVVIIKL

SEQ ID NO: 912099 - protein, 818 aa, Homo sapiens
MGSGAGELGRAERLPVLFLFLLSLFCPALCEQIRYRIPEEMPKGSVVGNLATDLGFSVQELPTRKLRVSSEKPYFTVSAESGELLVSSRLDREEICGKKPACALEFEAVAENPLNFYHVNVEIEDINDHTPKFTQNSFELQISESAQPGTRFILEVAEDADIGLNSLQKYKLSLNPSFSLIIKEKQDGSKYPELALEKTLDREQQSYHRLVLTALDGGHPPLSGTTELRIQVTDANDNPPVFNRDVYRVSLRENVPPGTTVLQVSATDQDEGINSEITYSFYRTGQIFSLNSKSGEITTQKKLDFEETKEYSMVVEGRDGGGLVAQCTVEINIQDENDNSPEVTFHSLLEMILENAVPGTLIALIKIHDQDSGENGEVNCQLQGEVPFKIISSSKNSYKLVTDGTLDREQTPEYNVTITATDRGKPPLSSSISVILHIRDVNDNAPVFHQASYLVSVPENNPPGASIAQVCASDLDLGLNGQVSYSIMASDLEPLALASYVSMSAQSGVVFAQRAFDYEQLRTFELTLQARDQGSPALSANVSLRVLVGDRNDNAPRVLYPALGPDGSALFDMVPRAAEPGYLVTKVVAVDADSGHNAWLSYHVLQASEPGLFSLGLRTGEVRTARALGDRDAARQRLLVAVRDGGQPPLSATATLHLVFADSLQEVLPDITDRPVPSDPQAELQFYLVVALALISVLFLLAVILAVALRLRRSSSPAAWSCFQPGLCVKSGPVVPPNYSQGTLPYSYNLCVAHTGKTEFNFLKCSEQLSSGQDILCGDSSGALFPLCNSSESTSHPELVSFIYVYSFSLPTQFSVFT

SEQ ID NO: 912100 - protein, 814 aa, Homo sapiens
MGNSSGWRGPAGQRRMLFLFLLSLLDQVLSEPIRYAIPEELDRGSLVGNLAKDLGFGVGDLPTRNLRVIAEKKFFTVSPENGNLLVSDRIDREEICGKKSTCVLEFEMVAEKPLNFFHVTVLIQDINDNPPTFSQNITELEISELALTGATFALESAQDPDVGVNSLQQYYLSPDPHFSLIQKENLDGSRYPELVLKAPLDREEQPHHHLVLTAVDGGEPSRSCTTQIRVIVADANDNPPVFTQDMYRVNVAENLPAGSSVLKVMAIDMDEGINAEIIYAFINIGKEVRQLFKLDSKTGELTTIGELDFEERDSYTIGVEAKDGGHHTAYCKVQIDISDENDNAPEITLASESQHIQEDAELGTAVALIKTHDLDSGFNGEILCQLKGNFPFKIVQDTKNTYRLVTDGALDREQIPEYNVTITATDKGNPPLSSSKTITLHILDVNDNVPVFHQASYTVHVAENNPPGASIAHVRASDPDLGPNGLVSYYIVASDLEPRELSSYVSVSARSGVVFAQRAFDHEQLRAFELTLQARDQGSPTLSANVSLRVLVDDRNDNAPLVLYPALGPEGSALFDMVPRSAEPGYLVTKVVAVDADSGYNAWLSYHIVQASEPGLFSLGLRTGEVRTARTLGDREAARQRLLVTVRDGGQQPLSATVMLHLIFADSLQEIQPDLSDRPTPSDPQAELQFHLVVALALISVLFLLAVILAISLRLRCSSRPATEGYFQPGVCFKTVPGVLPTYSERTLPYSYNPCAASHSSNTEFKFLNIKAENAAPQDLLCDEASWFESNDNPEMPSNSGNLQKVSFFKPFLP

SEQ ID NO: 912101 - protein, 2575 aa, Homo sapiens; identical to SEQ ID NO: 912076

SEQ ID NO: 912102 - protein, 817 aa, Homo sapiens
MTNCLSFRNGRGLALLCALLGTLCETGSGQIRYSVSEELDKGSFVGNIANDLGLEPRELAERGVRIVSRGRTQLFSLNPQSGSLVTAERIDREELCAQIPLVSEELEIKIGELTVPGTRFPIKTAFDPDVGINSLQNYKLSPNDYFSLAVNSVSEGAKYPELVLERALDREKKEIHQLVLVASDGGDPVHSGNLHIQVIVLDANDNPPMFTQPEYRVSVWENVPVGTRLLTVNATDPDEGFNAQVSYILDKMPGKIAEIFHLNSVSGEVSILKSLDYEDAMFYEIKIEAQDGPGLLSRAKILVTVLDVNDNAPEITITSLTSSVPEEGTVGREIALIDVHDRDSGQNGQVEVFVLGNLPFKLEKSIDQYYRLVTATSLDREQISEYNISLRASDGGSPPLSTETHITLHVIDINDNPPTFPHLSYSAYIPENNPRGASIFSVTAQDPDSNNNARITYALTEDTLQGAPLSSFVSINSNTGVLYALRSFDYEQFRDLKLLVTASDSGNPPLSSNVSLNLFVLDQNDNAPEILYPALPTDGSTGVELAPRSAEPGYLVTKVVAVDRDSGQNAWLSYRLLKASEPGLFSVGLHTGEVRTARALLDRDALKQSLVVAVQDHGQPPLSATVTLTVAVADRIPDILADLGSLEPSAKPNDSDLTLYLVVAVAAVSCVFLAFVIVLLALRLRRWHKSRLLQASGGGLASTPGSHFVGADGVRAFLQTYSHEVSLTADSRKSHLIFPQPNYADTLISQESCEKSEPLLITQDLLEMKGDSNLLKPRPTRTGVSLRPRDPAPAAPKMAMTPAPGPTTSLTQRCCKP

SEQ ID NO: 912103 - protein, 294 aa, Homo sapiens
MVPEAWRSGLVSTGRVVGVLLLLGALNKASTVIHYEFPSGSAPREQKKNLTFYLLLSLILVSVGFVVTVFGVIIFKVYKWKQSRDLYRAPVSSLYRTPGPSLHADAVRGGLMSPHLYHQVYLTTDSRRSDPLLKKPGAASPLASRQNTLRSCDPVFYRQVLGAESAPPGQQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 912104 - protein, 128 aa, Homo sapiens
MLRKQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 912105 - protein, 2575 aa, Homo sapiens; identical to SEQ ID NO: 912076

SEQ ID NO: 912106 - protein, 863 aa, Homo sapiens
MVPEAWRSGLVSTGRVVGVLLLLGALNKASTVIHYEIPEEREKGFAVGNVVANLGLDLGSLSARRFRVVSGASRRFFEVNRETGEMFVNDRLDREELCGTLPSCTVTLELVVENPLELFSVEVVIQDINDNNPAFPTQEMKLEISEAVAPGTRFPLESAHDPDVGSNSLQTYELSRNEYFALRVQTREDSTKYAELVLERALDREREPSLQLVLTALDGGTPALSASLPIHIKVLDANDNAPVFNQSLYRARVLEDAPSGTRVVQVLATDLDEGPNGEIIYSFGSHNRAGVRQLFALDLVTGMLTIKGRLDFEDTKLHEIYIQAKDKGANPEGAHCKVLVEVVDVNDNAPEITVTSVYSPVPEDAPLGTVIALLSVTDLDAGENGLVTCEVPPGLPFSLTSSLKNYFTLKTSADLDRETVPEYNLSITARDAGTPSLSALTIVRVQVSDINDNPPQSSQSSYDVYIEENNLPGAPILNLSVWDPDAPQNARLSFFLLEQGAETGLVGRYFTINRDNGIVSSLVPLDYEDRREFELTAHISDGGTPVLATNISVNIFVTDRNDNAPQVLYPRPGGSSVEMLPRGTSAGHLVSRVVGWDADAGHNAWLSYSLLGSPNQSLFAIGLHTGQISTARPVQDTDSPRQTLTVLIKDNGEPSLSTTATLTVSVTEDSPEARAEFPSGSAPREQKKNLTFYLLLSLILVSVGFVVTVFGVIIFKVYKWKQSRDLYRAPVSSLYRTPGPSLHADAVRGGLMSPHLYHQVYLTTDSRRSDPLLKKPGAASPLASRQNTLRSCDPVFYRQVLGAESAPPGQVRFSKSCLTLLVLFYSYIILRKEWSCFFSDEDVFLVMHSHFQLALPRSKLVPL

SEQ ID NO: 912107 - protein, 2519 aa, Homo sapiens
MGSGAGELGRAERLPVLFLFLLSLFCPALCEQIRYRIPEEMPKGSVVGNLATDLGFSVQELPTRKLRVSSEKPYFTVSAESGELLVSSRLDREEICGKKPACALEFEAVAENPLNFYHVNVEIEDINDHTPKFTQNSFELQISESAQPGTRFILGSAHDADIGSNTLQNYQLSPSDHFSLINKEKSDGSKYPEMVLKTPLDREKQKSYHLTLTALDFGAPPLSSTAQIHVLVTDANDNAPVFSQDVYRVSLSENVYPGTTVLQVTATDQDEGVNAEITFSFSEASQITQFDLNSNTGEITVLNTLDFEEVKEYSIVLEARDGGGMIAQCTVEVEVIDENDNAPEVIFQSLPNLIMEDAELGTHIALLKVRDKDSRHNGEVTCKLEGDVPFKILTSSRNTYKLVTDAVLDREQNPEYNITVTATDRGKPPLSSSSSITLHIGDVNDNAPVFSQSSYIVHVAENNPPGASISQVRASDPDLGPNGQVSYCIMASDLEQRELSSYVSISAESGVVFAQRAFDHEQLRAFELTLQARDQGSPALSANVSLRVLVDDRNDNAPRVLYPALGPDGSALFDMVPHAAEPGYLVTKVVAVDADSGHNAWLSYHVLQASEPGLFSLGLRTGEVRTARALGDRDAVRQRLLVAVRDGGQPPLSATATLHLVFADSLQEVLPDITDRPDPSDLQAELQFYLVVALALISVLFLVAMILAIALRLRRSSSPASWSCFQPGLCVKSESVVPPNYSEGTLPYSYNLCVAHTGKTEFNFLKCSEQLSSGQDILCGDSSGALFPLCNSSELTSHQVVSFKYNLMLIAYPFLHIHKKIYIFAGKYIIFRCHGSFLESCSQLKSCHIILQRRSKVGAIVWPNICLFFSQAEIYKAMRGGFNHKVKVLDSCWLSPEKVNEIFPIHFPSCCLIYDEYFFQLGYTINIKIIKPKNLSKNSTLFLTNLTGMVSIVVHCFVSCVNFPFVSKALRIRSQLDFYVHGPLVIICSVRCVCVCVCVCVREILLLRKRSTMLIEDQKQILLTCNIGVSGLICIQAHSISFIKEKTMFCVCCPSHTQPYYIMCNCLICSPKLIIARGLLIILLPLGKKYSLENCQSGVHTKYIQNTKEHYMSLLLGISKQLLQLMATLQIAERRKRLSILFVFLFFFFETESLSVTQAVVQWHNDSSLQPQTPGLKHSFCISLLTSWNSGSCHQTWLIFLFSVEKIFSFTNLTGMVSIVYPVFHMHKKIYSQENIKFSDFMSGFKKVLVSEKTIIPVFKGRVKKFICYVAQAGLEEETDFFVVILILWLLSKYYIVITFCSFLDQSVNVGKVNFRIYVKVKSALNLIISLVKGMGWSFAFYHIFICTFQVFKKKNINNVNKMQNNVISHKTAMVKAFILLKFHNFYLKILSTCNSSGIEKNNLKATTLEKACKMIKYFKPNKTISESVISSEVYFSLKINSFLVTTEVLSYLLVYIGDIYNKAESTMGNESIMFFLRPNVLQKCENLIRCYNLIILIYSDHLITLNKTFISHSLAVSFKIWVYWINQINSKQSNKQMIFFSQKSSRVLHLEVICISVQELFRTEAPLFTYWKTNATENTQISHLTKTRRCHKLTAGLQRNPTPVWRHSRFPEDCHLHSCGKKLNKTHLCTVKILRGFCSKTTMAAPQSRPRRGELILLCALLGTLWEIGRGQIRYSVPEETDKGSFVGNISKDLGLDPRKLAKHGVRIVSRGRTQLFALNPRSGSLITAGRIDREELCAQSPRCLININTLVEDKGKLFGVEIEIIDINDNNPKFQVEDLEVKINEIAVPGARYPLPEAVDPDVGVNSLQSYQLSPNHHFSLDVQTGDNGAINPELVLERALDREEEAAHHLVLTASDGGKPPRSSTVRIHVTVLDTNDNAPVFPHPIYRVKVLENMPPGTRLLTVTASDPDEGINGKVAYKFRKINEKQTPLFQLNENTGEISIAKSLDYEECSFYEMEIQAEDVGALLGRTKLLISVEDVNDNRPEVIITSLFSPVLENSLPGTVIAFLSVHDQDSGKNGQVVCYTRDNLPFKLEKSIGNYYRLVTRKYLDRENVSIYNITVMASDLGTPPLSTETQIALHVADINDNPPTFPHASYSAYILENNLRGASIFSLTAHDPDSQENAQVTYSVTEDTLQGAPLSSYISINSDTGVLYALQSFDYEQIRDLQLLVTASDSGDPPLSSNMSLSLFVLDQNDNAPEILYPALPTDGSTGVELAPRSAERGYLVTKVVAVDRDSGQNAWLSYRLLKASEPGLFSVGLHTGEVRTARALLDRDALKQSLVVAVQDHGQPPLSATVTLTVAVADSIPEVLTELGSLKPSVDPNDSSLTLYLVVAVAAISCVFLAFVAVLLGLRLRRWHKSRLLQDSGGRLVGVPASHFVGVEEVQAFLQTYSQEVSLTADSRKSHLIFPQPNYADMLISQEGCEKNDSLLTSVDFHEYKNEADHGQQAPPNTDWRFSQAQRPGTSGSQNGDDTGTWPNNQFDTEMLQAMILASASAPSFGWCRIASSVVRCAFT

SEQ ID NO: 912108 - protein, 398 aa, Homo sapiens
MVPEAWRSGLVSTGRVVGVLLLLGALNKASTVIHYEIPEEREKGFAVGNVVANLGLDLGSLSARRFRVVSGASRRFFEVNRETGEMFVNDRLDREELCGTLPSCTVTLELVVENPLELFSVEVVIQDINDNNPAFPTQEMKLEISEAVAPGTRFPLESAHDPDVGSNSLQTYELSRNEYFALRVQTREDSTKYAELVLERALDREREPSLQLVLTALDGGTPALSASLPIHIKVLDANDNAPVFNQSLYRARVLEDAPSGTRVVQVLATDLDEGPNGEIIYSFGIPVTRDAAEEASLKSLFTLAVMSKSESPKEPEQLRKLFIGGLSFETTDESLRSHFEQWGTLTDCVVMRDPNTKRSRGFGFVTYATVEEVDAAMNARPHKVDGRVVEPKRAVSRE

SEQ ID NO: 912109 - protein, 828 aa, Homo sapiens
MTNCLSFRNGRGLALLCALLGTLCETGSGQIRYSVSEELDKGSFVGNIANDLGLEPRELAERGVRIVSRGRTQLFSLNPQSGSLVTAERIDREELCAQIPLCLVKINILVEDKLKIFEVEIEIKDINDNAPNFPTEELEIKIGELTVPGTRFPIKTAFDPDVGINSLQNYKLSPNDYFSLAVNSVSEGAKYPELVLERALDREKKEIHQLVLVASDGGDPVHSGNLHIQVIVLDANDNPPMFTQPEYRVSVWENVPVGTRLLTVNATDPDEGFNAQVSYILDKMPGKIAEIFHLNSVSGEVSILKSLDYEDAMFYEIKIEAQDGPGLLSRAKILVTVLDVNDNAPEITITSLTSSVPEEGTVGREIALIDVHDRDSGQNGQVEVFVLGNLPFKLEKSIDQYYRLVTATSLDREQISEYNISLRASDGGSPPLSTETHITLHVIDINDNPPTFPHLSYSAYIPENNPRGASIFSVTAQDPDSNNNARITYALTEDTLQGAPLSSFVSINSNTGVLYALRSFDYEQFRDLKLLVTASDSGNPPLSSNVSLNLFVLDQNDNAPEILYPALPTDGSTGVELAPRSAEPGYLVTKVVAVDRDSGQNAWLSYRLLKASEPGLFSVGLHTGEVRTARALLDRDALKQSLVVAVQDHGQPPLSATVTLTVAVADRIPDILADLGSLEPSAKPNDSDLTLYLVVAVAAVSCVFLAFVIVLLALRLRRWHKSRLLQASGGGLASTPGSHFVGADGVRAFLQTYSHEVSLTADSRKSHLIFPQPNYADTLISQESCEKSEPLLITQDLLEMKGDSNLLLDEDEDERVEKADLRQLTEMG

SEQ ID NO: 912110 - protein, 121 aa, Homo sapiens
MSTTARLGEPGIPSGQTPSLAPSGPDYCSSCSNTSAKPGVIFTSATPGLSGCTPPTVGRGTLHAAACAAAMSLVIPEKFQHILRVLNTNIDGRRKIAFAHHCPFKGVGPKICSCGVEESRH

SEQ ID NO: 912111 - protein, 103 aa, Homo sapiens
VKRAPRSFWGCETKRWSKKVCVKSQAMKASSSLVSPEFSFLRSDSAAACAAAMSLVIPEKFQHILRVLNTNIDGRRKIAFAHHCPFKGVGPKICSCGVEESRH

SEQ ID NO: 912112 - protein, 101 aa, Homo sapiens
SFKPWGSTTKFHLPLQYRSLRLCSFNSISNSAALDASSCRIRHDAACAAAMSLVIPEKFQHILRVLNTNIDGRRKIAFAHHCPFKGVGPKICSCGVEESRH

SEQ ID NO: 912113 - protein, 67 aa, Homo sapiens
RLVEAAVSRTRACAAAMSLVIPEKFQHILRVLNTNIDGRRKIAFAHHCPFKGVGPKICSCGVEESRH

SEQ ID NO: 912114 - protein, 72 aa, Homo sapiens
NLRLGTRLGVGRLHAAACAAAMSLVIPEKFQHILRVLNTNIDGRRKIAFAHHCPFKGVGPKICSCGVEESRH

SEQ ID NO: 912115 - protein, 110 aa, Homo sapiens
MEDQLPRLQMRHKIVACLRCRFRKTLAPDVATGPLERHGSERGLDNAQPGGHAPLVLQAMSLVIPEKFQHILRVLNTNIDGRRKIAFAHHCPFKGVGPKICSCGVEESRH

SEQ ID NO: 912116 - protein, 35 aa, Homo sapiens
MILRVLNTNIDGRRKIAFAITAIKGVGRRYAHVVL

SEQ ID NO: 912117 - protein, 103 aa, Homo sapiens; identical to SEQ ID NO: 912111

SEQ ID NO: 912118 - protein, 74 aa, Homo sapiens
THASRTRGSTHASRRCAAACAAAMSLVIPEKFQHILRVLNTNIDGRRKIAFAHHCPFKGVGPKICSCGVEESRH

SEQ ID NO: 912119 - protein, 90 aa, Homo sapiens
LGCSALCRSGVRTKFGINMVTSRERGTTRLPKEEVNRPRSETELTEDEVERVITHYAESHASTRSPDLVLLNRQKDVKRIGKYSPVQPGP

SEQ ID NO: 912120 - protein, 67 aa, Homo sapiens
RPLQHQNGNHTFHLILSEFSRPLGEVERVITHYAESHASTRSPDLVLLNRQKDVKRIGKYSPVQPGP

SEQ ID NO: 912121 - protein, 40 aa, Homo sapiens
MCGGKTRGVRRRTFFDEKSHYLSVGEENNFDNTHPHKSLP

SEQ ID NO: 912122 - protein, 89 aa, Homo sapiens
SRAAAYYYKIRGRVDTAARRRQKGSSTGGLHAAACAAAMSLVIPEKFQHILRVLNTNIDGRRKIAFAHHCPFKGVGPKICSCGVEESRH

SEQ ID NO: 912123 - protein, 121 aa, Homo sapiens; identical to SEQ ID NO: 912110

SEQ ID NO: 912124 - protein, 89 aa, Homo sapiens; identical to SEQ ID NO: 912122

SEQ ID NO: 912125 - protein, 89 aa, Homo sapiens; identical to SEQ ID NO: 912122

SEQ ID NO: 912126 - protein, 136 aa, Homo sapiens
MLQEARCFEDLLLRFFVCRNQGRVKRVSTEFQEAKSNKNSSDSESDDEGDVSEVISRVVSKAEGIRKPESHPLKTRPRVSFRKKNLLDRCGLCHESHTQRSPYLQGMETTQPIASVGLGSASSASTPGFHIAGPFA

SEQ ID NO: 912127 - protein, 83 aa, Homo sapiens
MPSTLAFMMDGGHRNRTGTANKEESNKTKVFWKPKVPGVRRPMGKRPVKPLPLLSRRHQLNQKTPKTTTGHRTAAPSTDNNPE

SEQ ID NO: 912128 - protein, 60 aa, Homo sapiens
MNHVDRSHRGGGTSTLRQWINIHKRARDERPDLRDKRAGGGERQQNDGDLSGYRLGESTT

SEQ ID NO: 912129 - protein, 66 aa, Homo sapiens
MGLHRPRARAPLTSTFFIGEWGSVHWGYNLRATVKHLQAGAIRSLRPYQGGRFQFYAPSGDSRQHL

SEQ ID NO: 912130 - protein, 47 aa, Homo sapiens
MFPERLKPTTFPRYTTGVYYGQCPESWGANHRFMPIVLELIPLKSRH

SEQ ID NO: 912131 - protein, 152 aa, Homo sapiens
MAGRKNNKQSGHTKRRTGQHKHAGDPSHTHPPTPHNTTRTPTGRETQQRMRGEQQQLTPPTHQRGIQLTRVIKHNAQNPPHRAQNNDRHQNSASKRIHQKRDNNSKSTEKAKEETRKKEGQWDVRGQSSEEDSEPRRPEGNGRAGDGLSETR

SEQ ID NO: 912132 - protein, 89 aa, Homo sapiens; identical to SEQ ID NO: 912122

SEQ ID NO: 912133 - protein, 89 aa, Homo sapiens; identical to SEQ ID NO: 912122

SEQ ID NO: 912134 - protein, 121 aa, Homo sapiens; identical to SEQ ID NO: 912110

SEQ ID NO: 912135 - protein, 89 aa, Homo sapiens; identical to SEQ ID NO: 912122

SEQ ID NO: 912136 - protein, 105 aa, Homo sapiens
MSTTARLGEPGIPSGQTPSLAPSGPDYCSSCSNTSAKPGVIFTSATPGLSGCTPPTVGRGTLHAAACAAAMSLVIPEKFQHILRVLNTNIDGRRKIAFAHHCPFK

SEQ ID NO: 912137 - protein, 33 aa, Homo sapiens
MQITQSRSRLVLTDRGCKMEFSSPAIACTVLSL

SEQ ID NO: 912138 - protein, 78 aa, Homo sapiens
SRAAAYYYKIRGRVDTAARRRQKGSSTGGLHAAACAAAMSLVIPEKFQHILRVLNTNIDGRRKIAFAHHCPFKVSEVG

SEQ ID NO: 912139 - protein, 89 aa, Homo sapiens; identical to SEQ ID NO: 912122

SEQ ID NO: 912140 - protein, 121 aa, Homo sapiens; identical to SEQ ID NO: 912110

SEQ ID NO: 912141 - protein, 74 aa, Homo sapiens; identical to SEQ ID NO: 912118

SEQ ID NO: 912142 - protein, 91 aa, Homo sapiens
MCAEGDKPATNSGANEQEATLVTTKRRPEGNSTKPATRGSSRTQKHTLQNKQYQKHEKHHKSRQRHNRHRSKQTRDDYEKDSAEKRQNRPD

SEQ ID NO: 912143 - protein, 117 aa, Homo sapiens
MRGGEKRGYGNGPWVIRGSLDPVFWVPGGKFGGVPLLRGRRVKYFRETARVNGLDISREENRETESEQRARTSRLRKRWTDTPQEDETTRATTSDKTEESTGHQNTKQAESRDRYKE

SEQ ID NO: 912144 - protein, 110 aa, Homo sapiens; identical to SEQ ID NO: 912115

SEQ ID NO: 912145 - protein, 70 aa, Homo sapiens
MAYHALRAQTVPSPNREVRNQYRLGPVAGQFNQTSVHGENPAYPVSNPCATATLKPILGYFYPLLRHTTY

SEQ ID NO: 912146 - protein, 66 aa, Homo sapiens
PTRRGRVGRPTRRGVRSLVIPEKFQHILRVLNTNIDGRRKIAFAHHCPFKGVGPKICSCGVEESRH

SEQ ID NO: 912147 - protein, 102 aa, Homo sapiens
LWVKNCRDLLQSSYNKQRFDQPLEASTWLKNFKTTNERFLNQIKVQEKYVWNKRELTEDEVERVITHYAESHASTRSPDLVLLNRQKDVKRIGKYSPVQPGP

SEQ ID NO: 912148 - protein, 105 aa, Homo sapiens; identical to SEQ ID NO: 912136

SEQ ID NO: 912149 - protein, 121 aa, Homo sapiens; identical to SEQ ID NO: 912110

SEQ ID NO: 912150 - protein, 121 aa, Homo sapiens; identical to SEQ ID NO: 912110

SEQ ID NO: 912151 - protein, 89 aa, Homo sapiens; identical to SEQ ID NO: 912122

SEQ ID NO: 912152 - protein, 180 aa, Homo sapiens
MEMGTWDDKHESQDPKLPGTKGGKTLAGYTHNREHRNKVSRIKDPGLKPVEYTETRKKPRTKHTRNKNTHQDESDADKNQQQKRKHQKKTKRDEEHRKKQHKKKQEAKEQRRKKTGTQEEKRKENRKRGEKRTKKKKEKAAKNEKRQKTREEEGEKEEEEEEAGARSEKKRTHQHTEHHH

SEQ ID NO: 912153 - protein, 107 aa, Homo sapiens
MLSDEQTNNGPDRDIGKETSSARETQNNSRRTRPGRDKATPSQQHDHHSRPKTRQRSAKRVRNDAHHTQTQPKPPQTHTKHTRDPPHQTPQRTRRPPRRDAPPARQQ

SEQ ID NO: 912154 - protein, 38 aa, Homo sapiens
MIGCVFYTQPGRLGRIYNTRTWRRQTHLIRVILGDSHL

SEQ ID NO: 912155 - protein, 70 aa, Homo sapiens; identical to SEQ ID NO: 912145

SEQ ID NO: 912156 - protein, 167 aa, Homo sapiens
MVWTKQAPGKNSGKRSDKNPGPCRGAGAHSRGRLAVPRGTDTPKTQWTPWERHRRDDVPQDRPLTSVRPWTRTTTSSESYQRNKERTTHAPPQRHPKERRGHQNGRSTATHADQQGRQEQLAQRNTKQNPSTHRVRQTTERTPPKNEQNQRQPQKPTGRTEQKERRT

SEQ ID NO: 912157 - protein, 121 aa, Homo sapiens; identical to SEQ ID NO: 912110

SEQ ID NO: 912158 - protein, 121 aa, Homo sapiens; identical to SEQ ID NO: 912110

SEQ ID NO: 912159 - protein, 121 aa, Homo sapiens; identical to SEQ ID NO: 912110

SEQ ID NO: 912160 - protein, 121 aa, Homo sapiens; identical to SEQ ID NO: 912110

SEQ ID NO: 912161 - protein, 131 aa, Homo sapiens
MSTTCKAGRTRDTFWPNAQFSALGSRLLQLLLQYQRQTWRDLHECNIQVSRVAHPPLWAGGPLHAAACAAAMSLVIPEKFQHILRVLNTNIDGRRKIAFAHHCPFKVLAEVCIMWFEEADITYQRPETYLG

SEQ ID NO: 912162 - protein, 125 aa, Homo sapiens
TSLASVLASPVSLASPRVLACQCTNGFQFNSECRIKCEDSDASQGLGSNVIHCRKDGTWNGSFHVCQEMQGQCSVPNELNSNLKLQCPDGYAIGSECATSCLDHNSESIILPMNVTVRDIPHWRG

SEQ ID NO: 912163 - protein, 1627 aa, Homo sapiens
MRLWSWVLHLGLLSAALGCGLAERPRRARRDPRAGRPPRPAAGPATCATRGPRPPRLAAAAAAAGRAWEAVRVPRRRQQREARGATEEPSPPSRALYFSGRGEQLRVLRADLELPRDAFTLQVWLRAEGGQRSPAVITGLYDKCSYISRDRGWVVGIHTISDQDNKDPRYFFSLKTDRARQVTTINAHRSYLPGQWVYLAATYDGQFMKLYVNGAQVATSGEQVGGIFSPLTQKCKVLMLGGSALNHNYRGYIEHFSLWKVARTQREILSDMETHGAHTALPQLLLQENWDNVKHAWSPMKDGSSPKVEFSNAHGFLLDTSLEPPLCGQTLCDNTEVIASYNQLSSFRQPKVVRYRVVNLYEDDHKNPTVTREQVDFQHHQLAEAFKQYNISWELDVLEVSNSSLRRRLILANCDISKIGDENCDPECNHTLTGHDGGDCRHLRHPAFVKKQHNGVCDMDCNYERFNFDGGECCDPEITNVTQTCFDPDSPHRAYLDVNELKNILKLDGSTHLNIFFAKSSEEELAGVATWPWDKEALMHLGGIVLNPSFYGMPGHTHTMIHEIGHSLGLYHVFRGISEIQSCSDPCMETEPSFETGDLCNDTNPAPKHKSCGDPGPGNDTCGFHSFFNTPYNNFMSYADDDCTDSFTPNQVARMHCYLDLVYQGWQPSRKPAPVALAPQVLGHTTDSVTLEWFPPIDGHFFERELGSACHLCLEGRILVQYASNASSPMPCSPSGHWSPREAEGHPDVEQPCKSSVRTWSPNSAVNPHTVPPACPEPQGCYLELEFLYPLVPESLTIWVTFVSTDWDSSGAVNDIKLLAVSGKNISLGPQNVFCDVPLTIRLWDVGEEVYGIQIYTLDEHLEIDAAMLTSTADTPLCLQCKPLKYKVVRDPPLQMDVASILHLNRKFVDMDLNLGSVYQYWVITISGTEESEPSPAVTYIHGRGYCGDGIIQKDQGEQCDDMNKINGDGCSLFCRQEVSFNCIDEPSRCYFHDGDGVCEEFEQKTSIKDCGVYTPQGFLDQWASNASVSHQDQQCPGWVIIGQPAASQVCRTKVIDLSEGISQHAWYPCTISYPYSQLAQTTFWLRAYFSQPMVAAAVIVHLVTDGTYYGDQKQETISVQLLDTKDQSHDLGLHVLSCRNNPLIIPVVHDLSQPFYHSQAVRVSFSSPLVAISGVALRSFDNFDPVTLSSCQRGETYSPAEQSCVHFACEKTDCPELAVENASLNCSSSDRYHGAQCTVSCRTGYVLQIRRDDELIKSQTGPSVTVTCTEGKWNKQVACEPVDCSIPDHHQVYAASFSCPEGTTFGSQCSFQCRHPAQLKGNNSLLTCMEDGLWSFPEALCELMCLAPPPVPNADLQTARCRENKHKVGSFCKYKCKPGYHVPGSSRKSKKRAFKTQCTQDGSWQEGACVPVTCDPPPPKFHGLYQCTNGFQFNSECRIKCEDSDASQGLGSNVIHCRKDGTWNGSFHVCQEMQGQCSVPNELNSNLKLQCPDGYAIGSECATSCLDHNSESIILPMNVTVRDIPHWLNPTRVERVVCTAGLKWYPHPALIHCVKGCEPFMGDNYCDAINNRAFCNYDGGDCCTSTVKTKKVTPFPMSCDLQGDCACRDPQAQEHSRKDLRGYSHG

SEQ ID NO: 912164 - protein, 1627 aa, Homo sapiens; identical to SEQ ID NO: 912163

SEQ ID NO: 912165 - protein, 1627 aa, Homo sapiens; identical to SEQ ID NO: 912163

SEQ ID NO: 912166 - protein, 1708 aa, Homo sapiens
MIKERGEKLIANQEELGCIFQRWGEWSTHLEEESEKEKKKEVKGGSPKKGEEAKKVEAPRLPKLAAPGGGAGAKGGAGGTSDMRLWSWVLHLGLLSAALGCGLAERPRRARRDPRAGRPPRPAAGPATCPPAARGRRASPPPPPPPGGAWEAVRVPRRRQQREARGATEEPSPPSRALYFSGRGEQLRLRADLELPRDAFTLQVWLRAEGGQRSPAVITGLYDKCSYISRDRGWVVGIHTISDQDNKDPRYFFSLKTDRARQVTTINAHRSYLPGQWVYLAATYDGQFMKLYVNGAQVATSGEQVGGIFSPLTQKCKVLMLGGSALNHNYRGYIEHFSLWKVARTQREILSDMETHGAHTALPQLLLQENWDNVKHAWSPMKDGSSPKVEFSNAHGFLLDTSLEPPLCGQTLCDNTEVIASYNQLSSFRQPKVVRYRVVNLYEDDHKNPTVTREQVDFQHHQLAEAFKQYNISWELDVLEVSNSSLRRRLILANCDISKIGDENCDPECNHTLTGHDGGDCRHLRHPAFVKKQHNGVCDMDCNYERFNFDGGECCDPEITNVTQTCFDPDSPHRAYLDVNELKNILKLDGSTHLNIFFAKSSEEELAGVATWPWDKEALMHLGGIVLNPSFYGMPGHTHTMIHEIGHSLGLYHVFRGISEIQSCSDPCMETEPSFETGDLCNDTNPAPKHKSCGDPGPGNDTCGFHSFFNTPYNNFMSYADDDCTDSFTPNQVARMHCYLDLVYQGWQPSRKPAPVALAPQVLGHTTDSVTLEWFPPIDGHFFERELGSACHLCLEGRILVQYASNASSPMPCSPSGHWSPREAEGHPDVEQPCKSSVRTWSPNSAVNPHTVPPACPEPQGCYLELEFLYPLVPESLTIWVTFVSTDWDSSGAVNDIKLLAVSGKNISLGPQNVFCDVPLTIRLWDVGEEVYGIQIYTLDEHLEIDAAMLTSTADTPLCLQCKPLKYKVVRDPPLQMDVASILHLNRKFVDMDLNLGSVYQYWVITISGTEESEPSPAVTYIHGSGYCGDGIIQKDQGEQCDDMNKINGDGCSLFCRQEVSFNCIDEPSRCYFHDGDGVCEEFEQKTSIKDCGVYTPQGFLDQWASNASVSHQDQQCPGWVIIGQPAASQVCRTKVIDLSEGISQHAWYPCTISYPYSQLAQTTFWLRAYFSQPMVAAAVIVHLVTDGTYYGDQKQETISVQLLDTKDQSHDLGLHVLSCRNNPLIIPVVHDLSQPFYHSQAVRVSFSSPLVAISGVALRSFDNFDPVTLSSCQRGETYSPAEQSCVHFACEKTDCPELAVENAYLNCSSSDRYHGAQCTVSCRTGYVLQIRRDDELIKSQTGPSVTVTCTEGKWNKQVACEPVDCSIPDHHQVYAASFSCPEGTTFGSQCSFQCRHPAQLKGNNSLLTCMEDGLWSFPEALCELMCLAPPPVPNADLQTARCRENKHKVGSFCKYKCKPGYHVPGSSRKSKKRAFKTQCTQDGSWQEGACVPVTCDPPPPKFHGLYQCTNGFQFNSECRIKCEDSDASQGLGSNVIHCRKDGTWNGSFHVCQEMQGQCSVPNELNSNLKLQCPDGYAIGSECATSCLDHNSESIILPMNVTVRDIPHWLNPTRVERVVCTAGLKWYPHPALIHCVKGCEPFMGDNYCDAINNRAFCNYDGGDCCTSTVKTKKVTPFPMSCDLQGDCACRDPQAQEHSRKDLRGYSHG

SEQ ID NO: 912167 - protein, 1708 aa, Homo sapiens; identical to SEQ ID NO: 912166

SEQ ID NO: 912168 - protein, 1708 aa, Homo sapiens; identical to SEQ ID NO: 912166

SEQ ID NO: 912169 - protein, 1708 aa, Homo sapiens; identical to SEQ ID NO: 912166

SEQ ID NO: 912170 - protein, 1708 aa, Homo sapiens; identical to SEQ ID NO: 912166

SEQ ID NO: 912171 - protein, 650 aa, Homo sapiens
MIKERGEKLIANQEELGCIFQRWGEWSTHLEEESEKEKKKEVKGGSPKKGEEAKKVEAPRLPKLAAPGGGAGAKGGAGGTSDMRLWSWVLHLGLLSAALGCGLAERPRRARRDPRAGRPPRPAAGPATCPPAARGRRASPPPPPPPGGAWEAVRVPRRRQQREARGATEEPSPPSRALYFSGRGEQLRLRADLELPRDAFTLQVWLRAEGGQRSPAVITGLYDKCSYISRDRGWVVGIHTISDQDNKDPRYFFSLKTDRARQVTTINAHRSYLPGQWVYLAATYDGQFMKLYVNGAQVATSGEQVGGIFSPLTQKCKVLMLGGSALNHNYRGYIEHFSLWKVARTQREILSDMETHGAHTALPQLLLQENWDNVKHAWSPMKDGSSPKVEFSNAHGFLLDTSLEPPLCGQTLCDNTEVIASYNQLSSFRQPKVVRYRVVNLYEDDHKNPTVTREQVDFQHHQLAEAFKQYNISWELDVLEVSNSSLRRRLILANCDISKIGDENCDPECNHTLTGHDGGDCRHLRHPAFVKKQHNGVCDMDCNYERFNFDGGECCDPEITNVTQTCFDPDSPHRAYLDVNELKNILKLDGSTHLNIFFAKSSEEELAGVATWPWDKEALMHLGGIVLNPSFYGMPGHTHTMIHEIGHSAT

SEQ ID NO: 912172 - protein, 1611 aa, Homo sapiens
MIKERGEKLIANQEELGCIFQRWGEWSTHLEEESEKEKKKEVKGGSPKKGEEAKKVEAPRLPKLAAPGGGAGAKGGAGGTSDMRLWSWVLHLGLLSAALGCGLAERPRRARRDPRAGRPPRPAAGPATCPPAARGRRASPPPPPPPGGAWEAVRVPRRRQQREARGATEEPSPPSRALYFSGRGEQLRLRADLELPRDAFTLQVWLRAEGGQRSPAVITGLYDKCSYISRDRGWVVGIHTISDQDNKDPRYFFSLKTDRARQVTTINAHRSYLPGQWVYLAATYDGQFMKLYVNGAQVATSGEQVGGIFSPLTQKCKVLMLGGSALNHNYRGYIEHFSLWKVARTQREILSDMETHGAHTALPQLLLQENWDNVKHAWSPMKDGSSPKVEFSNAHGFLLDTSLEPPLCGQTLCDNTEVIASYNQLSSFRQPKVVRYRVVNLYEDDHKNPTVTREQVDFQHHQLAEAFKQYNISWELDVLEVSNSSLRRRLILANCDISKIGDENCDPECNHTLTGHDGGDCRHLRHPAFVKKQHNGVCDMDCNYERFNFDGGECCDPEITNVTQTCFDPDSPHRAYLDVNELKNILKLDGSTHLNIFFAKSSEEELAGVATWPWDKEALMHLGGIVLNPSFYGMPGHTHTMIHEIGHSLGLYHVFRGISEIQSCSDPCMETEPSFETGDLCNDTNPAPKHKSCGDPGPGNDTCGFHSFFNTPYNNFMSYADDDCTDSFTPNQVARMHCYLDLVYQGWQPSRKPAPVALAPQVLGHTTDSVTLEWFPPIDGHFFERELGSACHLCLEGRILVQYASNASSPMPCSPSGHWSPREAEGHPDVEQPCKSSVRTWSPNSAVNPHTVPPACPEPQGCYLELEFLYPLVPESLTIWVTFVSTDWDSSGAVNDIKLLAVSGKNISLGPQNVFCDVPLTIRLWDVGEEVYGIQIYTLDEHLEIDAAMLTSTADTPLCLQCKPLKYKVVRDPPLQMDVASILHLNRKFVDMDLNLGSVYQYWVITISGTEESEPSPAVTYIHGSGYCGDGIIQKDQGEQCDDMNKINGDGCSLFCRQEVSFNCIDEPSRCYFHDGDGVCEEFEQKTSIKDCGVYTPQGFLDQWASNASVSHQDQQCPGWVIIGQPAASQVCRTKVIDLSEGISQHAWYPCTISYPYSQLAQTTFWLRAYFSQPMVAAAVIVHLVTDGTYYGDQKQETISVQLLDTKDQSHDLGLHVLSCRNNPLIIPVVHDLSQPFYHSQAVRVSFSSPLVAISGVALRSFDNFDPVTLSSCQRGETYSPAEQSCVHFACEKTDCPELAVENAYLNCSSSDRYHGAQCTVSCRTGYVLQIRRDDELIKSQTGPSVTVTCTEGKWNKQVACEPVDCSIPDHHQVYAASFSCPEGTTFGSQCSFQCRHPAQLKGNNSLLTCMEDGLWSFPEALCELMCLAPPPVPNADLQTARCRENKHKVGSFCKYKCKPGYHVPGSSRKSKKRAFKTQCTQDGSWQEGACVPVTCDPPPPKFHGLYQCTNGFQFNSECRIKCEDSDASQGLGSNVIHCRKDGTWNGSFHVCQEMQGQCSVPNELNSNLKLQCPDGYAIGSECATSCLDHNSESIILPMNVTVRDIPHWRG

SEQ ID NO: 912173 - protein, 1451 aa, Homo sapiens
MIKERGEKLIANQEELGCIFQRWGEWSTHLEEESEKEKKKEVKGGSPKKGEEAKKVEAPRLPKLAAPGGGAGAKGGAGGTSDMRLWSWVLHLGLLSAALGCGLAERPRRARRDPRAGRPPRPAAGPATCPPAARGRRASPPPPPPPGGAWEAVRVPRRRQQREARGATEEPSPPSRALYFSGRGEQLRLRADLELPRDAFTLQVWLRAEGGQRSPAVITGLYDKCSYISRDRGWVVGIHTISDQDNKDPRYFFSLKTDRARQVTTINAHRSYLPGQWVYLAATYDGQFMKLYVNGAQVATSGEQVGGIFSPLTQKCKVLMLGGSALNHNYRGYIEHFSLWKVARTQREILSDMETHGAHTALPQLLLQENWDNVKHAWSPMKDGSSPKVEFSNAHGFLLDTSLEPPLCGQTLCDNTEVIASYNQLSSFRQPKVVRYRVVNLYEDDHKNPTVTREQVDFQHHQLAEAFKQYNISWELDVLEVSNSSLRRRLILANCDISKIGDENCDPECNHTLTGHDGGDCRHLRHPAFVKKQHNGVCDMDCNYERFNFDGGECCDPEITNVTQTCFDPDSPHRAYLDVNELKNILKLDGSTHLNIFFAKSSEEELAGVATWPWDKEALMHLGGIVLNPSFYGMPGHTHTMIHEIGHSLGLYHVFRGISEIQSCSDPCMETEPSFETGDLCNDTNPAPKHKSCGDPGPGNDTCGFHSFFNTPYNNFMSYADDDCTDSFTPNQVARMHCYLDLVYQGWQPSRKPAPVALAPQVLGHTTDSVTLEWFPPIDGHFFERELGSACHLCLEGRILVQYASNASSPMPCSPSGHWSPREAEGHPDVEQPCKSSVRTWSPNSAVNPHTVPPACPEPQGCYLELEFLYPLVPESLTIWVTFVSTDWDSSGAVNDIKLLAVSGKNISLGPQNVFCDVPLTIRLWDVGEEVYGIQIYTLDEHLEIDAAMLTSTADTPLCLQCKPLKYKVVRDPPLQMDVASILHLNRKFVDMDLNLGSVYQYWVITISGTEESEPSPAVTYIHGSGYCGDGIIQKDQGEQCDDMNKINGDGCSLFCRQEVSFNCIDEPSRCYFHDGDGVCEEFEQKTSIKDCGVYTPQGFLDQWASNASVSHQDQQCPGWVIIGQPAASQVCRTKVIDLSEGISQHAWYPCTISYPYSQLAQTTFWLRAYFSQPMVAAAVIVHLVTDGTYYGDQKQETISVQLLDTKDQSHDLGLHVLSCRNNPLIIPVVHDLSQPFYHSQAVRVSFSSPLVAISGVALRSFDNFDPVTLSSCQRGETYSPAEQSCVHFACEKTDCPELAVENAYLNCSSSDRYHGAQCTVSCRTGYVLQIRRDDELIKSQTGPSVTVTCTEGKWNKQVACEPVDCSIPDHHQVYAASFSCPEGTTFGSQCSFQCRHPAQLKGNNSLPSLCQFGRATGRCRGWYTYTDLVCAAGANRPRAVGPGLPLPARW

SEQ ID NO: 912174 - protein, 1220 aa, Homo sapiens
MIKERGEKLIANQEELGCIFQRWGEWSTHLEEESEKEKKKEVKGGSPKKGEEAKKVEAPRLPKLAAPGGGAGAKGGAGGTSDMRLWSWVLHLGLLSAALGCGLAERPRRARRDPRAGRPPRPAAGPATCPPAARGRRASPPPPPPPGGAWEAVRVPRRRQQREARGATEEPSPPSRALYFSGRGEQLRLRADLELPRDAFTLQVWLRAEGGQRSPAVITGLYDKCSYISRDRGWVVGIHTISDQDNKDPRYFFSLKTDRARQVTTINAHRSYLPGQWVYLAATYDGQFMKLYVNGAQVATSGEQVGGIFSPLTQKCKVLMLGGSALNHNYRGYIEHFSLWKVARTQREILSDMETHGAHTALPQLLLQENWDNVKHAWSPMKDGSSPKVEFSNAHGFLLDTSLEPPLCGQTLCDNTEVIASYNQLSSFRQPKVVRYRVVNLYEDDHKNPTVTREQVDFQHHQLAEAFKQYNISWELDVLEVSNSSLRRRLILANCDISKIGDENCDPECNHTLTGHDGGDCRHLRHPAFVKKQHNGVCDMDCNYERFNFDGGECCDPEITNVTQTCFDPDSPHRAYLDVNELKNILKLDGSTHLNIFFAKSSEEELAGVATWPWDKEALMHLGGIVLNPSFYGMPGHTHTMIHEIGHSLGLYHVFRGISEIQSCSDPCMETEPSFETGDLCNDTNPAPKHKSCGDPGPGNDTCGFHSFFNTPYNNFMSYADDDCTDSFTPNQVARMHCYLDLVYQGWQPSRKPAPVALAPQVLGHTTDSVTLEWFPPIDGHFFERELGSACHLCLEGRILVQYASNASSPMPCSPSGHWSPREAEGHPDVEQPCKSSVRTWSPNSAVNPHTVPPACPEPQGCYLELEFLYPLVPESLTIWVTFVSTDWDSSGAVNDIKLLAVSGKNISLGPQNVFCDVPLTIRLWDVGEEVYGIQIYTLDEHLEIDAAMLTSTADTPLCLQCKPLKYKVVRDPPLQMDVASILHLNRKFVDMDLNLGSVYQYWVITISGTEESEPSPAVTYIHGSGYCGDGIIQKDQGEQCDDMNKINGDGCSLFCRQEVSFNCIDEPSRCYFHDGDGVCEEFEQKTSIKDCGVYTPQGFLDQWASNASVSHQDQQCPGWVIIGQPAASQVCRTKVIDLSEGISQHAWYPCTISYPYSQLAQTTFWLRAYFSQPMVAAAVIVHLVTDGTYYGDQKQETISVQLLDTKDQSHDLDPKKERD

SEQ ID NO: 912175 - protein, 1169 aa, Homo sapiens
MIKERGEKLIANQEELGCIFQRWGEWSTHLEEESEKEKKKEVKGGSPKKGEEAKKVEAPRLPKLAAPGGGAGAKGGAGGTSDMRLWSWVLHLGLLSAALGCGLAERPRRARRDPRAGRPPRPAAGPATCPPAARGRRASPPPPPPPGGAWEAVRVPRRRQQREARGATEEPSPPSRALYFSGRGEQLRLRADLELPRDAFTLQVWLRAEGGQRSPAVITGLYDKCSYISRDRGWVVGIHTISDQDNKDPRYFFSLKTDRARQVTTINAHRSYLPGQWVYLAATYDGQFMKLYVNGAQVATSGEQVGGIFSPLTQKCKVLMLGGSALNHNYRGYIEHFSLWKVARTQREILSDMETHGAHTALPQLLLQENWDNVKHAWSPMKDGSSPKVEFSNAHGFLLDTSLEPPLCGQTLCDNTEVIASYNQLSSFRQPKVVRYRVVNLYEDDHKNPTVTREQVDFQHHQLAEAFKQYNISWELDVLEVSNSSLRRRLILANCDISKIGDENCDPECNHTLTGHDGGDCRHLRHPAFVKKQHNGVCDMDCNYERFNFDGGECCDPEITNVTQTCFDPDSPHRAYLDVNELKNILKLDGSTHLNIFFAKSSEEELAGVATWPWDKEALMHLGGIVLNPSFYGMPGHTHTMIHEIGHSLGLYHVFRGISEIQSCSDPCMETEPSFETGDLCNDTNPAPKHKSCGDPGPGNDTCGFHSFFNTPYNNFMSYADDDCTDSFTPNQVARMHCYLDLVYQGWQPSRKPAPVALAPQVLGHTTDSVTLEWFPPIDGHFFERELGSACHLCLEGRILVQYASNASSPMPCSPSGHWSPREAEGHPDVEQPCKSSVRTWSPNSAVNPHTVPPACPEPQGCYLELEFLYPLVPESLTIWVTFVSTDWDSSGAVNDIKLLAVSGKNISLGPQNVFCDVPLTIRLWDVGEEVYGIQIYTLDEHLEIDAAMLTSTADTPLCLQCKPLKYKVVRDPPLQMDVASILHLNRKFVDMDLNLGSVYQYWVITISGTEESEPSPAVTYIHGSGYCGDGIIQKDQGEQCDDMNKINGDGCSLFCRQEVSFNCIDEPSRCYFHDGDGVCEEFEQKTSIKDCGVYTPQGFLDQWASNASVSHQDQQCPGWVIIGQPAASQVCRTKVIDLSEGISQHAWYPCTIKEFPAPARSRDPLEHF

SEQ ID NO: 912176 - protein, 1086 aa, Homo sapiens
MIKERGEKLIANQEELGCIFQRWGEWSTHLEEESEKEKKKEVKGGSPKKGEEAKKVEAPRLPKLAAPGGGAGAKGGAGGTSDMRLWSWVLHLGLLSAALGCGLAERPRRARRDPRAGRPPRPAAGPATCPPAARGRRASPPPPPPPGGAWEAVRVPRRRQQREARGATEEPSPPSRALYFSGRGEQLRLRADLELPRDAFTLQVWLRAEGGQRSPAVITGLYDKCSYISRDRGWVVGIHTISDQDNKDPRYFFSLKTDRARQVTTINAHRSYLPGQWVYLAATYDGQFMKLYVNGAQVATSGEQVGGIFSPLTQKCKVLMLGGSALNHNYRGYIEHFSLWKVARTQREILSDMETHGAHTALPQLLLQENWDNVKHAWSPMKDGSSPKVEFSNAHGFLLDTSLEPPLCGQTLCDNTEVIASYNQLSSFRQPKVVRYRVVNLYEDDHKNPTVTREQVDFQHHQLAEAFKQYNISWELDVLEVSNSSLRRRLILANCDISKIGDENCDPECNHTLTGHDGGDCRHLRHPAFVKKQHNGVCDMDCNYERFNFDGGECCDPEITNVTQTCFDPDSPHRAYLDVNELKNILKLDGSTHLNIFFAKSSEEELAGVATWPWDKEALMHLGGIVLNPSFYGMPGHTHTMIHEIGHSLGLYHVFRGISEIQSCSDPCMETEPSFETGDLCNDTNPAPKHKSCGDPGPGNDTCGFHSFFNTPYNNFMSYADDDCTDSFTPNQVARMHCYLDLVYQGWQPSRKPAPVALAPQVLGHTTDSVTLEWFPPIDGHFFERELGSACHLCLEGRILVQYASNASSPMPCSPSGHWSPREAEGHPDVEQPCKSSVRTWSPNSAVNPHTVPPACPEPQGCYLELEFLYPLVPESLTIWVTFVSTDWDSSGAVNDIKLLAVSGKNISLGPQNVFCDVPLTIRLWDVGEEVYGIQIYTLDEHLEIDAAMLTSTADTPLCLQCKPLKYKVVRDPPLQMDVASILHLNRKFVDMDLNLGSVYQYWVITISGTEESEPSPAVTYIHGSGYCGDGIIQKDQGEQCDDMNKINGDGCSLFCRQEVSFNCIDEPSRCYFHDGDGVVQLLHHP

SEQ ID NO: 912177 - protein, 992 aa, Homo sapiens
MIKERGEKLIANQEELGCIFQRWGEWSTHLEEESEKEKKKEVKGGSPKKGEEAKKVEAPRLPKLAAPGGGAGAKGGAGGTSDMRLWSWVLHLGLLSAALGCGLAERPRRARRDPRAGRPPRPAAGPATCPPAARGRRASPPPPPPPGGAWEAVRVPRRRQQREARGATEEPSPPSRALYFSGRGEQLRLRADLELPRDAFTLQVWLRAEGGQRSPAVITGLYDKCSYISRDRGWVVGIHTISDQDNKDPRYFFSLKTDRARQVTTINAHRSYLPGQWVYLAATYDGQFMKLYVNGAQVATSGEQVGGIFSPLTQKCKVLMLGGSALNHNYRGYIEHFSLWKVARTQREILSDMETHGAHTALPQLLLQENWDNVKHAWSPMKDGSSPKVEFSNAHGFLLDTSLEPPLCGQTLCDNTEVIASYNQLSSFRQPKVVRYRVVNLYEDDHKNPTVTREQVDFQHHQLAEAFKQYNISWELDVLEVSNSSLRRRLILANCDISKIGDENCDPECNHTLTGHDGGDCRHLRHPAFVKKQHNGVCDMDCNYERFNFDGGECCDPEITNVTQTCFDPDSPHRAYLDVNELKNILKLDGSTHLNIFFAKSSEEELAGVATWPWDKEALMHLGGIVLNPSFYGMPGHTHTMIHEIGHSLGLYHVFRGISEIQSCSDPCMETEPSFETGDLCNDTNPAPKHKSCGDPGPGNDTCGFHSFFNTPYNNFMSYADDDCTDSFTPNQVARMHCYLDLVYQGWQPSRKPAPVALAPQVLGHTTDSVTLEWFPPIDGHFFERELGSACHLCLEGRILVQYASNASSPMPCSPSGHWSPREAEGHPDVEQPCKSSVRTWSPNSAVNPHTVPPACPEPQGCYLELEFLYPLVPESLTIWVTFVSTDWDSSGAVNDIKLLAVSGKNISLGPQNVFCDVPLTIRLWDVGEEVYGIQIYTLDEHLEIDAAMLTSTADTPLCLQCKPLKYKVVRDPPLQMDVASILHLNRKFVDM

SEQ ID NO: 912178 - protein, 706 aa, Homo sapiens
MIKERGEKLIANQEELGCIFQRWGEWSTHLEEESEKEKKKEVKGGSPKKGEEAKKVEAPRLPKLAAPGGGAGAKGGAGGTSDMRLWSWVLHLGLLSAALGCGLAERPRRARRDPRAGRPPRPAAGPATCPPAARGRRASPPPPPPPGGAWEAVRVPRRRQQREARGATEEPSPPSRALYFSGRGEQLRLRADLELPRDAFTLQVWLRAEGGQRSPAVITGLYDKCSYISRDRGWVVGIHTISDQDNKDPRYFFSLKTDRARQVTTINAHRSYLPGQWVYLAATYDGQFMKLYVNGAQVATSGEQVGGIFSPLTQKCKVLMLGGSALNHNYRGYIEHFSLWKVARTQREILSDMETHGAHTALPQLLLQENWDNVKHAWSPMKDGSSPKVEFSNAHGFLLDTSLEPPLCGQTLCDNTEVIASYNQLSSFRQPKVVRYRVVNLYEDDHKNPTVTREQVDFQHHQLAEAFKQYNISWELDVLEVSNSSLRRRLILANCDISKIGDENCDPECNHTLTGHDGGDCRHLRHPAFVKKQHNGVCDMDCNYERFNFDGGECCDPEITNVTQTCFDPDSPHRAYLDVNELKNILKLDGSTHLNIFFAKSSEEELAGVATWPWDKEALMHLGGIVLNPSFYGMPGHTHTMIHEIGHSLGLYHVFRGISEIQSCSDPCMETEPSFETGDLCNDTNPRKTVIEAQAVTNLMGPFNAS

SEQ ID NO: 912179 - protein, 553 aa, Homo sapiens
MIKERGEKLIANQEELGCIFQRWGEWSTHLEEESEKEKKKEVKGGSPKKGEEAKKVEAPRLPKLAAPGGGAGAKGGAGGTSDMRLWSWVLHLGLLSAALGCGLAERPRRARRDPRAGRPPRPAAGPATCPPAARGRRASPPPPPPPGGAWEAVRVPRRRQQREARGATEEPSPPSRALYFSGRGEQLRLRADLELPRDAFTLQVWLRAEGGQRSPAVITGLYDKCSYISRDRGWVVGIHTISDQDNKDPRYFFSLKTDRARQVTTINAHRSYLPGQWVYLAATYDGQFMKLYVNGAQVATSGEQVGGIFSPLTQKCKVLMLGGSALNHNYRGYIEHFSLWKVARTQREILSDMETHGAHTALPQLLLQENWDNVKHAWSPMKDGSSPKVEFSNAHGFLLDTSLEPPLCGQTLCDNTEVIASYNQLSSFRQPKVVRYRVVNLYEDDHKNPTVTREQVDFQHHQLAEAFKQYNISWELDVLEVSNSSLRRRLILANCDISKIGDENCDPECNHTLTGHDGGDCRHLRHPAFVKKQHNGVCDMDCNWYSGGILYNE

SEQ ID NO: 912180 - protein, 78 aa, Homo sapiens
TGPSVTVTCTEGKWNKQVACEPVDCSIPDHHQVYAASFSCPEGTTFGSQCSFQCRHPAQLKGIKNAFPSSAFLCLWET

SEQ ID NO: 912181 - protein, 1708 aa, Homo sapiens; identical to SEQ ID NO: 912166

SEQ ID NO: 912182 - protein, 1708 aa, Homo sapiens; identical to SEQ ID NO: 912166

SEQ ID NO: 912183 - protein, 1708 aa, Homo sapiens; identical to SEQ ID NO: 912166

SEQ ID NO: 912184 - protein, 1708 aa, Homo sapiens; identical to SEQ ID NO: 912166

SEQ ID NO: 912185 - protein, 1627 aa, Homo sapiens
MIKERGEKLIANQEELGCIFQRWGEWSTHLEEESEKEKKKEVKGGSPKKGEEAKKVEAPRLPKLAAPGGGAGAKGGAGGTSDMRLWSWVLHLGLLSAALGCGLAERPRRARRDPRAGRPPRPAAGPATCPPAARGRRASPPPPPPPGGAWEAVRVPRRRQQREARGATEEPSPPSRALYFSGRGEQLRLRADLELPRDAFTLQVWLRAEGGQRSPAVITGLYDKCSYISRDRGWVVGIHTISDQDNKDPRYFFSLKTDRARQVTTINAHRSYLPGQWVYLAATYDGQFMKLYVNGAQVATSGEQVGGIFSPLTQKCKVLMLGGSALNHNYRGYIEHFSLWKVARTQREILSDMETHGAHTALPQLLLQENWDNVKHAWSPMKDGSSPKVEFSNAHGFLLDTSLEPPLCGQTLCDNTEVIASYNQLSSFRQPKVVRYRVVNLYEDDHKNPTVTREQVDFQHHQLAEAFKQYNISWELDVLEVSNSSLRRRLILANCDISKIGDENCDPECNHTLTGHDGGDCRHLRHPAFVKKQHNGVCDMDCNYERFNFDGGECCDPEITNVTQTCFDPDSPHRAYLDVNELKNILKLDGSTHLNIFFAKSSEEELAGVATWPWDKEALMHLGGIVLNPSFYGMPGHTHTMIHEIGHSLGLYHVFRGISEIQSCSDPCMETEPSFETGDLCNDTNPAPKHKSCGDPGPGNDTCGFHSFFNTPYNNFMSYADDDCTDSFTPNQVARMHCYLDLVYQGWQPSRKPAPVALAPQVLGHTTDSVTLEWFPPIDGHFFERELGSACHLCLEGRILVQYASNASSPMPCSPSGHWSPREAEGHPDVEQPCKSSVRTWSPNSAVNPHTVPPACPEPQGCYLELEFLYPLVPESLTIWVTFVSTDWDSSGAVNDIKLLAVSGKNISLGPQNVFCDVPLTIRLWDVGEEVYGIQIYTLDEHLEIDAAMLTSTADTPLCLQCKPLKYKVVRDPPLQMDVASILHLNRKFVDMDLNLGSVYQYWVITISGTEESEPSPAVTYIHGSGYCGDGIIQKDQGEQCDDMNKINGDGCSLFCRQEVSFNCIDEPSRCYFHDGDGVCEEFEQKTSIKDCGVYTPQGFLDQWASNASVSHQDQQCPGWVIIGQPAASQVCRTKVIDLSEGISQHAWYPCTISYPYSQLAQTTFWLRAYFSQPMVAAAVIVHLVTDGTYYGDQKQETISVQLLDTKDQSHDLGLHVLSCRNNPLIIPVVHDLSQPFYHSQAVRVSFSSPLVAISGVALRSFDNFDPVTLSSCQRGETYSPAEQSCVHFACEKTDCPELAVENAYLNCSSSDRYHGAQCTVSCRTGYVLQIRRDDELIKSQTGPSVTVTCTEGKWNKQVACEPVDCSIPDHHQVYAASFSCPEGTTFGSQCSFQCRHPAQLKGNNSLLTCMEDGLWSFPEALCELMCLAPPPVPNADLQTARCRENKHKVGSFCKYKCKPGYHVPGSSRKSKKRAFKTQCTQDGSWQEGACVPVTCDPPPPKFHGLYQCTNGFQFNSECRIKCEDSDASQGLGSNVIHCRKDGTWNGSFHVCQEMQGQCSVPNELNSNLKLQCPDGYAIGSECATSCLDHNSESIILPMNVTVRDIPHWLNPTRVEVSDQGHLPTCS

SEQ ID NO: 912186 - protein, 1473 aa, Homo sapiens
MIKERGEKLIANQEELGCIFQRWGEWSTHLEEESEKEKKKEVKGGSPKKGEEAKKVEAPRLPKLAAPGGGAGAKGGAGGTSDMRLWSWVLHLGLLSAALGCGLAERPRRARRDPRAGRPPRPAAGPATCPPAARGRRASPPPPPPPGGAWEAVRVPRRRQQREARGATEEPSPPSRALYFSGRGEQLRLRADLELPRDAFTLQVWLRAEGGQRSPAVITGLYDKCSYISRDRGWVVGIHTISDQDNKDPRYFFSLKTDRARQVTTINAHRSYLPGQWVYLAATYDGQFMKLYVNGAQVATSGEQVGGIFSPLTQKCKVLMLGGSALNHNYRGYIEHFSLWKVARTQREILSDMETHGAHTALPQLLLQENWDNVKHAWSPMKDGSSPKVEFSNAHGFLLDTSLEPPLCGQTLCDNTEVIASYNQLSSFRQPKVVRYRVVNLYEDDHKNPTVTREQVDFQHHQLAEAFKQYNISWELDVLEVSNSSLRRRLILANCDISKIGDENCDPECNHTLTGHDGGDCRHLRHPAFVKKQHNGVCDMDCNYERFNFDGGECCDPEITNVTQTCFDPDSPHRAYLDVNELKNILKLDGSTHLNIFFAKSSEEELAGVATWPWDKEALMHLGGIVLNPSFYGMPGHTHTMIHEIGHSLGLYHVFRGISEIQSCSDPCMETEPSFETGDLCNDTNPAPKHKSCGDPGPGNDTCGFHSFFNTPYNNFMSYADDDCTDSFTPNQVARMHCYLDLVYQGWQPSRKPAPVALAPQVLGHTTDSVTLEWFPPIDGHFFERELGSACHLCLEGRILVQYASNASSPMPCSPSGHWSPREAEGHPDVEQPCKSSVRTWSPNSAVNPHTVPPACPEPQGCYLELEFLYPLVPESLTIWVTFVSTDWDSSGAVNDIKLLAVSGKNISLGPQNVFCDVPLTIRLWDVGEEVYGIQIYTLDEHLEIDAAMLTSTADTPLCLQCKPLKYKVVRDPPLQMDVASILHLNRKFVDMDLNLGSVYQYWVITISGTEESEPSPAVTYIHGSGYCGDGIIQKDQGEQCDDMNKINGDGCSLFCRQEVSFNCIDEPSRCYFHDGDGVCEEFEQKTSIKDCGVYTPQGFLDQWASNASVSHQDQQCPGWVIIGQPAASQVCRTKVIDLSEGISQHAWYPCTISYPYSQLAQTTFWLRAYFSQPMVAAAVIVHLVTDGTYYGDQKQETISVQLLDTKDQSHDLGLHVLSCRNNPLIIPVVHDLSQPFYHSQAVRVSFSSPLVAISGVALRSFDNFDPVTLSSCQRGETYSPAEQSCVHFACEKTDCPELAVENAYLNCSSSDRYHGAQCTVSCRTGYVLQIRRDDELIKSQTGPSVTVTCTEGKWNKQVACEPVDCSIPDHHQVYAASFSCPEGTTFGSQCSFQCRHPAQLKGNNSLLTCMEDGLWSFPEALCELMCLAPPPVPNADLQTARCRENKHKVGSFCKYKCKPGYHVPGSSRKSKK

SEQ ID NO: 912187 - protein, 130 aa, Homo sapiens
IGRPDFLCTEEPYQLPSNQSLSSFYLHSHHHLFSHYPAKQRFLEADLYLQTHRVNSALLNQDPPSLFHSDLLLTNLYLPRILGKRGYLIGGQPRAHMEGIFNRVFSNLSGGGSAQFGQCICSQFHFLPGN

SEQ ID NO: 912188 - protein, 1162 aa, Homo sapiens
MIKERGEKLIANQEELGCIFQRWGEWSTHLEEESEKEKKKEVKGGSPKKGEEAKKVEAPRLPKLAAPGGGAGAKGGAGGTSDMRLWSWVLHLGLLSAALGCGLAERPRRARRDPRAGRPPRPAAGPATCPPAARGRRASPPPPPPPGGAWEAVRVPRRRQQREARGATEEPSPPSRALYFSGRGEQLRLRADLELPRDAFTLQVWLRAEGGQRSPAVITGLYDKCSYISRDRGWVVGIHTISDQDNKDPRYFFSLKTDRARQVTTINAHRSYLPGQWVYLAATYDGQFMKLYVNGAQVATSGEQVGGIFSPLTQKCKVLMLGGSALNHNYRGYIEHFSLWKVARTQREILSDMETHGAHTALPQLLLQENWDNVKHAWSPMKDGSSPKVEFSNAHGFLLDTSLEPPLCGQTLCDNTEVIASYNQLSSFRQPKVVRYRVVNLYEDDHKNPTVTREQVDFQHHQLAEAFKQYNISWELDVLEVSNSSLRRRLILANCDISKIGDENCDPECNHTLTGHDGGDCRHLRHPAFVKKQHNGVCDMDCNYERFNFDGGECCDPEITNVTQTCFDPDSPHRAYLDVNELKNILKLDGSTHLNIFFAKSSEEELAGVATWPWDKEALMHLGGIVLNPSFYGMPGHTHTMIHEIGHSLGLYHVFRGISEIQSCSDPCMETEPSFETGDLCNDTNPAPKHKSCGDPGPGNDTCGFHSFFNTPYNNFMSYADDDCTDSFTPNQVARMHCYLDLVYQGWQPSRKPAPVALAPQVLGHTTDSVTLEWFPPIDGHFFERELGSACHLCLEGRILVQYASNASSPMPCSPSGHWSPREAEGHPDVEQPCKSSVRTWSPNSAVNPHTVPPACPEPQGCYLELEFLYPLVPESLTIWVTFVSTDWDSSGAVNDIKLLAVSGKNISLGPQNVFCDVPLTIRLWDVGEEVYGIQIYTLDEHLEIDAAMLTSTADTPLCLQCKPLKYKVVRDPPLQMDVASILHLNRKFVDMDLNLGSVYQYWVITISGTEESEPSPAVTYIHGSGYCGDGIIQKDQGEQCDDMNKINGDGCSLFCRQEVSFNCIDEPSRCYFHDGDGVCEEFEQKTSIKDCGVYTPQGFLDQWASNASVSHQDQQCPGWVIIGQPAASQVCRTKVIDLSEGISQHAWYPCTIKHQHEWDPL

SEQ ID NO: 912189 - protein, 1078 aa, Homo sapiens
MIKERGEKLIANQEELGCIFQRWGEWSTHLEEESEKEKKKEVKGGSPKKGEEAKKVEAPRLPKLAAPGGGAGAKGGAGGTSDMRLWSWVLHLGLLSAALGCGLAERPRRARRDPRAGRPPRPAAGPATCPPAARGRRASPPPPPPPGGAWEAVRVPRRRQQREARGATEEPSPPSRALYFSGRGEQLRLRADLELPRDAFTLQVWLRAEGGQRSPAVITGLYDKCSYISRDRGWVVGIHTISDQDNKDPRYFFSLKTDRARQVTTINAHRSYLPGQWVYLAATYDGQFMKLYVNGAQVATSGEQVGGIFSPLTQKCKVLMLGGSALNHNYRGYIEHFSLWKVARTQREILSDMETHGAHTALPQLLLQENWDNVKHAWSPMKDGSSPKVEFSNAHGFLLDTSLEPPLCGQTLCDNTEVIASYNQLSSFRQPKVVRYRVVNLYEDDHKNPTVTREQVDFQHHQLAEAFKQYNISWELDVLEVSNSSLRRRLILANCDISKIGDENCDPECNHTLTGHDGGDCRHLRHPAFVKKQHNGVCDMDCNYERFNFDGGECCDPEITNVTQTCFDPDSPHRAYLDVNELKNILKLDGSTHLNIFFAKSSEEELAGVATWPWDKEALMHLGGIVLNPSFYGMPGHTHTMIHEIGHSLGLYHVFRGISEIQSCSDPCMETEPSFETGDLCNDTNPAPKHKSCGDPGPGNDTCGFHSFFNTPYNNFMSYADDDCTDSFTPNQVARMHCYLDLVYQGWQPSRKPAPVALAPQVLGHTTDSVTLEWFPPIDGHFFERELGSACHLCLEGRILVQYASNASSPMPCSPSGHWSPREAEGHPDVEQPCKSSVRTWSPNSAVNPHTVPPACPEPQGCYLELEFLYPLVPESLTIWVTFVSTDWDSSGAVNDIKLLAVSGKNISLGPQNVFCDVPLTIRLWDVGEEVYGIQIYTLDEHLEIDAAMLTSTADTPLCLQCKPLKYKVVRDPPLQMDVASILHLNRKFVDMDLNLGSVYQYWVITISGTEESEPSPAVTYIHGSGYCGDGIIQKDQGEQCDDMNKINGDGCSLFCRQEVSFNCIGTSFSFLVAFMKK

SEQ ID NO: 912190 - protein, 908 aa, Homo sapiens
MIKERGEKLIANQEELGCIFQRWGEWSTHLEEESEKEKKKEVKGGSPKKGEEAKKVEAPRLPKLAAPGGGAGAKGGAGGTSDMRLWSWVLHLGLLSAALGCGLAERPRRARRDPRAGRPPRPAAGPATCPPAARGRRASPPPPPPPGGAWEAVRVPRRRQQREARGATEEPSPPSRALYFSGRGEQLRLRADLELPRDAFTLQVWLRAEGGQRSPAVITGLYDKCSYISRDRGWVVGIHTISDQDNKDPRYFFSLKTDRARQVTTINAHRSYLPGQWVYLAATYDGQFMKLYVNGAQVATSGEQVGGIFSPLTQKCKVLMLGGSALNHNYRGYIEHFSLWKVARTQREILSDMETHGAHTALPQLLLQENWDNVKHAWSPMKDGSSPKVEFSNAHGFLLDTSLEPPLCGQTLCDNTEVIASYNQLSSFRQPKVVRYRVVNLYEDDHKNPTVTREQVDFQHHQLAEAFKQYNISWELDVLEVSNSSLRRRLILANCDISKIGDENCDPECNHTLTGHDGGDCRHLRHPAFVKKQHNGVCDMDCNYERFNFDGGECCDPEITNVTQTCFDPDSPHRAYLDVNELKNILKLDGSTHLNIFFAKSSEEELAGVATWPWDKEALMHLGGIVLNPSFYGMPGHTHTMIHEIGHSLGLYHVFRGISEIQSCSDPCMETEPSFETGDLCNDTNPAPKHKSCGDPGPGNDTCGFHSFFNTPYNNFMSYADDDCTDSFTPNQVARMHCYLDLVYQGWQPSRKPAPVALAPQVLGHTTDSVTLEWFPPIDGHFFERELGSACHLCLEGRILVQYASNASSPMPCSPSGHWSPREAEGHPDVEQPCKSSVRTWSPNSAVNPHTVPPACPEPQGCYLELEFLYPLVPESDIWGLAHAGPMTACMCCMEKLGYSFGAMHNWR

SEQ ID NO: 912191 - protein, 1627 aa, Homo sapiens; identical to SEQ ID NO: 912163

SEQ ID NO: 912192 - protein, 1627 aa, Homo sapiens; identical to SEQ ID NO: 912163

SEQ ID NO: 912193 - protein, 1627 aa, Homo sapiens; identical to SEQ ID NO: 912163

SEQ ID NO: 912194 - protein, 2265 aa, Homo sapiens
MVSIDLHQAGRVDSQASITQDSDSIKKPEEIKQCNDAPVSVLQEDIVGSLKSTPENHPETPKKKSDPELSKSEMKQSESRLAESKPNENRLVETKSSENKLETKVETQTEELKQNESRTTECKQNESTIVEPKQNENRLSDTKPNDNKQNNGRSETTKSRPETPKQKGESRPETPKQKSDGHPETPKQKGDGRPETPKQKGESRPETPKQKNEGRPETPKHRHDNRRDSGKPSTEKKPEVSKHKQDTKSDSPRLKSERAEALKQRPDGRSVSESLRRDHDNKQKSDDRGESERHRGDQSRVRRPETLRSSSRNEHGIKSDSSKTDKLERKHRHESGDSRERPSSGEQKSRPDSPRVKQGDSNKSRSDKLGFKSPTSKDDKRTEGNKSKVDTNKAHPDNKAEFPSYLLGGRSGALKNFVIPKIKRDKDGNVTQETKKMEMKGEPKDKVEKIGLVEDLNKGAKPVVVLQKLSLDDVQKLIKDREDKSRSSLKPIKNKPSKSNKGSIDQSVLKELPPELLAEIESTMPLCERVKMNKRKRSTVNEKPKYAEISSDEDNDSDEAFESSRKRHKKDDDKAWEYEERDRRSSGDHRRSGHSHEGRRSSGGGRYRNRSPSDSDMEDYSPPPSLSEVARKMKKKEKQKKRKAYEPKLTPEEMMDSSTFKRFTASIENILDNLEDMDFTAFGDDDEIPQELLLGKHQLNELGSESAKIKAMGIMDKLSTDKTVKVLNILEKNIQDGSKLSTLLNHNNDTEEEERLWRDLIMERVTKSADACLTTINIMTSPNMPKAVYIEDVIERVIQYTKFHLQNTLYPQYDPVYRLDPHGGGLLSSKAKRAKCSTHKQRVIVMLYNKVCDIVSSLSELLEIQLLTDTTILQVSSMGITPFFVENVSELQLCAIKLVTAVFSRYEKHRQLILEEIFTSLARLPTSKRSLRNFRLNSSDMDGEPMYIQMVTALVLQLIQCVVHLPSSEKDSNAEEDSNKKIDQDVVITNSYETAMRTAQNFLSIFLKKCGSKQGEEDYRPLFENFVQDLLSTVNKPEWPAAELLLSLLGRLLVHQFSNKSTEMALRVASLDYLGTVAARLRKDAVTSKMDQGSIERILKQVSGGEDEIQQLQKALLDYLDENTETDPSLVFSRKFYIAQWFRDTTLETEKAMKSQKDEESSEGTHHAKEIETTGQIMHRAENRKKFLRSIIKTTPSQFSTLKMNSDTVDYDDACLIVRYLASMRPFAQSFDIYLTQILRVLGENAIAVRTKAMKCLSEVVAVDPSILARLDMQRGVHGRLMDNSTSVREAAVELLGRFVLCRPQLAEQYYDMLIERILDTGISVRKRVIKILRDICIEQPTFPKITEMCVKMIRRVNDEEGIKKLVNETFQKLWFTPTPHNDKEAMTRKILNITDVVAACRDTGYDWFEQLLQNLLKSEEDSSYKPVKKACTQLVDNLVEHILKYEESLADSDNKGVNSGRLVACITTLFLFSKIRPQLMVKHAMTMQPYLTTKCSTQNDFMVICNVAKILELVVPLMEHPSETFLATIEEDLMKLIIKYGMTVVQHCVSCLGAVVNKVTQNFKFVWACFNRYYGAISKLKSQHQEDPNNTSLLTNKPALLRSLFTVGALCRHFDFDLEDFKGNSKVNIKDKVLELLMYFTKHSDEEVQTKAIIGLGFAFIQHPSLMFEQEVKNLYNNILSDKNSSVNLKIQVLKNLQTYLQEEDTRMQQADRDWKKVAKQEDLKEMGDVSSGMSSSIMQLYLKQVLEAFFHTQSSVRHFALNVIALTLNQGLIHPVQCVPYLIAMGTDPEPAMRNKADQQLVEIDKKYAGFIHMKAVAGMKMSYQVQQAINTCLKDPVRGFRQDESSSALCSHLYSMIRGNRQHRRAFLISLLNLFDDTAKTDVTMLLYIADNLACFPYQTQEEPLFIMHHIDITLSVSGSNLLQSFKESMVKDKRKERKSSPSKENESSDSEEEVSRPRKSRKRVDSDSDSDSEDDINSVMKCLPENSAPLIEFANVSQGILLLLMLKQHLKNLCGFSDSKIQKYSPSESAKVYDKAINRKTGVHFHPKQTLDFLRSDMANSKITEEVKRSIVKQYLDFKLLMEHLDPDEEEEEGEVSASTNARNKAITSLLGGGSPKNNTAAETEDDESDGEDRGGGTSGSLRRSKRNSDSTELAAQMNESVDVMDVIAICCPKYKDRPQIARVVQKTSSGFSVQWMAGSYSGSWTEAKRRDGRKLVPWVDTIKESDIIYKKIALTSANKLTNKVVQTLRSLYAAKDGTSS

SEQ ID NO: 912195 - protein, 2158 aa, Homo sapiens
MVSIDLHQAGRVDSQASITQDSDSIKKPEEIKQCNDAPVSVLQEDIVGSLKSTPENHPETPKKKSDPELSKSEMKQSESRLAESKPNENRLVETKSSENKLETKVETQTEELKQNESRTTECKQNESTIVEPKQNENRLSDTKPNDNKQNNGRSETTKSRPETPKQKGESRPETPKQKSDGHPETPKQKGDGRPETPKQKGESRPETPKQKNEGRPETPKHRHDNRRDSGKPSTEKKPEVSKHKQDTKSDSPRLKSERAEALKQRPDGRSVSESLRRDHDNKQKSDDRGESERHRGDQSRVRRPETLRSSSRNEHGIKSDSSKTDKLERKHRHESGDSRERPSSGEQKSRPDSPRVKQGDSNKSRSDKLGFKSPTSKDDKRTEGNKSKVDTNKAHPDNKAEFPSYLLGGRSGALKNFVIPKIKRDKDGNVTQETKKMEMKGEPKDKVEKIGLVEDLNKGAKPVVVLQKLSLDDVQKLIKDREDKSRSSLKPIKNKPSKSNKGSIDQSVLKELPPELLAEIESTMPLCERVKMNKRKRSTVNEKPKYAEISSDEDNDSDEAFESSRKRHKKDDDKAWEYEERDRRSSGDHRRSGHSHEGRRSSGGGRYRNRSPSDSDMEDYSPPPSLSEVARKMKKKEKQKKRKAYEPKLTPEEMMDSSTFKRFTASIENILDNLEDMDFTAFGDDDEIPQELLLGKHQLNELGSESAKIKAMGIMDKLSTDKTVKVLNILEKNIQDGSKLSTLLNHNNDTEEEERLWRDLIMERVTKSADACLTTINIMTSPNMPKAVYIEDVIERVIQYTKFHLQNTLYPQYDPVYRLDPHGGGLLSSKAKRAKCSTHKQRVIVMLYNKVCDIVSSLSELLEIQLLTDTTILQVSSMGITPFFVENVSELQLCAIKLVTAVFSRYEKHRQLILEEIFTSLARLPTSKRSLRNFRLNSSDMDGEPMYIQMVTALVLQLIQCVVHLPSSEKDSNAEEDSNKKIDQDVVITNSYETAMRTAQNFLSIFLKKCGSKQGEEDYRPLFENFVQDLLSTVNKPEWPAAELLLSLLGRLLVHQFSNKSTEMALRVASLDYLGTVAARLRKDAVTSKMDQGSIERILKQVSGGEDEIQQLQKALLDYLDENTETDPSLVFSRKFYIAQWFRDTTLETEKAMKSQKDEESSEGTHHAKEIETTGQIMHRAENRKKFLRSIIKTTPSQFSTLKMNSDTVDYDDACLIVRYLASMRPFAQSFDIYLTQILRVLGENAIAVRTKAMKCLSEVVAVDPSILARLDMQRGVHGRLMDNSTSVREAAVELLGRFVLCRPQLAEQYYDMLIERILDTGISVRKRVIKILRDICIEQPTFPKITEMCVKMIRRVNDEEGIKKLVNETFQKLWFTPTPHNDKEAMTRKILNITDVVAACRDTGYDWFEQLLQNLLKSEEDSSYKPVKKACTQLVDNLVEHILKYEESLADSDNKGVNSGRLVACITTLFLFSKIRPQLMVKHAMTMQPYLTTKCSTQNDFMVICNVAKILELVVPLMEHPSETFLATIEEDLMKLIIKYGMTVVQHCVSCLGAVVNKVTQNFKFVWACFNRYYGAISKLKSQHQEDPNNTSLLTNKPALLRSLFTVGALCRHFDFDLEDFKGNSKVNIKDKVLELLMYFTKHSDEEVQTKAIIGLGFAFIQHPSLMFEQEVKNLYNNILSDKNSSVNLKIQVLKNLQTYLQEEDTRMQQADRDWKKVAKQEDLKEMGDVSSGMSSSIMQLYLKQVLEAFFHTQSSVRHFALNVIALTLNQGLIHPVQCVPYLIAMGTDPEPAMRNKADQQLVEIDKKYAGFIHMKAVAGMKMSYQVQQAINTCLKDPVRGFRQDESSSALCSHLYSMIRGNRQHRRAFLISLLNLFDDTAKTDVTMLLYIADNLACFPYQTQEEPLFIMHHIDITLSVSGSNLLQSFKESMVKDKRKERKSSPSKENESSDSEEEVSRPRKSRKRVDSDSDSDSEDDINSVMKCLPENSAPLIEFANVSQGILLLLMLKQHLKNLCGFSDSKIQKYSPSESAKVYDKAINRKTGVHFHPKQTLDFLRSDMANSKITEEVKRSIVKQYLDFKLLMEHLDPDEEEEEGEVSASTNARNKAITSLLGGGSPKNNTAAETEDDESDGEDRGGGTSGVRRRRSQRISQRIT

SEQ ID NO: 912196 - protein, 2158 aa, Homo sapiens; identical to SEQ ID NO: 912195

SEQ ID NO: 912197 - protein, 2494 aa, Homo sapiens
ASVSSPIVAGGLRNIHDNKVSGPLSGNSANHHADNPRHGSSEDYLHMVHRLSSDDGDSSTMRNAASFPLRSPQPVCSPAGSEGTPKGSRPPLILQSQSLPCSSPRDVPPDILLDSPERKQKKQKKMKLGKDEKEQSEKAAMYDIISSPSKDSTKLTLRLSRVRSSDMDQQEDMISGVENSNVSENDIPFNVQYPGQTSKTPITPQDINRPLNAAQCLSQQEQTAFLPANQVPVLQQNTSVAAKQPQTSVVQNQQQISQQGPIYDEVELDALAEIERIERESAIERERFSKEVQDKDKPLKKRKQDSYPQEAGGATGGNRPASQETGSTGNGSRPALMVSIDLHQAGRVDSQASITQDSDSIKKPEEIKQCNDAPVSVLQEDIVGSLKSTPENHPETPKKKSDPELSKSEMKQSESRLAESKPNENRLVETKSSENKLETKVETQTEELKQNESRTTECKQNESTIVEPKQNENRLSDTKPNDNKQNNGRSETTKSRPETPKQKGESRPETPKQKSDGHPETPKQKGDGRPETPKQKGESRPETPKQKNEGRPETPKHRHDNRRDSGKPSTEKKPEVSKHKQDTKSDSPRLKSERAEALKQRPDGRSVSESLRRDHDNKQKSDDRGESERHRGDQSRVRRPETLRSSSRNEHGIKSDSSKTDKLERKHRHESGDSRERPSSGEQKSRPDSPRVKQGDSNKSRSDKLGFKSPTSKDDKRTEGNKSKVDTNKAHPDNKAEFPSYLLGGRSGALKNFVIPKIKRDKDGNVTQETKKMEMKGEPKDKVEKIGLVEDLNKGAKPVVVLQKLSLDDVQKLIKDREDKSRSSLKPIKNKPSKSNKGSIDQSVLKELPPELLAEIESTMPLCERVKMNKRKRSTVNEKPKYAEISSDEDNDSDEAFESSRKRHKKDDDKAWEYEERDRRSSGDHRRSGHSHEGRRSSGGGRYRNRSPSDSDMEDYSPPPSLSEVARKMKKKEKQKKRKAYEPKLTPEEMMDSSTFKRFTASIENILDNLEDMDFTAFGDDDEIPQELLLGKHQLNELGSESAKIKAMGIMDKLSTDKTVKVLNILEKNIQDGSKLSTLLNHNNDTEEEERLWRDLIMERVTKSADACLTTINIMTSPNMPKAVYIEDVIERVIQYTKFHLQNTLYPQYDPVYRLDPHGGGLLSSKAKRAKCSTHKQRVIVMLYNKVCDIVSSLSELLEIQLLTDTTILQVSSMGITPFFVENVSELQLCAIKLVTAVFSRYEKHRQLILEEIFTSLARLPTSKRSLRNFRLNSSDMDGEPMYIQMVTALVLQLIQCVVHLPSSEKDSNAEEDSNKKIDQDVVITNSYETAMRTAQNFLSIFLKKCGSKQGEEDYRPLFENFVQDLLSTVNKPEWPAAELLLSLLGRLLVHQFSNKSTEMALRVASLDYLGTVAARLRKDAVTSKMDQGSIERILKQVSGGEDEIQQLQKALLDYLDENTETDPSLVFSRKFYIAQWFRDTTLETEKAMKSQKDEESSEGTHHAKEIETTGQIMHRAENRKKFLRSIIKTTPSQFSTLKMNSDTVDYDDACLIVRYLASMRPFAQSFDIYLTQILRVLGENAIAVRTKAMKCLSEVVAVDPSILARLDMQRGVHGRLMDNSTSVREAAVELLGRFVLCRPQLAEQYYDMLIERILDTGISVRKRVIKILRDICIEQPTFPKITEMCVKMIRRVNDEEGIKKLVNETFQKLWFTPTPHNDKEAMTRKILNITDVVAACRDTGYDWFEQLLQNLLKSEEDSSYKPVKKACTQLVDNLVEHILKYEESLADSDNKGVNSGRLVACITTLFLFSKIRPQLMVKHAMTMQPYLTTKCSTQNDFMVICNVAKILELVVPLMEHPSETFLATIEEDLMKLIIKYGMTVVQHCVSCLGAVVNKVTQNFKFVWACFNRYYGAISKLKSQHQEDPNNTSLLTNKPALLRSLFTVGALCRHFDFDLEDFKGNSKVNIKDKVLELLMYFTKHSDEEVQTKAIIGLGFAFIQHPSLMFEQEVKNLYNNILSDKNSSVNLKIQVLKNLQTYLQEEDTRMQQADRDWKKVAKQEDLKEMGDVSSGMSSSIMQLYLKQVLEAFFHTQSSVRHFALNVIALTLNQGLIHPVQCVPYLIAMGTDPEPAMRNKADQQLVEIDKKYAGFIHMKAVAGMKMSYQVQQAINTCLKDPVRGFRQDESSSALCSHLYSMIRGNRQHRRAFLISLLNLFDDTAKTDVTMLLYIADNLACFPYQTQEEPLFIMHHIDITLSVSGSNLLQSFKESMVKDKRKERKSSPSKENESSDSEEEVSRPRKSRKRVDSDSDSDSEDDINSVMKCLPENSAPLIEFANVSQGILLLLMLKQHLKNLCGFSDSKIQKYSPSESAKVYDKAINRKTGVHFHPKQTLDFLRSDMANSKITEEVKRSIVKQYLDFKLLMEHLDPDEEEEEGEVSASTNARNKAITSLLGGGSPKNNTAAETEDDESDGEDRGGGTSGVRRRRSQRISQRIT

SEQ ID NO: 912198 - protein, 1006 aa, Homo sapiens
MKSQKDEESSEGTHHAKEIETTGQIMHRAENRKKFLRSIIKTTPSQFSTLKMNSDTVDYDDACLIVRYLASMRPFAQSFDIYLTQILRVLGENAIAVRTKAMKCLSEVVAVDPSILARLDMQRGVHGRLMDNSTSVREAAVELLGRFVLCRPQLAEQYYDMLIERILDTGISVRKRVIKILRDICIEQPTFPKITEMCVKMIRRVNDEEGIKKLVNETFQKLWFTPTPHNDKEAMTRKILNITDVVAACRDTGYDWFEQLLQNLLKSEEDSSYKPVKKACTQLVDNLVEHILKYEESLADSDNKGVNSGRLVACITTLFLFSKIRPQLMVKHAMTMQPYLTTKCSTQNDFMVICNVAKILELVVPLMEHPSETFLATIEEDLMKLIIKYGMTVVQHCVSCLGAVVNKVTQNFKFVWACFNRYYGAISKLKSQHQEDPNNTSLLTNKPALLRSLFTVGALCRHFDFDLEDFKGNSKVNIKDKVLELLMYFTKHSDEEVQTKAIIGLGFAFIQHPSLMFEQEVKNLYNNILSDKNSSVNLKIQVLKNLQTYLQEEDTRMQQADRDWKKVAKQEDLKEMGDVSSGMSSSIMQLYLKQVLEAFFHTQSSVRHFALNVIALTLNQGLIHPVQCVPYLIAMGTDPEPAMRNKADQQLVEIDKKYAGFIHMKAVAGMKMSYQVQQAINTCLKDPVRGFRQDESSSALCSHLYSMIRGNRQHRRAFLISLLNLFDDTAKTDVTMLLYIADNLACFPYQTQEEPLFIMHHIDITLSVSGSNLLQSFKESMVKDKRKERKSSPSKENESSDSEEEVSRPRKSRKRVDSDSDSDSEDDINSVMKCLPENSAPLIEFANVSQGILLLLMLKQHLKNLCGFSDSKIQKYSPSESAKVYDKAINRKTGVHFHPKQTLDFLRSDMANSKITEEVKRSIVKQYLDFKLLMEHLDPDEEEEEGEVSASTNARNKAITSLLGGGSPKNNTAAETEDDESDGEDRGGGTSGVRRRRSQRISQRIT

SEQ ID NO: 912199 - protein, 2601 aa, Homo sapiens
ASVSSPIVAGGLRNIHDNKVSGPLSGNSANHHADNPRHGSSEDYLHMVHRLSSDDGDSSTMRNAASFPLRSPQPVCSPAGSEGTPKGSRPPLILQSQSLPCSSPRDVPPDILLDSPERKQKKQKKMKLGKDEKEQSEKAAMYDIISSPSKDSTKLTLRLSRVRSSDMDQQEDMISGVENSNVSENDIPFNVQYPGQTSKTPITPQDINRPLNAAQCLSQQEQTAFLPANQVPVLQQNTSVAAKQPQTSVVQNQQQISQQGPIYDEVELDALAEIERIERESAIERERFSKEVQDKDKPLKKRKQDSYPQEAGGATGGNRPASQETGSTGNGSRPALMVSIDLHQAGRVDSQASITQDSDSIKKPEEIKQCNDAPVSVLQEDIVGSLKSTPENHPETPKKKSDPELSKSEMKQSESRLAESKPNENRLVETKSSENKLETKVETQTEELKQNESRTTECKQNESTIVEPKQNENRLSDTKPNDNKQNNGRSETTKSRPETPKQKGESRPETPKQKSDGHPETPKQKGDGRPETPKQKGESRPETPKQKNEGRPETPKHRHDNRRDSGKPSTEKKPEVSKHKQDTKSDSPRLKSERAEALKQRPDGRSVSESLRRDHDNKQKSDDRGESERHRGDQSRVRRPETLRSSSRNEHGIKSDSSKTDKLERKHRHESGDSRERPSSGEQKSRPDSPRVKQGDSNKSRSDKLGFKSPTSKDDKRTEGNKSKVDTNKAHPDNKAEFPSYLLGGRSGALKNFVIPKIKRDKDGNVTQETKKMEMKGEPKDKVEKIGLVEDLNKGAKPVVVLQKLSLDDVQKLIKDREDKSRSSLKPIKNKPSKSNKGSIDQSVLKELPPELLAEIESTMPLCERVKMNKRKRSTVNEKPKYAEISSDEDNDSDEAFESSRKRHKKDDDKAWEYEERDRRSSGDHRRSGHSHEGRRSSGGGRYRNRSPSDSDMEDYSPPPSLSEVARKMKKKEKQKKRKAYEPKLTPEEMMDSSTFKRFTASIENILDNLEDMDFTAFGDDDEIPQELLLGKHQLNELGSESAKIKAMGIMDKLSTDKTVKVLNILEKNIQDGSKLSTLLNHNNDTEEEERLWRDLIMERVTKSADACLTTINIMTSPNMPKAVYIEDVIERVIQYTKFHLQNTLYPQYDPVYRLDPHGGGLLSSKAKRAKCSTHKQRVIVMLYNKVCDIVSSLSELLEIQLLTDTTILQVSSMGITPFFVENVSELQLCAIKLVTAVFSRYEKHRQLILEEIFTSLARLPTSKRSLRNFRLNSSDMDGEPMYIQMVTALVLQLIQCVVHLPSSEKDSNAEEDSNKKIDQDVVITNSYETAMRTAQNFLSIFLKKCGSKQGEEDYRPLFENFVQDLLSTVNKPEWPAAELLLSLLGRLLVHQFSNKSTEMALRVASLDYLGTVAARLRKDAVTSKMDQGSIERILKQVSGGEDEIQQLQKALLDYLDENTETDPSLVFSRKFYIAQWFRDTTLETEKAMKSQKDEESSEGTHHAKEIETTGQIMHRAENRKKFLRSIIKTTPSQFSTLKMNSDTVDYDDACLIVRYLASMRPFAQSFDIYLTQILRVLGENAIAVRTKAMKCLSEVVAVDPSILARLDMQRGVHGRLMDNSTSVREAAVELLGRFVLCRPQLAEQYYDMLIERILDTGISVRKRVIKILRDICIEQPTFPKITEMCVKMIRRVNDEEGIKKLVNETFQKLWFTPTPHNDKEAMTRKILNITDVVAACRDTGYDWFEQLLQNLLKSEEDSSYKPVKKACTQLVDNLVEHILKYEESLADSDNKGVNSGRLVACITTLFLFSKIRPQLMVKHAMTMQPYLTTKCSTQNDFMVICNVAKILELVVPLMEHPSETFLATIEEDLMKLIIKYGMTVVQHCVSCLGAVVNKVTQNFKFVWACFNRYYGAISKLKSQHQEDPNNTSLLTNKPALLRSLFTVGALCRHFDFDLEDFKGNSKVNIKDKVLELLMYFTKHSDEEVQTKAIIGLGFAFIQHPSLMFEQEVKNLYNNILSDKNSSVNLKIQVLKNLQTYLQEEDTRMQQADRDWKKVAKQEDLKEMGDVSSGMSSSIMQLYLKQVLEAFFHTQSSVRHFALNVIALTLNQGLIHPVQCVPYLIAMGTDPEPAMRNKADQQLVEIDKKYAGFIHMKAVAGMKMSYQVQQAINTCLKDPVRGFRQDESSSALCSHLYSMIRGNRQHRRAFLISLLNLFDDTAKTDVTMLLYIADNLACFPYQTQEEPLFIMHHIDITLSVSGSNLLQSFKESMVKDKRKERKSSPSKENESSDSEEEVSRPRKSRKRVDSDSDSDSEDDINSVMKCLPENSAPLIEFANVSQGILLLLMLKQHLKNLCGFSDSKIQKYSPSESAKVYDKAINRKTGVHFHPKQTLDFLRSDMANSKITEEVKRSIVKQYLDFKLLMEHLDPDEEEEEGEVSASTNARNKAITSLLGGGSPKNNTAAETEDDESDGEDRGGGTSGSLRRSKRNSDSTELAAQMNESVDVMDVIAICCPKYKDRPQIARVVQKTSSGFSVQWMAGSYSGSWTEAKRRDGRKLVPWVDTIKESDIIYKKIALTSANKLTNKVVQTLRSLYAAKDGTSS

SEQ ID NO: 912200 - protein, 2422 aa, Homo sapiens
ASVSSPIVAGGLRNIHDNKVSGPLSGNSANHHADNPRHGSSEDYLHMVHRLSSDDGDSSTMRNAASFPLRSPQPVCSPAGSEGTPKGSRPPLILQSQSLPCSSPRDVPPDILLDSPERKQKKQKKMKLGKDEKEQSEKAAMYDIISSPSKDSTKLTLRLSRVRSSDMDQQEDMISGVENSNVSENDIPFNVQYPGQTSKTPITPQDINRPLNAAQCLSQQEQTAFLPANQVPVLQQNTSVAAKQPQTSVVQNQQQISQQGPIYDEVELDALAEIERIERESAIERERFSKEVQDKDKPLKKRKQDSYPQEAGGATGGNRPASQETGSTGNGSRPALMVSIDLHQAGRVDSQASITQDSDSIKKPEEIKQCNDAPVSVLQEDIVGSLKSTPENHPETPKKKSDPELSKSEMKQSESRLAESKPNENRLVETKSSENKLETKVETQTEELKQNESRTTECKQNESTIVEPKQNENRLSDTKPNDNKQNNGRSETTKSRPETPKQKGESRPETPKQKSDGHPETPKQKGDGRPETPKQKGESRPETPKQKNEGRPETPKHRHDNRRDSGKPSTEKKPEVSKHKQDTKSDSPRLKSERAEALKQRPDGRSVSESLRRDHDNKQKSDDRGESERHRGDQSRVRRPETLRSSSRNEHGIKSDSSKTDKLERKHRHESGDSRERPSSGEQKSRPDSPRVKQGDSNKSRSDKLGFKSPTSKDDKRTEGNKSKVDTNKAHPDNKAEFPSYLLGGRSGALKNFVIPKIKRDKDGNVTQETKKMEMKGEPKDKVEKIGLVEDLNKGAKPVVVLQKLSLDDVQKLIKDREDKSRSSLKPIKNKPSKSNKGSIDQSVLKELPPELLAEIESTMPLCERVKMNKRKRSTVNEKPKYAEISSDEDNDSDEAFESSRKRHKKDDDKAWEYEERDRRSSGDHRRSGHSHEGRRSSGGGRYRNRSPSDSDMEDYSPPPSLSEVARKMKKKEKQKKRKAYEPKLTPEEMMDSSTFKRFTASIENILDNLEDMDFTAFGDDDEIPQELLLGKHQLNELGSESAKIKAMGIMDKLSTDKTVKVLNILEKNIQDGSKLSTLLNHNNDTEEEERLWRDLIMERVTKSADACLTTINIMTSPNMPKAVYIEDVIERVIQYTKFHLQNTLYPQYDPVYRLDPHGGGLLSSKAKRAKCSTHKQRVIVMLYNKVCDIVSSLSELLEIQLLTDTTILQVSSMGITPFFVENVSELQLCAIKLVTAVFSRYEKHRQLILEEIFTSLARLPTSKRSLRNFRLNSSDMDGEPMYIQMVTALVLQLIQCVVHLPSSEKDSNAEEDSNKKIDQDVVITNSYETAMRTAQNFLSIFLKKCGSKQGEEDYRPLFENFVQDLLSTVNKPEWPAAELLLSLLGRLLVHQFSNKSTEMALRVASLDYLGTVAARLRKDAVTSKMDQGSIERILKQVSGGEDEIQQLQKALLDYLDENTETDPSLVFSRKFYIAQWFRDTTLETEKAMKSQKDEESSEGTHHAKEIETTGQIMHRAENRKKFLRSIIKTTPSQFSTLKMNSDTVDYDDACLIVRYLASMRPFAQSFDIYLTQILRVLGENAIAVRTKAMKCLSEVVAVDPSILARLDMQRGVHGRLMDNSTSVREAAVELLGRFVLCRPQLAEQYYDMLIERILDTGISVRKRVIKILRDICIEQPTFPKITEMCVKMIRRVNDEEGIKKLVNETFQKLWFTPTPHNDKEAMTRKILNITDVVAACRDTGYDWFEQLLQNLLKSEEDSSYKPVKKACTQLVDNLVEHILKYEESLADSDNKGVNSGRLVACITTLFLFSKIRPQLMVKHAMTMQPYLTTKCSTQNDFMVICNVAKILELVVPLMEHPSETFLATIEEDLMKLIIKYGMTVVQHCVSCLGAVVNKVTQNFKFVWACFNRYYGAISKLKSQHQEDPNNTSLLTNKPALLRSLFTVGALCRHFDFDLEDFKGNSKVNIKDKVLELLMYFTKHSDEEVQTKAIIGLGFAFIQHPSLMFEQEVKNLYNNILSDKNSSVNLKIQVLKNLQTYLQEEDTRMQQADRDWKKVAKQEDLKEMGDVSSGMSSSIMQLYLKQVLEAFFHTQSSVRHFALNVIALTLNQGLIHPVQCVPYLIAMGTDPEPAMRNKADQQLVEIDKKYAGFIHMKAVAGMKMSYQVQQAINTCLKDPVRGFRQDESSSALCSHLYSMIRGNRQHRRAFLISLLNLFDDTAKTDVTMLLYIADNLACFPYQTQEEPLFIMHHIDITLSVSGSNLLQSFKESMVKDKRKERKSSPSKENESSDSEEEVSRPRKSRKRVDSDSDSDSEDDINSVMKCLPENSAPLIEFANVSQGILLLLMLKQHLKNLCGFSDSSNFSWNIWTLMKKKKKGRFQLAQMLGTKQLPHCLEEAALKIIQQQRQKMMKVMGRIEEEALQG

SEQ ID NO: 912201 - protein, 271 aa, Homo sapiens [sequence omitted]

SEQ ID NO: 912202 - protein, 1847 aa, Homo sapiens
ASVSSPIVAGGLRNIHDNKVSGPLSGNSANHHADNPRHGSSEDYLHMVHRLSSDDGDSSTMRNAASFPLRSPQPVCSPAGSEGTPKGSRPPLILQSQSLPCSSPRDVPPDILLDSPERKQKKQKKMKLGKDEKEQSEKAAMYDIISSPSKDSTKLTLRLSRVRSSDMDQQEDMISGVENSNVSENDIPFNVQYPGQTSKTPITPQDINRPLNAAQCLSQQEQTAFLPANQVPVLQQNTSVAAKQPQTSVVQNQQQISQQGPIYDEVELDALAEIERIERESAIERERFSKEVQDKDKPLKKRKQDSYPQEAGGATGGNRPASQETGSTGNGSRPALMVSIDLHQAGRVDSQASITQDSDSIKKPEEIKQCNDAPVSVLQEDIVGSLKSTPENHPETPKKKSDPELSKSEMKQSESRLAESKPNENRLVETKSSENKLETKVETQTEELKQNESRTTECKQNESTIVEPKQNENRLSDTKPNDNKQNNGRSETTKSRPETPKQKGESRPETPKQKSDGHPETPKQKGDGRPETPKQKGESRPETPKQKNEGRPETPKHRHDNRRDSGKPSTEKKPEVSKHKQDTKSDSPRLKSERAEALKQRPDGRSVSESLRRDHDNKQKSDDRGESERHRGDQSRVRRPETLRSSSRNEHGIKSDSSKTDKLERKHRHESGDSRERPSSGEQKSRPDSPRVKQGDSNKSRSDKLGFKSPTSKDDKRTEGNKSKVDTNKAHPDNKAEFPSYLLGGRSGALKNFVIPKIKRDKDGNVTQETKKMEMKGEPKDKVEKIGLVEDLNKGAKPVVVLQKLSLDDVQKLIKDREDKSRSSLKPIKNKPSKSNKGSIDQSVLKELPPELLAEIESTMPLCERVKMNKRKRSTVNEKPKYAEISSDEDNDSDEAFESSRKRHKKDDDKAWEYEERDRRSSGDHRRSGHSHEGRRSSGGGRYRNRSPSDSDMEDYSPPPSLSEVARKMKKKEKQKKRKAYEPKLTPEEMMDSSTFKRFTASIENILDNLEDMDFTAFGDDDEIPQELLLGKHQLNELGSESAKIKAMGIMDKLSTDKTVKVLNILEKNIQDGSKLSTLLNHNNDTEEEERLWRDLIMERVTKSADACLTTINIMTSPNMPKAVYIEDVIERVIQYTKFHLQNTLYPQYDPVYRLDPHGGGLLSSKAKRAKCSTHKQRVIVMLYNKVCDIVSSLSELLEIQLLTDTTILQVSSMGITPFFVENVSELQLCAIKLVTAVFSRYEKHRQLILEEIFTSLARLPTSKRSLRNFRLNSSDMDGEPMYIQMVTALVLQLIQCVVHLPSSEKDSNAEEDSNKKIDQDVVITNSYETAMRTAQNFLSIFLKKCGSKQGEEDYRPLFENFVQDLLSTVNKPEWPAAELLLSLLGRLLVHQFSNKSTEMALRVASLDYLGTVAARLRKDAVTSKMDQGSIERILKQVSGGEDEIQQLQKALLDYLDENTETDPSLVFSRKFYIAQWFRDTTLETEKAMKSQKDEESSEGTHHAKEIETTGQIMHRAENRKKFLRSIIKTTPSQFSTLKMNSDTVDYDDACLIVRYLASMRPFAQSFDIYLTQILRVLGENAIAVRTKAMKCLSEVVAVDPSILARLDMQRGVHGRLMDNSTSVREAAVELLGRFVLCRPQLAEQYYDMLIERILDTGISVRKRVIKILRDICIEQPTFPKITEMCVKMIRRVNDEEGIKKLVNETFQKLWFTPTPHNDKEAMTRKILNITDVVAACRDTGYDWFEQLLQNLLKSEEDSSYKPVKKACTQLVDNLVEHILKYEESLADSDNKGVNSGRLVACITTLFLFSKIRPQLMVKHAMTMQPYLTTKCSVFTYFLWITTTNNF

SEQ ID NO: 912203 - protein, 898 aa, Homo sapiens
ASVSSPIVAGGLRNIHDNKVSGPLSGNSANHHADNPRHGSSEDYLHMVHRLSSDDGDSSTMRNAASFPLRSPQPVCSPAGSEGTPKGSRPPLILQSQSLPCSSPRDVPPDILLDSPERKQKKQKKMKLGKDEKEQSEKAAMYDIISSPSKDSTKLTLRLSRVRSSDMDQQEDMISGVENSNVSENDIPFNVQYPGQTSKTPITPQDINRPLNAAQCLSQQEQTAFLPANQVPVLQQNTSVAAKQPQTSVVQNQQQISQQGPIYDEVELDALAEIERIERESAIERERFSKEVQDKDKPLKKRKQDSYPQEAGGATGGNRPASQETGSTGNGSRPALMVSIDLHQAGRVDSQASITQDSDSIKKPEEIKQCNDAPVSVLQEDIVGSLKSTPENHPETPKKKSDPELSKSEMKQSESRLAESKPNENRLVETKSSENKLETKVETQTEELKQNESRTTECKQNESTIVEPKQNENRLSDTKPNDNKQNNGRSETTKSRPETPKQKGESRPETPKQKSDGHPETPKQKGDGRPETPKQKGESRPETPKQKNEGRPETPKHRHDNRRDSGKPSTEKKPEVSKHKQDTKSDSPRLKSERAEALKQRPDGRSVSESLRRDHDNKQKSDDRGESERHRGDQSRVRRPETLRSSSRNEHGIKSDSSKTDKLERKHRHESGDSRERPSSGEQKSRPDSPRVKQGDSNKSRSDKLGFKSPTSKDDKRTEGNKSKVDTNKAHPDNKAEFPSYLLGGRSGALKNFVIPKIKRDKDGNVTQETKKMEMKGEPKDKVEKIGLVEDLNKGAKPVVVLQKLSLDDVQKLIKDREDKSRSSLKPIKNKPSKSNKGSIDQSVLKELPPELLAEIESTMPLCERVKMNKRKRSTVNEKPKYAEISSDEDNDSDEAFE

SEQ ID NO: 912204 - protein, 69 aa, Homo sapiens
SVLKELPPELLAEIESTMPLCERVKMNKRKRSTVNEKPKYAEISSDEDNDSDEAFECKYHRTLCYYFRV

SEQ ID NO: 912205 - protein, 2158 aa, Homo sapiens; identical to SEQ ID NO: 912195

SEQ ID NO: 912206 - protein, 2158 aa, Homo sapiens; identical to SEQ ID NO: 912195

SEQ ID NO: 912207 - protein, 1720 aa, Homo sapiens
MKGEPKDKVEKIGLVEDLNKGAKPVVVLQKLSLDDVQKLIKDREDKSRSSLKPIKNKPSKSNKGSIDQSVLKELPPELLAEIESTMPLCERVKMNKRKRSTVNEKPKYAEISSDEDNDSDEAFESSRKRHKKDDDKAWEYEERDRRSSGDHRRSGHSHEGRRSSGGGRYRNRSPSDSDMEDYSPPPSLSEVARKMKKKEKQKKRKAYEPKLTPEEMMDSSTFKRFTASIENILDNLEDMDFTAFGDDDEIPQELLLGKHQLNELGSESAKIKAMGIMDKLSTDKTVKVLNILEKNIQDGSKLSTLLNHNNDTEEEERLWRDLIMERVTKSADACLTTINIMTSPNMPKAVYIEDVIERVIQYTKFHLQNTLYPQYDPVYRLDPHGGGLLSSKAKRAKCSTHKQRVIVMLYNKVCDIVSSLSELLEIQLLTDTTILQVSSMGITPFFVENVSELQLCAIKLVTAVFSRYEKHRQLILEEIFTSLARLPTSKRSLRNFRLNSSDMDGEPMYIQMVTALVLQLIQCVVHLPSSEKDSNAEEDSNKKIDQDVVITNSYETAMRTAQNFLSIFLKKCGSKQGEEDYRPLFENFVQDLLSTVNKPEWPAAELLLSLLGRLLVHQFSNKSTEMALRVASLDYLGTVAARLRKDAVTSKMDQGSIERILKQVSGGEDEIQQLQKALLDYLDENTETDPSLVFSRKFYIAQWFRDTTLETEKAMKSQKDEESSEGTHHAKEIETTGQIMHRAENRKKFLRSIIKTTPSQFSTLKMNSDTVDYDDACLIVRYLASMRPFAQSFDIYLTQILRVLGENAIAVRTKAMKCLSEVVAVDPSILARLDMQRGVHGRLMDNSTSVREAAVELLGRFVLCRPQLAEQYYDMLIERILDTGISVRKRVIKILRDICIEQPTFPKITEMCVKMIRRVNDEEGIKKLVNETFQKLWFTPTPHNDKEAMTRKILNITDVVAACRDTGYDWFEQLLQNLLKSEEDSSYKPVKKACTQLVDNLVEHILKYEESLADSDNKGVNSGRLVACITTLFLFSKIRPQLMVKHAMTMQPYLTTKCSTQNDFMVICNVAKILELVVPLMEHPSETFLATIEEDLMKLIIKYGMTVVQHCVSCLGAVVNKVTQNFKFVWACFNRYYGAISKLKSQHQEDPNNTSLLTNKPALLRSLFTVGALCRHFDFDLEDFKGNSKVNIKDKVLELLMYFTKHSDEEVQTKAIIGLGFAFIQHPSLMFEQEVKNLYNNILSDKNSSVNLKIQVLKNLQTYLQEEDTRMQQADRDWKKVAKQEDLKEMGDVSSGMSSSIMQLYLKQVLEAFFHTQSSVRHFALNVIALTLNQGLIHPVQCVPYLIAMGTDPEPAMRNKADQQLVEIDKKYAGFIHMKAVAGMKMSYQVQQAINTCLKDPVRGFRQDESSSALCSHLYSMIRGNRQHRRAFLISLLNLFDDTAKTDVTMLLYIADNLACFPYQTQEEPLFIMHHIDITLSVSGSNLLQSFKESMVKDKRKERKSSPSKENESSDSEEEVSRPRKSRKRVDSDSDSDSEDDINSVMKCLPENSAPLIEFANVSQGILLLLMLKQHLKNLCGFSDSKIQKYSPSESAKVYDKAINRKTGVHFHPKQTLDFLRSDMANSKITEEVKRSIVKQYLDFKLLMEHLDPDEEEEEGEVSASTNARNKAITSLLGGGSPKNNTAAETEDDESDGEDRGGGTSGVRRRRSQRISQRIT

SEQ ID NO: 912208 - protein, 2601 aa, Homo sapiens; identical to SEQ ID NO: 912199

SEQ ID NO: 912209 - protein, 2495 aa, Homo sapiens
ASVSSPIVAGGLRNIHDNKVSGPLSGNSANHHADNPRHGSSEDYLHMVHRLSSDDGDSSTMRNAASFPLRSPQPVCSPAGSEGTPKGSRPPLILQSQSLPCSSPRDVPPDILLDSPERKQKKQKKMKLGKDEKEQSEKAAMYDIISSPSKDSTKLTLRLSRVRSSDMDQQEDMISGVENSNVSENDIPFNVQYPGQTSKTPITPQDINRPLNAAQCLSQQEQTAFLPANQVPVLQQNTSVAAKQPQTSVVQNQQQISQQGPIYDEVELDALAEIERIERESAIERERFSKEVQDKDKPLKKRKQDSYPQEAGGATGGNRPASQETGSTGNGSRPALMVSIDLHQAGRVDSQASITQDSDSIKKPEEIKQCNDAPVSVLQEDIVGSLKSTPENHPETPKKKSDPELSKSEMKQSESRLAESKPNENRLVETKSSENKLETKVETQTEELKQNESRTTECKQNESTIVEPKQNENRLSDTKPNDNKQNNGRSETTKSRPETPKQKGESRPETPKQKSDGHPETPKQKGDGRPETPKQKGESRPETPKQKNEGRPETPKHRHDNRRDSGKPSTEKKPEVSKHKQDTKSDSPRLKSERAEALKQRPDGRSVSESLRRDHDNKQKSDDRGESERHRGDQSRVRRPETLRSSSRNEHGIKSDSSKTDKLERKHRHESGDSRERPSSGEQKSRPDSPRVKQGDSNKSRSDKLGFKSPTSKDDKRTEGNKSKVDTNKAHPDNKAEFPSYLLGGRSGALKNFVIPKIKRDKDGNVTQETKKMEMKGEPKDKVEKIGLVEDLNKGAKPVVVLQKLSLDDVQKLIKDREDKSRSSLKPIKNKPSKSNKGSIDQSVLKELPPELLAEIESTMPLCERVKMNKRKRSTVNEKPKYAEISSDEDNDSDEAFESSRKRHKKDDDKAWEYEERDRRSSGDHRRSGHSHEGRRSSGGGRYRNRSPSDSDMEDYSPPPSLSEVARKMKKKEKQKKRKAYEPKLTPEEMMDSSTFKRFTASIENILDNLEDMDFTAFGDDDEIPQELLLGKHQLNELGSESAKIKAMGIMDKLSTDKTVKVLNILEKNIQDGSKLSTLLNHNNDTEEEERLWRDLIMERVTKSADACLTTINIMTSPNMPKAVYIEDVIERVIQYTKFHLQNTLYPQYDPVYRLDPHGGGLLSSKAKRAKCSTHKQRVIVMLYNKVCDIVSSLSELLEIQLLTDTTILQVSSMGITPFFVENVSELQLCAIKLVTAVFSRYEKHRQLILEEIFTSLARLPTSKRSLRNFRLNSSDMDGEPMYIQMVTALVLQLIQCVVHLPSSEKDSNAEEDSNKKIDQDVVITNSYETAMRTAQNFLSIFLKKCGSKQGEEDYRPLFENFVQDLLSTVNKPEWPAAELLLSLLGRLLVHQFSNKSTEMALRVASLDYLGTVAARLRKDAVTSKMDQGSIERILKQVSGGEDEIQQLQKALLDYLDENTETDPSLVFSRKFYIAQWFRDTTLETEKAMKSQKDEESSEGTHHAKEIETTGQIMHRAENRKKFLRSIIKTTPSQFSTLKMNSDTVDYDDACLIVRYLASMRPFAQSFDIYLTQILRVLGENAIAVRTKAMKCLSEVVAVDPSILARLDMQRGVHGRLMDNSTSVREAAVELLGRFVLCRPQLAEQYYDMLIERILDTGISVRKRVIKILRDICIEQPTFPKITEMCVKMIRRVNDEEGIKKLVNETFQKLWFTPTPHNDKEAMTRKILNITDVVAACRDTGYDWFEQLLQNLLKSEEDSSYKPVKKACTQLVDNLVEHILKYEESLADSDNKGVNSGRLVACITTLFLFSKIRPQLMVKHAMTMQPYLTTKCSTQNDFMVICNVAKILELVVPLMEHPSETFLATIEEDLMKLIIKYGMTVVQHCVSCLGAVVNKVTQNFKFVWACFNRYYGAISKLKSQHQEDPNNTSLLTNKPALLRSLFTVGALCRHFDFDLEDFKGNSKVNIKDKVLELLMYFTKHSDEEVQTKAIIGLGFAFIQHPSLMFEQEVKNLYNNILSDKNSSVNLKIQVLKNLQTYLQEEDTRMQQADRDWKKVAKQEDLKEMGDVSSGMSSSIMQLYLKQVLEAFFHTQSSVRHFALNVIALTLNQGLIHPVQCVPYLIAMGTDPEPAMRNKADQQLVEIDKKYAGFIHMKAVAGMKMSYQVQQAINTCLKDPVRGFRQDESSSALCSHLYSMIRGNRQHRRAFLISLLNLFDDTAKTDVTMLLYIADNLACFPYQTQEEPLFIMHHIDITLSVSGSNLLQSFKESMVKDKRKERKSSPSKENESSDSEEEVSRPRKSRKRVDSDSDSDSEDDINSVMKCLPENSAPLIEFANVSQGILLLLMLKQHLKNLCGFSDSKIQKYSPSESAKVYDKAINRKTGVHFHPKQTLDFLRSDMANSKITEEVKRSIVKQYLDFKLLMEHLDPDEEEEEGEVSASTNARNKAITSLLGGGSPKNNTAAETEDDESDGEDRGGGTSGVRRRRSQRISQRITH

SEQ ID NO: 912210 - protein, 2238 aa, Homo sapiens
ASVSSPIVAGGLRNIHDNKVSGPLSGNSANHHADNPRHGSSEDYLHMVHRLSSDDGDSSTMRNAASFPLRSPQPVCSPAGSEGTPKGSRPPLILQSQSLPCSSPRDVPPDILLDSPERKQKKQKKMKLGKDEKEQSEKAAMYDIISSPSKDSTKLTLRLSRVRSSDMDQQEDMISGVENSNVSENDIPFNVQYPGQTSKTPITPQDINRPLNAAQCLSQQEQTAFLPANQVPVLQQNTSVAAKQPQTSVVQNQQQISQQGPIYDEVELDALAEIERIERESAIERERFSKEVQDKDKPLKKRKQDSYPQEAGGATGGNRPASQETGSTGNGSRPALMVSIDLHQAGRVDSQASITQDSDSIKKPEEIKQCNDAPVSVLQEDIVGSLKSTPENHPETPKKKSDPELSKSEMKQSESRLAESKPNENRLVETKSSENKLETKVETQTEELKQNESRTTECKQNESTIVEPKQNENRLSDTKPNDNKQNNGRSETTKSRPETPKQKGESRPETPKQKSDGHPETPKQKGDGRPETPKQKGESRPETPKQKNEGRPETPKHRHDNRRDSGKPSTEKKPEVSKHKQDTKSDSPRLKSERAEALKQRPDGRSVSESLRRDHDNKQKSDDRGESERHRGDQSRVRRPETLRSSSRNEHGIKSDSSKTDKLERKHRHESGDSRERPSSGEQKSRPDSPRVKQGDSNKSRSDKLGFKSPTSKDDKRTEGNKSKVDTNKAHPDNKAEFPSYLLGGRSGALKNFVIPKIKRDKDGNVTQETKKMEMKGEPKDKVEKIGLVEDLNKGAKPVVVLQKLSLDDVQKLIKDREDKSRSSLKPIKNKPSKSNKGSIDQSVLKELPPELLAEIESTMPLCERVKMNKRKRSTVNEKPKYAEISSDEDNDSDEAFESSRKRHKKDDDKAWEYEERDRRSSGDHRRSGHSHEGRRSSGGGRYRNRSPSDSDMEDYSPPPSLSEVARKMKKKEKQKKRKAYEPKLTPEEMMDSSTFKRFTASIENILDNLEDMDFTAFGDDDEIPQELLLGKHQLNELGSESAKIKAMGIMDKLSTDKTVKVLNILEKNIQDGSKLSTLLNHNNDTEEEERLWRDLIMERVTKSADACLTTINIMTSPNMPKAVYIEDVIERVIQYTKFHLQNTLYPQYDPVYRLDPHGGGLLSSKAKRAKCSTHKQRVIVMLYNKVCDIVSSLSELLEIQLLTDTTILQVSSMGITPFFVENVSELQLCAIKLVTAVFSRYEKHRQLILEEIFTSLARLPTSKRSLRNFRLNSSDMDGEPMYIQMVTALVLQLIQCVVHLPSSEKDSNAEEDSNKKIDQDVVITNSYETAMRTAQNFLSIFLKKCGSKQGEEDYRPLFENFVQDLLSTVNKPEWPAAELLLSLLGRLLVHQFSNKSTEMALRVASLDYLGTVAARLRKDAVTSKMDQGSIERILKQVSGGEDEIQQLQKALLDYLDENTETDPSLVFSRKFYIAQWFRDTTLETEKAMKSQKDEESSEGTHHAKEIETTGQIMHRAENRKKFLRSIIKTTPSQFSTLKMNSDTVDYDDACLIVRYLASMRPFAQSFDIYLTQILRVLGENAIAVRTKAMKCLSEVVAVDPSILARLDMQRGVHGRLMDNSTSVREAAVELLGRFVLCRPQLAEQYYDMLIERILDTGISVRKRVIKILRDICIEQPTFPKITEMCVKMIRRVNDEEGIKKLVNETFQKLWFTPTPHNDKEAMTRKILNITDVVAACRDTGYDWFEQLLQNLLKSEEDSSYKPVKKACTQLVDNLVEHILKYEESLADSDNKGVNSGRLVACITTLFLFSKIRPQLMVKHAMTMQPYLTTKCSTQNDFMVICNVAKILELVVPLMEHPSETFLATIEEDLMKLIIKYGMTVVQHCVSCLGAVVNKVTQNFKFVWACFNRYYGAISKLKSQHQEDPNNTSLLTNKPALLRSLFTVGALCRHFDFDLEDFKGNSKVNIKDKVLELLMYFTKHSDEEVQTKAIIGLGFAFIQHPSLMFEQEVKNLYNNILSDKNSSVNLKIQVLKNLQTYLQEEDTRMQQADRDWKKVAKQEDLKEMGDVSSGMSSSIMQLYLKQVLEAFFHTQSSVRHFALNVIALTLNQGLIHPVQCVPYLIAMGTDPEPAMRNKADQQLVEIDKKYAGFIHMKAVAGMKMSYQVQQAINTCLKDPVRGFRQDESSSALCSHLYSMIRGNRQHRRAFLISLLNLFDDTAVSTKTYYFKKISALEILWIK

SEQ ID NO: 912211 - protein, 1244 aa, Homo sapiens
ASVSSPIVAGGLRNIHDNKVSGPLSGNSANHHADNPRHGSSEDYLHMVHRLSSDDGDSSTMRNAASFPLRSPQPVCSPAGSEGTPKGSRPPLILQSQSLPCSSPRDVPPDILLDSPERKQKKQKKMKLGKDEKEQSEKAAMYDIISSPSKDSTKLTLRLSRVRSSDMDQQEDMISGVENSNVSENDIPFNVQYPGQTSKTPITPQDINRPLNAAQCLSQQEQTAFLPANQVPVLQQNTSVAAKQPQTSVVQNQQQISQQGPIYDEVELDALAEIERIERESAIERERFSKEVQDKDKPLKKRKQDSYPQEAGGATGGNRPASQETGSTGNGSRPALMVSIDLHQAGRVDSQASITQDSDSIKKPEEIKQCNDAPVSVLQEDIVGSLKSTPENHPETPKKKSDPELSKSEMKQSESRLAESKPNENRLVETKSSENKLETKVETQTEELKQNESRTTECKQNESTIVEPKQNENRLSDTKPNDNKQNNGRSETTKSRPETPKQKGESRPETPKQKSDGHPETPKQKGDGRPETPKQKGESRPETPKQKNEGRPETPKHRHDNRRDSGKPSTEKKPEVSKHKQDTKSDSPRLKSERAEALKQRPDGRSVSESLRRDHDNKQKSDDRGESERHRGDQSRVRRPETLRSSSRNEHGIKSDSSKTDKLERKHRHESGDSRERPSSGEQKSRPDSPRVKQGDSNKSRSDKLGFKSPTSKDDKRTEGNKSKVDTNKAHPDNKAEFPSYLLGGRSGALKNFVIPKIKRDKDGNVTQETKKMEMKGEPKDKVEKIGLVEDLNKGAKPVVVLQKLSLDDVQKLIKDREDKSRSSLKPIKNKPSKSNKGSIDQSVLKELPPELLAEIESTMPLCERVKMNKRKRSTVNEKPKYAEISSDEDNDSDEAFESSRKRHKKDDDKAWEYEERDRRSSGDHRRSGHSHEGRRSSGGGRYRNRSPSDSDMEDYSPPPSLSEVARKMKKKEKQKKRKAYEPKLTPEEMMDSSTFKRFTASIENILDNLEDMDFTAFGDDDEIPQELLLGKHQLNELGSESAKIKAMGIMDKLSTDKTVKVLNILEKNIQDGSKLSTLLNHNNDTEEEERLWRDLIMERVTKSADACLTTINIMTSPNMPKAVYIEDVIERVIQYTKFHLQNTLYPQYDPVYRLDPHGGGLLSSKAKRAKCSTHKQRVIVMLYNKVCDIVSSLSELLEIQLLTDTTILQVSSMGITPFFVENVSELQLCAIKLVTAVFSRYET

SEQ ID NO: 912212 - protein, 106 aa, Homo sapiens
SSELVSEGIRCRWMDRLGCGVHGPETRSLLTRPPQPSSHQAAVPGAGRRVAGRHQAAGGWRSNTPLPPRQRTGARGPRLRMLAASRVARRHRERKRRKSSWGARAS

SEQ ID NO: 912213 - protein, 466 aa, Homo sapiens
MPTRRWAPGTQCITKCEHTRPKPGELAFRKGDVVTILEACENKSWYRVKHHTSGQEGLLAAGALREREALSADPKLSLMPWFHGKISGQEAVQQLQPPEDGLFLVRESARHPGDYVLCVSFGRDVIHYRVLHRDGHLTIDEAVFFCNLMDMVEHYSKDKGAICTKLVRPKRKHGTKSAEEELARAGWLLNLQHLTLGAQIGEGEFGAVLQGEYLGQKVAVKNIKCDVTAQAFLDETAVMTKMQHENLVRLLGVILHQGLYIVMEHVSKGNLVNFLRTRGRALVNTAQLLQFSLHVAEGMEYLESKKLVHRDLAARNILVSEDLVAKVSDFGLAKAERKGLDSSRLPVKWTAPEALKHGKFTSKSDVWSFGVLLWEVFSYGRAPYPKMSLKEVSEAVEKGYRMEPPEGCPGPVHVLMSSCWEAEPARRPPFRKLAEKLARELRSAGAPASVSGQDADGSTSPRSQEP

SEQ ID NO: 912214 - protein, 640 aa, Homo sapiens
GRRRRRRAEETAVRPALGPAGASQAAAPRAFPHSPTLLRPQNEETEQLAPSCAAGTASGCAAGSRRPSWGRARGAARGRPLSRKQEEPGSVQWHPAPYLLCQPPGLWQAIPSVPDCDHLLSVPLTCLSFPLGAMAGRGSLVSWRAFHGCDSAEELPRVSPRFLRAWHPPPVSARMPTRRWAPGTQCITKCEHTRPKPGELAFRKGDVVTILEACENKSWYRVKHHTSGQEGLLAAGALREREALSADPKLSLMPWFHGKISGQEAVQQLQPPEDGLFLVRESARHPGDYVLCVSFGRDVIHYRVLHRDGHLTIDEAVFFCNLMDMVEHYSKDKGAICTKLVRPKRKHGTKSAEEELARAGWLLNLQHLTLGAQIGEGEFGAVLQGEYLGQKVAVKNIKCDVTAQAFLDETAVMTKMQHENLVRLLGVILHQGLYIVMEHVSKGNLVNFLRTRGRALVNTAQLLQFSLHVAEGMEYLESKKLVHRDLAARNILVSEDLVAKVSDFGLAKAERKGLDSSRLPVKWTAPEALKHGKFTSKSDVWSFGVLLWEVFSYGRAPYPKMSLKEVSEAVEKGYRMEPPEGCPGPVHVLMSSCWEAEPARRPPFRKLAEKLARELRSAGAPASVSGQDADGSTSPRSQEP

SEQ ID NO: 912215 - protein, 706 aa, Homo sapiens
GRRRRRRAEETAVRPALGPAGASQAAAPRAFPHSPTLLRPQNEETEQLAPSCAAGTASGCAAGSRRPSWGRARGAARGRPLSRKQEEPGSVQWHPAPYLLCQPPGLWQAIPSVPDCDHLLSVPLTCLSFPLGAMAGRGSLVSWRAFHGCDSAEELPRVSPRFLRAWHPPPVSARMPTRRWAPGTQCITKCEHTRPKPGELAFRKGDVVTILEACENKSWYRVKHHTSGQEGLLAAGALREREALSADPKLSLMPWFHGKISGQEAVQQLQPPEDGLFLVRESARHPGDYVLCVSFGRDVIHYRVLHRDGHLTIDEAVFFCNLMDMVERPPGNGTGCWGSPPWGWAHGCPTILQHYSKDKGAICTKLVRPKRKHGTKSAEEELARGPQLRHSSVTIIHHLSQKPGPEPPPTPSSSIPSLARFPRPAGWLLNLQHLTLGAQIGEGEFGAVLQGEYLGQKVAVKNIKCDVTAQAFLDETAVMTKMQHENLVRLLGVILHQGLYIVMEHVSKGNLVNFLRTRGRALVNTAQLLQFSLHVAEGMEYLESKKLVHRDLAARNILVSEDLVAKVSDFGLAKAERKGLDSSRLPVKWTAPEALKHGKFTSKSDVWSFGVLLWEVFSYGRAPYPKMSLKEVSEAVEKGYRMEPPEGCPGPVHVLMSSCWEAEPARRPPFRKLAEKLARELRSAGAPASVSGQDADGSTSPRSQEP

SEQ ID NO: 912216 - protein, 508 aa, Homo sapiens
MQGHFPAERREGRPRRGTRGQQQLLVSPRFLRAWHPPPVSARMPTRRWAPGTQCITKCEHTRPKPGELAFRKGDVVTILEACENKSWYRVKHHTSGQEGLLAAGALREREALSADPKLSLMPWFHGKISGQEAVQQLQPPEDGLFLVRESARHPGDYVLCVSFGRDVIHYRVLHRDGHLTIDEAVFFCNLMDMVEHYSKDKGAICTKLVRPKRKHGTKSAEEELARAGWLLNLQHLTLGAQIGEGEFGAVLQGEYLGQKVAVKNIKCDVTAQAFLDETAVMTKMQHENLVRLLGVILHQGLYIVMEHVSKGNLVNFLRTRGRALVNTAQLLQFSLHVAEGMEYLESKKLVHRDLAARNILVSEDLVAKVSDFGLAKAERKGLDSSRLPVKWTAPEALKHGKFTSKSDVWSFGVLLWEVFSYGRAPYPKMSLKEVSEAVEKGYRMEPPEGCPGPVHVLMSSCWEAEPARRPPFRKLAEKLARELRSAGAPASVSGQDADGSTSPRSQEP

SEQ ID NO: 912217 - protein, 431 aa, Homo sapiens
GRRRRRRAEETAVRPALGPAGASQAAAPRAFPHSPTLLRPQNEETEQLAPSCAAGTASGCAAGSRRPSWGRARGAARGRPLSRKQEEPGSVQWHPAPYLLCQPPGLWQAIPSVPDCDHLLSVPLTCLSFPLGAMAGRGSLVSWRAFHGCDSAEELPRVSPRFLRAWHPPPVSARMPTRRWAPGTQCITKCEHTRPKPGELAFRKGDVVTILEACENKSWYRVKHHTSGQEGLLAAGALREREALSADPKLSLMPWFHGKISGQEAVQQLQPPEDGLFLVRESARHPGDYVLCVSFGRDVIHYRVLHRDGHLTIDEAVFFCNLMDMVEHYSKDKGAICTKLVRPKRKHGTKSAEEELARGPQLRHSSVTIIHHLSQKPGPEPPPTPSSSIPSLARFPRPGESSPLPSPQPSLRPSHQTASFPEGESPFQPRP

SEQ ID NO: 912218 - protein, 640 aa, Homo sapiens; identical to SEQ ID NO: 912214

SEQ ID NO: 912219 - protein, 666 aa, Homo sapiens
GRRRRRRAEETAVRPALGPAGASQAAAPRAFPHSPTLLRPQNEETEQLAPSCAAGTASGCAAGSRRPSWGRARGAARGRPLSRKQEEPGSVQWHPAPYLLCQPPGLWQAIPSVPDCDHLLSVPLTCLSFPLGAMAGRGSLVSWRAFHGCDSAEELPRVSPRFLRAWHPPPVSARMPTRRWAPGTQCITKCEHTRPKPGELAFRKGDVVTILEACENKSWYRVKHHTSGQEGLLAAGALREREALSADPKLSLMPWFHGKISGQEAVQQLQPPEDGLFLVRESARHPGDYVLCVSFGRDVIHYRVLHRDGHLTIDEAVFFCNLMDMVERPPGNGTGCWGSPPWGWAHGCPTILQHYSKDKGAICTKLVRPKRKHGTKSAEEELARAGWLLNLQHLTLGAQIGEGEFGAVLQGEYLGQKVAVKNIKCDVTAQAFLDETAVMTKMQHENLVRLLGVILHQGLYIVMEHVSKGNLVNFLRTRGRALVNTAQLLQFSLHVAEGMEYLESKKLVHRDLAARNILVSEDLVAKVSDFGLAKAERKGLDSSRLPVKWTAPEALKHGKFTSKSDVWSFGVLLWEVFSYGRAPYPKMSLKEVSEAVEKGYRMEPPEGCPGPVHVLMSSCWEAEPARRPPFRKLAEKLARELRSAGAPASVSGQDADGSTSPRSQEP

SEQ ID NO: 912220 - protein, 573 aa, Homo sapiens
EGPVCARVCASRARSGKQEEPGSVQWHPAPYLLCQPPGLWQAIPSVPDCDHLLSVPLTCLSFPLGAMAGRGSLVSWRAFHGCDSAEELPRVSPRFLRAWHPPPVSARMPTRRWAPGTQCITKCEHTRPKPGELAFRKGDVVTILEACENKSWYRVKHHTSGQEGLLAAGALREREALSADPKLSLMPWFHGKISGQEAVQQLQPPEDGLFLVRESARHPGDYVLCVSFGRDVIHYRVLHRDGHLTIDEAVFFCNLMDMVEHYSKDKGAICTKLVRPKRKHGTKSAEEELARAGWLLNLQHLTLGAQIGEGEFGAVLQGEYLGQKVAVKNIKCDVTAQAFLDETAVMTKMQHENLVRLLGVILHQGLYIVMEHVSKGNLVNFLRTRGRALVNTAQLLQFSLHVAEGMEYLESKKLVHRDLAARNILVSEDLVAKVSDFGLAKAERKGLDSSRLPVKWTAPEALKHGKFTSKSDVWSFGVLLWEVFSYGRAPYPKMSLKEVSEAVEKGYRMEPPEGCPGPVHVLMSSCWEAEPARRPPFRKLAEKLARELRSAGAPASVSGQDADGSTSPRSQEP

SEQ ID NO: 912221 - protein, 573 aa, Homo sapiens
GRRRRRRAEETAVRPALGPAGASQAAAPRAFPHSPTLLRPQNEETEQLAPSCAAGTASGCAAGSRRPSWGRARGAARGRPLSRKQEEPGSVQWHPAPYLLCQPPGLWQAIPSVPDCDHLLSVPLTCLSFPLGAMAGRGSLVSWRAFHGCDSAEELPRVSPRFLRAWHPPPVSARMPTRRWAPGTQCITKCEHTRPKPGELAFRKGDVVTILEACENKSWYRVKHHTSGQEGLLAAGALREREALSADPKLSLMPWFHGKISGQEAVQQLQPPEDGLFLVRESARHPGDYVLCVSFGRDVIHYRVLHRDGHLTIDEAVFFCNLMDMVEHYSKDKGAICTKLVRPKRKHGTKSAEEELARAGWLLNLQHLTLGAQIGEGEFGAVLQGEYLGQKVAVKNIKCDVTAQAFLDETAVMTKMQHENLVRLLGVILHQGLYIVMEHVSKGNLVNFLRTRGRALVNTAQLLQFSLHVAEGMEYLESKKLVHRDLAARNILVSEDLVAKVSDFGLAKAERKGLDSSRLPVKWTAPEALKHGKFTSKSDVWSFGVLLWEVFSYGRAPYPKMPPRAVQAPCTSS

SEQ ID NO: 912222 - protein, 163 aa, Homo sapiens
MRFLAATFLLLALSTAAQAEPVQFKDCGSVDGVIKEVNVSPCPTQPCQLSKGQSYSVNVTFTSNIQSKSSKAVVHGILMGVPVPFPIPEPDGCKSGINCPIQKDKTYSYLNKLPVKSEYPSIKLVVEWQLQDDKNQSLFCWEIPSTDRFSSLKCLIEFGASGQ

SEQ ID NO: 912223 - protein, 163 aa, Homo sapiens; identical to SEQ ID NO: 912222

SEQ ID NO: 912224 - protein, 116 aa, Homo sapiens
VGPNSFQRSVNVTFTSNIQSKSSKAVVHGILMGVPVPFPIPEPDGCKSGINCPIQKDKTYSYLNKLPVKSEYPSIKLVVEWQLQDDKNQSLFCWEIPSTDRFSSLKCLIEFGASGQ

SEQ ID NO: 912225 - protein, 84 aa, Homo sapiens
TIPRSMVLRIVVHGQKLVHVNDMSRTCGVDVPESEAEIVEPDVRLGSRVRGPTVPWKEMTYPGCCSTFTQRLCRGSKKYQLRDR

SEQ ID NO: 912226 - protein, 338 aa, Homo sapiens
MRFLAATFLLLALSTAAQAEPVQFKDCGSSRMEIKKKEKKPQTTPNRTNRAKNKRTTTKTPTPTKNKRKTTKPKTNNRERDGPGEPEDPYAESREEEERGERETNPKTERRRRTGRSEPKKERRTQGEEAKETLQKETEKEESKEELSSREEQERAQRGDSKQLGRRGPRYQRNSRTTEQQSRATEEVRPVARQKPKGGDEIGGDDERNESDLTESNRIGSETKRDQGETESCRTKERGEDPVKEAVGDGGEEEEATRRGVREGKEAALGKAEEEATAGGVEELRRGAHEVGQGAEGGRGEAQKRERVPREGGAAEKREGVVVVESRSRAGEGSRRED

SEQ ID NO: 912227 - protein, 163 aa, Homo sapiens; identical to SEQ ID NO: 912222

SEQ ID NO: 912228 - protein, 163 aa, Homo sapiens; identical to SEQ ID NO: 912222

SEQ ID NO: 912229 - protein, 150 aa, Homo sapiens
MRFLAATFLLLALSTAAQAEPVQFKDCGSVDGVIKEVNVSPCPTQPCQLSKGQSYSVNVTFTSNIQSKSSKAVVHGILMGVPVPFPIPEPDGCKSGINCPIQKDKTYSYLNKLPVKSEYPSIKLVVEWQLQDDKSFSSLKCLIEFGASGQ

SEQ ID NO: 912230 - protein, 163 aa, Homo sapiens; identical to SEQ ID NO: 912222

SEQ ID NO: 912231 - protein, 163 aa, Homo sapiens; identical to SEQ ID NO: 912222

SEQ ID NO: 912232 - protein, 116 aa, Homo sapiens; identical to SEQ ID NO: 912224

SEQ ID NO: 912233 - protein, 163 aa, Homo sapiens
MRFLAATFLLLALSTAAQAEPVQFKDCGSVDGVIKEVNVSPCPTQPCQLSKGQSYSVNVTFTSNIQSKSSKAVVHGILMGVPVPFPIPEPDGCKSGINCPIQKDKTYSYLNKLPVKSEYPSIKLVVEWQLQDDKNQSLFCWEIPSTDLLISKCLIEYVSLWSG

SEQ ID NO: 912234 - protein, 163 aa, Homo sapiens; identical to SEQ ID NO: 912222

SEQ ID NO: 912235 - protein, 153 aa, Homo sapiens
MRFLAATFLLLALSTAAQAEPVQFKDCGSVDGVIKEVNVSPCPTQPCQLSKGQSYSVNVTFTSNIQSKSSKAVVHGILMGVPVPFPIPEPDGCKSGINCPIQKDKTYSYLNKLPVKSEYPSIKLVVEWQLQDDKNQSLFCWEIPSTDHKSIWG

SEQ ID NO: 912236 - protein, 76 aa, Homo sapiens
IRGGLGKDGDSGDLLSATGDKAHLGTSLLGALEVIYRPNPRCMHAPGGWFSVVVSCLFFCLILGGFIKCSTWLADV

SEQ ID NO: 912237 - protein, 230 aa, Homo sapiens
SGRVPGAASWERCAGSREPSAPGWGRGRSGAERERARPSPESRRLPSRRSAGPPAAAPAMEQDNSPRKIQFTVPLLEPHLDPEAAEQIRRRRPTPATLVLTSDQSSPEIDEDRIPNPHLKSTLAMSPRQRKKMTRITPTMKELQMMVEHHLGQQQQGEEPEGAAESTGTQESRPPGIPDTEVESRLGTSGTAKKTAECIPKTHERGSKEPSTKEPSTHIPPLDSKGANSV

SEQ ID NO: 912238 - protein, 230 aa, Homo sapiens; identical to SEQ ID NO: 912237

SEQ ID NO: 912239 - protein, 1563 aa, Homo sapiens
GPGGARGAEGGGGSGARSARRWVRPRSPSLQPRLGPMDALCGSGELGSKFWDSNLSVHTENPDLTPCFQNSLLAWVPCIYLWVALPCYLLYLRHHCRGYIILSHLSKLKMVLGVLLWCVSWADLFYSFHGLVHGRAPAPVFFVTPLVVGVTMLLATLLIQYERLQGVQSSGVLIIFWFLCVVCAIVPFRSKILLAKAEGEISDPFRFTTFYIHFALVLSALILACFREKPPFFSAKNVDPNPYPETSAGFLSRLFFWWFTKMAIYGYRHPLEEKDLWSLKEEDRSQMVVQQLLEAWRKQEKQTARHKASAAPGKNASGEDEVLLGARPRPRKPSFLKALLATFGSSFLISACFKLIQDLLSFINPQLLSILIRFISNPMAPSWWGFLVAGLMFLCSMMQSLILQHYYHYIFVTGVKFRTGIMGVIYRKALVITNSVKRASTVGEIVNLMSVDAQRFMDLAPFLNLLWSAPLQIILAIYFLWQNLGPSVLAGVAFMVLLIPLNGAVAVKMRAFQVKQMKLKDSRIKLMSEILNGIKVLKLYAWEPSFLKQVEGIRQGELQLLRTAAYLHTTTTFTWMCSPFLVTLITLWVYVYVDPNNVLDAEKAFVSVSLFNILRLPLNMLPQLISNLTQASVSLKRIQQFLSQEELDPQSVERKTISPGYAITIHSGTFTWAQDLPPTLHSLDIQVPKGALVAVVGPVGCGKSSLVSALLGEMEKLEGKVHMKGSVAYVPQQAWIQNCTLQENVLFGKALNPKRYQQTLEACALLADLEMLPGGDQTEIGEKGINLSGGQRQRVSLARAVYSDADIFLLDDPLSAVDSHVAKHIFDHVIGPEGVLAGKTRVLVTHGISFLPQTDFIIVLADGQVSEMGPYPALLQRNGSFANFLCNYAPDEDQGHLEDSWTALEGAEDKEALLIEDTLSNHTDLTDNDPVTYVVQKQFMRQLSALSSDGEGQGRPVPRRHLGPSEKVQVTEAKADGALTQEEKAAIGTVELSVFWDYAKAVGLCTTLAICLLYVGQSAAAIGANVWLSAWTNDAMADSRQNNTSLRLGVYAALGILQGFLVMLAAMAMAAGGIQAARVLHQALLHNKIRSPQSFFDTTPSGRILNCFSKDIYVVDEVLAPVILMLLNSFFNAISTLVVIMASTPLFTVVILPLAVLYTLVQRFYAATSRQLKRLESVSRSPIYSHFSETVTGASVIRAYNRSRDFEIISDTKVDANQRSCYPYIISNRWLSIGVEFVGNCVVLFAALFAVIGRSSLNPGLVGLSVSYSLQVTFALNWMIRMMSDLESNIVAVERVKEYSKTETEAPWVVEGSRPPEGWPPRGEVEFRNYSVRYRPGLDLVLRDLSLHVHGGEKVGIVGRTGAGKSSMTLCLFRILEAAKGEIRIDGLNVADIGLHDLRSQLTIIPQDPILFSGTLRMNLDPFGSYSEEDIWWALELSHLHTFVSSQPAGLDFQCSEGGENLSVGQRQLVCLARALLRKSRILVLDEATAAIDLETDNLIQATIRTQFDTCTVLTIAHRLNTIMDYTRVLVLDKGVVAEFDSPANLIAARGIFYGMARDAGLA

SEQ ID NO: 912240 - protein, 1352 aa, Homo sapiens
MAIYGYRHPLEEKDLWSLKEEDRSQMVVQQLLEAWRKQEKQTARHKASAAPGKNASGEDEVLLGARPRPRKPSFLKALLATFGSSFLISACFKLIQDLLSFINPQLLSILIRFISNPMAPSWWGFLVAGLMFLCSMMQSLILQHYYHYIFVTGVKFRTGIMGVIYRKALVITNSVKRASTVGEIVNLMSVDAQRFMDLAPFLNLLWSAPLQIILAIYFLWQNLGPSVLAGVAFMVLLIPLNGAVAVKMRAFQVKQMKLKDSRIKLMSEILNGIKVLKLYAWEPSFLKQVEGIRQGELQLLRTAAYLHTTTTFTWMCSPFLVTLITLWVYVYVDPNNVLDAEKAFVSVSLFNILRLPLNMLPQLISNLTQASVSLKRIQQFLSQEELDPQSVERKTISPGYAITIHSGTFTWAQDLPPTLHSLDIQVPKGALVAVVGPVGCGKSSLVSALLGEMEKLEGKVHMKGSVAYVPQQAWIQNCTLQENVLFGKALNPKRYQQTLEACALLADLEMLPGGDQTEIGEKGINLSGGQRQRVSLARAVYSDADIFLLDDPLSAVDSHVAKHIFDHVIGPEGVLAGKTRVLVTHGISFLPQTDFIIVLADGQVSEMGPYPALLQRNGSFANFLCNYAPDEDQGHLEDSWTALEGAEDKEALLIEDTLSNHTDLTDNDPVTYVVQKQFMRQLSALSSDGEGQGRPVPRRHLGPSEKVQVTEAKADGALTQEEKAAIGTVELSVFWDYAKAVGLCTTLAICLLYVGQSAAAIGANVWLSAWTNDAMADSRQNNTSLRLGVYAALGILQGFLVMLAAMAMAAGGIQAARVLHQALLHNKIRSPQSFFDTTPSGRILNCFSKDIYVVDEVLAPVILMLLNSFFNAISTLVVIMASTPLFTVVILPLAVLYTLVQRFYAATSRQLKRLESVSRSPIYSHFSETVTGASVIRAYNRSRDFEIISDTKVDANQRSCYPYIISNRSEAASLAPCSSRNSQQALWCSGSLSLLSPKQKTGPCPAPAPFPPHLIPHRWLSIGVEFVGNCVVLFAALFAVIGRSSLNPGLVGLSVSYSLQVTFALNWMIRMMSDLESNIVAVERVKEYSKTETEAPWVVEGSRPPEGWPPRGEVEFRNYSVRYRPGLDLVLRDLSLHVHGGEKVGIVGRTGAGKSSMTLCLFRILEAAKGEIRIDGLNVADIGLHDLRSQLTIIPQDPILFSGTLRMNLDPFGSYSEEDIWWALELSHLHTFVSSQPAGLDFQCSEGGENLSVGQRQLVCLARALLRKSRILVLDEATAAIDLETDNLIQATIRTQFDTCTVLTIAHRLNTIMDYTRVLVLDKGVVAEFDSPANLIAARGIFYGMARDAGLA

SEQ ID NO: 912241 - protein, 1563 aa, Homo sapiens; identical to SEQ ID NO: 912239

SEQ ID NO: 912242 - protein, 153 aa, Homo sapiens
SRCDPICPSCQAPWVVEGSRPPEGWPPRGEVEFRNYSVRYRPGLDLVLRDLSLHVHGGEKVGIVGRTGAGKSSMTLCLFRILEAAKGEIRIDGLNVADIGLHDLRSQLTIIPQVGAWHGLATLTPHCLGASSSPASCLAAQFLHGYPCSCLCI

SEQ ID NO: 912243 - protein, 1563 aa, Homo sapiens; identical to SEQ ID NO: 912239

SEQ ID NO: 912244 - protein, 1256 aa, Homo sapiens
MGAALPTSLLSPPHSILIRFISNPMAPSWWGFLVAGLMFLCSMMQSLILQHYYHYIFVTGVKFRTGIMGVIYRKVSWSRAQGKGWPWAACKRLQPSPPTTVYLQALVITNSVKRASTVGEIVNLMSVDAQRFMDLAPFLNLLWSAPLQIILAIYFLWQNLGPSVLAGVAFMVLLIPLNGAVAVKMRAFQVKQMKLKDSRIKLMSEILNGIKVLKLYAWEPSFLKQVEGIRQGELQLLRTAAYLHTTTTFTWMCSPFLVRLGTGLGPCLQGSGCPGMARAHWTLPWHHLHAAQVTLITLWVYVYVDPNNVLDAEKAFVSVSLFNILRLPLNMLPQLISNLTQASVSLKRIQQFLSQEELDPQSVERKTISPGYAITIHSGTFTWAQDLPPTLHSLDIQVPKGALVAVVGPVGCGKSSLVSALLGEMEKLEGKVHMKGSVAYVPQQAWIQNCTLQEACALLADLEMLPGGDQTEIGEKGINLSGGQRQRVSLARAVYSDADIFLLDDPLSAVDSHVAKHIFDHVIGPEGVLAGKTRVLVTHGISFLPQTDFIIVLADGQVSEMGPYPALLQRNGSFANFLCNYAPDEDQGHLEDSWTALEGAEDKEALLIEDTLSNHTDLTDNDPVTYVVQKQFMRQLSALSSDGEGQGRPVPRRHLGPSEKVQVTEAKADGALTQEEKAAIGTVELSVFWDYAKAVGLCTTLAICLLYVGQSAAAIGANVWLSAWTNDAMADSRQNNTSLRLGVYAALGILQGFLVMLAAMAMAAGGIQAARVLHQALLHNKIRSPQSFFDTTPSGRILNCFSKDIYVVDEVLAPVILMLLNSFFNAISTLVVIMASTPLFTVVILPLAVLYTLVQRFYAATSRQLKRLESVSRSPIYSHFSETVTGASVIRAYNRSRDFEIISDTKVDANQRSCYPYIISNRWLSIGVEFVGNCVVLFAALFAVIGRSSLNPGLVGLSVSYSLQVTFALNWMIRMMSDLESNIVAVERVKEYSKTETEAPWVVEGSRPPEGWPPRGEVEFRNYSVRYRPGLDLVLRDLSLHVHGGEKVGIVGRTGAGKSSMTLCLFRILEAAKGEIRIDGLNVADIGLHDLRSQLTIIPQDPILFSGTLRMNLDPFGSYSEEDIWWALELSHLHTFVSSQPAGLDFQCSEGGENLSVGQRQLVCLARALLRKSRILVLDEATAAIDLETDNLIQATIRTQFDTCTVLTIAHRLNTIMDYTRVLVLDKGVVAEFDSPANLIAARGIFYGMARDAGLA

SEQ ID NO: 912245 - protein, 1284 aa, Homo sapiens
MGAALPTSLLSPPHSILIRFISNPMAPSWWGFLVAGLMFLCSMMQSLILQHYYHYIFVTGVKFRTGIMGVIYRKVSWSRAQGKGWPWAACKRLQPSPPTTVYLQALVITNSVKRASTVGEIVNLMSVDAQRFMDLAPFLNLLWSAPLQIILAIYFLWQNLGPSVLAGVAFMVLLIPLNGAVAVKMRAFQVKQMKLKDSRIKLMSEILNGIKVLKLYAWEPSFLKQVEGIRQGELQLLRTAAYLHTTTTFTWMCSPFLVRLGTGLGPCLQGSGCPGMARAHWTLPWHHLHAAQVTLITLWVYVYVDPNNVLDAEKAFVSVSLFNILRLPLNMLPQLISNLTQASVSLKRIQQFLSQEELDPQSVERKTISPGYAITIHSGTFTWAQDLPPTLHSLDIQVPKGALVAVVGPVGCGKSSLVSALLGEMEKLEGKVHMKGSVAYVPQQAWIQNCTLQENVLFGKALNPKRYQQTLEACALLADLEMLPGGDQTEIGEKGINLSGGQRQRVSLARAVYSDADIFLLDDPLSAVDSHVAKHIFDHVIGPEGVLAGKVGLPEAKGAKTRVLVTHGISFLPQTDFIIVLADGQVSEMGPYPALLQRNGSFANFLCNYAPDEDQGHLEDSWTALEGAEDKEALLIEDTLSNHTDLTDNDPVTYVVQKQFMRQLSALSSDGEGQGRPVPRRHLGPSEKVQVTEAKADGALTQEEKAAIGTVELSVFWDYAKAVGLCTTLAICLLYVGQSAAAIGANVWLSAWTNDAMADSRQNNTSLRLGVYAALGILQGFLVMLAAMAMAAGGIQAARVLHQALLHNKIRSPQSFFDTTPSGRILNCFSKDIYVVDEVLAPVILMLLNSFFNAISTLVVIMASTPLFTVVILPLAVLYTLVQRFYAATSRQLKRLESVSRSPIYSHFSETVTGASVIRAYNRSRDFEIISDTKVDANQRSCYPYIISNRWLSIGVEFVGNCVVLFAALFAVIGRSSLNPGLVGLSVSYSLQVTFALNWMIRMMSDLESNIVAVERVKEYSKTETEAPWVVEGSRPPEGWPPRGEVEFRNYSVRYRPGLDLVLRDLSLHVHGGEKVGIVGRTGAGKSSMTLCLFRILEAAKGEIRIDGLNVADIGLHDLRSQLTIIPQDPILFSGTLRMNLDPFGSYSEEDIWWALELSHLHTFVSSQPAGLDFQCSEGGENLSVGQRQLVCLARALLRKSRILVLDEATAAIDLETDNLIQATIRTQFDTCTVLTIAHRLNTIMDYTRVLVLDKGVVAEFDSPANLIAARGIFYGMARDAGLA

SEQ ID NO: 912246 - protein, 1609 aa, Homo sapiens
MASLENSHLGRQLLICVLSPPHLSSTPPLSLMEHLSSYSHLPQGSPILCGAATALNCSLCPQDSNLSVHTENPDLTPCFQNSLLAWVPCIYLWVALPCYLLYLRHHCRGYIILSHLSKLKMVLGVLLWCVSWADLFYSFHGLVHGRAPAPVFFVTPLVVGVTMLLATLLIQYERLQGVQSSGVLIIFWFLCVVCAIVPFRSKILLAKAEGEISDPFRFTTFYIHFALVLSALILACFREKPPFFSAKNVDPNPYPETSAGFLSRLFFWWFTKMAIYGYRHPLEEKDLWSLKEEDRSQMVVQQLLEAWRKQEKQTARHKASAAPGKNASGEDEVLLGARPRPRKPSFLKALLATFGSSFLISACFKLIQDLLSFINPQLLSILIRFISNPMAPSWWGFLVAGLMFLCSMMQSLILQHYYHYIFVTGVKFRTGIMGVIYRKALVITNSVKRASTVGEIVNLMSVDAQRFMDLAPFLNLLWSAPLQIILAIYFLWQNLGPSVLAGVAFMVLLIPLNGAVAVKMRAFQVKQMKLKDSRIKLMSEILNGIKVLKLYAWEPSFLKQVEGIRQGELQLLRTAAYLHTTTTFTWMCSPFLVRLGTGLGPCLQGSGCPGMARAHWTLPWHHLHAAQVTLITLWVYVYVDPNNVLDAEKAFVSVSLFNILRLPLNMLPQLISNLTQASVSLKRIQQFLSQEELDPQSVERKTISPGYAITIHSGTFTWAQDLPPTLHSLDIQVPKGALVAVVGPVGCGKSSLVSALLGEMEKLEGKVHMKGSVAYVPQQAWIQNCTLQENVLFGKALNPKRYQQTLEACALLADLEMLPGGDQTEIGEKGINLSGGQRQRVSLARAVYSDADIFLLDDPLSAVDSHVAKHIFDHVIGPEGVLAGKTRVLVTHGISFLPQTDFIIVLADGQVSEMGPYPALLQRNGSFANFLCNYAPDEDQGHLEDSWTALEGAEDKEALLIEDTLSNHTDLTDNDPVTYVVQKQFMRQLSALSSDGEGQGRPVPRRHLGPSEKVQVTEAKADGALTQEEKAAIGTVELSVFWDYAKAVGLCTTLAICLLYVGQSAAAIGANVWLSAWTNDAMADSRQNNTSLRLGVYAALGILQGFLVMLAAMAMAAGGIQAARVLHQALLHNKIRSPQSFFDTTPSGRILNCFSKDIYVVDEVLAPVILMLLNSFFNAISTLVVIMASTPLFTVVILPLAVLYTLVQRFYAATSRQLKRLESVSRSPIYSHFSETVTGASVIRAYNRSRDFEIISDTKVDANQRSCYPYIISNRWLSIGVEFVGNCVVLFAALFAVIGRSSLNPGLVGLSVSYSLQVTFALNWMIRMMSDLESNIVAVERVKEYSKTETEAPWVVEGSRPPEGWPPRGEVEFRNYSVRYRPGLDLVLRDLSLHVHGGEKVGIVGRTGAGKSSMTLCLFRILEAAKGEIRIDGLNVADIGLHDLRSQLTIIPQDPILFSGTLRMNLDPFGSYSEEDIWWALELSHLHTFVSSQPAGLDFQCSEGGENLSVGQRQLVCLARALLRKSRILVLDEATAAIDLETDNLIQATIRTQFDTCTVLTIAHRLNTIMDYTRVLVLDKGVVAEFDSPANLIAARGIFYGMARDAGLA

SEQ ID NO: 912247 - protein, 1474 aa, Homo sapiens
MAPHLAQVPHLSSLNQSSLVILPHLSESSEWGPGGPQVLPPAPEETDAPRDSAGQGLQAQAFPVLLTPLHSPTQGEISDPFRFTTFYIHFALVLSALILACFREKPPFFSAKNVDPNPYPETSAGFLSRLFFWWFTKMAIYGYRHPLEEKDLWSLKEEDRSQMVVQQLLEAWRKQEKQTARHKASAAPGKNASGEDEVLLGARPRPRKPSFLKALLATFGSSFLISACFKLIQDLLSFINPQLLSILIRFISNPMAPSWWGFLVAGLMFLCSMMQSLILQHYYHYIFVTGVKFRTGIMGVIYRKALVITNSVKRASTVGEIVNLMSVDAQRFMDLAPFLNLLWSAPLQIILAIYFLWQNLGPSVLAGVAFMVLLIPLNGAVAVKMRAFQVKQMKLKDSRIKLMSEILNGIKVLKLYAWEPSFLKQVEGIRQGELQLLRTAAYLHTTTTFTWMCSPFLVRLGTGLGPCLQGSGCPGMARLIGLYPDTTSTLLQVTLITLWVYVYVDPNNVLDAEKAFVSVSLFNILRLPLNMLPQLISNLTQASVSLKRIQQFLSQEELDPQSVERKTISPGYAITIHSGTFTWAQDLPPTLHSLDIQVPKGALVAVVGPVGCGKSSLVSALLGEMEKLEGKVHMKGSVAYVPQQAWIQNCTLQENVLFGKALNPKRYQQTLEACALLADLEMLPGGDQTEIGEKGINLSGGQRQRVSLARAVYSDADIFLLDDPLSAVDSHVAKHIFDHVIGPEGVLAGKTRVLVTHGISFLPQTDFIIVLADGQVSEMGPYPALLQRNGSFANFLCNYAPDEDQGHLEDSWTALEGAEDKEALLIEDTLSNHTDLTDNDPVTYVVQKQFMRQLSALSSDGEGQGRPVPRRHLGPSEKVQVTEAKADGALTQEEKAAIGTVELSVFWDYAKAVGLCTTLAICLLYVGQSAAAIGANVWLSAWTNDAMADSRQNNTSLRLGVYAALGILQGFLVMLAAMAMAAGGIQAARVLHQALLHNKIRSPQSFFDTTPSGRILNCFSKDIYVVDEVLAPVILMLLNSFFNAISTLVVIMASTPLFTVVILPLAVLYTLVQRFYAATSRQLKRLESVSRSPIYSHFSETVTGASVIRAYNRSRDFEIISDTKVDANQRSCYPYIISNRWLSIGVEFVGNCVVLFAALFAVIGRSSLNPGLVGLSVSYSLQVTFALNWMIRMMSDLESNIVAVERVKEYSKTETEAPWVVEGSRPPEGWPPRGEVEFRNYSVRYRPGLDLVLRDLSLHVHGGEKVGIVGRTGAGKSSMTLCLFRILEAAKGEIRIDGLNVADIGLHDLRSQLTIIPQDPILFSGTLRMNLDPFGSYSEEDIWWALELSHLHTFVSSQPAGLDFQCSEGGENLSVGQRQLVCLARALLRKSRILVLDEATAAIDLETDNLIQATIRTQFDTCTVLTIAHRLNTIMDYTRVLVLDKGVVAEFDSPANLIAARGIFYGMARDAGLA

SEQ ID NO: 912248 - protein, 446 aa, Homo sapiens
MYIFDSVDLGWGSGLCTLIKTPWYAKCGPWASCITILWELVRNEESQVPSPTSDYRIRRCILTRFSGKSYTYKVGETETKARWSLVKSALSLPKGVIRDYSPSWHACGLDPGPPGSSMGKDPMDGHMIQESELLPKPLRWGGEIAIRITQPFGQVTFALNWMIRMMSDLESNIVAVERVKEYSKTETEAPWVVEGSRPPEGWPPRGEVEFRNYSVRYRPGLDLVLRDLSLHVHGGEKVGIVGRTGAGKSSMTLCLFRILEAAKGEIRIDGLNVADIGLHDLRSQLTIIPQDPILFSGTLRMNLDPFGSYSEEDIWWALELSHLHTFVSSQPAGLDFQCSEGGENLSVGQRQLVCLARALLRKSRILVLDEATAAIDLETDNLIQATIRTQFDTCTVLTIAHRLNTIMDYTRVLVLDKGVVAEFDSPANLIAARGIFYGMARDAGLA

SEQ ID NO: 912249 - protein, 1275 aa, Homo sapiens
MGAALPTSLLSPPHSILIRFISNPMAPSWWGFLVAGLMFLCSMMQSLILQHYYHYIFVTGVKFRTGIMGVIYRKVSWSRAQGKGWPWAACKRLQPSPPTTVYLQALVITNSVKRASTVGEIVNLMSVDAQRFMDLAPFLNLLWSAPLQIILAIYFLWQNLGPSVLAGVAFMVLLIPLNGAVAVKMRAFQVKQMKLKDSRIKLMSEILNGIKVLKLYAWEPSFLKQVEGIRQGELQLLRTAAYLHTTTTFTWMCSPFLVRLGTGLGPCLQGSGCPGMARAHWTLPWHHLHAAQVTLITLWVYVYVDPNNVLDAEKAFVSVSLFNILRLPLNMLPQLISNLTQASVSLKRIQQFLSQEELDPQSVERKTISPGYAITIHSGTFTWAQDLPPTLHSLDIQVPKGALVAVVGPVGCGKSSLVSALLGEMEKLEGKVHMKGSVAYVPQQAWIQNCTLQENVLFGKALNPKRYQQTLEACALLADLEMLPGGDQTEIGEKGINLSGGQRQRVSLARAVYSDADIFLLDDPLSAVDSHVAKHIFDHVIGPEGVLAGKTRVLVTHGISFLPQTDFIIVLADGQVSEMGPYPALLQRNGSFANFLCNYAPDEDQGHLEDSWTALEGAEDKEALLIEDTLSNHTDLTDNDPVTYVVQKQFMRQLSALSSDGEGQGRPVPRRHLGPSEKVQVTEAKADGALTQEEKAAIGTVELSVFWDYAKAVGLCTTLAICLLYVGQSAAAIGANVWLSAWTNDAMADSRQNNTSLRLGVYAALGILQGFLVMLAAMAMAAGGIQAARVLHQALLHNKIRSPQSFFDTTPSGRILNCFSKDIYVVDEVLAPVILMLLNSFFNAISTLVVIMASTPLFTVVILPLAVLYTLVQRFYAATSRQLKRLESVSRSPIYSHFSETVTGASVIRAYNRSRDFEIISDTKVDANQRSCYPYIISNRWLSIGVEFVGNCVVLFAALFAVIGRSSLNPGLVGLSVSYSLQVTFALNWMIRMMSDLESNIVAVERVKEYSKTETEAPWVVEGSRPPEGWPPRGEVEFRNYSVRYRPGLDLVLRDLSLHVHGGEKVGIVGRTGAGKSSMTLCLFRILEAAKGEIRIDGLNVADIGLHDLRSQLTIIPQDPILFSGTLRMNLDPFGSYSEEDIWWALELSHLHTFVSSQPAGLDFQCSEGGENLSVGQRQLVCLARALLRKSRILVLDEATAAIDLETDNLIQATIRTQFDTCTVLTIAHRLNTIMDYTRVLVLDKGVVAEFDSPANLIAARGIFYGMARDAGLAK

SEQ ID NO: 912250 - protein, 985 aa, Homo sapiens
MGAALPTSLLSPPHSILIRFISNPMAPSWWGFLVAGLMFLCSMMQSLILQHYYHYIFVTGVKFRTGIMGVIYRKVSWSRAQGKGWPWAACKRLQPSPPTTVYLQALVITNSVKRASTVGEIVNLMSVDAQRFMDLAPFLNLLWSAPLQIILAIYFLWQNLGPSVLAGVAFMVLLIPLNGAVAVKMRAFQVKQMKLKDSRIKLMSEILNGIKVLKLYAWEPSFLKQVEGIRQGELQLLRTAAYLHTTTTFTWMCSPFLVRLGTGLGPCLQGSGCPGMARAHWTLPWHHLHAAQVTLITLWVYVYVDPNNVLDAEKAFVSVSLFNILRLPLNMLPQLISNLTQASVSLKRIQQFLSQEELDPQSVERKTISPGYAITIHSGTFTWAQDLPPTLHSLDIQVPKGALVAVVGPVGCGKSSLVSALLGEMEKLEGKVHMKGSVAYVPQQAWIQNCTLQENVLFGKALNPKRYQQTLEACALLADLEMLPGGDQTEIGEKGINLSGGQRQRVSLARAVYSDADIFLLDDPLSAVDSHVAKHIFDHVIGPEGVLAGKTRVLVTHGISFLPQTDFIIVLADGQVSEMGPYPALLQRNGSFANFLCNYAPDEDQGHLEDSWTALEGAEDKEALLIEDTLSNHTDLTDNDPVTYVVQKQFMRQLSALSSDGEGQGRPVPRRHLGPSEKVQVTEAKADGALTQEEKAAIGTVELSVFWDYAKAVGLCTTLAICLLYVGQSAAAIGANVWLSAWTNDAMADSRQNNTSLRLGVYAALGILQGFLVMLAAMAMAAGGIQAARVLHQALLHNKIRSPQSFFDTTPSGRILNCFSKDIYVVDEVLAPVILMLLNSFFNAISTLVVIMASTPLFTVVILPLAVLYTLVQRFYAATSRQLKRLESVSRSPIYSHFSETVTGASVIRAYNRSRDFEIISDTKVDANQRSCYPYIISNRSEAASLAPCSSRNSQQALWCSGSLSLLSPKQKTGPALPLPHFLLI

SEQ ID NO: 912251 - protein, 811 aa, Homo sapiens
MGAALPTSLLSPPHSILIRFISNPMAPSWWGFLVAGLMFLCSMMQSLILQHYYHYIFVTGVKFRTGIMGVIYRKVSWSRAQGKGWPWAACKRLQPSPPTTVYLQALVITNSVKRASTVGEIVNLMSVDAQRFMDLAPFLNLLWSAPLQIILAIYFLWQNLGPSVLAGVAFMVLLIPLNGAVAVKMRAFQVKQMKLKDSRIKLMSEILNGIKVLKLYAWEPSFLKQVEGIRQGELQLLRTAAYLHTTTTFTWMCSPFLVRLGTGLGPCLQGSGCPGMARAHWTLPWHHLHAAQVTLITLWVYVYVDPNNVLDAEKAFVSVSLFNILRLPLNMLPQLISNLTQASVSLKRIQQFLSQEELDPQSVERKTISPGYAITIHSGTFTWAQDLPPTLHSLDIQVPKGALVAVVGPVGCGKSSLVSALLGEMEKLEGKVHMKGSVAYVPQQAWIQNCTLQENVLFGKALNPKRYQQTLEACALLADLEMLPGGDQTEIGEKGINLSGGQRQRVSLARAVYSDADIFLLDDPLSAVDSHVAKHIFDHVIGPEGVLAGKVGLPEAKGAKTRVLVTHGISFLPQTDFIIVLADGQVSEMGPYPALLQRNGSFANFLCNYAPDEDQGHLEDSWTALEGAEDKEALLIEDTLSNHTDLTDNDPVTYVVQKQFMRQLSALSSDGEGQGRPVPRRHLGPSEKVQVTEAKADGALTQEEKAAIGTVELSVFWDYAKAVGLCTTLAICLLYVGQSAAAIGANVWLSAWTNDAMADSRQNNTSLRGDSGKICRVWDVQQQEGIQRRVPAVQESHFEHTGQGPNMKGAG

SEQ ID NO: 912252 - protein, 73 aa, Homo sapiens
DRRHVDRRHVDRRHVDNARIQNPEYKGGWKPRQIDNPDYKGTRSTQKLTSPVSRFPTECYLHTALFSNNDFMK

SEQ ID NO: 912253 - protein, 1613 aa, Homo sapiens
GPGGARGAEGGGGSGARSARRWVRPRSPSLQPRLGPMDALCGSGELGSKFWDSNLSVHTENPDLTPCFQNSLLAWVPCIYLWVALPCYLLYLRHHCRGYIILSHLSKLKMVLGVLLWCVSWADLFYSFHGLVHGRAPAPVFFVTPLVVGVTMLLATLLIQYERLQGVQSSGVLIIFWFLCVVCAIVPFRSKILLAKAEGEISDPFRFTTFYIHFALVLSALILACFREKPPFFSAKNVDPNPYPETSAGFLSRLFFWWFTKMAIYGYRHPLEEKDLWSLKEEDRSQMVVQQLLEAWRKQEKQTARHKASAAPGKNASGEDEVLLGARPRPRKPSFLKALLATFGSSFLISACFKLIQDLLSFINPQLLSILIRFISNPMAPSWWGFLVAGLMFLCSMMQSLILQHYYHYIFVTGVKFRTGIMGVIYRKALVITNSVKRASTVGEIVNLMSVDAQRFMDLAPFLNLLWSAPLQIILAIYFLWQNLGPSVLAGVAFMVLLIPLNGAVAVKMRAFQVKQMKLKDSRIKLMSEILNGIKVLKLYAWEPSFLKQVEGIRQGELQLLRTAAYLHTTTTFTWMCSPFLVTLITLWVYVYVDPNNVLDAEKAFVSVSLFNILRLPLNMLPQLISNLTQASVSLKRIQQFLSQEELDPQSVERKTISPGYAITIHSGTFTWAQDLPPTLHSLDIQVPKGALVAVVGPVGCGKSSLVSALLGEMEKLEGKVHMKGSVAYVPQQAWIQNCTLQENVLFGKALNPKRYQQTLEACALLADLEMLPGGDQTEIGEKGINLSGGQRQRVSLARAVYSDADIFLLDDPLSAVDSHVAKHIFDHVIGPEGVLAGKTRVLVTHGISFLPQTDFIIVLADGQVSEMGPYPALLQRNGSFANFLCNYAPDEDQGHLEDSWTALEGAEDKEALLIEDTLSNHTDLTDNDPVTYVVQKQFMRQLSALSSDGEGQGRPVPRRHLGPSEKVQVTEAKADGALTQEEKAAIGTVELSVFWDYAKAVGLCTTLAICLLYVGQSAAAIGANVWLSAWTNDAMADSRQNNTSLRLGVYAALGILQGFLVMLAAMAMAAGGIQAARVLHQALLHNKIRSPQSFFDTTPSGRILNCFSKDIYVVDEVLAPVILMLLNSFFNAISTLVVIMASTPLFTVVILPLAVLYTLVQRFYAATSRQLKRLESVSRSPIYSHFSETVTGASVIRAYNRSRDFEIISDTKVDANQRSCYPYIISNRSEAASLAPCSSRNSQQALWCSGSLSLLSPKQNNWPCPAPAPFPPHLIPHRWLSIGVEFVGNCVVLFAALFAVIGRSSLNPGLVGLSVSYSLQVTFALNWMIRMMSDLESNIVAVERVKEYSKTETEAPWVVEGSRPPEGWPPRGEVEFRNYSVRYRPGLDLVLRDLSLHVHGGEKVGIVGRTGAGKSSMTLCLFRILEAAKGEIRIDGLNVADIGLHDLRSQLTIIPQDPILFSGTLRMNLDPFGSYSEEDIWWALELSHLHTFVSSQPAGLDFQCSEGGENLSVGQRQLVCLARALLRKSRILVLDEATAAIDLETDNLIQATIRTQFDTCTVLTIAHRLNTIMDYTRVLVLDKGVVAEFDSPANLIAARGIFYGMARDAGLA

SEQ ID NO: 912254 - protein, 76 aa, Homo sapiens
GLWLLIGPKLPPSEATLYPQDPILFSGTLRMNLDPFGSYSEEDIWWALELSHLHTFVSSQPAGLDFQCSEGGENLR

SEQ ID NO: 912255 - protein, 102 aa, Homo sapiens
LSVWPTTIFCFLPIYTFQVNRPLFACWVLSVDFGNLSLCVIYPPVPPQNLGPSVLAGVAFMVLLIPLNGAVAVKMRAFQVGAVRGASSCLQHPAGCLGEGVH

SEQ ID NO: 912256 - protein, 1274 aa, Homo sapiens
MGAALPTSLLSPPHSILIRFISNPMAPSWWGFLVAGLMFLCSMMQSLILQHYYHYIFVTGVKFRTGIMGVIYRKVSWSRAQGKGWPWAACKRLQPSPPTTVYLQALVITNSVKRASTVGEIVNLMSVDAQRFMDLAPFLNLLWSAPLQIILAIYFLWQNLGPSVLAGVAFMVLLIPLNGAVAVKMRAFQVKQMKLKDSRIKLMSEILNGIKVLKLYAWEPSFLKQVEGIRQGELQLLRTAAYLHTTTTFTWMCSPFLVRLGTGLGPCLQGSGCPGMARAHWTLPWHHLHAAQVTLITLWVYVYVDPNNVLDAEKAFVSVSLFNILRLPLNMLPQLISNLTQASVSLKRIQQFLSQEELDPQSVERKTISPGYAITIHSGTFTWAQDLPPTLHSLDIQVPKGALVAVVGPVGCGKSSLVSALLGEMEKLEGKVHMKGSVAYVPQQAWIQNCTLQENVLFGKALNPKRYQQTLEACALLADLEMLPGGDQTEIGEKGINLSGGQRQRVSLARAVYSDADIFLLDDPLSAVDSHVAKHIFDHVIGPEGVLAGKTRVLVTHGISFLPQTDFIIVLADGQVSEMGPYPALLQRNGSFANFLCNYAPDEDQGHLEDSWTALEGAEDKEALLIEDTLSNHTDLTDNDPVTYVVQKQFMRQLSALSSDGEGQGRPVPRRHLGPSEKVQVTEAKADGALTQEEKAAIGTVELSVFWDYAKAVGLCTTLAICLLYVGQSAAAIGANVWLSAWTNDAMADSRQNNTSLRLGVYAALGILQGFLVMLAAMAMAAGGIQAARVLHQALLHNKIRSPQSFFDTTPSGRILNCFSKDIYVVDEVLAPVILMLLNSFFNAISTLVVIMASTPLFTVVILPLAVLYTLVQRFYAATSRQLKRLESVSRSPIYSHFSETVTGASVIRAYNRSRDFEIISDTKVDANQRSCYPYIISNRWLSIGVEFVGNCVVLFAALFAVIGRSSLNPGLVGLSVSYSLQVTFALNWMIRMMSDLESNIVAVERVKEYSKTETEAPWVVEGSRPPEGWPPRGEVEFRNYSVRYRPGLDLVLRDLSLHVHGGEKVGIVGRTGAGKSSMTLCLFRILEAAKGEIRIDGLNVADIGLHDLRSQLTIIPQDPILFSGTLRMNLDPFGSYSEEDIWWALELSHLHTFVSSQPAGLDFQCSEGGENLSVGQRQLVCLARALLRKSRILVLDEATAAIDLETDNLIQATIRTQFDTCTVLTIAHRLNTIMDYTRVLVLDKGVVAEFDSPANLIAARGIFYGMARDAGLA

SEQ ID NO: 912257 - protein, 1550 aa, Homo sapiens
MKKDSNLSVHTENPDLTPCFQNSLLAWVPCIYLWVALPCYLLYLRHHCRGYIILSHLSKLKMVLGVLLWCVSWADLFYSFHGLVHGRAPAPVFFVTPLVVGVTMLLATLLIQYERLQGVQSSGVLIIFWFLCVVCAIVPFRSKILLAKAEGEISDPFRFTTFYIHFALVLSALILACFREKPPFFSAKNVDPNPYPETSAGFLSRLFFWWFTKMAIYGYRHPLEEKDLWSLKEEDRSQMVVQQLLEAWRKQEKQTARHKASAAPGKNASGEDEVLLGARPRPRKPSFLKALLATFGSSFLISACFKLIQDLLSFINPQLLSILIRFISNPMAPSWWGFLVAGLMFLCSMMQSLILQHYYHYIFVTGVKFRTGIMGVIYRKALVITNSVKRASTVGEIVNLMSVDAQRFMDLAPFLNLLWSAPLQIILAIYFLWQNLGPSVLAGVAFMVLLIPLNGAVAVKMRAFQVKQMKLKDSRIKLMSEILNGIKVLKLYAWEPSFLKQVEGIRQGELQLLRTAAYLHTTTTFTWMCSPFLVRLGTGLGPCLQGSGCPGMARAHWTLPWHHLHAAQVTLITLWVYVYVDPNNVLDAEKAFVSVSLFNILRLPLNMLPQLISNLTQASVSLKRIQQFLSQEELDPQSVERKTISPGYAITIHSGTFTWAQDLPPTLHSLDIQVPKGALVAVVGPVGCGKSSLVSALLGEMEKLEGKVHMKGSVAYVPQQAWIQNCTLQENVLFGKALNPKRYQQTLEACALLADLEMLPGGDQTEIGEKGINLSGGQRQRVSLARAVYSDADIFLLDDPLSAVDSHVAKHIFDHVIGPEGVLAGKTRVLVTHGISFLPQTDFIIVLADGQVSEMGPYPALLQRNGSFANFLCNYAPDEDQGHLEDSWTALEGAEDKEALLIEDTLSNHTDLTDNDPVTYVVQKQFMRQLSALSSDGEGQGRPVPRRHLGPSEKVQVTEAKADGALTQEEKAAIGTVELSVFWDYAKAVGLCTTLAICLLYVGQSAAAIGANVWLSAWTNDAMADSRQNNTSLRLGVYAALGILQGFLVMLAAMAMAAGGIQAARVLHQALLHNKIRSPQSFFDTTPSGRILNCFSKDIYVVDEVLAPVILMLLNSFFNAISTLVVIMASTPLFTVVILPLAVLYTLVQRFYAATSRQLKRLESVSRSPIYSHFSETVTGASVIRAYNRSRDFEIISDTKVDANQRSCYPYIISNRWLSIGVEFVGNCVVLFAALFAVIGRSSLNPGLVGLSVSYSLQVTFALNWMIRMMSDLESNIVAVERVKEYSKTETEAPWVVEGSRPPEGWPPRGEVEFRNYSVRYRPGLDLVLRDLSLHVHGGEKVGIVGRTGAGKSSMTLCLFRILEAAKGEIRIDGLNVADIGLHDLRSQLTIIPQDPILFSGTLRMNLDPFGSYSEEDIWWALELSHLHTFVSSQPAGLDFQCSEGGENLSVGQRQLVCLARALLRKSRILVLDEATAAIDLETDNLIQATIRTQFDTCTVLTIAHRLNTIMDYTRVLVLDKGVVAEFDSPANLIAARGIFYGMARDAGLA

SEQ ID NO: 912258 - protein, 1636 aa, Homo sapiens
GSGRSAGCGGRRRLRRPLCPPLGPTALAFLAAAPRPHGRPVRFRGARLQVLEPSPLPDSPRPSPNIVKAKSDAPGKGISLGGRVLKMKKDSNLSVHTENPDLTPCFQNSLLAWVPCIYLWVALPCYLLYLRHHCRGYIILSHLSKLKMVLGVLLWCVSWADLFYSFHGLVHGRAPAPVFFVTPLVVGVTMLLATLLIQYERLQGVQSSGVLIIFWFLCVVCAIVPFRSKILLAKAEGEISDPFRFTTFYIHFALVLSALILACFREKPPFFSAKNVDPNPYPETSAGFLSRLFFWWFTKMAIYGYRHPLEEKDLWSLKEEDRSQMVVQQLLEAWRKQEKQTARHKASAAPGKNASGEDEVLLGARPRPRKPSFLKALLATFGSSFLISACFKLIQDLLSFINPQLLSILIRFISNPMAPSWWGFLVAGLMFLCSMMQSLILQHYYHYIFVTGVKFRTGIMGVIYRKALVITNSVKRASTVGEIVNLMSVDAQRFMDLAPFLNLLWSAPLQIILAIYFLWQNLGPSVLAGVAFMVLLIPLNGAVAVKMRAFQVKQMKLKDSRIKLMSEILNGIKVLKLYAWEPSFLKQVEGIRQGELQLLRTAAYLHTTTTFTWMCSPFLVRLGTGLGPCLQGSGCPGMARAHWTLPCHHLHAAQVTLITLWVYVYVDPNNVLDAEKAFVSVSLFNILRLPLNMLPQLISNLTQASVSLKRIQQFLSQEELDPQSVERKTISPGYAITIHSGTFTWAQDLPPTLHSLDIQVPKGALVAVVGPVGCGKSSLVSALLGEMEKLEGKVHMKGSVAYVPQQAWIQNCTLQENVLFGKALNPKRYQQTLEACALLADLEMLPGGDQTEIGEKGINLSGGQRQRVSLARAVYSDADIFLLDDPLSAVDSHVAKHIFDHVIGPEGVLAGKTRVLVTHGISFLPQTDFIIVLADGQVSEMGPYPALLQRNGSFANFLCNYAPDEDQGHLEDSWTALEGAEDKEALLIEDTLSNHTDLTDNDPVTYVVQKQFMRQLSALSSDGEGQGRPVPRRHLGPSEKVQVTEAKADGALTQEEKAAIGTVELSVFWDYAKAVGLCTTLAICLLYVGQSAAAIGANVWLSAWTNDAMADSRQNNTSLRLGVYAALGILQGFLVMLAAMAMAAGGIQAARVLHQALLHNKIRSPQSFFDTTPSGRILNCFSKDIYVVDEVLAPVILMLLNSFFNAISTLVVIMASTPLFTVVILPLAVLYTLVQRFYAATSRQLKRLESVSRSPIYSHFSETVTGASVIRAYNRSRDFEIISDTKVDANQRSCYPYIISNRWLSIGVEFVGNCVVLFAALFAVIGRSSLNPGLVGLSVSYSLQVTFALNWMIRMMSDLESNIVAVERVKEYSKTETEAPWVVEGSRPPEGWPPRGEVEFRNYSVRYRPGLDLVLRDLSLHVHGGEKVGIVGRTGAGKSSMTLCLFRILEAAKGEIRIDGLNVADIGLHDLRSQLTIIPQDPILFSGTLRMNLDPFGSYSEEDIWWALELSHLHTFVSSQPAGLDFQCSEGGENLSVGQRQLVCLARALLRKSRILVLDEATAAIDLETDNLIQATIRTQFDTCTVLTIAHRLNTIMDYTRVLVLDKGVVAEFDSPANLIAARGIFYGMARDAGLA

SEQ ID NO: 912259 - protein, 624 aa, Homo sapiens
MRQLSALSSDGEGQGRPVPRRHLGPSEKVQVTEAKADGALTQEEKAAIGTVELSVFWDYAKAVGLCTTLAICLLYVGQSAAAIGANVWLSAWTNDAMADSRQNNTSLRLGVYAALGILQGFLVMLAAMAMAAGGIQAARVLHQALLHNKIRSPQSFFDTTPSGRILNCFSKDIYVVDEVLAPVILMLLNSFFNAISTLVVIMASTPLFTVVILPLAVLYTLVQRFYAATSRQLKRLESVSRSPIYSHFSETVTGASVIRAYNRSRDFEIISDTKVDANQRSCYPYIISNRWLSIGVEFVGNCVVLFAALFAVIGRSSLNPGLVGLSVSYSLQVTFALNWMIRMMSDLESNIVAVERVKEYSKTETEAPWVVEGSRPPEGWPPRGEVEFRNYSVRYRPGLDLVLRDLSLHVHGGEKVGIVGRTGAGKSSMTLCLFRILEAAKGEIRIDGLNVADIGLHDLRSQLTIIPQDPILFSGTLRMNLDPFGSYSEEDIWWALELSHLHTFVSSQPAGLDFQCSEGGENLSVGQRQLVCLARALLRKSRILVLDEATAAIDLETDNLIQATIRTQFDTCTVLTIAHRLNTIMDYTRVLVLDKGVVAEFDSPANLIAARGIFYGMARDAGLA

SEQ ID NO: 912260 - protein, 487 aa, Homo sapiens
GPGGARGAEGGGGSGARSARRWVRPRSPSLQPRLGPMDALCGSGELGSKFWDSNLSVHTENPDLTPCFQNSLLAWVPCIYLWVALPCYLLYLRHHCRGYIILSHLSKLKMVLGVLLWCVSWADLFYSFHGLVHGRAPAPVFFVTPLVVGVTMLLATLLIQYERLQGVQSSGVLIIFWFLCVVCAIVPFRSKILLAKAEGEISDPFRFTTFYIHFALVLSALILACFREKPPFFSAKNVDPNPYPETSAGFLSRLFFWWFTKMAIYGYRHPLEEKDLWSLKEEDRSQMVVQQLLEAWRKQEKQTARHKASAAPGKNASGEDEVLLGARPRPRKPSFLKALLATFGSSFLISACFKLIQDLLSFINPQLLSILIRFISNPMAPSWWGFLVAGLMFLCSMMQSLILQHYYHYIFVTGVKFRTGIMGVIYRKALVITNSVKRASTVGEIVNLMSVDAQRFMDLAPFLNLLWSAPLQIILAIYFLWQVTLQP

SEQ ID NO: 912261 - protein, 1221 aa, Homo sapiens
MGAALPTSLLSPPHSILIRFISNPMAPSWWGFLVAGLMFLCSMMQSLILQHYYHYIFVTGVKFRTGIMGVIYRKVSWSRAQGKGWPWAACKRLQPSPPTTVYLQALVITNSVKRASTVGEIVNLMSVDAQRFMDLAPFLNLLWSAPLQIILAIYFLWQNLGPSVLAGVAFMVLLIPLNGAVAVKMRAFQVKQMKLKDSRIKLMSEILNGIKVLKLYAWEPSFLKQVEGIRQGELQLLRTAAYLHTTTTFTWMCSPFLVRLGTGLGPCLQGSGCPGMARAHWTLPWHHLHAAQVTLITLWVYVYVDPNNVLDAEKAFVSVSLFNILRLPLNMLPQLISNLTQASVSLKRIQQFLSQEELDPQSVERKTISPGYAITIHSGTFTWAQDLPPTLHSLDIQVPKGALVAVVGPVGCGKSSLVSALLGEMEKLEGKVHMKGSVAYVPQQAWIQNCTLQENVLFGKALNPKRYQQTLEACALLADLEMLPGGDQTEIGEKGINLSGGQRQRVSLARAVYSDADIFLLDDPLSAVDSHVAKHIFDHVIGPEGVLAGKTRVLVTHGISFLPQTDFIIVLADGQVSEMGPYPALLQRNGSFANFLCNYAPDEDQGHLEDSWTALEGAEDKEALLIEDTLSNHTDLTDNDPVTYVVQKQFMRQLSALSSDGEGQGRPVPRRHLGPSEKVQVTEAKADGALTQEEKAAIGTVELSVFWDYAKAVGLCTTLAICLLYVGQSAAAIGANVWLSAWTNDAMADSRQNNTSLRLGVYAALGILQGFLVMLAAMAMAAGGIQAARVLHQALLHNKIRSPQSFFDTTPSGRILNCFSKDIYVVDEVLAPVILMLLNSFFNAISTLVVIMASTPLFTVVILPLAVLYTLVQRFYAATSRQLKRLESVSRSPIYSHFSETVTGASVIRAYNRSRDFEIISDTKVDANQRSCYPYIISNRWLSIGVEFVGNCVVLFAALFAVIGRSSLNPGLVGLSVSYSLQVTFALNWMIRMMSDLESNIVAVERVKEYSKTETEAPWVVEGSRPPEGWPPRGEVEFRNYSVRYRPGLDLVLRDLSLHVHGGEKVGIVGRTGAGKSSMTLCLFRILEAAKGEIRIDGLNVADIGLHDLRSQLTIIPQDPILFSGTLRMNLDPFGSYSEEDIWWALELSHLHTFVSSQPAGLDFQCSEGGENLSVGQRQLVCLARALLRKSRILVLDEATAAIDLETDNLIQATIRMLERF

SEQ ID NO: 912262 - protein, 124 aa, Homo sapiens
MSSVPDKGCGRLDFQCSEGGENLSVGQRQLVCLARALLRKSRILVLDEATAAIDLETDNLIQATIRTQFDTCTVLTIAHRLNTIMDYTRVLVLDKGVVAEFDSPANLIAARGIFYGMARDAGLA

SEQ ID NO: 912263 - protein, 50 aa, Homo sapiens
MKLKDSRIKLMSEILNGIKVLKLYAWEPSFLKQVEGIRQGELQLLRTAAY

SEQ ID NO: 912264 - protein, 319 aa, Homo sapiens
MATKGGTVKAASGFNAMEDAQTLRKAMKGLGTDEDAIISVLAYRNTAQRQEIRTAYKSTIGRDLIDDLKSELSGNFEQVIVGMMTPTVLYDVQELRRAMKGAGTDEGCLIEILASRTPEEIRRISQTYQQQYGRSLEDDIRSDTSFMFQRVLVSLSAGGRDEGNYLDDALVRQDAQDLYEAGEKKWGTDEVKFLTVLCSRNRNHLLHVFDEYKRISQKDIEQSIKSETSGSFEDALLAIVKCMRNKSAYFAEKLYKSMKGLGTDDNTLIRVMVSRAEIDMLDIRAHFKRLYGKSLYSFIKGDTSGDYRKVLLVLCGGDD

SEQ ID NO: 912265 - protein, 184 aa, Homo sapiens
MATKGGTVKAASGFNAMEDAQTLRKAMKGLGTDEDAIISVLAYRNTAQRQEIRTAYKSTIGRDLIDDLKSELSGNFEQVIVGMMTPTVLYDVQELRRAMKGAGTDEGCLIEILASRTPEEIRRISQTYQQQYGRSLEDDIRSDTSFMFQRVLVSLSAVGGKKEVSRHCFSEHDPMILISIAQRI

SEQ ID NO: 912266 - protein, 319 aa, Homo sapiens; identical to SEQ ID NO: 912264

SEQ ID NO: 912267 - protein, 321 aa, Homo sapiens
MAMATKGGTVKAASGFNAMEDAQTLRKAMKGLGTDEDAIISVLAYRNTAQRQEIRTAYKSTIGRDLIDDLKSELSGNFEQVIVGMMTPTVLYDVQELRRAMKGAGTDEGCLIEILASRTPEEIRRISQTYQQQYGRSLEDDIRSDTSFMFQRVLVSLSAGGRDEGNYLDDALVRQDAQDLYEAGEKKWGTDEVKFLTVLCSRNRNHLLHVFDEYKRISQKDIEQSIKSETSGSFEDALLAIVKCMRNKSAYFAEKLYKSMKGLGTDDNTLIRVMVSRAEIDMLDIRAHFKRLYGKSLYSFIKGDTSGDYRKVLLVLCGGDD

SEQ ID NO: 912268 - protein, 237 aa, Homo sapiens
MMTPTVLYDVQELRRAMKGAGTDEGCLIEILASRTPEEIRRISQTYQQQYGRSLEDDIRSDTSFMFQRVLVSLSAGGRDEGNYLDDALVRQDAQDLYEAGEKKWGTDEVKFLTVLCSRNRNHLLHVFDEYKRISQKDIEQSIKSETSGSFEDALLAIVKCMRNKSAYFAEKLYKSMKGLGTDDNTLIRVMVSRAEIDMLDIRAHFKRLYGKSLYSFIKGDTSGDYRKVLLVLCGGDD

SEQ ID NO: 912269 - protein, 336 aa, Homo sapiens
MATKGGTVKAASGFNAMEDAQTLRKAMKGLGTDEDAIISVLAYRNTAQRQEIRTAYKSTIGRDLIDDLKSELSGNFEQVIVGMMTPTVLYDVQELRRAMKGAGTDEGCLIEILASRTPEEIRRISQTYQQQYGRSLEDDIRSDTSFMFQRVLVSLSAGGRDEGNYLDDALVRQDAQDLYEAGEKKWGTDEVKFLTVLCSRNRNHLLHVFDEYKRISQKDIEQSIKSETSGSFEDALLAIVKCMRNKSAYFAEKLYKSMKGLGTDDNTLIRVMVSRAEIDMLDIRAHFKRLYGKSLYSFIKGDTSGDYRKVLLVLCGGDDFIFLHCYYHYLRMLISN

SEQ ID NO: 912270 - protein, 246 aa, Homo sapiens
SCRFGTIVGMMTPTVLYDVQELRRAMKGAGTDEGCLIEILASRTPEEIRRISQTYQQQYGRSLEDDIRSDTSFMFQRVLVSLSAGGRDEGNYLDDALVRQDAQDLYEAGEKKWGTDEVKFLTVLCSRNRNHLLHVFDEYKRISQKDIEQSIKSETSGSFEDALLAIVKCMRNKSAYFAEKLYKSMKGLGTDDNTLIRVMVSRAEIDMLDIRAHFKRLYGKSLYSFIKGDTSGDYRKVLLVLCGGDD

SEQ ID NO: 912271 - protein, 319 aa, Homo sapiens; identical to SEQ ID NO: 912264

SEQ ID NO: 912272 - protein, 255 aa, Homo sapiens
LRGSQSLEREEEEPARRILLGGDSVLDQSHGMATKGGTVKAASGFNAMEDAQTLRKAMKGLGTDEDAIISVLAYRNTAQRQEIRTAYKSTIGRGGRDEGNYLDDALVRQDAQDLYEAGEKKWGTDEVKFLTVLCSRNRNHLLHVFDEYKRISQKDIEQSIKSETSGSFEDALLAIVKCMRNKSAYFAEKLYKSMKGLGTDDNTLIRVMVSRAEIDMLDIRAHFKRLYGKSLYSFIKGDTSGDYRKVLLVLCGGDD

SEQ ID NO: 912273 - protein, 164 aa, Homo sapiens
MLSGNSIATYWWRYLEWSTRDDLYEAGEKKWGTDEVKFLTVLCSRNRNHLLHVFDEYKRISQKDIEQSIKSETSGSFEDALLAIVKCMRNKSAYFAEKLYKSMKGLGTDDNTLIRVMVSRAEIDMLDIRAHFKRLYGKSLYSFIKGDTSGDYRKVLLVLCGGDD

SEQ ID NO: 912274 - protein, 133 aa, Homo sapiens
DHRTKYFFFFFFEIESRSVAQAGVQWRDLVSLQPPPPGFKQFSCSFEDALLAIVKCMRNKSAYFAEKLYKSMKGLGTDDNTLIRVMVSRAEIDMLDIRAHFKRLYGKSLYSFIKGDTSGDYRKVLLVLCGGDD

SEQ ID NO: 912275 - protein, 214 aa, Homo sapiens
MATKGGTVKAASGFNAMEDAQTLRKAMKGLGTDEDAIISVLAYRNTAQRQEIRTAYKSTIGRDLIDDLKSELSGNFEQVIVGMMTPTVLYDVQELRRAMKGAGTDEGCLIEILASRTPEEIRRISQTYQQQYGRSLEDDIRSDTSFMFQRVLVSLSAGGRDEGNYLDDALVRQDAQDLYEAGEKKWGTDEVKFLTVLCSRNRNHLLHVLPGDPL

SEQ ID NO: 912276 - protein, 190 aa, Homo sapiens
MATKGGTVKAASGFNAMEDAQTLRKAMKGLGTDEDAIISVLAYRNTAQRQEIRTAYKSTIGRDLIDDLKSELSGNFEQVIVGMMTPTVLYDVQELRRAMKGAGTDEGCLIEILASRTPEEIRRISQTYQQQYGRSLEDDIRSDTSFMFQRVLVSLSAGGRDEGNYLDDALVRQDAQTCMSCERFGSSRYP

SEQ ID NO: 912277 - protein, 132 aa, Homo sapiens
MATKGGTVKAASGFNAMEDAQTLRKAMKGLGTDEDAIISVLAYRNTAQRQEIRTAYKSTIGRDLIDDLKSELSGNFEQVIVGMMTPTVLYDVQELRRAMKGAGTDEGCLIEILASRTPEEIRRISQTYQQRT

SEQ ID NO: 912278 - protein, 132 aa, Homo sapiens; identical to SEQ ID NO: 912277

SEQ ID NO: 912279 - protein, 319 aa, Homo sapiens; identical to SEQ ID NO: 912264

SEQ ID NO: 912280 - protein, 241 aa, Homo sapiens
MATKGGTVKAASGFNAMEDAQTLRKAMKGLGTDEDAIISVLAYRNTAQRQEIRTAYKSTIGRDLIDDLKSELSGNFEQVIVGMMTPTVLYDVQELRRAMKGAGTDEGCLIEILASRTPEEIRRISQTYQQQYGRSLEDDIRSDTSFMFQRVLVSLSAGGRDEGNYLDDALVRQDAQDLYEAGEKKWGTDEVKFLTVLCSRNRNHLLHVFDEYKKDNTFARDNTFARDTPSRGIHVAEGLHV

SEQ ID NO: 912281 - protein, 319 aa, Homo sapiens; identical to SEQ ID NO: 912264

SEQ ID NO: 912282 - protein, 319 aa, Homo sapiens; identical to SEQ ID NO: 912264

SEQ ID NO: 912283 - protein, 319 aa, Homo sapiens; identical to SEQ ID NO: 912264

SEQ ID NO: 912284 - protein, 173 aa, Homo sapiens [sequence omitted]

SEQ ID NO: 912285 - protein, 224 aa, Homo sapiens
MATKGGTVKAASGFNAMEDAQTLRKAMKGLGTDEDAIISVLAYRNTAQRQEIRTAYKSTIGRGGRDEGNYLDDALVRQDAQDLYEAGEKKWGTDEVKFLTVLCSRNRNHLLHVFDEYKRISQKDIEQSIKSETSGSFEDALLAIVKCMRNKSAYFAEKLYKSMKGLGTDDNTLIRVMVSRAEIDMLDIRAHFKRLYGKSLYSFIKGDTSGDYRKVLLVLCGGDD

SEQ ID NO: 912286 - protein, 177 aa, Homo sapiens [sequence omitted]

SEQ ID NO: 912287 - protein, 278 aa, Homo sapiens
MATKGGTVKAASGFNAMEDAQTLRKAMKGLGTDEDAIISVLAYRNTAQRQEIRTAYKSTIGRDLIDDLKSELSGNFEQVIVGMMTPTVLYDVQELRRAMKGAGTDEGCLIEILASRTPEEIRRISQTYQQQYGRSLEDDIRSDTSFMFQRVLVSLSAGGRDEGNYLDDALVRQDAQDLYEAGEKKWGTDEVKFLTVLCSRNRNHLLHVFDEYKRISQKDIEQSIKSETSGSFEDALLAIVKCMRNKSAYFAEKLYKSMKGDTSGDYRKVLLVLCGGDD

SEQ ID NO: 912288 - protein, 241 aa, Homo sapiens; identical to SEQ ID NO: 912280

SEQ ID NO: 912289 - protein, 183 aa, Homo sapiens
MATKGGTVKAASGFNAMEDAQTLRKAMKGLGTDEDAIISVLAYRNTAQRQEIRTAYKSTIGRDLIDDLKSELSGNFEQVIVGMMTPTVLYDVQELRRAMKGAGTDEGCLIEILASRTPEEIRRISQTYQQQYGRSLEDDIRSDTSFMFQRVLVSLSASDGRDRMEIICPMLSLYHHDVTRPPS

SEQ ID NO: 912290 - protein, 121 aa, Homo sapiens
SALRGCGAPGKRDPKNPTAPTLRGQERGWRYWGHCPIRAGGEAGGPGGPGEQARVEGGPAGGRGLPLRELLARPSRPGAPGALPLERDFPVSWAEEQPGTWAQSPPHSGADPSRIRPAVWP

SEQ ID NO: 912291 - protein, 816 aa, Homo sapiens
MSGEAWQLQLGAHRRLPRLSEAGAAAMLRGGRRGQLGWHSWAAGPGSLLAWLILASAGAAPCPDACCPHGSSGLRCTRDGALDSLHHLPGAENLTELYIENQQHLQHLELRDLRGLGELRNLTIVKSGLRFVAPDAFHFTPRLSRLNLSFNALESLSWKTVQGLSLQELVLSGNPLHCSCALRWLQRWEEEGLGGVPEQKLQCHGQGPLAHMPNASCGVPTLKVQVPNASVDVGDDVLLRCQVEGRGLEQAGWILTELEQSATVMKSGGLPSLGLTLANVTSDLNRKNVTCWAENDVGRAEVSVQVNVSFPASVQLHTAVEMHHWCIPFSVDGQPAPSLRWLFNGSVLNETSFIFTEFLEPAANETVRHGCLRLNQPTHVNNGNYTLLAANPFGQASASIMAAFMDNPFEFNPEDPIPDTNSTSGDPVEKKDETPFGVSVAVGLAVFACLFLSTLLLVLNKCGRRNKFGINRPAVLAPEDGLAMSLHFMTLGGSSLSPTEGKGSGLQGHIIENPQYFSDACVHHIKRRDIVLKWELGEGAFGKVFLAECHNLLPEQDKMLVAVKALKEASESARQDFQREAELLTMLQHQHIVRFFGVCTEGRPLLMVFEYMRHGDLNRFLRSHGPDAKLLAGGEDVAPGPLGLGQLLAVASQVAAGMVYLAGLHFVHRDLATRNCLVGQGLVVKIGDFGMSRDIYSTDYYRVGGRTMLPIRWMPPESILYRKFTTESDVWSFGVVLWEIFTYGKQPWYQLSNTEAIDCITQGRELERPRACPPEVYAIMRGCWQREPQQRHSIKDVHARLQALAQAPPVYLDVLG

SEQ ID NO: 912292 - protein, 506 aa, Homo sapiens
GPTDMAAVLQQVLERTELNKLPKSVQNKLEKFLADRQSEIDGLKGRHEKFKVESEQQYFEIEKRLSHSQERLVNETRECQSLRLELEKLNNQLKALTEKNKELEIAQDRNIAIQSQFTRTKEELEAEKRDLIRTNERLSQELEYLTEDVKRLNEKLKESNTTKGELQLKLDELQASDVSVKYREKRLEKKRNCSGLQGHIIENPQYFSDACVHHIKRRDIVLKWELGEGAFGKVFLAECHNLLPEQDKMLVAVKALKEASESARQDFQREAELLTMLQHQHIVRFFGVCTEGRPLLMVFEYMRHGDLNRFLRSHGPDAKLLAGGEDVAPGPLGLGQLLAVASQVAAGMVYLAGLHFVHRDLATRNCLVGQGLVVKIGDFGMSRDIYSTDYYRVGGRTMLPIRWMPPESILYRKFTTESDVWSFGVVLWEIFTYGKQPWYQLSNTEAIDCITQGRELERPRACPPEVYAIMRGCWQREPQQRHSIKDVHARLQALAQAPPVYLDVLG

SEQ ID NO: 912293 - protein, 439 aa, Homo sapiens
MPKGKKAKGKKVAPAPAVVKKQEAKKVVNPLFEKRPKNFGIDTNSTSGDPVEKKDETPFGVSVAVGLAVFACLFLSTLLLVLNKCGRRNKFGINRPAVLAPEDGLAMSLHFMTLGGSSLSPTEGKGSGLQGHIIENPQYFSDACVHHIKRRDIVLKWELGEGAFGKVFLAECHNLLPEQDKMLVAVKALKEASESARQDFQREAELLTMLQHQHIVRFFGVCTEGRPLLMVFEYMRHGDLNRFLRSHGPDAKLLAGGEDVAPGPLGLGQLLAVASQVAAGMVYLAGLHFVHRDLATRNCLVGQGLVVKIGDFGMSRDIYSTDYYRVGGRTMLPIRWMPPESILYRKFTTESDVWSFGVVLWEIFTYGKQPWYQLSNTEAIDCITQGRELERPRACPPEVYAIMRGCWQREPQQRHSIKDVHARLQALAQAPPVYLDVLG

SEQ ID NO: 912294 - protein, 597 aa, Homo sapiens
NILESTMNGQLDLSGKLIVKAQLGEDIRRIPIHNEDITYDELVLMMQRVFRGKLLSNDEVTIKYKDEDGDLITIFDSSDLSFAIQCSRILKLTLFVNGQPRPLESSQVKYLRRELIELRNKVNRLLDSLEPPGEPGPSTNIPENDTVDGREEKSASDSSGKQSTQVMAASMSAFDPLKNQDEINKNVMSAFGLTDDQVFDTNSTSGDPVEKKDETPFGVSVAVGLAVFACLFLSTLLLVLNKCGRRNKFGINRPAVLAPEDGLAMSLHFMTLGGSSLSPTEGKGSGLQGHIIENPQYFSDACVHHIKRRDIVLKWELGEGAFGKVFLAECHNLLPEQDKMLVAVKALKEASESARQDFQREAELLTMLQHQHIVRFFGVCTEGRPLLMVFEYMRHGDLNRFLRSHGPDAKLLAGGEDVAPGPLGLGQLLAVASQVAAGMVYLAGLHFVHRDLATRNCLVGQGLVVKIGDFGMSRDIYSTDYYRVGGRTMLPIRWMPPESILYRKFTTESDVWSFGVVLWEIFTYGKQPWYQLSNTEAIDCITQGRELERPRACPPEVYAIMRGCWQREPQQRHSIKDVHARLQALAQAPPVYLDVLG

SEQ ID NO: 912295 - protein, 120 aa, Homo sapiens
MGTGKGWGKLPGVTSPGLQVIEEGGGRSSPAVEFWGHSQLYHPLALGRPGWPGVPTLKVQVPNASVDVGDDVLLRCQVEGRGLEQAGWILTELEQSATVMVRRPSLAAPKRSRQSTGDKD

SEQ ID NO: 912296 - protein, 207 aa, Homo sapiens
MPITRMRMRPWLEMQINSNQIPGLIWINKEEMIFQIPWKHAAKHGWDINKDACLFRSWAIHTGRYKAGEKEPDPKTWKANFRCAMNSLPDIEEVKDQSRNKGSSAVRVYRMLPPLTKNQRKERKSKSSRDAKSKAKRKSCGDSSPDTFSDGLSSSTLPDDHSSYTVPGYMQDLEVEQALTPALSPCAVSSTLPRLAHPSGSCAGQHQ

SEQ ID NO: 912297 - protein, 207 aa, Homo sapiens; identical to SEQ ID NO: 912296

SEQ ID NO: 912298 - protein, 207 aa, Homo sapiens; identical to SEQ ID NO: 912296

SEQ ID NO: 912299 - protein, 207 aa, Homo sapiens; identical to SEQ ID NO: 912296

SEQ ID NO: 912300 - protein, 180 aa, Homo sapiens
MPITRMRMRPWLEMQINSNQIPGLIWINKEEMIFQIPWKHAAKHGWDINKDACLFRSWAIHTDIEEVKDQSRNKGSSAVRVYRMLPPLTKNQRKERKSKSSRDAKSKAKRKSCGDSSPDTFSDGLSSSTLPDDHSSYTVPGYMQDLEVEQALTPALSPCAVSSTLPRLAHPSGSCAGQHQ

SEQ ID NO: 912301 - protein, 207 aa, Homo sapiens; identical to SEQ ID NO: 912296

SEQ ID NO: 912302 - protein, 207 aa, Homo sapiens; identical to SEQ ID NO: 912296

SEQ ID NO: 912303 - protein, 207 aa, Homo sapiens; identical to SEQ ID NO: 912296

SEQ ID NO: 912304 - protein, 116 aa, Homo sapiens
SSSTLPDDHSSYTVPGYMQDLEVEQALTPGELVQVWQETPQVSGMTLSLGGMVLAHGGPLVQAAGLVGGRSMSCKLRKHTTLTCGFCCSPALSPCAVSSTLPRLAHPSGSCAGQHQ

SEQ ID NO: 912305 - protein, 207 aa, Homo sapiens; identical to SEQ ID NO: 912296

SEQ ID NO: 912306 - protein, 207 aa, Homo sapiens; identical to SEQ ID NO: 912296

SEQ ID NO: 912307 - protein, 123 aa, Homo sapiens
MNSLPDIEEVKDQSRNKGSSAVRVYRMLPPLTKNQRKERKSKSSRDAKSKAKRKSCGDSSPDTFSDGLSSSTLPDDHSSYTVPGYMQDLEVEQALTPALSPCAVSSTLPRLAHPSGSCAGQHQ

SEQ ID NO: 912308 - protein, 284 aa, Homo sapiens
MPITRMRMRPWLEMQINSNQIPGLIWINKEEMIFQIPWKHAAKHGWDINKDACLFRSWAIHTGRYKAGEKEPDPKTWKANFRCAMNSLPDIEEVKDQSRNKGSSAVRVYRMLPPLTKNQRKERKSKSSRDAKSKAKRKSCGDSSPDTFSDGLSSSTLPDDHSSYTVPGYMQDLEVEQALTPATTDEDEEGKLPEDIMKLLEQSEWQPTNVDGKGYLLNEPGVQPTSVYGDFSCKEEPEIDSPGGDIGLSLQRVFTDLKNMDATWLDSLLTPVRLPSIQAIPCAP

SEQ ID NO: 912309 - protein, 207 aa, Homo sapiens; identical to SEQ ID NO: 912296

SEQ ID NO: 912310 - protein, 207 aa, Homo sapiens; identical to SEQ ID NO: 912296

SEQ ID NO: 912311 - protein, 253 aa, Homo sapiens
SPTLAPSYIPGYPHYHGLLLAELGTGRLQTTSGPRSPVLILRNHGLVSVGESVEEAFYYIHNLVVACEIQVRTLASAGGPDNLVLLNPEKYKAKSRSPGSPVGEGTGSPPKWQIGEQEFEALMRMLDNLGYRTGYPYRYPALREKSKKYSDVEVPASVTGYSFASDGDSGTCSPLRHSFQKQQREKTRWLNSGRGDEASEEGQNGSSPKSKTKVWTNITHDHVKPLLQSLSSGVCVPSCITNCLVCAYLTVHS

SEQ ID NO: 912312 - protein, 483 aa, Homo sapiens
MHHIAFHDPVISCFQLALVLDDFQSSEPMVSEGPPLLVPGLWGSALSSAYLMTQIQLGFPDGGFPSVMTLTSSINWSLCGCILLPWRLCWVTQIRCGHWFSPLCDVQCMTRCEDKLNRLDAMSLIVVIILTFQLFLILQWTKEDGHRTSTSAVPNLFVPLNTNPKEVQEMRNKIREQNLQDIKTAGPQSQVLCGVVMDRSLVQVRAQSVSDFSGWWLCDRLLQSYSEIERVTLLGKYSRQPVTFVKTFMMRNGSGTFLLSSRRSEHAEGCVHPSGHAPCNACICEGGTYTTSFGAQIRPGFSSVLCKALGEGGFRDSVFWYILLSATKCCLGCRGVGACKCGAHLHTFLQNDSTLWHIEDNCVSSYLLKTNMPPNALTPDSAGVDDCWICPAVVLVSCSVSARPAIITATLTVDSCPCCMLLASSILCSQLIFHRLGLVCSGDSVYCFRMHLSLTVRKLSKGSSLQSRPLVPLNLSLLERESW

SEQ ID NO: 912313 - protein, 1014 aa, Homo sapiens
MHHIAFHDPVISCFQLALVLDDFQSSEPMVSEGPPLLVPGLWGSALSSAYLMTQIQLGFPDGGFPSVMTLTSSINWSLCGCILLPWRLCWVTQIRCGHWFSPLCDVQCMTRCEDKLNRLDAMSLIVVIILTFQLFLILQWTKEDGHRTSTSAVPNLFVPLNTNPKEVQEMRNKIREQNLQDIKTAGPQSQVLCGVVMDRSLVQGELVTASKAIIEKEYQPHVIVSTTGPNPFTTLTDRELEEYRREVERKQKGSEENLDEAREQKEKSPPDQPAVPHPPPSTPIKLEEGELWVAAAAYCGRVHGSCALWRNVAGVVLTATRKCVLASAPGRDTFSPPILLLSWVTPGKTDLYVSCDQVGRPASGVGTHHGCWCPRCPLLAHSSCCVVMQMPPSEVPSAVWATRRLPLSHRVSVVCDPGCLSLGLVHPCLSVKPVALPFFFCNLMAVTECIDSLLVLFFSLWLRHKQETDALESTCYPSKYRAASALHRCPALCLILLLLCCLLSFVFCLFENKNRSPPFLYPVPWRPSWKWFSHLSAVLPSAAAGTSTHLGAMEHSGPQEFLPPAFEGLFGLLGGRVLPHWIRCKCSLGSDRVGFCHLPCGVRLPWTFAEAGPKEVGRGADIGPSYSSVMFTQMMAALQSECPGAASVLASATPCPAERAPSPQGERRLCAHSPFPVLMKRGLESAWGSWQGGGASSFPKVKHWEFGAWASCAAPNHSADSPGPDVWLRFLNTKQLVVPNLSVAGNFVGRLRMDRAGARVSARKAPPGCVLRAAVLLHRWPLLMLGGVFAPTPCLTGHLFPFNYTSSLNGFVLLDVDVTNVLWELCTIFYWLFWGRPGVVDPNLDLISVLLVHALRVTGQTSRHIMKAGRRSFSRPQLVLQSVFPAGGPRPGTELVLSAHCPPEGAKNYPETESVFYDISSIQPYSESRPYFKFLVLVKICESKIKWQFRVWGSPISSCPLRSGQEPLIPSLTSPTRTLCRSRLLEMTVMLPPLSQLSPICPLMNLQKHSASQC

SEQ ID NO: 912314 - protein, 253 aa, Homo sapiens; identical to SEQ ID NO: 912311

SEQ ID NO: 912315 - protein, 338 aa, Homo sapiens
SPTLAPSYIPGYPHYHGLLLAELGTGRLQTTSGPRSPVLILRNHGLVSVGESVEEAFYYIHNLVVACEIQVRTLASAGGPDNLVLLNPEKYKAKSRSPGSPVGEGTGSPPKWQIGEQEFEALMRMLDNLGYRTGYPYRYPALREKSKKYSDVEVPASVTGYSFASDGDSGTCSPLRHSFQKQQREKTRWLNSGRGDEASEEGQNGSSPKSKTKVWTNITHDHVKPLLQSLSSGVCVPSCITNCLWTKEDGHRTSTSAVPNLFVPLNTNPKEVQEMRNKIREQNLQDIKTAGPQSQVLCGVVMDRSLVQVRAQSVSDFSGWWLCDRLLQSYSEIERVTL

SEQ ID NO: 912316 - protein, 483 aa, Homo sapiens; identical to SEQ ID NO: 912312

SEQ ID NO: 912317 - protein, 253 aa, Homo sapiens; identical to SEQ ID NO: 912311

SEQ ID NO: 912318 - protein, 253 aa, Homo sapiens; identical to SEQ ID NO: 912311

SEQ ID NO: 912319 - protein, 253 aa, Homo sapiens; identical to SEQ ID NO: 912311

SEQ ID NO: 912320 - protein, 253 aa, Homo sapiens; identical to SEQ ID NO: 912311

SEQ ID NO: 912321 - protein, 253 aa, Homo sapiens; identical to SEQ ID NO: 912311

SEQ ID NO: 912322 - protein, 253 aa, Homo sapiens; identical to SEQ ID NO: 912311

SEQ ID NO: 912323 - protein, 253 aa, Homo sapiens; identical to SEQ ID NO: 912311

SEQ ID NO: 912324 - protein, 114 aa, Homo sapiens [sequence omitted]

SEQ ID NO: 912325 - protein, 253 aa, Homo sapiens; identical to SEQ ID NO: 912311

SEQ ID NO: 912326 - protein, 355 aa, Homo sapiens
MLDNLGYRTGYPYRYPALREKSKKYSDVEVPASVTGYSFASDGDSGTCSPLRHSFQKQQREKTRWLNSGRGDEASEEGQNGSSPKSKTKWTKEDGHRTSTSAVPNLFVPLNTNPKEVQEMRNKIREQNLQDIKTAGPQSQVLCGVVMDRSLVQGELVTASKAIIEKEYQPHVIVSTTGPNPFTTLTDRELEEYRREVERKQKGSEENLDEAREQKEKSPPDQPAVPHPPPSTPIKLEEDLVPEPTTGDDSDAATFKPTLPDLSPDEPSEALGFPMLEKEEEAHRPPSPTEAPTEASPEPAPDPAPVAEEAAPSAVEEGAAADPGSDGSPGKSPSKKKKKFRTPSFLKKSKKKSDS

SEQ ID NO: 912327 - protein, 594 aa, Homo sapiens
MHHIAFHDPVISCFQLALVLDDFQSSEPMVSEGPPLLVPGLWGSALSSAYLMTQIQLGFPDGGFPSVMTLTSSINWSLCGCILLPWRLCWVTQIRCGHWFSPLCDVQCMTRCEDKLNRLDAMSLIVVIILTFQLFLILQWTKEDGHRTSTSAVPNLFVPLNTNPKEVQEMRNKIREQNLQDIKTAGPQSQVLCGVVMDRSLVQGELVTASKAIIEKEYQPHVIVSTTGPNPFTTLTDRELEEYRREVERKQKGSEENLDEAREQKEKSPPDQPAVPHPPPSTPIKLEEGELWVAAAAYCGRVHGSCALWRNVAGVVLTATRKCVLASAPGRDTFSPPILLLSWVTPGKTDLYVSCDQVGRPASGVGTHHGCWCPRCPLLAHSSCCVVMQMPPSEVPSAVWATRRLPLSHRVSVVCDPGCLSLGLVHPCLSVKPVALPFFFCNLMAVTECIDSLLVLFFSLWLRHKQETDALESTCYPNLVPEPTTGDDSDAATFKPTLPDLSPDEPSEALGFPMLEKEEEAHRPPSPTEAPTEASPEPAPDPAPVAEEAAPSAVEEGAAADPGSDGSPGKSPSKKKKKFRTPSFLKKSKKKSDS

SEQ ID NO: 912328 - protein, 253 aa, Homo sapiens; identical to SEQ ID NO: 912311

SEQ ID NO: 912329 - protein, 253 aa, Homo sapiens; identical to SEQ ID NO: 912311

SEQ ID NO: 912330 - protein, 253 aa, Homo sapiens; identical to SEQ ID NO: 912311

SEQ ID NO: 912331 - protein, 253 aa, Homo sapiens; identical to SEQ ID NO: 912311

SEQ ID NO: 912332 - protein, 253 aa, Homo sapiens; identical to SEQ ID NO: 912311

SEQ ID NO: 912333 - protein, 253 aa, Homo sapiens; identical to SEQ ID NO: 912311

SEQ ID NO: 912334 - protein, 135 aa, Homo sapiens
SPTLAPSYIPGYPHYHGLLLAELGTGRLQTTSGPRSPVLILRNHGLVSVGESVEEAFYYIHNLVVACEIQVRTLASAGGPDNLVLLNPEKYKAKSRSPGSPVGEGTGSPPKWQIGEQEFEALMRMLDNLKNGATT

SEQ ID NO: 912335 - protein, 143 aa, Homo sapiens [sequence omitted]

SEQ ID NO: 912336 - protein, 212 aa, Homo sapiens
GHRRKRSQSHGGPGPPHWLRPGQSRHSPAAVGPRAAAPARARSPCYALSNSPRYRVMCCCSRRRCLPLPPPVVPRLLRRASRWQPRAGPREQGPGCSAPSPPRRVPVQPPPAAGDAATSGLSISRGLAAELHPKVGAHLSRQGPGAAREGDAQVEPRRAGARNPGAGAAARAAVAAGNSFGDVRGSGGGGGERSGLPFAAARAWEIVPLSAV

SEQ ID NO: 912337 - protein, 858 aa, Homo sapiens
MFTLAEVASLNDIQPTYRILKPWWDVFMDYLAVVMLMVAIFAGTMQLTKDQVVCLPVLPSPVNSKAHTPPGNAEVTTNIPKMEAATNQDQDGRTTNDISFGTSAVTPDIPLRATYPRTDFALPNQEAKKEKKDPTGRKTNLDFQQYVFINQMCYHLALPWYSKYFPYLALIHTIILMVSSNFWFKYPKTCSKVEHFVSILGKCFESPWTTKALSETACEDSEENKQRITGAQTLPKHVSTSSDEGSPSASTPMINKTGFKFSAEKPVIEVPSMTILDKKDGEQAKALFEKVRKFRAHVEDSDLIYKLYVVQTVIKTAKFIFILCYTANFVNAISFEHVCKPKVEHLIGYEVFECTHNMAYMLKKLLISYISIICVYGFICLYTLFWLFRIPLKEYSFEKVREESSFSDIPDVKNDFAFLLHMVDQYDQLYSKRFGVFLSEVSENKLREISLNHEWTFEKLRQHISRNAQDKQELHLFMLSGVPDAVFDLTDLDVLKLELIPEAKIPAKISQMTNLQELHLCHCPAKVEQTAFSFLRDHLRCLHVKFTDVAEIPAWVYLLKNLRELYLIGNLNSENNKMIGLESLRELRHLKILHVKSNLTKVPSNITDVAPHLTKLVIHNDGTKLLVLNSLKKMMNVAELELQNCELERIPHAIFSLSNLQELDLKSNNIRTIEEIISFQHLKRLTCLKLWHNKIVTIPPSITHVKNLESLYFSNNKLESLPVAVFSLQKLRCLDVSYNNISMIPIEIGLLQNLQHLHITGNKVDILPKQLFKCIKLRTLNLGQNCITSLPEKVGQLSQLTQLELKGNCLDRLPAQLGQCRMLKKSGLVVEDHLFDTLPLEVKEALNQDINIPFANGI

SEQ ID NO: 912338 - protein, 858 aa, Homo sapiens; identical to SEQ ID NO: 912337

SEQ ID NO: 912339 - protein, 858 aa, Homo sapiens; identical to SEQ ID NO: 912337

SEQ ID NO: 912340 - protein, 858 aa, Homo sapiens; identical to SEQ ID NO: 912337

SEQ ID NO: 912341 - protein, 747 aa, Homo sapiens
MFTLAEVASLNDIQPTYRILKPWWDVFMDYLAVVMLMVAIFAGTMQLTKDQVVCLPVLPSPVNSKAHTPPGNAEVTTNIPKMEAATNQDQDGRTTNDISFGTSAVTPDIPLRATYPRTDFALPNQEAKKEKKDPTGRKTNLDFQQYVFINQMCYHLALPWYSKYFPYLALIHTIILMVSSNFWFKYPKTCSKVEHFVSILGKCFESPWTTKALSETACEDSEENKQRITGAQTLPKHVSTSSDEGSPSASTPMINKTGFKFSAEKPVIEVPSMTILDKKDGEQAKALFEKVRKFRAHVEDSDLIYKLYVVQTVIKTAKFIFILCYTANFVNAISFEHVCKPKVEHLIGYEVFECTHNMAYMLKKLLISYISIICVYGFICLYTLFWLFRIPLKEYSFEKVREESSFSDIPDVKNDFAFLLHMVDQYDQLYSKRFGVFLSEVSENKLREISLNHEWTFEKLRQHISRNAQDKQELHLFMLSGVPDAVFDLTDLDVLKLELIPEAKIPAKISQMTNLQELHLCHCPAKVEQTAFSFLRDHLRCLHVKFTDVAEIPAWVYLLKNLRELYLIGNLNSENNKMIGLESLRELRHLKILHVKSNLTKVPSNITDVAPHLTKLVIHNDGTKLLVLNSLKKMMNVAELELQNCELERIPHAIFSLSNLQELDLKSNNIRTIEEIISFQHLKRLTCLKLWHNKIVTIPPSITHVKNLESLYFSNNKLESLPVAVFSLQKLRCLDVSYNNISMFVGF

SEQ ID NO: 912342 - protein, 140 aa, Homo sapiens
GHRRKRSQSHGGPGPPHWLRPGQSRHSPAAVGPRAAAPARARSPCYALSNSPRYRVMCCCSRRRCLPLPPPVVPRLLRRASRWQPRAGPREQGPGCSAPSPPRRVPVQPPPAAGDAATSGLSISRGLAAELHPKEVHGCL

SEQ ID NO: 912343 - protein, 65 aa, Homo sapiens
VGSWERDFCSNPVQGLEKEENWGWLPGGPAPPVTGGLIGAFSFPSPFTRGYPLQINEKAPERGTE

SEQ ID NO: 912344 - protein, 858 aa, Homo sapiens; identical to SEQ ID NO: 912337

SEQ ID NO: 912345 - protein, 858 aa, Homo sapiens; identical to SEQ ID NO: 912337

SEQ ID NO: 912346 - protein, 867 aa, Homo sapiens
MFTLAEVASLNDIQPTYRILKPWWDVFMDYLAVVMLMVAIFAGTMQLTKDQVVCLPVLPSPVNSKAHTPPGNAEVTTNIPKMEAATNQDQDGRTTNDISFGTSAVTPDIPLRATYPRTDFALPNQEAKKEKKDPTGRKTNLDFQQYVFINQMCYHLALPWYSKYFPYLALIHTIILMVSSNFWFKYPKTCSKVEHFVSILGKCFESPWTTKALSETACEDSEENKQRITGAQTLPKHVSTSSDEGSPSASTPMINKTGFKFSAEKPVIEVPSMTILDKKDGEQAKALFEKVRKFRAHVEDSDLIYKLYVVQTVIKTAKFIFILCYTANFVNAISFEHVCKPKVEHLIGYEVFECTHNMAYMLKKLLISYISIICVYGFICLYTLFWLFRIPLKEYSFEKVREESSFSDIPDVKNDFAFLLHMVDQYDQLYSKRFGVFLSEVSENKLREISLNHEWTFEKLRQHISRNAQDKQELHLFMLSGVPDAVFDLTDLDVLKLELIPEAKIPAKISQMTNLQELHLCHCPAKVEQTAFSFLRDHLRCLHVKFTDVAEIPAWVYLLKNLRELYLIGNLNSENNKMIGLESLRELRHLKILHVKSNLTKVPSNITDVAPHLTKLVIHNDGTKLLVLNSLKKMMNVAELELQNCELERIPHAIFSLSNLQELDLKSNNIRTIEEIISFQHLKRLTCLKLWHNKIVTIPPSITHVKNLESLYFSNNKLESLPVAVFSLQKLRCLDVSYNNISMIPIEIGLLQNLQHLHITGNKVDILPKQLFKCIKLRTLNLGQNCITSLPEKVGQLSQLTQLELKGNCLDRLPAQLGQCRMLKKSGLVVEDHLFDTLPLEVKEALNQDINIPFASFKIKQRGCIEG

SEQ ID NO: 912347 - protein, 681 aa, Homo sapiens
MFTLAEVASLNDIQPTYRILKPWWDVFMDYLAVVMLMVAIFAGTMQLTKDQVVCLPVLPSPVNSKAHTPPGNAEVTTNIPKMEAATNQDQDGRTTNDISFGTSAVTPDIPLRATYPRTDFALPNQEAKKEKKDPTGRKTNLDFQQYVFINQMCYHLALPWYSKYFPYLALIHTIILMVSSNFWFKYPKTCSKVEHFVSILGKCFESPWTTKALSETACEDSEENKQRITGAQTLPKHVSTSSDEGSPSASTPMINKTGFKFSAEKPVIEVPSMTILDKKDGEQAKALFEKVRKFRAHVEDSDLIYKLYVVQTVIKTAKFIFILCYTANFVNAISFEHVCKPKVEHLIGYEVFECTHNMAYMLKKLLISYISIICVYGFICLYTLFWLFRIPLKEYSFEKVREESSFSDIPDVKNDFAFLLHMVDQYDQLYSKRFGVFLSEVSENKLREISLNHEWTFEKLRQHISRNAQDKQELHLFMLSGVPDAVFDLTDLDVLKLELIPEAKIPAKISQMTNLQELHLCHCPAKVEQTAFSFLRDHLRCLHVKFTDVAEIPAWVYLLKNLRELYLIGNLNSENNKMIGLESLRELRHLKILHVKSNLTKVPSNITDVLVPIRHELNPHHNGGSRNRIAPFIGFYNIERNSKNNTQMEILEQCGCFLAAGIRIGIIYSEKSSDISFKHGI

SEQ ID NO: 912348 - protein, 292 aa, Homo sapiens; identical to SEQ ID NO: 818048

SEQ ID NO: 912349 - protein, 295 aa, Homo sapiens
MLGAWAVEGTAVALLRLLLLLLPPAIRGPGLGVAGVAGAAGAGLPESVIWAVNAGGEAHVDVHGIHFRKDPLEGRVGRASDYGMKLPILRSNPEDQILYQTERYNEETFGYEVPIKEEGDYVLVLKFAEVYFAQSQQKVFDVRLNGHVVVKDLDIFDRVGHSTAHDEIIPMSIRKGKLSVQGEVSTFTGKLYIEFVKRGTNDNSQGTVHSDIMVWDTWIDVPKLQPHPGLEKKEEEEEEEEYDEGSNLKKQTNKNRVQSGPRTPNPYASDNSSLMFPILVAFGVFIPTLFCLCRL

SEQ ID NO: 912350 - protein, 233 aa, Homo sapiens
MLGAWAVEGTAVALLRLLLLLLPPAIRGPGLGVAGVAGAAGAGLPESVIWAVNAGGEAHVDVHGIHFRKDPLEGRVGRASDYGMKLPILRSNPEDQILYQTERYNEETFGYEVPIKEEGDYVLVLKFAEVYFAQSQQKVFDVRLNGHVVVKDLDIFDRVGHSTAHDEIIPMSIRKGKLSVQGEVSTFTGKLYIEFVKGYYDNPKVCALYIMAGTVDAESSFQPSSASAGCENK

SEQ ID NO: 912351 - protein, 292 aa, Homo sapiens; identical to SEQ ID NO: 818048

SEQ ID NO: 912352 - protein, 217 aa, Homo sapiens
MLGAWAVEGTAVALLRLLLLLLPPAIRGPGLGVAGVAGAAGAGLPESVIWAVNAGGEAHVDVHGIHFRKDPLEGRVGRASDYGMKLPILRSNPEDQILYQTERYNEETFGYEVPIKEEGDYVLVLKFAEVYFAQSQQKMYQSFSLIRDWRRKKRKKKKKNMMKGLISKNRPIRTGCSQAPAHPTPMPRTTAASCFPSWWPSESSFQPSSASAGCENK

SEQ ID NO: 912353 - protein, 292 aa, Homo sapiens; identical to SEQ ID NO: 818048

SEQ ID NO: 912354 - protein, 72 aa, Homo sapiens
SYEVRWMFFLGKYWKSVRMVAVPRGCALAGAQLQEETETVSALASLTVDVEQPFAQEDSRTAGEPMEEEPAL

SEQ ID NO: 912355 - protein, 92 aa, Homo sapiens
VGNYYGYRMQTSEREGSGPELSPSVMPEAPLESPPFPTKSPAFDLFNLVLSYKRLEIYLEPLKDAGDGVRYLLRYRLCGVALVCSAFCRPAL

SEQ ID NO: 912356 - protein, 325 aa, Homo sapiens
MQVMVFDTCSGAWYSVGALMISVPALLGYLQEVCRARLPDSELMRRKYHSVRQEDLQRGRLSRPEAVAEVKSFLIQLEAFLSRLCCTCEAAYRVLHWENPVVSSQFYGALLGTVCMLYLLPLCWVLTLLNSTLFLGNVEFFRVVSEYRASLQQRMNPKQEEHAFESPPPPDVGGKDGLMDSTPALTPTEDLTPGSVEEAEEAEPDEEFKDAIEEDDEGAPCPAEDELALQDNGFLSKNEVLRSKVSRLTERLRKRYPTNNFGNCTGCSATFSVLKKRRSCSNCGNSFCSRCCSFKVPKSSMGATAPEAQRETVFVCASCNQTLSK

SEQ ID NO: 912357 - protein, 201 aa, Homo sapiens
LDLEDPELSLLGNVEFFRVVSEYRASLQQRMNPKQEEHAFESPPPPDVGGKDGLMDSTPALTPTEDLTPGSVEEAEEAEPDEEFKDAIEEDDEGAPCPAEDELALQDNGFLSKNEVLRSKVSRLTERLRKRYPTNNFGNCTGCSATFSVLKKRRSCSNCGNSFCSRCCSFKVPKSSMGATAPEAQRETVFVCASCNQTLSK

SEQ ID NO: 912358 - protein, 470 aa, Homo sapiens
SDSRPGSGGGGRGVGGGDFRTCDFRTTLAGGAAFSRGRPEETLRGPVALPLLLPDPAASLTEPAAGMQTSEREGSGPELSPSVMPEAPLESPPFPTKSPAFDLFNLVLSYKRLEIYLEPLKDAGDGVRYLLRWQMPLCSLLTCLGLNVLFLTLNEGAWYSVGALMISVPALLGYLQEVCRARLPDSELMRRKYHSVRQEDLQRGRLSRPEAVAEVKSFLIQLEAFLSRLCCTCEAAYRVLHWENPVVSSQFYGALLGTVCMLYLLPLCWVLTLLNSTLFLGNVEFFRVVSEYRASLQQRMNPKQEEHAFESPPPPDVGGKDGLMDSTPALTPTEDLTPGSVEEAEEAEPDEEFKDAIEEDDEGAPCPAEDELALQDNGFLSKNEVLRSKVSRLTERLRKRYPTNNFGNCTGCSATFSVLKKRRSCSNCGNSFCSRCCSFKVPKSSMGATAPEAQRETVFVCASCNQTLSK

SEQ ID NO: 912359 - protein, 470 aa, Homo sapiens; identical to SEQ ID NO: 912358

SEQ ID NO: 912360 - protein, 452 aa, Homo sapiens
SDSRPGSGGGGRGVGGGDFRTCDFRTTLAGGAAFSRGRPEETLRGPVALPLLLPDPAASLTEPAAGMQTSEREGSGPELSPSVMPEAPLESPPFPTKSPAFDLFNLVLSYKRLEIYLEPLKDAGDGVRYLLRWQMPLCSLLTCLGLNVLFLTLNEGAWYSVGALMISVPALLGYLQEVCRARLPDSELMRRKYHSVRQEDLQRGRLSRPEAVAEVKSFLIQLEAFLSRLCCTCEAAYRVLHWENPVVSSQFYGALLGTVCMLYLLPLCWVLTLLNSTLFLGNVEFFRVVSEYRASLQQRMNPKQEEHAFESPPPPDVGGKDGLMDSTPALTPTEDLTPGSVEEAEEAEPDEEFKDAIEEDDEGAPCPAEDELALQDNGFLSKNEVLRSKVSRLTERLRKRYPTNNFGNCTGCSATFSVLKKRRSCSNCGNSFCSRCCSFKVPKSSMGATAKS

SEQ ID NO: 912361 - protein, 150 aa, Homo sapiens
SDSRPGSGGGGRGVGGGDFRTCDFRTTLAGGAAFSRGRPEETLRGPVALPLLLPDPAASLTEPAAGMQTSEREGSGPELSPSVMPEAPLESPPFPTKSPAFDLFNLVLSYKRLEIYLEPLKDAGDGVRYLLRYRLCGVALVCSAFCRPAL

SEQ ID NO: 912362 - protein, 470 aa, Homo sapiens; identical to SEQ ID NO: 912358

SEQ ID NO: 912363 - protein, 408 aa, Homo sapiens
SDSRPGSGGGGRGVGGGDFRTCDFRTTLAGGAAFSRGRPEETLRGPVALPLLLPDPAASLTEPAAGWQMPLCSLLTCLGLNVLFLTLNEGAWYSVGALMISVPALLGYLQEVCRARLPDSELMRRKYHSVRQEDLQRGRLSRPEAVAEVKSFSLVLRLWSSSRAAVLWLHVVTPTTRVLAGRPPGVSQFYGALLGTVCMLYLLPLCWVLTLLNSTLFLGNVEFFRVVSEYRASLQQRMNPKQEEHAFESPPPPDVGGKDGLMDSTPALTPTEDLTPGSVEEAEEAEPDEEFKDAIEEDDEGAPCPAEDELALQDNGFLSKNEVLRSKVSRLTERLRKRYPTNNFGNCTGCSATFSVLKKRRSCSNCGNSFCSRCCSFKVPKSSMGATAPEAQRETVFVCASCNQTLSK

SEQ ID NO: 912364 - protein, 84 aa, Homo sapiens
EQVSVRVLGWAGVELLPLFLRNCTGCSATFSVLKKRRSCSNCGNSFCSRCCSFKVPKSSMGATAPEAQRETVFVCASCNQTLSK

SEQ ID NO: 912365 - protein, 470 aa, Homo sapiens; identical to SEQ ID NO: 912358

SEQ ID NO: 912366 - protein, 414 aa, Homo sapiens
SDSRPGSGGGGRGVGGGDFRTCDFRTTLAGGAAFSRGRPEETLRGPVALPLLLPDPAASLTEPAAGMQTSEREGSGPELSPSVMPEAPLESPPFPTKSPAFDLFNLVLSYKRLEIYLEPLKDAGDGVRYLLRWQMPLCSLLTCLGLNVLFLTLNEGAWYSVGALMISVPALLGYLQEVCRARLPDSELMRRKYHSVRQEDLQRGRLSRPEAVAEVKSFLIQLEAFLSRLCCTCEAAYRVLHWENPVVSSQFYGALLGTVCMLYLLPLCWVLTLLNSTLFLGNVEFFRVVSEYRASLQQRMNPKQEEHAFESPPPPDVGGKDGLMDSTPALTPTEDLTPGSVEEAEEAEPDEEFKDAIEEDDEGAPCPAEDELALQDNGFLSKNEVLRSKVSRLTERLRKRYPTNNFGVTGAGSS

SEQ ID NO: 912367 - protein, 60 aa, Homo sapiens
MAFPVQPHGLHQAPLAAEVLAKASAGVDIPRPFLGSYLAPLCALSPWLGLRGFRGPVGPF

SEQ ID NO: 912368 - protein, 362 aa, Homo sapiens
MAEVPPGPSSLLPPPAPPAPAAVEPRCPFPAGAALACCSEDEEDDEEHEGGGSRSPAGGESATVAAKGHPCLRCPQPPQEQQQLNGLISPELRHLRAAASLKSKVLSVAEVAATTATPDGGPRATATKGAGVHSGERPPHSLSSNARTAVPSPVEAAAASDPAAARNGLAEGTEQEEEEEDEQVRLLSSSLTADCSLRSPSGREVEPGEDRTIRYVRYESELQMPDIMRLITKDLSEPYSIYTYRYFIHNWPQLCFLAMVGEECVGAIVCKLDMHKKMFRRGYIAMLAVDSKYRRNGIGTNLVKKAIYAMVEGDCDEVVLETEITNKSALKLYENLGFVRDKRLFRYYLNGVDALRLKLWLR

SEQ ID NO: 912369 - protein, 296 aa, Homo sapiens
AGSATVAESQPPQEQQQLNGLISPELRHLRAAASLKSKVLSVAEVAATTATPDGGPRATATKGAGVHSGERPPHSLSSNARTAVPSPVEAAAASDPAAARNGLAEGTEQEEEEEDEQVRLLSSSLTADCSLRSPSGREVEPGEDRTIRYVRYESELQMPDIMRLITKDLSEPYSIYTYRYFIHNWPQLCFLAMVGEECVGAIVCKLDMHKKMFRRGYIAMLAVDSKYRRNGIGTNLVKKAIYAMVEGDCDEVVLETEITNKSALKLYENLGFVRDKRLFRYYLNGVDALRLKLWLR

SEQ ID NO: 912370 - protein, 362 aa, Homo sapiens; identical to SEQ ID NO: 912368

SEQ ID NO: 912371 - protein, 153 aa, Homo sapiens
VAEVAATTATPDGGPRATATKGAGVHSGERPPHSLSSNARTAVPSPVEAAAASDPAAARNGLAEGTEQEEEEEDEQVRLLSSSLTADCSLRSPSGREVEPGEDRTIRYVRYESELQMPDIMRLITKDLSEPYSIYTYRYFIHNWPQLCFLVSG

SEQ ID NO: 912372 - protein, 362 aa, Homo sapiens; identical to SEQ ID NO: 912368

SEQ ID NO: 912373 - protein, 278 aa, Homo sapiens
MAEVPPGPSSLLPPPAPPAPAAVEPRCPFPAGAALACCSEDEEDDEEHEGGGSRSPAGGESATVAAKGHPCLRCPQPPQEQQQLNGLISPELRHLRAAASLKSKVLSVAEVAATTATPDGGPRATATKGAGVHSGERPPHSLSSNARTAVPSPVEAAAASDPAAARNGLAEGTEQEEEEEDEQVRLLSSSLTADCSLRSPSGREVEPGEDRTIRYVRYESELQMPDIMRLITKDLSEPYSIYTYRYFIHNWPQLCFLVMVGEECFLFLFSFFTAFIFT

SEQ ID NO: 912374 - protein, 1841 aa, Homo sapiens
RGAMALQLWALTLLGLLGAGASLRPRKLDFFRSEKELNHLAVDEASGVVYLGAVNALYQLDAKLQLEQQVATGPALDNKKCTPPIEASQCHEAEMTDNVNQLLLLDPPRKRLVECGSLFKGICALRALSNISLRLFYEDGSGEKSFVASNDEGVATVGLVSSTGPGGDRVLFVGKGNGPHDNGIIVSTRLLDRTDSREAFEAYTDHATYKAGYLSTNTQQFVAAFEDGPYVFFVFNQQDKHPARNRTLLARMCREDPNYYSYLEMDLQCRDPDIHAAAFGTCLAASVAAPGSGRVLYAVFSRDSRSSGGPGAGLCLFPLDKVHAKMEANRNACYTGTREARDIFYKPFHGDIQCGGHAPGSSKSFPCGSEHLPYPLGSRDGLRGTAVLQRGGLNLTAVTVAAENNHTVAFLGTSDGRILKVYLTPDGTSSEYDSILVEINKRVKRDLVLSGDLGSLYAMTQDKVFRLPVQECLSYPTCTQCRDSQDPYCGWCVVEGRCTRKAECPRAEEASHWLWSRSKSCVAVTSAQPQNMSRRAQGEVQLTVSPLPALSEEDELLCLFGESPPHPARVEGEAVICNSPSSIPVTPPGQDHVAVTIQLLLRRGNIFLTSYQYPFYDCRQAMSLEENLPCISCVSNRWTCQWDLRYHECREASPNPEDGIVRAHMEDSCPQFLGPSPLVIPMNHETDVNFQGKNLDTVKGSSLHVGSDLLKFMEPVTMQESGTFAFRTPKLSHDANETLPLHLYVKSYGKNIDSKLHVTLYNCSFGRSDCSLCRAANPDYRCAWCGGQSRCVYEALCNTTSECPPPVITRIQPETGPLGGGIRITILGSNLGVQAGDIQRISVAGRNCSFQPERYSVSTRIVCVIEAAETPFTGGVEVDVFGKLGRSPPNVQFTFQQPKPLSVEPQQGPQAGGTTLTIHGTHLDTGSQEDVRVTLNGVPCKVTKFGAQLQCVTGPQATRGQMLLEVSYGGSPVPNPGIFFTYRENPVLRAFEPLRSFASGGRSINVTGQGFSLIQRFAMVVIAEPLQSWQPPREAESLQPMTVVGTDYVFHNDTKVVFLSPAVPEEPEAYNLTVLIEMDGHRALLRTEAGAFEYVPDPTFENFTGGVKKQVNKLIHARGTNLNKAMTLQEAEAFVGAERCTMKTLTETDLYCEPPEVQPPPKRRQKRDTTHNLPEFIVKFGSREWVLGRVEYDTRVSDVPLSLILPLVIVPMVVVIAVSVYCYWRKSQQAEREYEKIKSQLEGLEESVRDRCKKEFTDLMIEMEDQTNDVHEAGIPVLDYKTYTDRVFFLPSKDGDKDVMITGKLDIPEPRRPVVEQALYQFSNLLNSKSFLINFIHTLENQREFSARAKVYFASLLTVALHGKLEYYTDIMHTLFLELLEQYVVAKNPKLMLRRSETVVERMLSNWMSICLYQYLKDSAGEPLYKLFKAIKHQVEKGPVDAVQKKAKYTLNDTGLLGDDVEYAPLTVSVIVQDEGVDAIPVKVLNCDTISQVKEKIIDQVYRGQPCSCWPRPDSVVLEWRPGSTAQILSDLDLTSQREGRWKRVNTLMHYNVRDGATLILSKVGVSQQPEDSQQDLPGERHALLEEENRVWHLVRPTDEVDEGKSKRGSVKEKERTKAITEIYLTRLLSVKGTLQQFVDNFFQSVLAPGHAVPPAVKYFFDFLDEQAEKHNIQDEDTIHIWKTNSLPLRFWVNILKNPHFIFDVHVHEVVDASLSVIAQTFMDACTRTEHKLSRDSPSNKLLYAKEISTYKKMVEDYYKGIRQMVQVSDQDMNTHLAEISRAHTDSLNTLVALHQLYQYTQKYYDEIINALEEDPAAQKMQLAFRLQQIAAALENKVTDL

SEQ ID NO: 912375 - protein, 1272 aa, Homo sapiens
MALQLWALTLLGLLGAGASLRPRKLDFFRSEKELNHLAVDEASGVVYLGAVNALYQLDAKLQLEQQVATGPALDNKKCTPPIEASQCHEAEMTDNVNQLLLLDPPRKRLVECGSLFKGICALRALSNISLRLFYEDGSGEKSFVASNDEGVATVGLVSSTGPGGDRVLFVGKGNGPHDNGIIVSTRLLDRTDSREAFEAYTDHATYKAGYLSTNTQQFVAAFEDGPYVFFVFNQQDKHPARNRTLLARMCREDPNYYSYLEMDLQCRDPDIHAAAFGTCLAASVAAPGSGRVLYAVFSRDSRSSGGPGAGLCLFPLDKVHAKMEANRNACYTGTREARDIFYKPFHGDIQCGGHAPGSSKSFPCGSEHLPYPLGSRDGLRGTAVLQRGGLNLTAVTVAAENNHTVAFLGTSDGRILKVYLTPDGTSSEYDSILVEINKRVKRDLVLSGDLGSLYAMTQDKVFRLPVQECLSYPTCTQCRDSQDPYCGWCVVEGRCTRKAECPRAEEASHWLWSRSKSCVAVTSAQPQNMSRRAQGEVQLTVSPLPALSEEDELLCLFGESPPHPARVEGEAVICNSPSSIPVTPPGQDHVAVTIQLLLRRGNIFLTSYQYPFYDCRQAMSLEENLPCISCVSNRWTCQWDLRYHECREASPNPEDGIVRAHMEDSCPQFLGPSPLVIPMNHETDVNFQGKNLDTVKGSSLHVGSDLLKFMEPVTMQESGTFAFRTPKLSHDANETLPLHLYVKSYGKNIDSKLHVTLYNCSFGRSDCSLCRAANPDYRCAWCGGQSRCVYEALCNTTSECPPPVITRIQPETGPLGGGIRITILGSNLGVQAGDIQRISVAGRNCSFQPERYSVSTRIVCVIEAAETPFTGGVEVDVFGKLGRSPPNVQFTFQQPKPLSVEPQQGPQAGGTTLTIHGTHLDTGSQEDVRVTLNGVPCKVTKFGAQLQCVTGPQATRGQMLLEVSYGGSPVPNPGIFFTYRENPVLRAFEPLRSFASGGRSINVTGQGFSLIQRFAMVVIAEPLQSWQPPREAESLQPMTVVGTDYVFHNDTKVVFLSPAVPEEPEAYNLTVLIEMDGHRALLRTEAGAFEYVPDPTFENFTGGVKKQVNKLIHARGTNLNKAMTLQEAEAFVGAERCTMKTLTETDLYCEPPEVQPPPKRRQKRDTTHNLPEFIVKFGSREWVLGRVEYDTRVSDVPLSLILPLVIVPMVVVIAVSVYCYWRKSQQAEREYEKIKSQLEGLEESVRDRCKKEFTDLMIWVDSRLLGPTSKVK

SEQ ID NO: 912376 - protein, 1882 aa, Homo sapiens
MALQLWALTLLGLLGAGASLRPRKLDFFRSEKELNHLAVDEASGVVYLGAVNALYQLDAKLQLEQQVATGPALDNKKCTPPIEASQCHEAEMTDNVNQLLLLDPPRKRLVECGSLFKGICALRALSNISLRLFYEDGSGEKSFVASNDEGVATVGLVSSTGPGGDRVLFVGKGNGPHDNGIIVSTRLLDRTDSREAFEAYTDHATYKAGYLSTNTQQFVAAFEDGPYVFFVFNQQDKHPARNRTLLARMCREDPNYYSYLEMDLQCRDPDIHAAAFGTCLAASVAAPGSGRVLYAVFSRDSRSSGGPGAGLCLFPLDKVHAKMEANRNACYTGTREARDIFYKPFHGDIQCGGHAPGSSKSFPCGSEHLPYPLGSRDGLRGTAVLQRGGLNLTAVTVAAENNHTVAFLGTSDGRILKVYLTPDGTSSEYDSILVEINKRVKRDLVLSGDLGSLYAMTQDKVFRLPVQECLSYPTCTQCRDSQDPYCGWCVVEGRCTRKAECPRAEEASHWLWSRSKSCVAVTSAQPQNMSRRAQGEVQLTVSPLPALSEEDELLCLFGESPPHPARVEGEAVICNSPSSIPVTPPGQDHVAVTIQLLLRRGNIFLTSYQYPFYDCRQAMSLEENLPCISCVSNRWTCQWDLRYHECREASPNPEDGIVRAHMEDSCPQFLGPSPLVIPMNHETDVNFQGKNLDTVKGSSLHVGSDLLKFMEPVTMQESGTFAFRTPKLSHDANETLPLHLYVKSYGKNIDSKLHVTLYNCSFGRSDCSLCRAANPDYRCAWCGGQSRCVYEALCNTTSECPPPVITRIQPETGPLGGGIRITILGSNLGVQAGDIQRISVAGRNCSFQPERYSVSTRIVCVIEAAETPFTGGVEVDVFGKLGRSPPNVQFTFQQPKPLSVEPQQGPQAGGTTLTIHGTHLDTGSQEDVRVTLNGVPCKVTKFGAQLQCVTGPQATRGQMLLEVSYGGSPVPNPGIFFTYRENPVLRAFEPLRSFASGGRSINVTGQGFSLIQRFAMVVIAEPLQSWQPPREAESLQPMTVVGTDYVFHNDTKVVFLSPAVPEEPEAYNLTVLIEMDGHRALLRTEAGAFEYVPDPTFENFTGGVKKQVNKLIHARGTNLNKAMTLQEAEAFVGAERCTMKTLTETDLYCEPPEVQPPPKRRQKRDTTHNLPEFIVKFGSREWVLGRVEYDTRVSDVPLSLILPLVIVPMVVVIAVSVYCYWRKSQQAEREYEKIKSQLEGLEESVRDRCKKEFTDLMIEMEDQTNDVHEAGIPVLDYKTYTDRVFFLPSKDGDKDVMITGKLDIPEPRRPVVEQALYQFSNLLNSKSFLINFIHTLENQREFSARAKVYFASLLTVALHGKLEYYTDIMHTLFLELLEQYVVAKNPKLMLRRSETVVERMLSNWMSICLYQYLKDSAGEPLYKLFKAIKHQVEKGPVDAVQKKAKYTLNDTGLLGDDVEYAPLTVSVIVQDEGVDAIPVKVLNCDTISQVKEKIIDQVYRGQPCSCWPRPDSVVLEWRPGSTAQILSDLDLTSQREGRWKRVNTLMHYNVRDGATLILSKVGVSQQPEDSQQDLPGERHALLEEENRVWHLVRPTDEVDEGKSKRGSVKEKERTKAITEILLRTAACCWENRGSAYAPCALQASMKVCAMTDSEASTTSWTCTSKMKWGFLRMFTQNRSGKLFVFQMWMVSSSWMLCFSACSSRKSKKYLTAGGTACPGSQHALEEVVHKLLQCALDWEHPRQVDLGDGLRPLHLYHTASHGHALVHLVGRPHQVPHPVLLLQEGMALPRQVLLAVLRLLGDPHLGQDEGGSIPDIVVHKGVDALPPPTARDVTSSPLYQYTQKYYDEIINALEEDPAAQKMQLAFRLQQIAAALENKVTDL

SEQ ID NO: 912377 - protein, 1597 aa, Homo sapiens
MALQLWALTLLGLLGAGASLRPRKLDFFRSEKELNHLAVDEASGVVYLGAVNALYQLDAKLQLEQQVATGPALDNKKCTPPIEASQCHEAEMTDNVNQLLLLDPPRKRLVECGSLFKGICALRALSNISLRLFYEDGSGEKSFVASNDEGVATVGLVSSTGPGGDRVLFVGKGNGPHDNGIIVSTRLLDRTDSREAFEAYTDHATYKAGYLSTNTQQFVAAFEDGPYVFFVFNQQDKHPARNRTLLARMCREDPNYYSYLEMDLQCRDPDIHAAAFGTCLAASVAAPGSGRVLYAVFSRDSRSSGGPGAGLCLFPLDKVHAKMEANRNACYTGTREARDIFYKPFHGDIQCGGHAPGSSKSFPCGSEHLPYPLGSRDGLRGTAVLQRGGLNLTAVTVAAENNHTVAFLGTSDGRILKVYLTPDGTSSEYDSILVEINKRVKRDLVLSGDLGSLYAMTQDKVFRLPVQECLSYPTCTQCRDSQDPYCGWCVVEGRCTRKAECPRAEEASHWLWSRSKSCVAVTSAQPQNMSRRAQGEVQLTVSPLPALSEEDELLCLFGESPPHPARVEGEAVICNSPSSIPVTPPGQDHVAVTIQLLLRRGNIFLTSYQYPFYDCRQAMSLEENLPCISCVSNRWTCQWDLRYHECREASPNPEDGIVRAHMEDSCPQFLGPSPLVIPMNHETDVNFQGKNLDTVKGSSLHVGSDLLKFMEPVTMQESGTFAFRTPKLSHDANETLPLHLYVKSYGKNIDSKLHVTLYNCSFGRSDCSLCRAANPDYRCAWCGGQSRCVYEALCNTTSECPPPVITRIQPETGPLGGGIRITILGSNLGVQAGDIQRISVAGRNCSFQPERYSVSTRIVCVIEAAETPFTGGVEVDVFGKLGRSPPNVQFTFQQPKPLSVEPQQGPQAGGTTLTIHGTHLDTGSQEDVRVTLNGVPCKVTKFGAQLQCVTGPQATRGQMLLEVSYGGSPVPNPGIFFTYRENPVLRAFEPLRSFASGGRSINVTGQGFSLIQRFAMVVIAEPLQSWQPPREAESLQPMTVVGTDYVFHNDTKVVFLSPAVPEEPEAYNLTVLIEMDGHRALLRTEAGAFEYVPDPTFENFTGGVKKQVNKLIHARGTNLNKAMTLQEAEAFVGAERCTMKTLTETDLYCEPPEVQPPPKRRQKRDTTHNLPEFIVKFGSREWVLGRVEYDTRVSDVPLSLILPLVIVPMVVVIAVSVYCYWRKSQQAEREYEKIKSQLEGLEESVRDRCKKEFTDLMIEMEDQTNDVHEAGIPVLDYKTYTDRVFFLPSKDGDKDVMITGKLDIPEPRRPVVEQALYQFSNLLNSKSFLINFIHTLENQREFSARAKVYFASLLTVALHGKLEYYTDIMHTLFLELLEQYVVAKNPKLMLRRSETVVERMLSNWMSICLYQYLKDSAGEPLYKLFKAIKHQVEKGPVDAVQKKAKYTLNDTGLLGDDVEYAPLTVSVIVQDEGVDAIPVKVLNCDTISQVKEKIIDQVYRGQPCSCWPRPDSVVLEWRPGSTAQILSDLDLTSQREGRWKRVNTLMHYNVRDGATLILSKVGVSQQPEDSQQGKFPDPMSVCPPRDGRRRKSGTMPS

SEQ ID NO: 912378 - protein, 1841 aa, Homo sapiens; identical to SEQ ID NO: 912374

SEQ ID NO: 912379 - protein, 1841 aa, Homo sapiens; identical to SEQ ID NO: 912374

SEQ ID NO: 912380 - protein, 1615 aa, Homo sapiens
MALQLWALTLLGLLGAGASLRPRKLDFFRSEKELNHLAVDEASGVVYLGAVNALYQLDAKLQLEQQVATGPALDNKKCTPPIEASQCHEAEMTDNVNQLLLLDPPRKRLVECGSLFKGICALRALSNISLRLFYEDGSGEKSFVASNDEGVATVGLVSSTGPGGDRVLFVGKGNGPHDNGIIVSTRLLDRTDSREAFEAYTDHATYKAGYLSTNTQQFVAAFEDGPYVFFVFNQQDKHPARNRTLLARMCREDPNYYSYLEMDLQCRDPDIHAAAFGTCLAASVAAPGSGRVLYAVFSRDSRSSGGPGAGLCLFPLDKVHAKMEANRNACYTGTREARDIFYKPFHGDIQCGGHAPGSSKSFPCGSEHLPYPLGSRDGLRGTAVLQRGGLNLTAVTVAAENNHTVAFLGTSDGRILKVYLTPDGTSSEYDSILVEINKRVKRDLVLSGDLGSLYAMTQDKVFRLPVQECLSYPTCTQCRDSQDPYCGWCVVEGRCTRKAECPRAEEASHWLWSRSKSCVAVTSAQPQNMSRRAQGEVQLTVSPLPALSEEDELLCLFGESPPHPARVEGEAVICNSPSSIPVTPPGQDHVAVTIQLLLRRGNIFLTSYQYPFYDCRQAMSLEENLPCISCVSNRWTCQWDLRYHECREASPNPEDGIVRAHMEDSCPQFLGPSPLVIPMNHETDVNFQGKNLDTVKGSSLHVGSDLLKFMEPVTMQESGTFAFRTPKLSHDANETLPLHLYVKSYGKNIDSKLHVTLYNCSFGRSDCSLCRAANPDYRCAWCGGQSRCVYEALCNTTSECPPPVITRIQPETGPLGGGIRITILGSNLGVQAGDIQRISVAGRNCSFQPERYSVSTRIVCVIEAAETPFTGGVEVDVFGKLGRSPPNVQFTFQQPKPLSVEPQQGPQAGGTTLTIHGTHLDTGSQEDVRVTLNGVPCKVTKFGAQLQCVTGPQATRGQMLLEVSYGGSPVPNPGIFFTYRENPVLRAFEPLRSFASGGRSINVTGQGFSLIQRFAMVVIAEPLQSWQPPREAESLQPMTVVGTDYVFHNDTKVVFLSPAVPEEPEAYNLTVLIEMDGHRALLRTEAGAFEYVPDPTFENFTGGVKKQVNKLIHARGTNLNKAMTLQEAEAFVGAERCTMKTLTETDLYCEPPEVQPPPKRRQKRDTTHNLPEFIVKFGSREWVLGRVEYDTRVSDVPLSLILPLVIVPMVVVIAVSVYCYWRKSQQAEREYEKIKSQLEGLEESVRDRCKKEFTDLMIEMEDQTNDVHEAGIPVLDYKTYTDRVFFLPSKDGDKDVMITGKLDIPEPRRPVVEQALYQFSNLLNSKSFLINFIHTLENQREFSARAKVYFASLLTVALHGKLEYYTDIMHTLFLELLEQYVVAKNPKLMLRRSETVVERMLSNWMSICLYQYLKDSAGEPLYKLFKAIKHQVEKGPVDAVQKKAKYTLNDTGLLGDDVEYAPLTVSVIVQDEGVDAIPVKVLNCDTISQVKEKIIDQVYRGQPCSCWPRPDSVVLEWRPGSTAQILSDLDLTSQREGRWKRVNTLMHYNVRDGAIPVKVLNCDTISHVKGQVRRRSSPTSGPRHPGVLVCQTGCPRAPPSPGGLGAVPRPPHPFL

SEQ ID NO: 912381 - protein, 140 aa, Homo sapiens
MTDRYTIHSQLEHLQSKYIGTGHADTTKWEWLVNQHRDSYCSYMGHFDLLNYFAIAENESKARVRFNLMEKMLQPCGPPSRQARGELRLCLYPPQCGAPLPAFLRFANPLKYSCLQRTGSPWLLRLVLSAYRSACPGSPA

SEQ ID NO: 912382 - protein, 140 aa, Homo sapiens; identical to SEQ ID NO: 912381

SEQ ID NO: 912383 - protein, 140 aa, Homo sapiens; identical to SEQ ID NO: 912381

SEQ ID NO: 912384 - protein, 154 aa, Homo sapiens
MTDRYTIHSQLEHLQSKYIGTGHADTTKWEWLVNQHRDSYCSYMGHFDLLNYFAIAENESKARVRFNLMDSAFTHRSAGHLSQRFSGLPILLSIPVSKGPALHGSCASCFPRTEVLARGVPPDLPSCGPLEQHWETSRTPENCAGGEVLEPASV

SEQ ID NO: 912385 - protein, 212 aa, Homo sapiens
EKHLNVSKKFHQVSILLGIELLYQVNFSREALQERRARCETQNIDPVVWTNQRVLKWVRDIDLKEYADNLTNSGVHGAVLVLEPTFNAEAMATALGIPSGKHILRRHLAEEMSAVFHPANSTGIREAERFGTPPGRASSVTRAGKEENSSGLKYKAGRLPLGKIGRGFSSKDPDFHDDYGSLQNEDCGDDDPQSRLEQCRLEGYNSLEVTNV

SEQ ID NO: 912386 - protein, 86 aa, Homo sapiens
HRAIRIGDISQTFILNSCFSSSCPLIIFFSSQLPLGKIGRGFSSKDPDFHDDYGSLQNEDCGDDDPQSRLEQCRLEGYNSLEVTNV

SEQ ID NO: 912387 - protein, 1388 aa, Homo sapiens
MAPRRNNGQCWCLLMLLSVSTPLPAVTQTRGATETASQGHLDLTQLIGVPLPSSVSFVTGYGGFPAYSFGPGANVGRPARTLIPSTFFRDFAIRLVVKPSSTRGGVLFAITDAFQKVIYLGLRLSGVEDGHQRIILYYTEPGSHVSQEAAAFSVPVMTHRWNRFAMIVQGEEVTLLVNCEEHSRIPFQRSSQALAFESSAGIFMGNAGATGLERFTGSLQQLTVHPDPRTPEELCDPEESSASGETSGLQEADGVAEILEAVTYTQASPKEAKVEPINTPPTPSSPFEDMELSGEPVPEGTLETTNMSIIQHSSPKQGSGEILNDTLEGVHSVDGDPITDSGSGAGAFLDIAEEKNLAATAAGLAEVPISTAGEAEASSVPTGGPTLSMSTENPEEGVTPGPDNEERLAATAAGEAEALASMPGEVEASGVAPGELDLSMSAQSLGEEATVGPSSEDSLTTAAAATEVSLSTFEDEEASGVPTDGLAPLTATMAPERAVTSGPGDEEDLAAATTEEPLITAGGEESGSPPPDGPPLPLPTVAPERWITPAQREHVGMKGQAGPKGEKGDAGEELPGPPEPSGPVGPTAGAEAEGSGLGWGSDVGSGSGDLVGSEQLLRGPPGPPGPPGLPGIPGKPGTDVFMGPPGSPGEDGPAGEPGPPGPEGQPGVDGATGLPGMKGEKGARGPNGSVGEKGDPGNRGLPGPPGKKGQAGPPGVMGPPGPPGPPGPPGPGCTMGLGFEDTEGSGSTQLLNEPKLSRPTAAIGLKGEKGDRGPKGERGMDGASIVGPPGPRGPPGHIKVLSNSLINITHGFMNFSDIPELVGPPGPDGLPGLPGFPGPRGPKGDTGLPGFPGLKGEQGEKGEPGAILTEDIPLERLMGKKGEPGMHGAPGPMGPKGPPGHKGEFGLPGRPGRPGLNGLKGTKGDPGVIMQGPPGLPGPPGPPGPPGAVINIKGAIFPIPVRPHCKMPVDTAHPGSPELITFHGVKGEKGSWGLPGSKGEKGDQGAQGPPGPPLDLAYLRHFLNNLKGENGDKGFKGEKGEKGDINGSFLMSGPPGLPGNPGPAGQKGETVVGPQGPPGAPGLPGPPGFGRPGDPGPPGPPGPPGPPAILGAAVALPGPPGPPGQPGLPGSRNLVTAFSNMDDMLQKAHLVIEGTFIYLRDSTEFFIRVRDGWKKLQLGELIPIPADSPPPPALSSNPHQLLPPPNPISSANYEKPALHLAALNMPFSGDIRADFQCFKQARAAGLLSTYRAFLSSHLQDLSTIVRKAERYSLPIVNLKGQVLFNNWDSIFSGHGGQFNMHIPIYSFDGRDIMTDPSWPQKVIWHGSSPHGVRLVDNYCEAWRTADTAVTGLASPLSTGKILDQKAYSCANRLIVLCIENSFMTDARK

SEQ ID NO: 912388 - protein, 1388 aa, Homo sapiens; identical to SEQ ID NO: 912387

SEQ ID NO: 912389 - protein, 1388 aa, Homo sapiens; identical to SEQ ID NO: 912387

SEQ ID NO: 912390 - protein, 1312 aa, Homo sapiens
MAPRRNNGQCWCLLMLLSVSTPLPAVTQTRGATETASQGHLDLTQLIGVPLPSSVSFVTGYGGFPAYSFGPGANVGRPARTLIPSTFFRDFAIRLVVKPSSTRGGVLFAITDAFQKVIYLGLRLSGVEDGHQRIILYYTEPGSHVSQEAAAFSVPVMTHRWNRFAMIVQGEEVTLLVNCEEHSRIPFQRSSQALAFESSAGIFMGNAGATGLERFTGSLQQLTVHPDPRTPEELCDPEESSASGETSGLQEADGVAEILEAVTYTQASPKEAKVEPINTPPTPSSPFEDMELSGEPVPEGTLETTNMSIIQHSSPKQGSGEILNDTLEGVHSVDGDPITDSGSGAGAFLDIAEEKNLAATAAGLAEVPISTAGEAEASSVPTGGPTLSMSTENPEEGVTPGPDNEERLAATAAGEAEALASMPGEVEASGVAPGELDLSMSAQSLGEEATVGPSSEDSLTTAAAATEVSLSTFEDEEASGVPTDGLAPLTATMAPERAVTSGPGDEEDLAAATTEEPLITAGGEESGSPPPDGPPLPLPTVAPERWITPAQREHVGMKGQAGPKGEKGDAGEELPGPPEPSGPVGPTAGAEAEGSGLGWGSDVGSGSGDLVGSEQLLRGPPGPPGPPGLPGIPGKPGTDVFMGPPGSPGEDGPAGEPGPPGPEGQPGVDGATGLPGMKGEKGARGPNGSVGEKGDPGNRGLPGPPGKKGQAGPPGVMGPPGPPGPPGPPGPGCTMGLGFEDTEGSGSTQLLNEPKLSRPTAAIGLKGEKGDRGPKGERGMDGASIVGPPGPRGPPGHIKVLSNSLINITHGFMNFSDIPELVGPPGPDGLPGLPGFPGPRGPKGDTGLPGFPGLKGEQGEKGEPGAILTEDIPLERLMGKKGEPGMHGAPGPMGPKGPPGHKGEFGLPGRPGRPGLNGLKGTKGDPGVIMQGPPGLPGPPGPPGPPGAVINIKGAIFPIPVRPHCKMPVDTAHPGSPELITFHGVKGEKGSWGLPGSKGEKGDQGAQGPPGPPLDLAYLRHFLNNLKGENGDKGFKGEKGEKGDINGSFLMSGPPGLPGNPGPAGQKGETVVGPQGPPGAPGLPGPPGFGRPGDPGPPGPPGPPGPPAILGAAVALPGPPGPPGQPGLPGSRNLVTAFSNMDDMLQKAHLVIEGTFIYLRDSTEFFIRVRDGWKKLQLGELIPIPADSPPPPALSSNPHQLLPPPNPISSANYEKPALHLAALNMPFSGDIRADFQCFKQARAAGLLSTYRAFLSSHLQDLSTIVRKAERYSLPIVNLKVKINMVPIAFCMHWSLQGLEAVFIPDINRRLLT

SEQ ID NO: 912391 - protein, 76 aa, Homo sapiens
VCLGHLALEDLVILGHRGPRGHQDLQLSWEQVSAVNSALVHAVPTIVFKVTASGWLVTAALPNRGLSWIPPSFFFF

SEQ ID NO: 912392 - protein, 1388 aa, Homo sapiens; identical to SEQ ID NO: 912387

SEQ ID NO: 912393 - protein, 232 aa, Homo sapiens
SSSVPNFYFFLRVRDGWKKLQLGELIPIPADSPPPPALSSNPHQLLPPPNPISSANYEKPALHLAALNMPFSGDIRADFQCFKQARAAGLLSTYRAFLSSHLQDLSTIVRKAERYSLPIVNLKGQVLFNNWDSIFSGHGGQFNMHIPIYSFDGRDIMTDPSWPQKVIWHGSSPHGVRLVDNYCEAWRTADTAVTGLASPLSTGKILDQKAYSCANRLIVLCIENSFMTDARK

SEQ ID NO: 912394 - protein, 164 aa, Homo sapiens
MPFSGDIRADFQCFKQARAAGLLSTYRAFLSSHLQDLSTIVRKAERYSLPIVNLKGQVLFNNWDSIFSGHGGQFNMHIPIYSFDGRDIMTDPSWPQKVIWHGSSPHGVRLVDNYCEAWRTADTAVTGLASPLSTGKILDQKAYSCANRLIVLCIENSFMTDARK

SEQ ID NO: 912395 - protein, 399 aa, Homo sapiens
MAQRAFPNPYADYNKSLAEGYFDAAGRLTPEFSQRLTNKIRELLQQMERGLKSADPRDGTGYTGWAGIAVLYLHLYDVFGDPAYLQLAHGYVKQSLNCLTKRSITFLCGDAGPLAVAAVLYHKMNNEKQAEDCITRLIHLNKIDPHAPNEMLYGRIGYIYALLFVNKNFGVEKIPQSHIQQICETILTSGENLARKRNFTAKSPLMYEWYQEYYVGAAHGLAGIYYYLMQPSLQVSQGKLHSLVKPSVDYVCQLKFPSGNYPPCIGDNRDLLVHWCHGAPGVIYMLIQAYKVFREEKYLCDAYQCADVIWQYGLLKKGYGLCHGSAGNAYAFLTLYNLTQDMKYLYRACKFAEWCLEYGEHGCRTPDTPFSLFEGMAGTIYFLADLLVPTKARFPAFEL

SEQ ID NO: 912396 - protein, 399 aa, Homo sapiens; identical to SEQ ID NO: 912395

SEQ ID NO: 912397 - protein, 411 aa, Homo sapiens
MGLICTRLASGVMAQRAFPNPYADYNKSLAEGYFDAAGRLTPEFSQRLTNKIRELLQQMERGLKSADPRDGTGYTGWAGIAVLYLHLYDVFGDPAYLQLAHGYVKQSLNCLTKRSITFLCGDAGPLAVAAVLYHKMNNEKQAEDCITRLIHLNKIDPHAPNEMLYGRIGYIYALLFVNKNFGVEKIPQSHIQQICETILTSGENLARKRNFTAKSPLMYEWYQEYYVGAAHGLAGIYYYLMQPSLQVSQGKLHSLVKPSVDYVCQLKFPSGNYPPCIGDNRDLLVHWCHGAPGVIYMLIQAYKVFREEKYLCDAYQCADVIWQYGLLKKGYGLCHGSAGNAYAFLTLYNLTQDMKYLYRACKFAEWCLEYGEHGCRTPDTPFSLFEGMAGTIYFLADLLVPTKARFPAFEL

SEQ ID NO: 912398 - protein, 399 aa, Homo sapiens; identical to SEQ ID NO: 912395

SEQ ID NO: 912399 - protein, 399 aa, Homo sapiens; identical to SEQ ID NO: 912395

SEQ ID NO: 912400 - protein, 399 aa, Homo sapiens; identical to SEQ ID NO: 912395

SEQ ID NO: 912401 - protein, 399 aa, Homo sapiens; identical to SEQ ID NO: 912395

SEQ ID NO: 912402 - protein, 399 aa, Homo sapiens; identical to SEQ ID NO: 912395

SEQ ID NO: 912403 - protein, 399 aa, Homo sapiens; identical to SEQ ID NO: 912395

SEQ ID NO: 912404 - protein, 350 aa, Homo sapiens
MGLICTRLASGVMAQRAFPNPYADYNKSLAEGYFDAAGRLTPEFSQRLTNKIRELLQQMERGLKSADPRDGTGYTGWAGIAVLYLHLYDVFGDPAYLQLAHGYVKQSLNCLTKRSITFLCGDAGPLAVAAVLYHKMNNEKQAEDCITRLIHLNKIDPHAPNEMLYGRIGYIYALLFVNKNFGVEKIPQSHIQQICETILTSGENLARKRNFTAKSPLMYEWYQEYYVGAAHGLAGIYYYLMQVFREEKYLCDAYQCADVIWQYGLLKKGYGLCHGSAGNAYAFLTLYNLTQDMKYLYRACKFAEWCLEYGEHGCRTPDTPFSLFEGMAGTIYFLADLLVPTKARFPAFEL

SEQ ID NO: 912405 - protein, 399 aa, Homo sapiens; identical to SEQ ID NO: 912395

SEQ ID NO: 912406 - protein, 67 aa, Homo sapiens
VMAQRAFPNPYADYNKSLAEGYFDAAGRVSLGYVCLHPCLSPRCSERCSFLPERVEHPPLKKYMIRR

SEQ ID NO: 912407 - protein, 752 aa, Homo sapiens
MAKRSRSEDEDDDLQYADHDYEVPQQKGLKKLWNRVKWTRDEDDKLKKLVEQHGTDDWTLIASHLQNRSDFQCQHRWQKVLNPELIKGPWTKEEDQRVIELVQKYGPKRWSLIAKHLKGRIGKQCRERWHNHLNPEVKKSSWTEEEDRIIYEAHKRLGNRWAEIAKLLPGRTDNSIKNHWNSTMRRKVEQEGYLQDGIKSERSSSKLQHKPCAAMDHMQTQNQFYIPVQIPGYQYVSPEGNCIEHVQPTSAFIQQPFIDEDPDKEKKIKELEMLLMSAENEVRRKRIPSQPGSFSSWSGSFLMDDNMSNTLNSLDEHTSEFYSMDENQPVSAQQNSPTKFLAVEANAVLSSLQTIPEFAETLELIESDPVAWSDVTSFDISDAAASPIKSTPVKLMRIQHNEGAMECQFNVSLVLEGKKNTCNGGNSEAVPLTSPNIAKFSTPPAILRKKRKMRVGHSPGSELRDGSLNDGGNMALKHTPLKTLPFSPSQFFNTCPGNEQLNIENPSFTSTPICGQKALITTPLHKETTPKDQKENVGFRTPTIRRSILGTTPRTPTPFKNALAAQEKKYGPLKIVSQPLAFLEEDIREVLKEETGTDLFLKEEDEPAYKSCKQENTASGKKVRKSLVLDNWEKEESGTQLLTEDISDMQSENRFTTSLLMIPLLEIHDNRCNLIPEKQDINSTNKTYTLTKKKPNPNTSKVVKLEKNLQSNCEWETVVYGKTEDQLIMTEQARRYLSTYTATSSTSRALIL

SEQ ID NO: 912408 - protein, 720 aa, Homo sapiens
MRVQISDLMLPLLRGRFLASEDEDDDLQYADHDYEVPQQKGLKKLWNRVKWTRDEDDKLKKLVEQHGTDDWTLIASHLQNRSDFQCQHRWQKVLNPELIKGPWTKEEDQRVIELVQKYGPKRWSLIAKHLKGRIGKQCRERWHNHLNPEVKKSSWTEEEDRIIYEAHKRLGNRWAEIAKLLPGRTDNSIKNHWNSTMRRKVEQEGYLQDGIKSERSSSKLQHKPCAAMDHMQTQNQFYIPVQIPGYQYVSPEGNCIEHVQPTSAFIQQPFIDEDPDKEKKIKELEMLLMSAENEVRRKRIPSNSPTKFLAVEANAVLSSLQTIPEFAETLELIESDPVAWSDVTSFDISDAAASPIKSTPVKLMRIQHNEGAMECQFNVSLVLEGKKNTCNGGNSEAVPLTSPNIAKFSTPPAILRKKRKMRVGHSPGSELRDGSLNDGGNMALKHTPLKTLPFSPSQFFNTCPGNEQLNIENPSFTSTPICGQKALITTPLHKETTPKDQKENVGFRTPTIRRSILGTTPRTPTPFKNALAAQEKKYGPLKIVSQPLAFLEEDIREVLKEETGTDLFLKEEDEPAYKSCKQENTASGKKVRKSLVLDNWEKEESGTQLLTEDISDMQSENRFTTSLLMIPLLEIHDNRCNLIPEKQDINSTNKTYTLTKKKPNPNTSKVVKLEKNLQSNCEWETVVYGKTEDQLIMTEQARRYLSTYTATSSTSRALIL

SEQ ID NO: 912409 - protein, 446 aa, Homo sapiens
MSNTLNSLDEHTSEFYSMDENQPVSAQQNSPTKFLAVEANAVLSSLQTIPEFAETLELIESDPVAWSDVTSFDISDAAASPIKSTPVKLMRIQHNEGAMECQFNVSLVLEGKKNTCNGGNSEAVPLTSPNIAKFSTPPAILRKKRKMRVGHSPGSELRDGSLNDGGNMALKHTPLKTLPFSPSQFFNTCPGNEQLNIENPSFTSTPICGQKALITTPLHKETTPKDQKENVGFRTPTIRRSILGTTPRTPTPFKNALAAQEKKYGPLKIVSQPLAFLEEDIREVLKEETGTDLFLKEEDEPAYKSCKQENTASGKKVRKSLVLDNWEKEESGTQLLTEDISDMQSENRFTTSLLMIPLLEIHDNRCNLIPEKQDINSTNKTYTLTKKKPNPNTSKVVKLEKNLQSNCEWETVVYGKTEDQLIMTEQARRYLSTYTATSSTSRALIL

SEQ ID NO: 912410 - protein, 663 aa, Homo sapiens
MRVQISDLMLPLLRGRFLASEDEDDDLQYADHDYEVPQQKGLKKLWNRVKWTRDEDDKLKKLVEQHGTDDWTLIASHLQNRSDFQCQHRWQKVLNPELIKGPWTKEEDQRVIELVQKYGPKRWSLIAKHLKGRIGKQCRERWHNHLNPEVKKSSWTEEEDRIIYEAHKRLGNRWAEIAKLLPGRTDNSIKNHWNSTMRRKVEQEGYLQDGIKSERSSSKLQHKPCAAMDHMQTQNQFYIPVQIPGYQYVSPEGNCIEHVQPTSAFIQQPFIDEDPDKEKKIKELEMLLMSAENEVRRKRIPSQPGSFSSWSGSFLMDDNMSNTLNSLDEHTSEFYSMDENQPVSAQQNSPTKFLAVEANAVLSSLQTIPEFAETLELIESDPVAWSDVTSFDISDAAASPIKSTPVKLMRIQHNEGAMECQFNVSLVLEGKKNTCNGGNSEAVPLTSPNIAKFSTPPAILRKKRKMRVGHSPGSELRDGSLNDGGNMALKHTPLKTLPFSPSQFFNTCPGNEQLNIENPSFTSTPICGQKALITTPLHKETTPKDQKENVGFRTPTIRRSILGTTPRTPTPFKNALAAQEKKYGPLKIVSQPLAFLEEDIREVLKEETGTDLFLKEEDEPAYKSCKQENTASGKKVRKSLVLDNWEKEESGTQLLTEDISDMQ

SEQ ID NO: 912411 - protein, 765 aa, Homo sapiens
MRVQISDLMLPLLRGRFLASEDEDDDLQYADHDYEVPQQKGLKKLWNRVKWTRDEDDKLKKLVEQHGTDDWTLIASHLQNRSDFQCQHRWQKVLNPELIKGPWTKEEDQRVIELVQKYGPKRWSLIAKHLKGRIGKQCRERWHNHLNPEVKKSSWTEEEDRIIYEAHKRLGNRWAEIAKLLPGRTDNSIKNHWNSTMRRKVEQEGYLQDGIKSERSSSKLQHKPCAAMDHMQTQNQFYIPVQIPGYQYVSPEGNCIEHVQPTSAFIQQPFIDEDPDKEKKIKELEMLLMSAENEVRRKRIPSQPGSFSSWSGSFLMDDNMSNTLNSLDEHTSEFYSMDENQPVSAQQNSPTKFLAVEANAVLSSLQTIPEFAETLELIESDPVAWSDVTSFDISDAAASPIKSTPVKLMRIQHNEGAMECQFNVSLVLEGKKNTCNGGNSEAVPLTSPNIAKFSTPPAILRKKRKMRVGHSPGSELRDGSLNDGGNMALKHTPLKTLPFSPSQFFNTCPGNEQLNIENPSFTSTPICGQKALITTPLHKETTPKDQKENVGFRTPTIRRSILGTTPRTPTPFKNALAAQEKKYGPLKIVSQPLAFLEEDIREVLKEETGTDLFLKEEDEPAYKSCKQENTASGKKVRKSLVLDNWEKEESGTQLLTEDISDMQSENRFTTSLLMIPLLEIHDNRCNLIPEKQDINSTNKTYTLTKKKPNPNTSKVVKLEKNLQSNCEWETVVYGKTEDQLIMTEQARRYLSTYTATSSTSRALIL

SEQ ID NO: 912412 - protein, 167 aa, Homo sapiens
QETASPAELLAAGERAGVGRLWRSRAGARAGRLTSGGRSRRRAGSRLLTCWGYPWPGRAGAKSGAAGRGRGRVAVRPRCPSVLPCRGRAFRTRPPPEGAREAARGSGRRSIRRRLEEADPRPRPACSYAVLEGWRRGRAGGWHPFRPGLSAPSRLRFSFLSRCPLPP

SEQ ID NO: 912413 - protein, 466 aa, Homo sapiens
EAELGWAWRGCSAATGGSAAATVPRDSKPQTRDLGALSRAGKQSLVVRNSRPLLSAPLRTASPSTPLRKWWGRRGPRREAFERPLGERKDSPVLGARTRARRERRQALAFGTMGCTLSAEDKAAVERSKMIDRNLREDGEKAAREVKLLLLGAGESGKSTIVKQMKIIHEAGYSEEECKQYKAVVYSNTIQSIIAIIRAMGRLKIDFGDSARADDARQLFVLAGAAEEGFMTAELAGVIKRLWKDSGVQACFNRSREYQLNDSAAYYLNDLDRIAQPNYIPTQQDVLRTRVKTTGIVETHFTFKDLHFKMFDVGGQRSERKKWIHCFEGVTAIIFCVALSDYDLVLAEDEEMNRMHESMKLFDSICNNKWFTDTSIILFLNKKDLFEEKIKKSPLTICYPEYAGSNTYEEAAAYIQCQFEDLNKRKDTKEIYTHFTCATDTKNVQFVFDAVTDVIIKNNLKDCGLF

SEQ ID NO: 912414 - protein, 157 aa, Homo sapiens
EAELGWAWRGCSAATGGSAAATVPRDSKPQTRDLGALSRAGKQSLVVRNSRPLLSAPLRTASPSTPLRKWWGRRGPRREAFERPLGERKDSPVLGARTRARRERRQALAFGTMGCTLSAEDKAAVERSKMIDRNLREDGEKAAREVKLLLLGKGGRV

SEQ ID NO: 912415 - protein, 466 aa, Homo sapiens; identical to SEQ ID NO: 912413

SEQ ID NO: 912416 - protein, 466 aa, Homo sapiens; identical to SEQ ID NO: 912413

SEQ ID NO: 912417 - protein, 197 aa, Homo sapiens
AGLGPEVACARPFCVPGPRPSGVSCADRSEGSWPTAPSRSLPPPSTLSVVEKMVGRNSAIAAGVCGALFIGYCIYFDRKRRSDPNFKNRLRERRKKQKLAKERAGLSKLPDLKDAEAVQKFFLEEIQLGEELLAQGEYEKGVDHLTNAIAVCGQPQQLLQVLQQTLPPPVFQMLLTKLPTISQRIVSAQSLAEDDVE

SEQ ID NO: 912418 - protein, 197 aa, Homo sapiens; identical to SEQ ID NO: 912417

SEQ ID NO: 912419 - protein, 185 aa, Homo sapiens
MNEAGLSDLQLAVPAQVDGLAVDPAPGMVCLLYFRTLSVYPKCTVYGKRMPLSNPPVMYTGRILPFLDLAGLSYSDGSHVSLTSLHLTASRWTPEDSSDLRCGHMHRMLLLQLASSHALDACLDASQNAHGNIECGQDEPYGSLSGNVRAFDTHEECDVDDNVFSYLLITLGSGVDAVVVQWKEK

SEQ ID NO: 912420 - protein, 197 aa, Homo sapiens; identical to SEQ ID NO: 912417

SEQ ID NO: 912421 - protein, 201 aa, Homo sapiens
AGLGPEVACARPFCVPGPRPSGVSCADRSEGSWPTAPSRSLPPPSTLSVVEKMVGRNSAIAAGVCGALFIGYCIYFDRKRRSDPNFKNRLRERRKKQKLAKERAGLSKLPDLKDAEAVQKFFLEEIQLGEELLAQGEYEKGVDHLTNAIAVCGQPQQLLQVLQQTLPPPVFQMLLTKLPTISQRIVSAQSLADFSEWGPQR

SEQ ID NO: 912422 - protein, 197 aa, Homo sapiens; identical to SEQ ID NO: 912417

SEQ ID NO: 912423 - protein, 197 aa, Homo sapiens; identical to SEQ ID NO: 912417

SEQ ID NO: 912424 - protein, 203 aa, Homo sapiens
AGLGPEVACARPFCVPGPRPSGVSCADRSEGSWPTAPSRSLPPPSTLSVVEKMVGRNSAIAAGVCGALFIGYCIYFDRKRRSDPNFKNRLRERRKKQKLAKERAGLSKLPDLKDAEAVQKFFLEEIQLGEELLAQGEYEKGVDHLTNAIAVCGQPQQLLQVLQQTLPPPVFQMLLTKLPTISQRIVSAQSLAVDIEECTFGVL

SEQ ID NO: 912425 - protein, 521 aa, Homo sapiens
MVLRSGICGLSPHRIFPSLLVVVALVGLLPVLRSHGLQLSPTASTIRSSEPPRERSIGDVTTAPPEVTPESRPVNHSVTDHGMKPRKAFPVLGIDYTHVRTPFEISLWILLACLMKIGFHVIPTISSIVPESCLLIVVGLLVGGLIKGVGETPPFLQSDVFFLFLLPPIILDAGYFLPLRQFTENLGTILIFAVVGTLWNAFFLGGLMYAVCLVGGEQINNIGLLDNLLFGSIISAVDPVAVLAVFEEIHINELLHILVFGESLLNDAVTVVLYHLFEEFANYEHVGIVDIFLGFLSFFVVALGGVLVGVVYGVIAAFTSRFTSHIRVIEPLFVFLYSYMAYLSAELFHLSGIMALIASGVVMRPYVEANISHKSHTTIKYFLKMWSSVSETLIFIFLGVSTVAGSHHWNWTFVISTLLFCLIARVLGVLGLTWFINKFRIVKLTPKDQFIIAYGGLRGAIAFSLGYLLDKKHFPMCDLFLTAIITVIFFTVFVQVLGPGQGRPLPWGPSQAVPVEREESV

SEQ ID NO: 912426 - protein, 815 aa, Homo sapiens
MVLRSGICGLSPHRIFPSLLVVVALVGLLPVLRSHGLQLSPTASTIRSSEPPRERSIGDVTTAPPEVTPESRPVNHSVTDHGMKPRKAFPVLGIDYTHVRTPFEISLWILLACLMKIGFHVIPTISSIVPESCLLIVVGLLVGGLIKGVGETPPFLQSDVFFLFLLPPIILDAGYFLPLRQFTENLGTILIFAVVGTLWNAFFLGGLMYAVCLVGGEQINNIGLLDNLLFGSIISAVDPVAVLAVFEEIHINELLHILVFGESLLNDAVTVVLYHLFEEFANYEHVGIVDIFLGFLSFFVVALGGVLVGVVYGVIAAFTSRFTSHIRVIEPLFVFLYSYMAYLSAELFHLSGIMALIASGVVMRPYVEANISHKSHTTIKYFLKMWSSVSETLIFIFLGVSTVAGSHHWNWTFVISTLLFCLIARVLGVLGLTWFINKFRIVKLTPKDQFIIAYGGLRGAIAFSLGYLLDKKHFPMCDLFLTAIITVIFFTVFVQGMTIRPLVDLLAVKKKQETKRSINEEIHTQFLDHLLTGIEDICGHYGHHHWKDKLNRFNKKYVKKCLIAGERSKEPQLIAFYHKMEMKQAIELVESGGMGKIPSAVSTVSMQNIHPKSLPSERILPALSKDKEEEIRKILRNNLQKTRQRLRSYNRHTLVADPYEEAWNQMLLRRQKARQLEQKINNYLTVPAHKLDSPTMSRARIGSDPLAYEPKEDLPVITIDPASPQSPESVDLVNEELKGKVLGLSRDPAKVAEEDEDDDGGIMMRSKETSSPGTDDVFTPAPSDSPSSQRIQRCLSDPGPHPEPGEGEPFFPKGQ

SEQ ID NO: 912427 - protein, 815 aa, Homo sapiens; identical to SEQ ID NO: 912426

SEQ ID NO: 912428 - protein, 806 aa, Homo sapiens
MVLRSGICGLSPHRIFPSLLVVVALVGLLPVLRSHGLQLSPTASTIRSSEPPRERSIGDVTTAPPEVTPESRPVNHSVTDHGMKPRKAFPVLGIDYTHVRTPFEISLWILLACLMKIGFHVIPTISSIVPESCLLIVVGLLVGGLIKGVGETPPFLQSDVFFLFLLPPIILDAGYFLPLRQFTENLGTILIFAVVGTLWNAFFLGGLMYAVCLVGGEQINNIGLLDNLLFGSIISAVDPVAVLAVFEEIHINELLHILVFGESLLNDAVTVVLYHLFEEFANYEHVGIVDIFLGFLSFFVVALGGVLVGVVYGVIAAFTSRFTSHIRVIEPLFVFLYSYMAYLSAELFHLSGIMALIASGVVMRPYVEANISHKSHTTIKYFLKMWSSVSETLIFIFLGVSTVAGSHHWNWTFVISTLLFCLIARVLGVLGLTWFINKFRIVKLTPKDQFIIAYGGLRGAIAFSLGYLLDKKHFPMCDLFLTAIITVIFFTVFVQGMTIRPLVDLLAVKKKQETKRSINEEIHTQFLDHLLTGIEDICGHYGHHHWKDKLNRFNKKYVKKCLIAGERSKEPQLIAFYHKMEMKQAIELVESGGMGKIPSAVSTVSMQNIHPKSLPSERILPALSKDKEEEIRKILRNNLQKTRQRLRSYNRHTLVADPYEEAWNQMLLRRQKARQLEQKINNYLTVPAHKLDSPTMSRARIGSDPLAYEPKEDLPVITIDPASPQSPESVDLVNEELKGKVLGLSRDPAKVAEEDEDDDGGIMMRSKETSSPGTDDVFTPAPSDSPSSQRIQRCLILLLIQTNLSF

SEQ ID NO: 912429 - protein, 105 aa, Homo sapiens
MRLLHMRLLHMRLLHMSLSACWALNCCSKTVTSEVTPTPNQESLQPHRCWPLGTCLALGPDLQSCWPALTSPTLGLAPGTFPLCVPHPACCGSPLWRRWGGEGLP

SEQ ID NO: 912430 - protein, 521 aa, Homo sapiens; identical to SEQ ID NO: 912425

SEQ ID NO: 912431 - protein, 558 aa, Homo sapiens
MVLRSGICGLSPHRIFPSLLVVVALVGLLPVLRSHGLQLSPTASTIRSSEPPRERSIGDVTTAPPEVTPESRPVNHSVTDHGMKPRKAFPVLGIDYTHVRTPFEISLWILLACLMKIGFHVIPTISSIVPESCLLIVVGLLVGGLIKGVGETPPFLQSDVFFLFLLPPIILDAGYFLPLRQFTENLGTILIFAVVGTLWNAFFLGGLMYAVCLVGGEQINNIGLLDNLLFGSIISAVDPVAVLAVFEEIHINELLHILVFGESLLNDAVTVVLYHLFEEFANYEHVGIVDIFLGFLSFFVVALGGVLVGVVYGVIAAFTSRFTSHIRVIEPLFVFLYSYMAYLSAELFHLSGIMALIASGVVMRPYVEANISHKSHTTIKYFLKMWSSVSETLIFIFLGVSTVAGSHHWNWTFVISTLLFCLIARVLGVLGLTWFINKFRIVKLTPKDQFIIAYGGLRGAIAFSLGYLLDKKHFPMCDLFLTAIITVIFFTVFVQGMTIRPLVDLLAVKKKQETKRSINEEIHTQFLDHLLTGIEDICGHYGHHHWKDKQVAGLVGRQ

SEQ ID NO: 912432 - protein, 132 aa, Homo sapiens
MVLRSGICGLSPHRIFPSLLVVVALVGLLPVLRSHGLQLSPTASTIRSSEPPRERSIGDVTTAPPEVTPESRPVNHSVTDHGMKPRKAFPVLGIDYTHVRTPFEISLWILLACLMKIDNSGVTTVLTWIIIS

SEQ ID NO: 912433 - protein, 815 aa, Homo sapiens; identical to SEQ ID NO: 912426

SEQ ID NO: 912434 - protein, 110 aa, Homo sapiens
LGLVLELDQEELQLGRGGAPRRARAARRGVLLLAHREPPPARAEAPSRQAACLPPLSISPESQPGAPGPLPLSGWRSSRPLPGFTPSQPGLPAPSLLFLDWLSPPSVPFL

SEQ ID NO: 912435 - protein, 848 aa, Homo sapiens
MTQVFGQRLFESPYETADVDVKSFVEAGSGSSTMVLRSGICGLSPHRIFPSLLVVVALVGLLPVLRSHGLQLSPTASTIRSSEPPRERSIGDVTTAPPEVTPESRPVNHSVTDHGMKPRKAFPVLGIDYTHVRTPFEISLWILLACLMKIGFHVIPTISSIVPESCLLIVVGLLVGGLIKGVGETPPFLQSDVFFLFLLPPIILDAGYFLPLRQFTENLGTILIFAVVGTLWNAFFLGGLMYAVCLVGGEQINNIGLLDNLLFGSIISAVDPVAVLAVFEEIHINELLHILVFGESLLNDAVTVVLYHLFEEFANYEHVGIVDIFLGFLSFFVVALGGVLVGVVYGVIAAFTSRFTSHIRVIEPLFVFLYSYMAYLSAELFHLSGIMALIASGVVMRPYVEANISHKSHTTIKYFLKMWSSVSETLIFIFLGVSTVAGSHHWNWTFVISTLLFCLIARVLGVLGLTWFINKFRIVKLTPKDQFIIAYGGLRGAIAFSLGYLLDKKHFPMCDLFLTAIITVIFFTVFVQGMTIRPLVDLLAVKKKQETKRSINEEIHTQFLDHLLTGIEDICGHYGHHHWKDKLNRFNKKYVKKCLIAGERSKEPQLIAFYHKMEMKQAIELVESGGMGKIPSAVSTVSMQNIHPKSLPSERILPALSKDKEEEIRKILRNNLQKTRQRLRSYNRHTLVADPYEEAWNQMLLRRQKARQLEQKINNYLTVPAHKLDSPTMSRARIGSDPLAYEPKEDLPVITIDPASPQSPESVDLVNEELKGKVLGLSRDPAKVAEEDEDDDGGIMMRSKETSSPGTDDVFTPAPSDSPSSQRIQRCLSDPGPHPEPGEGEPFFPKGQ

SEQ ID NO: 912436 - protein, 298 aa, Homo sapiens
VGKAPHSEADLALGPFQFLDHLLTGIEDICGHYGHHHWKDKLNRFNKKYVKKCLIAGERSKEPQLIAFYHKMEMKQAIELVESGGMGKIPSAVSTVSMQNIHPKSLPSERILPALSKDKEEEIRKILRNNLQKTRQRLRSYNRHTLVADPYEEAWNQMLLRRQKARQLEQKINNYLTVPAHKLDSPTMSRARIGSDPLAYEPKEDLPVITIDPASPQSPESVDLVNEELKGKVLGLSRDPAKVAEEDEDDDGGIMMRSKETSSPGTDDVFTPAPSDSPSSQRIQRCLILLLIQTNLSF

SEQ ID NO: 912437 - protein, 816 aa, Homo sapiens
MVLRSGICGLSPHRIFPSLLVVVALVGLLPVLRSHGLQLSPTASTIRSSEPPRERSIGDVTTAPPEVTPESRPVNHSVTDHGMKPRKAFPVLGIDYTHVRTPFEISLWILLACLMKIGFHVIPTISSIVPESCLLIVVGLLVGGLIKGVGETPPFLQSDVFFLFLLPPIILDAGYFLPLRQFTENLGTILIFAVVGTLWNAFFLGGLMYAVCLVGGEQINNIGLLDNLLFGSIISAVDPVAVLAVFEEIHINELLHILVFGESLLNDAVTVVLYHLFEEFANYEHVGIVDIFLGFLSFFVVALGGVLVGVVYGVIAAFTSRFTSHIRVIEPLFVFLYSYMAYLSAELFHLSGIMALIASGVVMRPYVEANISHKSHTTIKYFLKMWSSVSETLIFIFLGVSTVAGSHHWNWTFVISTLLFCLIARVLGVLGLTWFINKFRIVKLTPKDQFIIAYGGLRGAIAFSLGYLLDKKHFPMCDLFLTAIITVIFFTVFVQGMTIRPLVDLLAVKKKQETKRSINEEIHTQFLDHLLTGIEDICGHYGHHHWKDKLNRFNKKYVKKCLIAGERSKEPQLIAFYHKMEMKQAIELVESGGMGKIPSAVSTVSMQNIHPKSLPSERILPALSKDKEEEIRKILRNNLQKTRQRLRSYNRHTLVADPYEEAWNQMLLRRQKARQLEQKINNYLTVPAHKLDSPTMSRARIGSDPLAYEPKEDLPVITIDPASPQSPESVDLVNEELKGKVLGLSRDPAKVAEEDEDDDGGIMMRSKETSSPGTDDVFTPAPSDSPSSQRIQRCLSDPGPHPEPGEGEPFFPRIVQ

SEQ ID NO: 912438 - protein, 324 aa, Homo sapiens
MVLRSGICGLSPHRIFPSLLVVVALVGLLPVLRSHGLQLSPTASTIRSSEPPRERSIGDVTTAPPEVTPESRPVNHSVTDHGMKPRKAFPVLGIDYTHVRTPFEISLWILLACLMKIGFHVIPTISSIVPESCLLIVVGLLVGGLIKGVGETPPFLQSDVFFLFLLPPIILDAGYFLPLRQFTENLGTILIFAVVGTLWNAFFLGGLMYAVCLVGGEQINNIGLLDNLLFGSIISAVDPVAVLAVFEEIHINELLHILVFGESLLNDAVTVVLYHLFEEFANYEHVGIVDIFLGFLSFFVVAGLVACFLLMFSIFSSPKTPRLN

SEQ ID NO: 912439 - protein, 54 aa, Homo sapiens
TAPTPPGAEPSGARTALTLSLPQLRSYNRHTLVADPYEEAWNQMLLRRQKARQL

SEQ ID NO: 912440 - protein, 401 aa, Homo sapiens
ESASGSEGIGREMGKMAAAVGSVATLATEPGEDAFRKLFRFYRQSRPGTADLEGVIDFSAAHAARGKGPGAQKVIKSQLNVSSVSEQNAYRAGLQPVSKWQAYGLKGYPGFIFIPNPFLPGYQWHWVKQCLKLYSQKPNVCNLDKHMSKEETQDLWEQSKEFLRYKEATKRRPRSLLEKLRWVTVGYHYNWDSKKYSADHYTPFPSDLGFLSEQVAAACGFEDFRAEAGILNYYRLDSTLGIHVDRSELDHSKPLLSFSFGQSAIFLLGGLQRDEAPTAMFMHSGDIMIMSGFSRLLNHAVPRVLPNPEGEGLPHCLEAPLPAVLPRDSMVEPCSMEDWQVCASYLKTARVNMTVRQVLATDQNFPLEPIEDEKRDISTEGFCHLDDQNSEVKRARINPDS

SEQ ID NO: 912441 - protein, 310 aa, Homo sapiens
NLLPDQRVWAARWGRWQRPWALWRLWRLSPGRTPFGNFSASTVRAGPGPQTWKGSSTSRRPTQPVARVLVPKRYKEATKRRPRSLLEKLRWVTVGYHYNWDSKKYSADHYTPFPSDLGFLSEQVAAACGFEDFRAEAGILNYYRLDSTLGIHVDRSELDHSKPLLSFSFGQSAIFLLGGLQRDEAPTAMFMHSGDIMIMSGFSRLLNHAVPRVLPNPEGEGLPHCLEAPLPAVLPRDSMVEPCSMEDWQVCASYLKTARVNMTVRQVLATDQNFPLEPIEDEKRDISTEGFCHLDDQNSEVKRARINPDS

SEQ ID NO: 912442 - protein, 234 aa, Homo sapiens
ESASGSEGIGREMGKMAAAVGSVATLATEPGEDAFRKLFRFYRQSRPGTADLEGVIDFSAAHAARGKGPGAQKVIKSQLNVSSVSEQNAYRAGLQPVSKWQAYGLKGYPGFIFIPNPFLPGYQWHWVKQCLKLYSQKPNVCNLDKHMSKEETQDLWEQSKEFLRESPKPHPNLMIRQEDSGLSRWLHLQIYHSESIQSKISKGKRHLEQSPGKTRCMPPKVLSQGSHTGYGNGL

SEQ ID NO: 912443 - protein, 401 aa, Homo sapiens; identical to SEQ ID NO: 912440

SEQ ID NO: 912444 - protein, 128 aa, Homo sapiens
ESASGSEGIGREMGKMAAAVGSVATLATEPGEDAFRKLFRFYRQSRPGTADLEGVIDFSAAHAARGKGPGAQKVIKSQLNVSSVSEQNAYRAGLQPVSKWQAYGLKGYPGIKKRLNGDPEVYWRNCVG

SEQ ID NO: 912445 - protein, 529 aa, Homo sapiens
PRPLPDFARSDPRGCPPLRTPLAARARSAARPHRFTMLKALFLTMLTLALVKSQDTEETITYTQCTDGYEWDPVRQQCKDIDECDIVPDACKGGMKCVNHYGGYLCLPKTAQIIVNNEQPQQETQPAEGTSGATTGVVAASSMATSGVLPGGGFVASAAAVAGPEMQTGRNNFVIRRNPADPQRIPSNPSHRIQCAAGYEQSEHNVCQDIDECTAGTHNCRADQVCINLRGSFACQCPPGYQKRGEQCVDIDECTIPPYCHQRCVNTPGSFYCQCSPGFQLAANNYTCVDINECDASNQCAQQCYNILGSFICQCNQGYELSSDRLNCEDIDECRTSSYLCQYQCVNEPGKFSCMCPQGYQVVRSRTCQDINECETTNECREDEMCWNYHGGFRCYPRNPCQDPYILTPENRCVCPVSNAMCRELPQSIVYKYMSIRSDRSVPSDIFQIQATTIYANTINTFRIKSGNENGEFYLRQTSPVSAMLVLVKSLSGPREHIVDLEMLTVSSIGTFRTSSVLRLTIIVGPFSF

SEQ ID NO: 912446 - protein, 542 aa, Homo sapiens
AAAAGLRQIRPTGLPSPAHSPRCPGPERSAAAQVFLLCCARNSASSRFTMLKALFLTMLTLALVKSQDTEETITYTQCTDGYEWDPVRQQCKDIDECDIVPDACKGGMKCVNHYGGYLCLPKTAQIIVNNEQPQQETQPAEGTSGATTGVVAASSMATSGVLPGGGFVASAAAVAGPEMQTGRNNFVIRRNPADPQRIPSNPSHRIQCAAGYEQSEHNVCQDIDECTAGTHNCRADQVCINLRGSFACQCPPGYQKRGEQCVDIDECTIPPYCHQRCVNTPGSFYCQCSPGFQLAANNYTCVDINECDASNQCAQQCYNILGSFICQCNQGYELSSDRLNCEDIDECRTSSYLCQYQCVNEPGKFSCMCPQGYQVVRSRTCQDINECETTNECREDEMCWNYHGGFRCYPRNPCQDPYILTPENRCVCPVSNAMCRELPQSIVYKYMSIRSDRSVPSDIFQIQATTIYANTINTFRIKSGNENGEFYLRQTSPVSAMLVLVKSLSGPREHIVDLEMLTVSSIGTFRTSSVLRLTIIVGPFSF

SEQ ID NO: 912447 - protein, 493 aa, Homo sapiens
MLKALFLTMLTLALVKSQDTEETITYTQCTDGYEWDPVRQQCKDIDECDIVPDACKGGMKCVNHYGGYLCLPKTAQIIVNNEQPQQETQPAEGTSGATTGVVAASSMATSGVLPGGGFVASAAAVAGPEMQTGRNNFVIRRNPADPQRIPSNPSHRIQCAAGYEQSEHNVCQDIDECTAGTHNCRADQVCINLRGSFACQCPPGYQKRGEQCVDIDECTIPPYCHQRCVNTPGSFYCQCSPGFQLAANNYTCVDINECDASNQCAQQCYNILGSFICQCNQGYELSSDRLNCEDIDECRTSSYLCQYQCVNEPGKFSCMCPQGYQVVRSRTCQDINECETTNECREDEMCWNYHGGFRCYPRNPCQDPYILTPENRCVCPVSNAMCRELPQSIVYKYMSIRSDRSVPSDIFQIQATTIYANTINTFRIKSGNENGEFYLRQTSPVSAMLVLVKSLSGPREHIVDLEMLTVSSIGTFRTSSVLRLTIIVGPFSF

SEQ ID NO: 912448 - protein, 484 aa, Homo sapiens [sequence omitted]

SEQ ID NO: 912449 - protein, 511 aa, Homo sapiens
PRPLPDFARSDPRGCPPLRTPLAARARSAARPHRFTMLKALFLTMLTLALVKSQDTEETITYTQCTDGYEWDPVRQQCKDIDECDIVPDACKGGMKCVNHYGGYLCLPTEGTSGATTGVVAASSMATSGVLPGGGFVASAAAVAGPEMQTGRNNFVIRRNPADPQRIPSNPSHRIQCAAGYEQSEHNVCQDIDECTAGTHNCRADQVCINLRGSFACQCPPGYQKRGEQCVDIDECTIPPYCHQRCVNTPGSFYCQCSPGFQLAANNYTCVDINECDASNQCAQQCYNILGSFICQCNQGYELSSDRLNCEDIDECRTSSYLCQYQCVNEPGKFSCMCPQGYQVVRSRTCQDINECETTNECREDEMCWNYHGGFRCYPRNPCQDPYILTPENRCVCPVSNAMCRELPQSIVYKYMSIRSDRSVPSDIFQIQATTIYANTINTFRIKSGNENGEFYLRQTSPVSAMLVLVKSLSGPREHIVDLEMLTVSSIGTFRTSSVLRLTIIVGPFSF

SEQ ID NO: 912450 - protein, 548 aa, Homo sapiens
PRPLPDFARSDPRGCPPLRTPLAARARSAARPHRFTMLKALFLTMLTLALVKSQDTEETITYTQCTDGYEWDPVRQQCKDIDECDIVPDACKGGMKCVNHYGGYLCLPKTAQIIVNNEQPQQETQPAEGTSGATTGVVAASSMATSGVLPGGGFVASAAAVAGPEMQTGRNNFVIRRNPADPQRIPSNPSHRIQCAAGYEQSEHNVCQDIDECTAGTHNCRADQVCINLRGSFACQCPPGYQKRGEQCVDIDECTIPPYCHQRCVNTPGSFYCQCSPGFQLAANNYTCVDINECDASNQCAQQCYNILGSFICQCNQGYELSSDRLNCEDIDECRTSSYLCQYQCVNEPGKFSCMCPQGYQVVRSRTCQVYFSCMCPQGYQVVEVEHVNINECETTNECREDEMCWNYHGGFRCYPRNPCQDPYILTPENRCVCPVSNAMCRELPQSIVYKYMSIRSDRSVPSDIFQIQATTIYANTINTFRIKSGNENGEFYLRQTSPVSAMLVLVKSLSGPREHIVDLEMLTVSSIGTFRTSSVLRLTIIVGPFSF

SEQ ID NO: 912451 - protein, 283 aa, Homo sapiens
RTRGCQLKPRTALAANNYIYAGIVVCCQLKPRTALAINNYTCVDINECDASNQCAQQCYNILGSFICQCNQGYELSSDRLNCEDIDECRTSSYLCQYQCVNEPGKFSCMCPQGYQVVRSRTCQDINECETTNECREDEMCWNYHGGFRCYPRNPCQDPYILTPENRCVCPVSNAMCRELPQSIVYKYMSIRSDRSVPSDIFQIQATTIYANTINTFRIKSGNENGEFYLRQTSPVSAMLVLVKSLSGPREHIVDLEMLTVSSIGTFRTSSVLRLTIIVGPFSF

SEQ ID NO: 912452 - protein, 514 aa, Homo sapiens
PRPLPDFARSDPRGCPPLRTPLAARARSAARPHRFTMLKALFLTMLTLALVKSQDTEETITYTQCTDGYEWDPVRQQCKDIDECDIVPDACKGGMKCVNHYGGYLCLPKTAQIIVNNEQPQQETQPAEGTSGATTGVVAASSMATSGVLPGGGFVASAAAVAGPEMQTGRNNFVIRRNPADPQRIPSNPSHRIQCAAGYEQSEHNVCQDIDECTAGTHNCRADQVCINLRGSFACQCPPGYQKRGEQCVDIDECTIPPYCHQRCVNTPGSFYCQCSPGFQLAANNYTCVDINECDASNQCAQQCYNILGSFICQCNQGYELSSDRLNCEDIDECRTSSYLCQYQCVNEPGKFSCMCPQGYQVVRSRTCQDINECETTNECREDEMCWNYHGGFRCYPRNPCQDPYILTPENRCVCPVSNAMCRELPQSIVYKYMSIRSDRSVPSDIFQIQATTIYANTINTFRIKSGNENGEFYLRQTSPVSAMLVLVKSLSGPREHIVDLEMLTVSSIHFSLF

SEQ ID NO: 912453 - protein, 529 aa, Homo sapiens; identical to SEQ ID NO: 912445

SEQ ID NO: 912454 - protein, 411 aa, Homo sapiens
PRPLPDFARSDPRGCPPLRTPLAARARSAARPHRFTMLKALFLTMLTLALVKSQDTEETITYTQCTDGYEWDPVRQQCKDIDECDIVPDACKGGMKCVNHYGGYLCLPKTAQIIVNNEQPQQETQPAEGTSGATTGVVAASSMATSGVLPGGGFVASAAAVAGPEMQTGRNNFVIRRNPADPQRIPSNPSHRIQCAAGYEQSEHNVCQDIDECTAGTHNCRADQVCINLRGSFACQCPPGYQKRGEQCVDIDECTIPPYCHQRCVNTPGSFYCQCSPGFQLAANNYTCVDINECDASNQCAQQCYNILGSFICQCNQGYELSSDRLNCEDIDECRTSSYLCQYQCVNEPGKFSCMCPQGYQVVRSRTCQDINECETTNECREDEMCWNYHGGFRCYPRNPCQDPYILTPEN

SEQ ID NO: 912455 - protein, 291 aa, Homo sapiens
PRPLPDFARSDPRGCPPLRTPLAARARSAARPHRFTMLKALFLTMLTLALVKSQDTEETITYTQCTDGYEWDPVRQQCKDIDECDIVPDACKGGMKCVNHYGGYLCLPKTAQIIVNNEQPQQETQPAEGTSGATTGVVAASSMATSGVLPGGGFVASAAAVAGPEMQTGRNNFVIRRNPADPQRIPSNPSHRIQCAAGYEQSEHNVCQDIDECTAGTHNCRADQVCINLRGSFACQCPPGYQKRGEQCVDIDECTIPPYCHQRCVNTPGSFYCQCSPGFQLAANNYTCVEF

SEQ ID NO: 912456 - protein, 493 aa, Homo sapiens; identical to SEQ ID NO: 912447

SEQ ID NO: 912457 - protein, 470 aa, Homo sapiens
MHSQQCTDGYEWDPVRQQCKDIDECDIVPDACKGGMKCVNHYGGYLCLPKTAQIIVNNEQPQQETQPAEGTSGATTGVVAASSMATSGVLPGGGFVASAAAVAGPEMQTGRNNFVIRRNPADPQRIPSNPSHRIQCAAGYEQSEHNVCQDIDECTAGTHNCRADQVCINLRGSFACQCPPGYQKRGEQCVDIDECTIPPYCHQRCVNTPGSFYCQCSPGFQLAANNYTCVDINECDASNQCAQQCYNILGSFICQCNQGYELSSDRLNCEDIDECRTSSYLCQYQCVNEPGKFSCMCPQGYQVVRSRTCQDINECETTNECREDEMCWNYHGGFRCYPRNPCQDPYILTPENRCVCPVSNAMCRELPQSIVYKYMSIRSDRSVPSDIFQIQATTIYANTINTFRIKSGNENGEFYLRQTSPVSAMLVLVKSLSGPREHIVDLEMLTVSSIGTFRTSSVLRLTIIVGPFSF

SEQ ID NO: 912458 - protein, 435 aa, Homo sapiens
ELGPVSSGGYLCLPKTAQIIVNNEQPQQETQPAEGTSGATTGVVAASSMATSGVLPGGGFVASAAAVAGPEMQTGRNNFVIRRNPADPQRIPSNPSHRIQCAAGYEQSEHNVCQDIDECTAGTHNCRADQVCINLRGSFACQCPPGYQKRGEQCVDIDECTIPPYCHQRCVNTPGSFYCQCSPGFQLAANNYTCVDINECDASNQCAQQCYNILGSFICQCNQGYELSSDRLNCEDIDECRTSSYLCQYQCVNEPGKFSCMCPQGYQVVRSRTCQDINECETTNECREDEMCWNYHGGFRCYPRNPCQDPYILTPENRCVCPVSNAMCRELPQSIVYKYMSIRSDRSVPSDIFQIQATTIYANTINTFRIKSGNENGEFYLRQTSPVSAMLVLVKSLSGPREHIVDLEMLTVSSIGTFRTSSVLRLTIIVGPFSF

SEQ ID NO: 912459 - protein, 449 aa, Homo sapiens
PRPLPDFARSDPRGCPPLRTPLAARARSAARPHRFTMLKALFLTMLTLALVKSQDTEETITYTQCTDGYEWDPVRQQCKDIDECDIVPDACKGGMKCVNHYGGYLCLPKTAQIIVNNEQPQQETQPAEGTSGATTGVVAASSMATSGVLPGGGFVASAAAVAGPEMQTGRNNFVIRRNPADPQRIPSNPSHRIQCAAGYEQSEHNVCQDIDECTAGTHNCRADQVCINLRGSFACQCPPGYQKRGEQCVDIDECRTSSYLCQYQCVNEPGKFSCMCPQGYQVVRSRTCQDINECETTNECREDEMCWNYHGGFRCYPRNPCQDPYILTPENRCVCPVSNAMCRELPQSIVYKYMSIRSDRSVPSDIFQIQATTIYANTINTFRIKSGNENGEFYLRQTSPVSAMLVLVKSLSGPREHIVDLEMLTVSSIGTFRTSSVLRLTIIVGPFSF

SEQ ID NO: 912460 - protein, 529 aa, Homo sapiens; identical to SEQ ID NO: 912445

SEQ ID NO: 912461 - protein, 529 aa, Homo sapiens; identical to SEQ ID NO: 912445

SEQ ID NO: 912462 - protein, 91 aa, Homo sapiens
FDGDSPFIFQIQATTIYANTINTFRIKSGNENGEFYLRQTSPVSAMLVLVKSLSGPREHIVDLEMLTVSSIGTFRTSSVLRLTIIVGPFSF

SEQ ID NO: 912463 - protein, 114 aa, Homo sapiens
AAAAGLRQIRPTGLPSPAHSPRCPGPERSAAAQVFLLCCARNSASSRFTMLKALFLTMLTLALVKSQDTEETITYTQCTDGYEWDPVRQQCKDIDECDIVPDACKGGMKCVNHY

SEQ ID NO: 912464 - protein, 218 aa, Homo sapiens
IVKRSPELFCWFCLQRTSSPQVRKLIVLDPKKRLTTFQALQHPWVTGKAANFVHMDTAQKKLQEFNARRKLKAAVKAVVASSRLGSASSSHGSIQESHKASRDPSPIQDGNEDMKAIPEGEKIQGDGAQAAVKGAQAELMKVQALEKVKGADINAEEAPKMVPKAVEDGIKVADLELEEGLAEEKLKTVEEAAAPREGQGSSAVGFEVPQQDVILPEY

SEQ ID NO: 912465 - protein, 508 aa, Homo sapiens
SGSLAPAFAGGGWRPASRSGSGGGGGGGFRSPAAKMLKVTVPSCSASSCSSVTASAAPGTASLVPDYWIDGSNRDALSDFFEVESELGRGATSIVYRCKQKGTQKPYALKVLKKTVDKKIVRTEIGVLLRLSHPNIIKLKEIFETPTEISLVLELVTGGELFDRIVEKGYYSERDAADAVKQILEAVAYLHENGIVHRDLKPENLLYATPAPDAPLKIADFGLSKIVEHQVLMKTVCGTPGYCAPEILRGCAYGPEVDMWSVGIITYILLCGFEPFYDERGDQFMFRRILNCEYYFISPWWDEVSLNAKDLVRKLIVLDPKKRLTTFQALQHPWVTGKAANFVHMDTAQKKLQEFNARRKLKAAVKAVVASSRLGSASSSHGSIQESHKASRDPSPIQDGNEDMKAIPEGEKIQGDGAQAAVKGAQAELMKVQALEKVKGADINAEEAPKMVPKAVEDGIKVADLELEEGLAEEKLKTVEEAAAPREGQGSSAVGFEVPQQDVILPEY

SEQ ID NO: 912466 - protein, 508 aa, Homo sapiens; identical to SEQ ID NO: 912465

SEQ ID NO: 912467 - protein, 670 aa, Homo sapiens
MAKRIKAKPTSDKPGSPYRSVTHFDSLAVIDIPGADTLDKLFDHAVSKFGKKDSLGTREILSEENEMQPNGKVFKKLILGNYKWMNYLEVNRRVNNFGSGLTALGLKPKNTIAIFCETRAEWMIAAQTCFKYNFPLVTLYATLGKEAVVHGLNESEASYLITSVELLESKLKTALLDISCVKHIIYVDNKAINKAEYPEGFEIHSMQSVEELGSNPENLGIPPSRPTPSDMAIVMYTSGSTGRPKGVMMHHSNLIAGMTGQCERIPGLGPKDTYIGYLPLAHVLELTAEISCFTYGCRIGYSSPLTLSDQSSKIKKGSKGDCTVLKPTLMAAVPEIMDRIYKNVMSKVQEMNYIQKTLFKIGYDYKLEQIKKGYDAPLCNLLLFKKVKALLGGNVRMMLSGGAPLSPQTHRFMNVCFCCPIGQGYGLTESCGAGTVTEVTDYTTGRVGAPLICCEIKLKDWQEGGYTINDKPNPRGEIVIGGQNISMGYFKNEEKTAEDYSVDENGQRWFCTGDIGEFHPDGCLQIIDRKKDLVKLQAGEYVSLGKVEAALKNCPLIDNICAFAKSDQSYVISFVVPNQKRLTLLAQQKGVEGTWVDICNNPAMEAEILKEIREAANAMKLERFEIPIKVRLSPEPWTPETGLVTDAFKLKRKELRNHYLKDIERMYGGK

SEQ ID NO: 912468 - protein, 670 aa, Homo sapiens; identical to SEQ ID NO: 912467

SEQ ID NO: 912469 - protein, 670 aa, Homo sapiens; identical to SEQ ID NO: 912467

SEQ ID NO: 912470 - protein, 711 aa, Homo sapiens
MKLKLNVLTIILLPVHLLITIYSALIFIPWYFLTNAKKKNAMAKRIKAKPTSDKPGSPYRSVTHFDSLAVIDIPGADTLDKLFDHAVSKFGKKDSLGTREILSEENEMQPNGKVFKKLILGNYKWMNYLEVNRRVNNFGSGLTALGLKPKNTIAIFCETRAEWMIAAQTCFKYNFPLVTLYATLGKEAVVHGLNESEASYLITSVELLESKLKTALLDISCVKHIIYVDNKAINKAEYPEGFEIHSMQSVEELGSNPENLGIPPSRPTPSDMAIVMYTSGSTGRPKGVMMHHSNLIAGMTGQCERIPGLGPKDTYIGYLPLAHVLELTAEISCFTYGCRIGYSSPLTLSDQSSKIKKGSKGDCTVLKPTLMAAVPEIMDRIYKNVMSKVQEMNYIQKTLFKIGYDYKLEQIKKGYDAPLCNLLLFKKVKALLGGNVRMMLSGGAPLSPQTHRFMNVCFCCPIGQGYGLTESCGAGTVTEVTDYTTGRVGAPLICCEIKLKDWQEGGYTINDKPNPRGEIVIGGQNISMGYFKNEEKTAEDYSVDENGQRWFCTGDIGEFHPDGCLQIIDRKKDLVKLQAGEYVSLGKVEAALKNCPLIDNICAFAKSDQSYVISFVVPNQKRLTLLAQQKGVEGTWVDICNNPAMEAEILKEIREAANAMKLERFEIPIKVRLSPEPWTPETGLVTDAFKLKRKELRNHYLKDIERMYGGK

SEQ ID NO: 912471 - protein, 711 aa, Homo sapiens; identical to SEQ ID NO: 912470

SEQ ID NO: 912472 - protein, 628 aa, Homo sapiens
EFPPGPAPRPAQPRAPRVLPGLRPSPCAARPTRDRPPDRASRPPGRPACMLRSGPASGPSVPTGRAMPSRRVARPPAAPELGALGSPDLSSLSLAVSRSTDELEIIDEYIKENGFGLDGGQPGPGEGLPRLVSRGAASLSTVTLGPVAPPATPPPWGCPLGRLVSPAPGPGPQPHLVITEQPKQRGMRFRYECEGRSAGSILGESSTEASKTLPAIELRDCGGLREVEVTACLVWKDWPHRVHPHSLVGKDCTDGICRVRLRPHVSPRHSFNNLGIQCVRKKEIEAAIERKIQLGIDPYNAGSLKNHQEVDMNVVRICFQASYRDQQGQMRRMDPVLSEPVYDKKSTNTSELRICRINKESGPCTGGEELYLLCDKVQKEDISVVFSRASWEGRADFSQADVHRQIAIVFKTPPYEDLEIVEPVTVNVFLQRLTDGVCSEPLPFTYLPRDHDSYGVDKKRKRGMPDVLGELNSSDPHGIESKRRKKKPAILDHFLPNHGSGPFLPPSALLPDPDFFSGTVSLPGLEPPGGPDLLDDGFAYDPTAPTLFTMLDLLPPAPPHASAVVCSGGAGAVVGETPGPEPLTLDSYQAPGPGDGGTASLVGSNMFPNHYREAAFGGGLLSPGPEAT

SEQ ID NO: 912473 - protein, 628 aa, Homo sapiens; identical to SEQ ID NO: 912472

SEQ ID NO: 912474 - protein, 332 aa, Homo sapiens
EFPPGPAPRPAQPRAPRVLPGLRPSPCAARPTRDRPPDRASRPPGRPACMLRSGPASGPSVPTGRAMPSRRVARPPAAPELGALGSPDLSSLSLAVSRSTDELEIIDEYIKENGFGLDGGQPGPGEGLPRLVSRGAASLSTVTLGPVAPPATPPPWGCPLGRLVSPAPGPGPQPHLVITEQPKQRGMRFRYECEGRSAGSILGESSTEASKTLPAIELRDCGGLREVEVTACLVWKDWPHRVHPHSLVGKDCTDGICRVRLRPHVSPRHSEQLGISVEEQGDRGALREIKGHDPQVGRRHQSRHTGQIARQTDEGNPRTGRARKPGHGEEKK

SEQ ID NO: 912475 - protein, 332 aa, Homo sapiens
KILKRGNISLDFEGRLGKLGAQWSRCPGLADVPRFLPEDISVVFSRASWEGRADFSQADVHRQIAIVFKTPPYEDLEIVEPVTVNVFLQRLTDGVCSEPLPFTYLPRDHDSYGVDKKRKRGMPDVLGELNSSGVCPLPLSTPIPRFWGGDSCPHCPVPPQAGEEGLSGNRGPHLCLPSDPHGIESKRRKKKPAILDHFLPNHGSGPFLPPSALLPDPDFFSGTVSLPGLEPPGGPDLLDDGFAYDPTAPTLFTMLDLLPPAPPHASAVVCSGGAGAVVGETPGPEPLTLDSYQAPGPGDGGTASLVGSNMFPNHYREAAFGGGLLSPGPEAT

SEQ ID NO: 912476 - protein, 318 aa, Homo sapiens
MPKRGKKGAVAEDGDELRTEPEAKKSKTAAKKNDKEAAGEGPALYEDPPDQKTSPSGKPATLKICSWNVDGLRAWIKKKGLDWVKEEAPDILCLQETKCSENKLPAELQELPGLSHQYWSAPSDKEGYSGVGLLSRQCPLKVSYGIGDEEHDQEGRVIVAEFDSFVLVTAYVPNAGRGLVRLEYRQRWDEAFRKFLKGLASRKPLVLCGDLNVAHEEIDLRNPKGNKKNAGFTPQERQGFGELLQAVPLADSFRHLYPNTPYAYTFWTYMMNARSKNVGWRLDYFLLSHSLLPALCDSKIRSKALGSDHCPITLYLAL

SEQ ID NO: 912477 - protein, 318 aa, Homo sapiens; identical to SEQ ID NO: 912476

SEQ ID NO: 912478 - protein, 318 aa, Homo sapiens; identical to SEQ ID NO: 912476

SEQ ID NO: 912479 - protein, 318 aa, Homo sapiens; identical to SEQ ID NO: 912476

SEQ ID NO: 912480 - protein, 249 aa, Homo sapiens
MPKRGKKGAVAEDGDELRTEPEAKKSKTAAKKNDKEAAGEGPALYEDPPDQKTSPSGKPATLKICSWNVDGLRAWIKKKGLDWVKEEAPDILCLQETKCSENKLPAELQELPGLSHQYWSAPSDKEGYSGVGLLSRQCPLKVSYGIGDEEHDQEGRVIVAEFDSFVLVTAYVPNAGRGLVRLEYRQRWDEAFRKFLKGLASRKPLVLCGDLNVAHEEIDLRNPKGNKKNAGFTPQERQGFGELLQAVLI

SEQ ID NO: 912481 - protein, 345 aa, Homo sapiens
MPKRGKKGAVAEDGDELRTEPEAKKSKTAAKKNDKEAAGEGPALYEDPPDQKTSPSGKPATLKICSWNVDGLRAWIKKKGLDWVKEEAPDILCLQETKCSENKLPAELQELPGLSHQYWSAPSDKEGYSGVGLLSRQCPLKVSYGIGDEEHDQEGRVIVAEFDSFVLVTAYVPNAGRGLVRLEYRQRWDEAFRKFLKGLASRKPLVLCGDLNVAHEEIDLRNPKGNKKNAGFTPQERQGFGELLQAVPLADSFRHLYPNTPYAYTFWTYMMNARSKNVGWRLDYFLLSHSLLPALCDSKIRSKAELWLNYTYGTPKIDGKAKNFNLKKVFVKGPQGVEYRMGVKD

SEQ ID NO: 912482 - protein, 318 aa, Homo sapiens; identical to SEQ ID NO: 912476

SEQ ID NO: 912483 - protein, 353 aa, Homo sapiens
THVGAQRAPFFVRNAVKILLRWVTRYSCPRAFVTGMPKRGKKGAVAEDGDELRTEPEAKKSKTAAKKNDKEAAGEGPALYEDPPDQKTSPSGKPATLKICSWNVDGLRAWIKKKGLDWVKEEAPDILCLQETKCSENKLPAELQELPGLSHQYWSAPSDKEGYSGVGLLSRQCPLKVSYGIGDEEHDQEGRVIVAEFDSFVLVTAYVPNAGRGLVRLEYRQRWDEAFRKFLKGLASRKPLVLCGDLNVAHEEIDLRNPKGNKKNAGFTPQERQGFGELLQAVPLADSFRHLYPNTPYAYTFWTYMMNARSKNVGWRLDYFLLSHSLLPALCDSKIRSKALGSDHCPITLYLAL

SEQ ID NO: 912484 - protein, 318 aa, Homo sapiens; identical to SEQ ID NO: 912476

SEQ ID NO: 912485 - protein, 308 aa, Homo sapiens
MSVYITHFIEPEAKKSKTAAKKNDKEAAGEGPALYEDPPDQKTSPSGKPATLKICSWNVDGLRAWIKKKGLDWVKEEAPDILCLQETKCSENKLPAELQELPGLSHQYWSAPSDKEGYSGVGLLSRQCPLKVSYGIGDEEHDQEGRVIVAEFDSFVLVTAYVPNAGRGLVRLEYRQRWDEAFRKFLKGLASRKPLVLCGDLNVAHEEIDLRNPKGNKKNAGFTPQERQGFGELLQAVPLADSFRHLYPNTPYAYTFWTYMMNARSKNVGWRLDYFLLSHSLLPALCDSKIRSKALGSDHCPITLYLAL

SEQ ID NO: 912486 - protein, 300 aa, Homo sapiens
MPKRGKKGAVAEDGDELRTEPEAKKSKTAAKKNDKEAAGEGPALYEDPPDQDGLRAWIKKKGLDWVKEEAPDILCLQETKCSENKLPAELQELPGLSHQYWSAPSDKEGYSGVGLLSRQCPLKVSYGIGDEEHDQEGRVIVAEFDSFVLVTAYVPNAGRGLVRLEYRQRWDEAFRKFLKGLASRKPLVLCGDLNVAHEEIDLRNPKGNKKNAGFTPQERQGFGELLQAVPLADSFRHLYPNTPYAYTFWTYMMNARSKNVGWRLDYFLLSHSLLPALCDSKIRSKALGSDHCPITLYLAL

SEQ ID NO: 912487 - protein, 308 aa, Homo sapiens; identical to SEQ ID NO: 912485

SEQ ID NO: 912488 - protein, 301 aa, Homo sapiens [sequence omitted]

SEQ ID NO: 912489 - protein, 300 aa, Homo sapiens; identical to SEQ ID NO: 912486

SEQ ID NO: 912490 - protein, 300 aa, Homo sapiens; identical to SEQ ID NO: 912486

SEQ ID NO: 912491 - protein, 249 aa, Homo sapiens
MPKRGKKGAVAEDGDELRTEPEAKKSKTAAKKNDKEAAGEGPALYEDPPDQKTSPSGKPATLKICSWNVDGLRAWIKKKGLDWVKEEAPDILCLQETKCSENKLPAELQELPGLSHQYWSAPSDKEGYSGVGLLSRQCPLKVSYGIGDEEHDQEGRVIVAEFDSFVLVTAYVPNAGRGLVRLEYRQRWLVKLWKSEGWFQSLAGGLWAGMSPRDRVVRQRVGFGAGLAPPCWVVRGLPRGPVLPFRSLS

SEQ ID NO: 912492 - protein, 318 aa, Homo sapiens; identical to SEQ ID NO: 912476

SEQ ID NO: 912493 - protein, 318 aa, Homo sapiens; identical to SEQ ID NO: 912476

SEQ ID NO: 912494 - protein, 249 aa, Homo sapiens
MPKRGKKGAVAEDGDELRTEPEAKKSKTAAKKNDKEAAGEGPALYEDPPDQKTSPSGKPATLKICSWNVDGLRAWIKKKGLDWVKEEAPDILCLQETKCSENKLPAELQELPGLSHQYWSAPSDKEGYSGVGLLSRQCPLKVSYGIGDEEHDQEGRVIVAEFDSFVLVTAYVPNAGRGLVRLEYRQRWDEAFRKFLKGLASRKPLVLCGDLNVAHEEIDLRNPKGNSHWLTALGTSTPTHPMPTPFGLI

SEQ ID NO: 912495 - protein, 318 aa, Homo sapiens; identical to SEQ ID NO: 912476

SEQ ID NO: 912496 - protein, 294 aa, Homo sapiens
MPKRGKKGAVAEDGDELRTEPEAKKSKTAAKKNDKEAAGEGPALYEDPPDQKTSPSGKPATLKICSWNVDGLRAWIKKKGLDWVKEEAPDILCLQETKCSENKLPAELQELPGLSHQYWSAPSDKEGYSGVGLLSRQCPLKVSYGIDVPNAGRGLVRLEYRQRWDEAFRKFLKGLASRKPLVLCGDLNVAHEEIDLRNPKGNKKNAGFTPQERQGFGELLQAVPLADSFRHLYPNTPYAYTFWTYMMNARSKNVGWRLDYFLLSHSLLPALCDSKIRSKALGSDHCPITLYLAL

SEQ ID NO: 912497 - protein, 318 aa, Homo sapiens; identical to SEQ ID NO: 912476

SEQ ID NO: 912498 - protein, 262 aa, Homo sapiens
MPKRGKKGAVAEDGDELRTEPEAKKSKTAAKKNDKEAAGEGPALYEDPPDQKTSPSGKPATLKICSWNVDGLRAWIKKKGLDWVKEEAPDILCLQETKCSENKLPAELQELPGLSHQYWSAPSDKEGYSGVGLLSRQCPLKVSYGIGDEEHDQEGRVIVAEFDSFVLVTAYVPNAGRGLVRLEYRQRWDEAFRKFLKGLASRKPLVLCGDLNVAHEEIDLRNPKGNKKNAGFTPRGQVGILRLCRVQLALPNLLLGFFAPQC

SEQ ID NO: 912499 - protein, 308 aa, Homo sapiens; identical to SEQ ID NO: 912485

SEQ ID NO: 912500 - protein, 308 aa, Homo sapiens; identical to SEQ ID NO: 912485

SEQ ID NO: 912501 - protein, 324 aa, Homo sapiens
ATHPDPPLKNLQKESAPPMTPGRRAEPEAKKSKTAAKKNDKEAAGEGPALYEDPPDQKTSPSGKPATLKICSWNVDGLRAWIKKKGLDWVKEEAPDILCLQETKCSENKLPAELQELPGLSHQYWSAPSDKEGYSGVGLLSRQCPLKVSYGIGDEEHDQEGRVIVAEFDSFVLVTAYVPNAGRGLVRLEYRQRWDEAFRKFLKGLASRKPLVLCGDLNVAHEEIDLRNPKGNKKNAGFTPQERQGFGELLQAVPLADSFRHLYPNTPYAYTFWTYMMNARSKNVGWRLDYFLLSHSLLPALCDSKIRSKALGSDHCPITLYLAL

SEQ ID NO: 912502 - protein, 299 aa, Homo sapiens
MHKHKNHPVLDLKIEGNPFNLFWLRYEDPPDQKTSPSGKPATLKICSWNVDGLRAWIKKKGLDWVKEEAPDILCLQETKCSENKLPAELQELPGLSHQYWSAPSDKEGYSGVGLLSRQCPLKVSYGIGDEEHDQEGRVIVAEFDSFVLVTAYVPNAGRGLVRLEYRQRWDEAFRKFLKGLASRKPLVLCGDLNVAHEEIDLRNPKGNKKNAGFTPQERQGFGELLQAVPLADSFRHLYPNTPYAYTFWTYMMNARSKNVGWRLDYFLLSHSLLPALCDSKIRSKALGSDHCPITLYLAL

SEQ ID NO: 912503 - protein, 229 aa, Homo sapiens
MPKRGKKGAVAEDGDELRTEPEAKKSKTAAKKNDKEAAGEGPALYEDPPDQKTSPSGKPATLKICSWNVDGLRAWIKKKGLDWVKEEAPDILCLQETKCSENKLPAELQELPGLSHQYWSAPSDKEGYSGVGLLSRQCPLKVSYGIGDEEHDQEGRVIVAEFDSFVLVTAYVPNAGRGLVRLEYRQRWDEAFRKFLKGLASCVVETQVAELLRPGTMFPRPSEAARSAP

SEQ ID NO: 912504 - protein, 85 aa, Homo sapiens
MLILFISIGDEEHDQEGRVIVAEFDSFVLVTAYVPNAGRGLVRLEYRQRWDEAFRKFLKGLASRKPLVLCGDLNVAHEEIDLRNP

SEQ ID NO: 912505 - protein, 139 aa, Homo sapiens
MGGGERYNIPAPQSRNVSKNQQQLNRQKTKEQNSQMKIVHKKKERGHGYNSSAAAWQAMQNGGKNKNFPNNQSWNSSLSGPRLLFKSQANQNYAGAKFSEPPSPSVLPKPPSHWVPVSFNPSDKEIMTFQLKTLLKVQV

SEQ ID NO: 912506 - protein, 139 aa, Homo sapiens; identical to SEQ ID NO: 912505

SEQ ID NO: 912507 - protein, 121 aa, Homo sapiens
MGGGERYNIPAPQSRNVSKNQQQLNRQKTKEQNSQMKIVHKKKERGHGYNSSAAAWQAMQNGGKNIFKSQANQNYAGAKFSEPPSPSVLPKPPSHWVPVSFNPSDKEIMTFQLKTLLKVQV

SEQ ID NO: 912508 - protein, 134 aa, Homo sapiens
MYNIPAPQSRNVSKNQQQLNRQKTKEQNSQMKIVHKKKERGHGYNSSAAAWQAMQNGGKNKNFPNNQSWNSSLSGPRLLFKSQANQNYAGAKFSEPPSPSVLPKPPSHWVPVSFNPSDKEIMTFQLKTLLKVQV

SEQ ID NO: 912509 - protein, 139 aa, Homo sapiens; identical to SEQ ID NO: 912505

SEQ ID NO: 912510 - protein, 139 aa, Homo sapiens; identical to SEQ ID NO: 912505

SEQ ID NO: 912511 - protein, 139 aa, Homo sapiens; identical to SEQ ID NO: 912505

SEQ ID NO: 912512 - protein, 139 aa, Homo sapiens; identical to SEQ ID NO: 912505

SEQ ID NO: 912513 - protein, 139 aa, Homo sapiens; identical to SEQ ID NO: 912505

SEQ ID NO: 912514 - protein, 139 aa, Homo sapiens; identical to SEQ ID NO: 912505

SEQ ID NO: 912515 - protein, 139 aa, Homo sapiens; identical to SEQ ID NO: 912505

SEQ ID NO: 912516 - protein, 81 aa, Homo sapiens
GVTSGQGSHLAVRQQVSDPQAQPCDCCPLQPCIRLLAETWGWNRTEPRALCSCDFRPTFSTEVLYWQLLEKILQLLLLILD

SEQ ID NO: 912517 - protein, 269 aa, Homo sapiens
MLSSTAMYSAPGRDLGMEPHRAAGPLQLRFSPYVFNGGTILAIAGEDFAIVASDTRLSEGFSIHTRDSPKCYKLTDKTVIGCSGFHGDCLTLTKIIEARLKMYKHSNNKAMTTGAIAAMLSTILYSRRFFPYYVYNIIGGLDEEGKGAVYSFDPVGSYQRDSFKAGGSASAMLQPLLDNQVGFKNMQNVEHVPLSLDRAMRLVKDVFISAAERDVYTGGRTPDLHSDQRGHQGGNCFLKEGLICVLLSPISSDLVDFVLWNCTLDGFVY

SEQ ID NO: 912518 - protein, 106 aa, Homo sapiens
KIFHCVVITKLEKGFHFTRDTPNVSIYHQPALDTQVFIELSLAVQSFFSASLKLYNLSIIRPFSRGPFLPFRSPSWIPSASFQTMFPTSSVDFIKKERGLYTALIQ

SEQ ID NO: 912519 - protein, 269 aa, Homo sapiens; identical to SEQ ID NO: 912517

SEQ ID NO: 912520 - protein, 71 aa, Homo sapiens
WRNVRSRQPSRRETASVGSAGAAVRMLSSTAMYSAPGRDLGMEPHRAAGPLQLRFSPYVFNGGLALLKFTW

SEQ ID NO: 912521 - protein, 81 aa, Homo sapiens; identical to SEQ ID NO: 912516

SEQ ID NO: 912522 - protein, 114 aa, Homo sapiens
WRNVRSRQPSRRETASVGSAGAAVRMLSSTAMYSAPGRDLGMEPHRAAGPLQLRFSPYVFNGGTILAIAGEDFAIVASDTRLSEGFSIHTRDSPKCYKFFINNCRCISIPIIRP

SEQ ID NO: 912523 - protein, 228 aa, Homo sapiens
WRNVRSRQPSRRETASVGSAGAAVRMLSSTAMYSAPGRDLGMEPHRAAGPLQLRFSPYVFNGGTILAIAGEDFAIVASDTRLSEGFSIHTRDSPKCYKLTDKTVIGCSGFHGDCLTLTKIIEARLKMYKHSNNKAMTTGAIAAMLSTILYSRRFFPYYVYNIIGGLDEEGKGAVYSFDPVGSYQRDSFKAGGSASAMLQPLLDNQDTATRPSPNAVAWILDSLASVMI

SEQ ID NO: 912524 - protein, 269 aa, Homo sapiens; identical to SEQ ID NO: 912517

SEQ ID NO: 912525 - protein, 183 aa, Homo sapiens
ESGKQGQIWAGDRAQEGLCALAGLRGCAWPSTRSDSGHSQEGLLCTLTCWVVFPPRRSLALSPRLECSGAISAHCNIRLPGSNDYLFPASYVAGTTGSTTTLSKFFVFLVAMRFHHVGQAGLELLASGDPPASASQSVGITGVSHCVWPGLLFLFMKLTVAHPCDRNQVIYTDSVGNRFFCAQ

SEQ ID NO: 912526 - protein, 63 aa, Homo sapiens
PSRAPPPISAPLLVSGVPGVFVFLGAFMVGVSYSFLFVRGLYFPFQLIYYTGNCWRRFCNCCF

SEQ ID NO: 912527 - protein, 80 aa, Homo sapiens
GVTSGQGSHLAVRQQVSDPQAQPCDCCPLQPCIRLLAETWGWNRTEPRALCSCDFRPTFSTEEQTKQSLDAAVFMETVLR

SEQ ID NO: 912528 - protein, 231 aa, Homo sapiens
WRNVRSRQPSRRETASVGSAGAAVRMLSSTAMYSAPGRDLGMEPHRAAGPLQLRFSPYVFNGGTILAIAGEDFAIVASDTRLSEGFSIHTRDSPKCYKLTDKTVIGCSGFHGDCLTLTKIIEARLKMYKHSNNKAMTTGAIAAMLSTILYSRRFFPYYVYNIIGGLDEEGKGAVYSFDPVGSYQRDSFKAGGSASAMLQPLLDNQVGFKNMQNVEHVPLSLDRAMRLSGSA

SEQ ID NO: 912529 - protein, 129 aa, Homo sapiens
APVGALEGTFPVPEADRVLHPWSELRARGERGSQSSGVPSRAPSLRPTAFQPPWKWGEHGRGAWRGSPLEAPEWRPQCCSDLVPLGCALRPRQAPSGSWAAGKGFGPVRSWVRPVPDRPCPHPITGPWT

SEQ ID NO: 912530 - protein, 771 aa, Homo sapiens
MERAESSSTEPAKAIKPIDRKSVHQICSGQVVLSLSTAVKELVENSLDAGATNIDLKLKDYGVDLIEVSDNGCGVEEENFEGLTLKHHTSKIQEFADLTQVETFGFRGEALSSLCALSDVTISTCHASAKVGTRLMFDHNGKIIQKTPYPRPRGTTVSVQQLFSTLPVRHKEFQRNIKKEYAKMVQVLHAYCIISAGIRVSCTNQLGQGKRQPVVCTGGSPSIKENIGSVFGQKQLQSLIPFVQLPPSDSVCEEYGLSCSDALHNLFYISGFISQCTHGVGRSSTDRQFFFINRRPCDPAKVCRLVNEVYHMYNRHQYPFVVLNISVDSECVDINVTPDKRQILLQEEKLLLAVLKTSLIGMFDSDVNKLNVSQQPLLDVEGNLIKMHAADLEKPMVEKQDQSPSLRTGEEKKDVSISRLREAFSLRHTTENKPHSPKTPEPRRSPLGQKRGMLSSSTSGAISDKGVLRPQKEAVSSSHGPSDPTDRAEVEKDSGHGSTSVDSEGFSIPDTGSHCSSEYAASSPGDRGSQEHVDSQEKAPETDDSFSDVDCHSNQEDTGCKFRVLPQPTNLATPNTKRFKKEEILSSSDICQKLVNTQDMSASQVDVAVKINKKVVPLDFSMSSLAKRIKQLHHEAQQSEGEQNYRKFRAKICPGENQAAEDELRKEISKTMFAEMEIIGQFNLGFIITKLNEDIFIVDQHATDEKYNFEMLQQHTVLQGQRLIAPQTLNLTAVNEAVLIENLEIFRKNGFDFVIDENVKTGPSDPRTSMN

SEQ ID NO: 912531 - protein, 749 aa, Homo sapiens
SACGSPGGNFPSPRGGSGVASMERAESSSTEPAKAIKPIDRKSVHQICSGQVVLSLSTAVKELVENSLDAGATNIDLKLKDYGVDLIEVSDNGCGVEEENFEGLTLKHHTSKIQEFADLTQVETFGFRGEALSSLCALSDVTISTCHASAKVGTRLMFDHNGKIIQKTPYPRPRGTTVSVQQLFSTLPVRHKEFQRNIKKEYAKMVQVLHAYCIISAGIRVSCTNQLGQGKRQPVVCTGGSPSIKENIGSVFGQKQLQSLIPFVQLPPSDSVCEEYGLSCSDALHNLFYISGFISQCTHGVGRSSTDRQFFFINRRPCDPAKVCRLVNEVYHMYNRHQYPFVVLNISVDSECVDINVTPDKRQILLQEEKLLLAVLKTSLIGMFDSDVNKLNVSQQPLLDVEGNLIKMHAADLEKPMVEKQDQSPSLRTGEEKKDVSISRLREAFSLRHTTENKPHSPKTPEPRRSPLGQKRGMLSSSTSGAISDKGVLRPQKEAVSSSHGPSDPTDRAEVEKDSGHGSTSVDSEGFSIPDTGSHCSSEYAASSPGDRGSQEHVDSQEKAPETDDSFSDVDCHSNQEDTGCKFRVLPQPTNLATPNTKRFKKEEILSSSDICQKLVNTQDMSASQVDVAVKINKKVVPLDFSMSSLAKRIKQLHHEAQQSEGEQNYRKFRAKICPGENQAAEDELRKEISKTMFAEMEIIGQFNLGFIITKLNEDIFIVDQHATDEKYNFEMLQQHTVLQGQRLIASSH

SEQ ID NO: 912532 - protein, 707 aa, Homo sapiens
SACGSPGGNFPSPRGGSGVASMERAESSSTEPAKAIKPIDRKSVHQICSGQVVLSLSTAVKELVENSLDAGATNIDLKLKDYGVDLIEVSDNGCGVEEENFEGLTLKHHTSKIQEFADLTQVETFGFRGEALSSLCALSDVTISTCHASAKVGTRLMFDHNGKIIQKTPYPRPRGTTVSVQQLFSTLPVRHKEFQRNIKKEYAKMVQVLHAYCIISAGIRVSCTNQLGQGKRQPVVCTGGSPSIKENIGSVFGQKQLQSLIPFVQLPPSDSVCEEYGLSCSDALHNLFYISGFISQCTHGVGRSSTDRQFFFINRRPCDPAKVCRLVNEVYHMYNRHQYPFVVLNISVDSECVDINVTPDKRQILLQEEKLLLAVLKTSLIGMFDSDVNKLNVSQQPLLDVEGNLIKMHAADLEKPMVEKQDQSPSLRTGEEKKDVSISRLREAFSLRHTTENKPHSPKTPEPRRSPLGQKRGMLSSSTSGAISDKGVLRPQKEAVSSSHGPSDPTDRAEVEKDSGHGSTSVDSEGFSIPDTGSHCSSEYAASSPGDRGSQEHVDSQEKAPETDDSFSDVDCHSNQEDTGCKFRVLPQPTNLATPNTKRFKKEEILSSSDICQKLVNTQDMSASQVDVAVKINKKVVPLDFSMSSLAKRIKQLHHEAQQSEGEQNYRKFRAKICPGENQAAEDELRKEISKTMFAKWKSLPYRGYRA

SEQ ID NO: 912533 - protein, 476 aa, Homo sapiens
MHAADLEKPMVEKQDQSPSLRTGEEKKDVSISRLREAFSLRHTTENKPHSPKTPEPRRSPLGQKRGMLSSSTSGAISDKGVLRPQKEAVSSSHGPSDPTDRAEVEKDSGHGSTSVDSEGFSIPDTGSHCSSEYAASSPGDRGSQEHVDSQEKAPETDDSFSDVDCHSNQEDTGCKFRVLPQPTNLATPNTKRFKKEEILSSSDICQKLVNTQDMSASQVDVAVKINKKVVPLDFSMSSLAKRIKQLHHEAQQSEGEQNYRKFRAKICPGENQAAEDELRKEISKTMFAEMEIIGQFNLGFIITKLNEDIFIVDQHATDEKYNFEMLQQHTVLQGQRLIAPQTLNLTAVNEAVLIENLEIFRKNGFDFVIDENAPVTERAKLISLPTSKNWTFGPQDVDELIFMLSDSPGVMCRPSRVKQMFASRACRKSVMIGTALNTSEMKKLITHMGEMDHPWNCPHGRPTMRHIANLGVISQN

SEQ ID NO: 912534 - protein, 883 aa, Homo sapiens
SACGSPGGNFPSPRGGSGVASMERAESSSTEPAKAIKPIDRKSVHQICSGQVVLSLSTAVKELVENSLDAGATNIDLKLKDYGVDLIEVSDNGCGVEEENFEGLTLKHHTSKIQEFADLTQVETFGFRGEALSSLCALSDVTISTCHASAKVGTRLMFDHNGKIIQKTPYPRPRGTTVSVQQLFSTLPVRHKEFQRNIKKEYAKMVQVLHAYCIISAGIRVSCTNQLGQGKRQPVVCTGGSPSIKENIGSVFGQKQLQSLIPFVQLPPSDSVCEEYGLSCSDALHNLFYISGFISQCTHGVGRSSTDRQFFFINRRPCDPAKVCRLVNEVYHMYNRHQYPFVVLNISVDSECVDINVTPDKRQILLQEEKLLLAVLKTSLIGMFDSDVNKLNVSQQPLLDVEGNLIKMHAADLEKPMVEKQDQSPSLRTGEEKKDVSISRLREAFSLRHTTENKPHSPKTPEPRRSPLGQKRGMLSSSTSGAISDKGVLRPQKEAVSSSHGPSDPTDRAEVEKDSGHGSTSVDSEGFSIPDTGSHCSSEYAASSPGDRGSQEHVDSQEKAPETDDSFSDVDCHSNQEDTGCKFRVLPQPTNLATPNTKRFKKEEILSSSDICQKLVNTQDMSASQVDVAVKINKKVVPLDFSMSSLAKRIKQLHHEAQQSEGEQNYRKFRAKICPGENQAAEDELRKEISKTMFAEMEIIGQFNLGFIITKLNEDIFIVDQHATDEKYNFEMLQQHTVLQGQRLIAPQTLNLTAVNEAVLIENLEIFRKNGFDFVIDENAPVTERAKLISLPTSKNWTFGPQDVDELIFMLSDSPGVMCRPSRVKQMFASRACRKSVMIGTALNTSEMKKLITHMGEMDHPWNCPHGRPTMRHIANLGVISQN

SEQ ID NO: 912535 - protein, 873 aa, Homo sapiens
MERAESSSTEPAKAIKPIDRKSVHQICSGQVVLSLSTAVKELVENSLDAGATNIDLKLKDYGVDLIEVSDNGCGVEEENFEGLTLKHHTSKIQEFADLTQVETFGFRGEALSSLCALSDVTISTCHASAKVGTRLMFDHNGKIIQKTPYPRPRGTTVSVQQLFSTLPVRHKEFQRNIKKEYAKMVQVLHAYCIISAGIRVSCTNQLGQGKRQPVVCTGGSPSIKENIGSVFGQKQLQSLIPFVQLPPSDSVCEEYGLSCSDALHNLFYISGFISQCTHGVGRSSTDRQFFFINRRPCDPAKVCRLVNEVYHMYNRHQYPFVVLNISVDSECVDINVTPDKRQILLQEEKLLLAVLKTSLIGMFDSDVNKLNVSQQPLLDVEGNLIKMHAADLEKPMVEKQDQSPSLRTGEEKKDVSISRLREAFSLRHTTENKPHSPKTPEPRRSPLGQKRGMLSSSTSGAISDKGVLRPQKEAVSSSHGPSDPTDRAEVEKDSGHGSTSVDSEGFSIPDTGSHCSSEYAASSPGDRGSQEHVDSQEKAPETDDSFSDVDCHSNQEDTGCKFRVLPQPTNLATPNTKRFKKEEILSSSDICQKLVNTQDMSASQVDVAVKINKKVVPLDFSMSSLAKRIKQLHHEAQQSEGEQNYRKFRAKICPGENQAAEDELRKEISKTMFAEMEIIGQFNLGFIITKLNEDIFIVDQHATDEKYNFEMLQQHTVLQGQRLIAPQTLNLTAVNEAVLIENLEIFRKNGFDFVIDENVMDFSQNCILLAPVTERAKLISLPTSKNWTFGPQDVDELIFMLSDSPGVMCRPSRVKQMFASRACRKSVMIGTALNTSEMKKLITHMGEMDHPWNCPHGRPTMRHIANLGVISQN

SEQ ID NO: 912536 - protein, 569 aa, Homo sapiens
FYSLYFVQVCRLVNEVYHMYNRHQYPFVVLNISVDSECVDINVTPDKRQILLQEEKLLLAVLKTSLIGMFDSDVNKLNVSQQPLLDVEGNLIKMHAADLEKPMVEKQDQSPSLRTGEEKKDVSISRLREAFSLRHTTENKPHSPKTPEPRRSPLGQKRGMLSSSTSGAISDKGVLRPQKEAVSSSHGPSDPTDRAEVEKDSGHGSTSVDSEGFSIPDTGSHCSSEYAASSPGDRGSQEHVDSQEKAPETDDSFSDVDCHSNQEDTGCKFRVLPQPTNLATPNTKRFKKEEILSSSDICQKLVNTQDMSASQVDVAVKINKKVVPLDFSMSSLAKRIKQLHHEAQQSEGEQNYRKFRAKICPGENQAAEDELRKEISKTMFAEMEIIGQFNLGFIITKLNEDIFIVDQHATDEKYNFEMLQQHTVLQGQRLIAPQTLNLTAVNEAVLIENLEIFRKNGFDFVIDENAPVTERAKLISLPTSKNWTFGPQDVDELIFMLSDSPGVMCRPSRVKQMFASRACRKSVMIGTALNTSEMKKLITHMGEMDHPWNCPHGRPTMRHIANLGVISQN

SEQ ID NO: 912537 - protein, 83 aa, Homo sapiens
ALLSLLCIRKNCVPSHSGIAGLSRSSRLAMTDFDGVCSLRHSCMHRELYFLIRAITGCRVVKTGDQVGGIQGGAESWGWGQTR

SEQ ID NO: 912538 - protein, 381 aa, Homo sapiens
SDIIMLGQSPDALVGGLTDSAPGGRKTRERKLEANMESVSCSAAAVRTGDMESQRDLSLVPERLQRREQERQLEVERRKQKRQNQEVEKENSHFFVATFARERAAVEELLERAESVERLEEAASRLQGLQKLINDSVFFLAAYDLRQGQEALARLQAALAERRRGLQPKKRFAFKTRGKDAASSTKVDAAPGIPPAVESIQDSPLPKKAEGDLGPSWVCGFSNLESQVLEKRASELHQRDVLLTELSNCTVRLYGNPNTLRLTKAHSCKLLCGPVSTSVFLEDCSDCVLAVACQQLRIHSTKDTRIFLQVTSRAIVEDCSGIQFAPYTWSYPEIDKDFESSGLDRSKNNWNDVDDFNWLARDMASPNWSILPEEERNIQWD

SEQ ID NO: 912539 - protein, 74 aa, Homo sapiens
RAEAQAPDLQCSLPRRPLPCPQCGKSFIHPKRLQTHEAQGDEGPAARATTRTCIFSRDGVSPCCPGCSRTPDLR

SEQ ID NO: 912540 - protein, 381 aa, Homo sapiens; identical to SEQ ID NO: 912538

SEQ ID NO: 912541 - protein, 334 aa, Homo sapiens
SDIIMLGQSPDALVGGLTDSAPGGRKTRERKLEANMESVSCSAAAVRTGDMESQRDLSLVPERLQRREQERQLEVERRKQKRQNQEVEKENSHFFVATFARERAAVEELLERAESVERLEEAASRLQGLQKLINDSVFFLAAYDLRQGQEALARLQAALAERRRGLQPKKRFAFKTRGKDAASSTKVDAAPGIPPAVESIQDSPLPKKAEGDLGPSWVCGFSNLESQVLEKRASELHQRDVLLTELSNCTVRLYGNPNTLRLTKAHSCKLLCGPVSTSVFLEDCSDCVLAVACQQLRIHSTKEPASASQSAGITGVSHHARALFIYFYHNSLKQ

SEQ ID NO: 912542 - protein, 381 aa, Homo sapiens; identical to SEQ ID NO: 912538

SEQ ID NO: 912543 - protein, 146 aa, Homo sapiens [sequence omitted]

SEQ ID NO: 912544 - protein, 456 aa, Homo sapiens
MYMGKYICERKVSSGGILGTAMCKFLNMMDTPSFHLKEVGPIDIPHTFTQAVPLNLVICQCEKWKIVFNCSLDLYFYWVVYLLINNKSSLHIKEINPFQIHSYFSLIFKFYCNILLFSLYIYVYIYICIYIYIHIYIHIYILIFFYGFLDFVSSLKRLIQLKILLLLLNPMFSPNSFYFYFGGLYLDLIFSITSDRVQLACCPYTIFWLIQLLTIDLSIHVPVPNGFTECNLHFKISEGKPYLIILLFQNSPGYSRLHVYLNLPCDVFMPLSSYARIRYVFSIHSRLFNLTLHYTEKLVLVCLPRHLVVLTAPKPTPPHLTDYPITEYFYLRFALPNGYLILSRRQCPVQWSLQLKCSRTHCLVKNASKFIQTQLAPKVTFRERRAGMGCFPSFCHCVASSSHWEVLCTRNVGVESCSSVQHLTLCPTPQQPIPAVHSLLELFTKYVAMLDPGHWT

SEQ ID NO: 912545 - protein, 456 aa, Homo sapiens; identical to SEQ ID NO: 912544

SEQ ID NO: 912546 - protein, 643 aa, Homo sapiens
MTLAKFLKFMKQVSGWNEMGIKIVFKPIRWFVETEMNSIVQVLVSKGSCCFLSLYDGKYLDKFTNPLHCRLHGTEGLVTPAGAGLLLGASVVLKTFICLFVLVDVGSFCVARTGLKLLDSSDPPPLNLPKCWDYRCEPLCPALKTFSGSSRVTGLLNISISYKSVFQSYIILITFFICISVEYILYFDILLMHSFSLFIPSFSFLIRLSRNLFYWPFEKSSFRSSKQFCFHFIIYFYFCFINLFLRHALDFVVLLFFQRLALCVWFTYDHACLLLRMEEGRWRVAAQSRVWGSLALAPPCPQPAVATLVPQLLGRAVSVREATDAIRGRCKVSCGQREPSRHVGCPAKGNSGQLLPHSTEFVIFFFFLMVTPSTSPMARAWAGPQRHRHSADSLAFTLLLFSWGTGLRWQCTNHKLRAVVTVTKECSPPPPAQLKTALTRGGDLWALTRRVGEAGRTAFLSAKAGAKLPGYEGNGWSLKSCKLGLAGTGPTSRPGGHHEDSGRDPQGTMKAFHLYLRKDFIRRVWWLTPESSALWEAEAGGSRGQEFNTSLANMENPISTKTTKISQAWWRTPVVPATREAEAEESLEPGRWRLQSAKIAPLHSSLGDRVRLRLKKTKRLYLISYMFVVSVLMYNLTLVRMVI

SEQ ID NO: 912547 - protein, 456 aa, Homo sapiens; identical to SEQ ID NO: 912544

SEQ ID NO: 912548 - protein, 456 aa, Homo sapiens; identical to SEQ ID NO: 912544

SEQ ID NO: 912549 - protein, 456 aa, Homo sapiens; identical to SEQ ID NO: 912544

SEQ ID NO: 912550 - protein, 456 aa, Homo sapiens; identical to SEQ ID NO: 912544

SEQ ID NO: 912551 - protein, 456 aa, Homo sapiens; identical to SEQ ID NO: 912544

SEQ ID NO: 912552 - protein, 78 aa, Homo sapiens
TEDPVSTLTRGGDLWALTRRVGEAGRTAFLSAKAGAKLPGYEGNGWSLKSCKLGLAGTGPTSRPGGHHEDSGRDPQGT

SEQ ID NO: 912553 - protein, 623 aa, Homo sapiens
MPSDLAKKKAAKKKEAAKARQRPRKGHEENGDVVTEPQVAEKNEANGRETTEVDLLTKELEDFEMKKAAARAVTGVLASHPNSTDVHIINLSLTFHGQELLSDTKLELNSGRRYGLIGLNGIGKSMLLSAIGKREVPIPEHIDIYHLTREMPPSDKTPLHCVMEVDTERAMLEKEAERLAHEDAECEKLMELYERLEELDADKAEMRASRILHGLGFTPAMQRKKLKDFSGGWRMRVALARALFIRPFMLLLDEPTNHLDLDACVWLEEELKTFKRILVLVSHSQDFLNGVCTNIIHMHNKKLKYYTGNYDQYVKTRLELEENQMKRFHWEQDQIAHMKNYIARFGHGSAKLARQAQSKEKTLQKMMASGLTERVVSDKTLSFYFPPCGKIPPPVIMVQNVSFKYTKDGPCIYNNLEFGIDLDTRVALVGPNGAGKSTLLKLLTGELLPTDGMIRKHSHVKIGRYHQHLQEQLDLDLSPLEYMMKCYPEIKEKEEMRKIIGRYGLTGKQQVSPIRNLSDGQKCRVCLAWLAWQNPHMLFLDEPTNHLDIETIDALADAINEFEGGMMLVSHDFRLIQQVAQEIWVCEKQTITKWPGDILAYKEHLKSKLVDEEPQLTKRTHNV

SEQ ID NO: 912554 - protein, 701 aa, Homo sapiens
MPSDLAKKKAAKKKEAAKARQRPRKGHEENGDVVTEPQVAEKNEANGRETTEVDLLTKELEDFEMKKAAARAVTGVLASHPNSTDVHIINLSLTFHGQELLSDTKLELNSGRRYGLIGLNGIGKSMLLSAIGKREVPIPEHIDIYHLTREMPPSDKTPLHCVMEVDTERAMLEKEAERLAHEDAECEKLMELYERLEELDADKAEMRASRILHGLGFTPAMQRKKLKDFSGGWRMRVALARALFIRPFMLLLDEPTNHLDLDACVWLEEELKTFKRILVLVSHSQDFLNGVCTNIIHMHNKKLKYYTGNYDQYVKTRLELEENQMKRFHWEQDQIAHMKNYIARFGHGSAKLARQAQSKEKTLQKMMASGLTERVVSDKTLSFYFPPCGKIPPPVIMVQNVSFKYTKDGPCIYNNLEFGIDLDTRVALVGPNGAGKSTLLKLLTGELLPTDGMIRKHSHVKIGRYHQHLQEQLDLDLSPLEYMMKCYPEIKEKEEMRKIIGRYGLTGKQQVSPIRNLSDGQKCRVCLAWLAWQNPHMLFLDEPTNHLDIETIDALADAINEFEGGMMLVSHDFRLIQQVAQEIWVCEKQTITKWPGDILAYKEHLKSKLVDEEPQLTKRTHNVCTLDIGISAKAMSIMNSFVNDVFEQLACEAARLAQYSGRTTLTSREVQTAVRLLLPGELAKHAVSEGTKAVTKYTSSK

SEQ ID NO: 912555 - protein, 623 aa, Homo sapiens; identical to SEQ ID NO: 912553

SEQ ID NO: 912556 - protein, 623 aa, Homo sapiens; identical to SEQ ID NO: 912553

SEQ ID NO: 912557 - protein, 718 aa, Homo sapiens
MPSDLAKKKAAKKKEAAKARQRPRKGHEENGDVVTEPQVAEKNEANGRETTEVDLLTKELEDFEMKKAAARAVTGVLASHPNSTDVHIINLSLTFHGQELLSDTKLELNSGRRYGLIGLNGIGKSMLLSAIGKREVPIPEHIDIYHLTREMPPSDKTPLHCVMEVDTERAMLEKEAERLAHEDAECEKLMELYERLEELDADKAEMRASRILHGLGFTPAMQRKKLKDFSGGWRMRVALARALFIRPFMLLLDEPTNHLDLDACVWLEEELKTFKRILVLVSHSQDFLNGVCTNIIHMHNKKLKYYTGNYDQYVKTRLELEENQMKRFHWEQDQIAHMKNYIARFGHGSAKLARQAQSKEKTLQKMMASGLTERVVSDKTLSFYFPPCGKIPPPVIMVQNVSFKYTKDGPCIYNNLEFGIDLDTRVALVGPNGAGKSTLLKLLTGELLPTDGMIRKHSHVKIGRYHQHLQEQLDLDLSPLEYMMKCYPEIKEKEEMRKIIGRYGLTGKQQVSPIRNLSDGQKCRVCLAWLAWQNPHMLFLDEPTNHLDIETIDALADAINEFEGGMMLVSHDFRLIQQVAQEIWVCEKQTITKWPGDILAYKEHLKSKLDADKAEMRASRILHWTGFHTCHAAQEAKRLQDRTLGLHSCIAAILLPQPLPCPSTCLSCTLLPTAGQYLSVSCPPSSYICPCLDSAGRSLQPLAGYLTLSVMQSEAPAG

SEQ ID NO: 912558 - protein, 623 aa, Homo sapiens; identical to SEQ ID NO: 912553

SEQ ID NO: 912559 - protein, 326 aa, Homo sapiens
MHNKKLKYYTGNYDQYVKTRLELEENQMKRFHWEQDQIAHMKNYIARFGHGSAKLARQAQSKEKTLQKMMASGLTERVVSDKTLSFYFPPCGKIPPPVIMVQNVSFKYTKDGPCIYNNLEFGIDLDTRVALVGPNGAGKSTLLKLLTGELLPTDGMIRKHSHVKIGRYHQHLQEQLDLDLSPLEYMMKCYPEIKEKEEMRKIIGRYGLTGKQQVSPIRNLSDGQKCRVCLAWLAWQNPHMLFLDEPTNHLDIETIDALADAINEFEGGMMLVSHDFRLIQQVAQEIWVCEKQTITKWPGDILAYKEHLKSKLVDEEPQLTKRTHNV

SEQ ID NO: 912560 - protein, 193 aa, Homo sapiens
MPSDLAKKKAAKKKEAAKARQRPRKGHEENGDVVTEPQVAEKNEANGRETTEVDLLTKELEDFEMKKAAARAVTGVLASHVSPIRNLSDGQKCRVCLAWLAWQNPHMLFLDEPTNHLDIETIDALADAINEFEGGMMLVSHDFRLIQQVAQEIWVCEKQTITKWPGDILAYKEHLKSKLVDEEPQLTKRTHNV

SEQ ID NO: 912561 - protein, 623 aa, Homo sapiens; identical to SEQ ID NO: 912553

SEQ ID NO: 912562 - protein, 623 aa, Homo sapiens; identical to SEQ ID NO: 912553

SEQ ID NO: 912563 - protein, 623 aa, Homo sapiens; identical to SEQ ID NO: 912553

SEQ ID NO: 912564 - protein, 461 aa, Homo sapiens [sequence omitted]

SEQ ID NO: 912565 - protein, 273 aa, Homo sapiens [sequence omitted]

SEQ ID NO: 912566 - protein, 325 aa, Homo sapiens
MVIQKEKKSCGQVVEEWKEFVWNPRTHQFMGRTGTSWAFILLFYLVFYGFLTAMFTLTMWVMLQTVSDHTPKYQDRLATPGLMIRPKTENLDVIVNVSDTESWDQHVQKLNKFLERECGPGYVSVQDFGQGTGDLGSGHLAPESLPPTSLAYNDSIQAQKNDVCRPGRYYEQPDNGVLNYPKRACQFNRTQLGNCSGIGDSTHYGYSTGQPCVFIKMNRVINFYAGANQSMNVTCAGKRDEDAENLGNFVMFPANGNIDLMYFPYYGKKFHVNYTQPLVAVKFLNVTPNVEVNVECRINAANIATDDERDKFAGRVAFKLRINKT

SEQ ID NO: 912567 - protein, 290 aa, Homo sapiens
MVIQKEKKSCGQVVEEWKEFVWNPRTHQFMGRTGTSWAFILLFYLVFYGFLTAMFTLTMWVMLQTVSDHTPKYQDRLATPGLMIRPKTENLDVIVNVSDTESWDQHVQKLNKFLEPYNDSIQAQKNDVCRPGRYYEQPDNGVLNYPKRACQFNRTQLGNCSGIGDSTHYGYSTGQPCVFIKMNRVINFYAGANQSMNVTCAGKRDEDAENLGNFVMFPANGNIDLMYFPYYGKKFHVNYTQPLVAVKFLNVTPNVEVNVECRINAANIATDDERDKFAGRVAFKLRINKT

SEQ ID NO: 912568 - protein, 290 aa, Homo sapiens; identical to SEQ ID NO: 912567

SEQ ID NO: 912569 - protein, 1014 aa, Homo sapiens
RGPRRAGRAGGTAPRPEAAAAAAALVPAAASPVPSVITTPAAGNGRERGGGEKLPPTHRGSMTSATSPIILKWDPKSLEIRTLTVERLLEPLVTQVTTLVNTSNKGPSGKKKGRSKKAHVLAASVEQATQNFLEKGEQIAKESQDLKEELVAAVEDVRKQGETMRIASSEFADDPCSSVKRGTMVRAARALLSAVTRLLILADMADVMRLLSHLKIVEEALEAVKNATNEQDLANRFKEFGKKMVKLNYVAARRQQELKDPHCRDEMAAARGALKKNATMLYTASQAFLRHPDVAATRANRDYVFKQVQEAIAGISNAAQATSPTDEAKGHTGIGELAAALNEFDNKIILDPMTFSEARFRPSLEERLESIISGAALMADSSCTRDDRRERIVAECNAVRQALQDLLSEYMNNTGRKEKGDPLNIAIDKMTKKTRDLRRQLRKAVMDHISDSFLETNVPLLVLIEAAKSGNEKEVKEYAQVFREHANKLVEVANLACSISNNEEGVKLVRMAATQIDSLCPQVINAALTLAARPQSKVAQDNMDVFKDQWEKQVRVLTEAVDDITSVDDFLSVSENHILEDVNKCVIALQEGDVDTLDRTAGAIRGRAARVIHIINAEMENYEAGVYTEKVLEATKLLSETVMPRFAEQVEVAIEALSANVPQPFEENEFIDASRLVYDGVRDIRKAVLMIRTPEELEDDSDFEQEDYDVRSRTSVQTEDDQLIAGQSARAIMAQLPQEEKAKIAEQVEIFHQEKSKLDAEVAKWDDSGNDIIVLAKQMCMIMMEMTDFTRGKGPLKNTSDVINAAKKIAEAGSRMDKLARAVADQCPDSACKQDLLAYLQRIALYCHQLNICSKVKAEVQNLGGELIVSGTGVQSTFTTFYEVDCDVIDGGRASQLSTHLPTCAEGAPIGSGSSDSSMLDSATSLIQAAKNLMNAVVLTVKASYVASTKYQKVYGTAAVNSPVVSWKMKAPEKKPLVKREKPEEFQTRVRRGSQKKHISPVQALSEFKAMDSF

SEQ ID NO: 912570 - protein, 966 aa, Homo sapiens
RGPRRAGRAGGTAPRPEAAAAAAALVPAAASPVPSVITTPAAGNGRERGGGEKLPPTHRGSMTSATSPIILKWDPKSLEIRTLTVERLLEPLVTQVTTLVNTSNKGPSGKKKGRSKKAHVLAASVEQATQNFLEKGEQIAKESQDLKEELVAAVEDVRKQGETMRIASSEFADDPCSSVKRGTMVRAARALLSAVTRLLILADMADVMRLLSHLKIVEEALEAVKNATNEQDLANRFKEFGKKMVKLNYVAARRQQELKDPHCRDEMAAARGALKKNATMLYTASQAFLRHPDVAATRANRDYVFKQVQEAIAGISNAAQATSPTDEAKGHTGIGELAAALNEFDNKIILDPMTFSEARFRPSLEERLESIISGAALMADSSCTRDDRRERIVAECNAVRQALQDLLSEYMNNTGRKEKGDPLNIAIDKMTKKTRDLRRQLRKAVMDHISDSFLETNVPLLVLIEAAKSGNEKEVKEYAQVFREHANKLVEVANLACSISNNEEGVKLVRMAATQIDSLCPQVINAALTLAARPQSKVAQDNMDVFKDQWEKQVRVLTEAVDDITSVDDFLSVSENHILEDVNKCVIALQEGDVDTLDRTAGAIRGRAARVIHIINAEMENYEAGVYTEKVLEATKLLSETVMPRFAEQVEVAIEALSANVPQPFEENEFIDASRLVYDGVRDIRKAVLMIRTPEELEDDSDFEQEDYDVRSRTSVQTEDDQLIAGQSARAIMAQLPQEEKAKIAEQVEIFHQEKSKLDAEVAKWDDSGNDIIVLAKQMCMIMMEMTDFTRGKGPLKNTSDVINAAKKIAEAGSRMDKLARAVADQCPDSACKQDLLAYLQRIALYCHQLNICSKVKAEVQNLGGELIVSGLDSATSLIQAAKNLMNAVVLTVKASYVASTKYQKVYGTAAVNSPVVSWKMKAPEKKPLVKREKPEEFQTRVRRGSQKKHISPVQALSEFKAMDSF

SEQ ID NO: 912571 - protein, 537 aa, Homo sapiens
MTKKTRDLRRQLRKAVMDHISDSFLETNVPLLVLIEAAKSGNEKEVKEYAQVFREHANKLVEVANLACSISNNEEGVKLVRMAATQIDSLCPQVINAALTLAARPQSKVAQDNMDVFKDQWEKQVRVLTEAVDDITSVDDFLSVSENHILEDVNKCVIALQEGDVDTLDRTAGAIRGRAARVIHIINAEMENYEAGVYTEKVLEATKLLSETVMPRFAEQVEVAIEALSANVPQPFEENEFIDASRLVYDGVRDIRKAVLMIRTPEELEDDSDFEQEDYDVRSRTSVQTEDDQLIAGQSARAIMAQLPQEEKAKIAEQVEIFHQEKSKLDAEVAKWDDSGNDIIVLAKQMCMIMMEMTDFTRGKGPLKNTSDVINAAKKIAEAGSRMDKLARAVADQCPDSACKQDLLAYLQRIALYCHQLNICSKVKAEVQNLGGELIVSGLDSATSLIQAAKNLMNAVVLTVKASYVASTKYQKVYGTAAVNSPVVSWKMKAPEKKPLVKREKPEEFQTRVRRGSQKKHISPVQALSEFKAMDSF

SEQ ID NO: 912572 - protein, 905 aa, Homo sapiens
MTSATSPIILKWDPKSLEIRTLTVERLLEPLVTQVTTLVNTSNKGPSGKKKGRSKKAHVLAASVEQATQNFLEKGEQIAKESQDLKEELVAAVEDVRKQGETMRIASSEFADDPCSSVKRGTMVRAARALLSAVTRLLILADMADVMRLLSHLKIVEEALEAVKNATNEQDLANRFKEFGKKMVKLNYVAARRQQELKDPHCRDEMAAARGALKKNATMLYTASQAFLRHPDVAATRANRDYVFKQVQEAIAGISNAAQATSPTDEAKGHTGIGELAAALNEFDNKIILDPMTFSEARFRPSLEERLESIISGAALMADSSCTRDDRRERIVAECNAVRQALQDLLSEYMNNTGRKEKGDPLNIAIDKMTKKTRDLRRQLRKAVMDHISDSFLETNVPLLVLIEAAKSGNEKEVKEYAQVFREHANKLVEVANLACSISNNEEGVKLVRMAATQIDSLCPQVINAALTLAARPQSKVAQDNMDVFKDQWEKQVRVLTEAVDDITSVDDFLSVSENHILEDVNKCVIALQEGDVDTLDRTAGAIRGRAARVIHIINAEMENYEAGVYTEKVLEATKLLSETVMPRFAEQVEVAIEALSANVPQPFEENEFIDASRLVYDGVRDIRKAVLMIRTPEELEDDSDFEQEDYDVRSRTSVQTEDDQLIAGQSARAIMAQLPQEEKAKIAEQVEIFHQEKSKLDAEVAKWDDSGNDIIVLAKQMCMIMMEMTDFTRGKGPLKNTSDVINAAKKIAEAGSRMDKLARAVADQCPDSACKQDLLAYLQRIALYCHQLNICSKVKAEVQNLGGELIVSGLDSATSLIQAAKNLMNAVVLTVKASYVASTKYQKVYGTAAVNSPVVSWKMKAPEKKPLVKREKPEEFQTRVRRGSQKKHISPVQALSEFKAMDSF

SEQ ID NO: 912573 - protein, 216 aa, Homo sapiens
MAQLPQEEKAKIAEQVEIFHQEKSKLDAEVAKWDDSGNDIIVLAKQMCMIMMEMTDFTRGKGPLKNTSDVINAAKKIAEAGSRMDKLARAVADQCPDSACKQDLLAYLQRIALYCHQLNICSKVKAEVQNLGGELIVSGLDSATSLIQAAKNLMNAVVLTVKASYVASTKYQKVYGTAAVNSPVVSWKMKAPEKKPLVKRVSPVQALSEFKAMDSF

SEQ ID NO: 912574 - protein, 234 aa, Homo sapiens
MAQLPQEEKAKIAEQVEIFHQEKSKLDAEVAKWDDSGNDIIVLAKQMCMIMMEMTDFTRGKGPLKNTSDVINAAKKIAEAGSRMDKLARAVADQCPDSACKQDLLAYLQRIALYCHQLNICSKVKAEVQNLGGELIVSGLDSATSLIQAAKNLMNAVVLTVKASYVASTKYQKVYGTAAVNSPVVSWKMKAPEKKPLVKREKPEEFQTRVRRGSQKKHISPVQALSEFKAMDSF

SEQ ID NO: 912575 - protein, 948 aa, Homo sapiens
RGPRRAGRAGGTAPRPEAAAAAAALVPAAASPVPSVITTPAAGNGRERGGGEKLPPTHRGSMTSATSPIILKWDPKSLEIRTLTVERLLEPLVTQVTTLVNTSNKGPSGKKKGRSKKAHVLAASVEQATQNFLEKGEQIAKESQDLKEELVAAVEDVRKQGETMRIASSEFADDPCSSVKRGTMVRAARALLSAVTRLLILADMADVMRLLSHLKIVEEALEAVKNATNEQDLANRFKEFGKKMVKLNYVAARRQQELKDPHCRDEMAAARGALKKNATMLYTASQAFLRHPDVAATRANRDYVFKQVQEAIAGISNAAQATSPTDEAKGHTGIGELAAALNEFDNKIILDPMTFSEARFRPSLEERLESIISGAALMADSSCTRDDRRERIVAECNAVRQALQDLLSEYMNNTGRKEKGDPLNIAIDKMTKKTRDLRRQLRKAVMDHISDSFLETNVPLLVLIEAAKSGNEKEVKEYAQVFREHANKLVEVANLACSISNNEEGVKLVRMAATQIDSLCPQVINAALTLAARPQSKVAQDNMDVFKDQWEKQVRVLTEAVDDITSVDDFLSVSENHILEDVNKCVIALQEGDVDTLDRTAGAIRGRAARVIHIINAEMENYEAGVYTEKVLEATKLLSETVMPRFAEQVEVAIEALSANVPQPFEENEFIDASRLVYDGVRDIRKAVLMIRTPEELEDDSDFEQEDYDVRSRTSVQTEDDQLIAGQSARAIMAQLPQEEKAKIAEQVEIFHQEKSKLDAEVAKWDDSGNDIIVLAKQMCMIMMEMTDFTRGKGPLKNTSDVINAAKKIAEAGSRMDKLARAVADQCPDSACKQDLLAYLQRIALYCHQLNICSKVKAEVQNLGGELIVSGLDSATSLIQAAKNLMNAVVLTVKASYVASTKYQKVYGTAAVNSPVVSWKMKAPEKKPLVKRVSPVQALSEFKAMDSF

SEQ ID NO: 912576 - protein, 731 aa, Homo sapiens
RGPRRAGRAGGTAPRPEAAAAAAALVPAAASPVPSVITTPAAGNGRERGGGEKLPPTHRGSMTSATSPIILKWDPKSLEIRTLTVERLLEPLVTQVTTLVNTSNKGPSGKKKGRSKKAHVLAASVEQATQNFLEKGEQIAKESQDLKEELVAAVEDVRKQGETMRIASSEFADDPCSSVKRGTMVRAARALLSAVTRLLILADMADVMRLLSHLKIVEEALEAVKNATNEQDLANRFKEFGKKMVKLNYVAARRQQELKDPHCRDEMAAARGALKKNATMLYTASQAFLRHPDVAATRANRDYVFKQVQEAIAGISNAAQATSPTDEAKGHTGIGELAAALNEFDNKIILDPMTFSEARFRPSLEERLESIISGAALMADSSCTRDDRRERIVAECNAVRQALQDLLSEYMNNTGRKEKGDPLNIAIDKMTKKTRDLRRQLRKAVMDHISDSFLETNVPLLVLIEAAKSGNEKEVKEYAQVFREHANKLVEVANLACSISNNEEGVKLVRMAATQIDSLCPQVINAALTLAARPQSKVAQDNMDVFKDQWEKQVRVLTEAVDDITSVDDFLSVSENHILEDVNKCVIALQEGDVDTLDRTAGAIRGRAARVIHIINAEMENYEAGVYTEKVLEATKLLSETVMPRFAEQVEVAIEALSANVPQPFEENEFIDASRLVYDGVRDIRKAVLMIRTPEELEDNMDVFKDQWEKQVRVLTEAVDDITSVDDFLSV

SEQ ID NO: 912577 - protein, 78 aa, Homo sapiens
AGGKCMPKNPSRHPGAPGDQGKDPVHSGEALLAIIAIEDLGQRTAVCPLWSPCLARGSDPYATVYPLATVDPLATVNP

SEQ ID NO: 912578 - protein, 130 aa, Homo sapiens
KSTCARLLLAIEDLGQRTAVCPLWSPCLARGSVTPAMRTLAILAAILLVALQAQAEPLQARADEVAAAPEQIAADIPEVVVSLAWDESLAPKHPGSRKNMACYCRIPACIAGERRYGTCIYQGRLWAFCC

SEQ ID NO: 912579 - protein, 131 aa, Homo sapiens
ARYQRGTITFAIEDLGQRTAVCPLWSPCLARGSVTPAMRTLAILAAILLVALQAQAEPLQARADEVAAAPEQIAADIPEVVVSLAWDESLAPKHPGSRKNMACYCRIPACIAGERRYGTCIYQGRLWAFCC

SEQ ID NO: 912580 - protein, 117 aa, Homo sapiens
LHGEYLSLLKIQKISRALWRGARNPSYSWGCYGILTVPDKGRIIPNSPRSRLQRTSQKWLFPLHGTKAWLQSIQAQGKTWPAIAEYQRALQENVAMEPASTREDSGHSAAELAEKEK

SEQ ID NO: 912581 - protein, 162 aa, Homo sapiens
QEVNQFRSSFLIRGVSCSFDFFKVRLGLGLKLWALDLLHQVAIEDLGQRTAVCPLWSPCLARGSVTPAMRTLAILAAILLVALQAQAEPLQARADEVAAAPEQIAADIPEVVVSLAWDESLAPKHPGSRKNMACYCRIPACIAGERRYGTCIYQGRLWAFCC

SEQ ID NO: 912582 - protein, 131 aa, Homo sapiens; identical to SEQ ID NO: 912579

SEQ ID NO: 912583 - protein, 131 aa, Homo sapiens; identical to SEQ ID NO: 912579

SEQ ID NO: 912584 - protein, 102 aa, Homo sapiens
MRTLAILAAILLVALQAQAEPLQARADEVAAAPEQIAADIPEVVVSLAWDESLAPKHPAQGNTVFAVAGIVALPCSSKFVWLLLVSRESPVCEPAELAEKEK

SEQ ID NO: 912585 - protein, 109 aa, Homo sapiens
RGRGLSQSRQLPVFRGLRNFLSVRVSALPPSSPICLVRPPVALTWDPQGALPAKQWPPGRRDPLSGRGKMPAVGQGVQAAQPRQAPGGCGDSTQKIHLGSKLALFQYWL

SEQ ID NO: 912586 - protein, 109 aa, Homo sapiens; identical to SEQ ID NO: 912585

SEQ ID NO: 912587 - protein, 167 aa, Homo sapiens
MPGPTPSGTNVGSSGRSPSKAVAARAAGSTVRQREEKILNTCMETSEGCEEGCDIFWLQQEKCQLWDKECRPHNLGRHRGDVAILHRRFTWAQSWPCSSIGYESSVHRFCIYVAHLGQVHSFVDSVTSICHLKKEEKTQHFLDQKYSDYLFMREIFCKLAVLQGIYQ

SEQ ID NO: 912588 - protein, 167 aa, Homo sapiens; identical to SEQ ID NO: 912587

SEQ ID NO: 912589 - protein, 126 aa, Homo sapiens
RGRGLSQSRQLPVFRGLRNFLSVRVSALPPSSPICLVRPPVALTWDPQGALPAKQWPPGRRDPLSGRGKMPAVGQGVQAAQPRQAPGGCGDSTQKIHLGSKLALFQYCVTWTLLSVLSKSGFFPLG

SEQ ID NO: 912590 - protein, 109 aa, Homo sapiens; identical to SEQ ID NO: 912585

SEQ ID NO: 912591 - protein, 109 aa, Homo sapiens; identical to SEQ ID NO: 912585

SEQ ID NO: 912592 - protein, 131 aa, Homo sapiens
ILSDPGYIFPSVGIGLSEGRCDPKEGGRRSLLPIQQPGPTPSGTNVGSSGRSPSKAVAARAAGSTVRQRKNASCGTRSAGRTTSAGTGGMWRFYTEDSPGLKVGPVPVLVMSLLFIASVFMLHIWGKYTRS

SEQ ID NO: 912593 - protein, 98 aa, Homo sapiens
RGRGLSQSRQLPVFRGLRNFLSVRVSALPPSSPICLVRPPVALTWDPQGALPAKQWPPGRRDPLSGRGKEPCSSFASRLGDRTQNLADSGVETLACED

SEQ ID NO: 912594 - protein, 102 aa, Homo sapiens
ILSDPGYIFPSVGIGLSEGRCDPKEGGRRSLLPIQQPGPTPSGTNVGSSGRSPSKAVAARAAGSTVRQREEKILNTCMETSEGCEEGCDIFWLQQVNLKLMI

SEQ ID NO: 912595 - protein, 598 aa, Homo sapiens
MENSSAASASSEAGSSRSQEIEELERFIDSYVLEYQVQGLLADKTEGDGESERTQSHISQWTADCSEPLDSSCSFSRGRAPPQQNGSKDNSLDMLGTDIWAANTFDSFSGATWDLQPEKLDFTQFHRKVRHTPKQPLPHIDREGCGKGKLEDGDGINLNDIEKVLPAWQGYHPMPHEVEIAHTKKLFRRRRNDRRRQQRPPGGNKPQQHGDHQPGSAKHNRDHQKSYQGGSAPHPSGRPTHHGYSQNRRWHHGNMKHPPGDKGEAGAHRNAKETMTIENPKLEDTAGDTGHSSLEAPRSPDTLAPVASERLPPQQSGGPEVETKRKDSILPERIGERPKITLLQSSKDRLRRRLKEKDEVAVETTTPQQNKMDKLIEILNSMRNNSSDVDTKLTTFMEEAQNSTNSEEMLGEIVRTIYQKAVSDRSFAFTAAKLCDKMALFMVEGTKFRSLLLNMLQKDFTVREELQQQDVERWLGFITFLCEVFGTMRSSTGEPFRVLVCPIYTCLRELLQSQDVKEDAVLCCSMELQSTGRLLEEQLPEMMTELLASARDKMLCPSESMLTRSLLLEVIELHANSWNPLTPPITQYYNRTIQKLTA

SEQ ID NO: 912596 - protein, 598 aa, Homo sapiens; identical to SEQ ID NO: 912595

SEQ ID NO: 912597 - protein, 598 aa, Homo sapiens; identical to SEQ ID NO: 912595

SEQ ID NO: 912598 - protein, 598 aa, Homo sapiens; identical to SEQ ID NO: 912595

SEQ ID NO: 912599 - protein, 598 aa, Homo sapiens; identical to SEQ ID NO: 912595

SEQ ID NO: 912600 - protein, 541 aa, Homo sapiens
MENSSAASASSEAGSSRSQEIEELERFIDSYVLEYQVQGLLADKTEGDGESERTQSHISQWTADCSEPLDSSCSFSRGRAPPQQNGSKDNSLDMLGTDIWAANTFDSFSGATWDLQPEKLDFTQFHRKVRHTPKQPLPHIDREGCGKGKLEDGDGINLNDIEKVLPAWQGYHPMPHEVEIAHTKKLFRRRRNDRRRQQRPPGGNKPQQHGDHQPGSAKHNRDHQKSYQGGSAPHPSGRPTHHGYSQNRRWHHGNMKHPPGDKGEAGAHRNAKETMTIENPKLEDTAGDTGHSSLEAPRSPDTLAPVASERLPPQQSGGPEVETKRKDSILPERIGERPKITLLQSSKDRLRRRLKEKDEVAVETTTPQQNKMDKLIEILNSMRNNSSDVDTKLTTFMEEAQNSTNSEEMLGEIVRTIYQKAVSDRSFAFTAAKLCDKMALFMVEGTKFRSLLLNMLQKDFTVREELQQQDVERWLGFITFLCEVFGTMRSSTGEPFRVSCPSAAGHCVGKPLAGPLRTQIRRKKDNFPLRGTLTRKGWPPP

SEQ ID NO: 912601 - protein, 96 aa, Homo sapiens
MENSSAASASSEAGSSRSQEIEELERFIDSYVLEYQVQGLLADKTEGDGESERTQSHISQWTADCSEPLDSSCSFSRGRAPPQQNTAPRMGSSRRH

SEQ ID NO: 912602 - protein, 598 aa, Homo sapiens; identical to SEQ ID NO: 912595

SEQ ID NO: 912603 - protein, 598 aa, Homo sapiens; identical to SEQ ID NO: 912595

SEQ ID NO: 912604 - protein, 598 aa, Homo sapiens; identical to SEQ ID NO: 912595

SEQ ID NO: 912605 - protein, 598 aa, Homo sapiens; identical to SEQ ID NO: 912595

SEQ ID NO: 912606 - protein, 102 aa, Homo sapiens
MENSSAASASSEAGSSRSQEIEELERFIDSYVLEYQVQGLLADKTEGDGESERTQSHISQVSAGPGLGQLGKFRGGDAGAPEFWAASSCLTLDRQGMNGPTQ

SEQ ID NO: 912607 - protein, 755 aa, Homo sapiens
MLDCSDYVLDSRMNNPSETSKPSMESGDGNTGTQTNGLDFQKQPVPVGGAISTAQAQAFLGHLHQVQLAGTSLQAAAQSLNVQSKSNEESGDSQQPSQPSQQPSVQAAIPQTQLMLAGGQITGLTLTPAQQQLLLQQAQAQAQLLAAAVQQHSASQQHSAAGATISASAATPMTQIPLSQPIQIAQDLQQLQQLQQQNLNLQQFVLVHPTTNLQPAQFIISQTPQGQQGLLQAQNLLTQLPQQSQANLLQSQPSITLTSQPATPTRTIAATPIQTLPQSQSTPKRIDTPSLEEPSDLEELEQFAKTFKQRRIKLGFTQGDVGLAMGKLYGNDFSQTTISRFEALNLSFKNMCKLKPLLEKWLNDAENLSSDSSLSSPSALNSPGIEGLSRRRKKRTSIETNIRVALEKSFLENQKPTSEEITMIADQLNMEKEVIRVWFCNRRQKEKRINPPSSGGTSSSPIKAIFPSPTSLVATTPSLVTSSAATTLTVSPVLPLTSAAVTNLSVTGTSDTTSNNTATVISTAPPASSAVTSPSLSPSPSASASTSEASSASETSTTQTTSTPLSSPLGTSQVMVTASGLQTAAAAALQGAAQLPANASLAAMAAAAGLNPSLMAPSQFAAGGALLSLNPGTLSGALSPALMSNSTLATIQALASGGSLPITSLDATGNLVFANAGGAPNIVTAPLFLNPQNLSLLTSNPVSLVSAAAASAGNSAPVASLHATSTSAESIQNSLFTVASASGAASTTTTASKAQ

SEQ ID NO: 912608 - protein, 293 aa, Homo sapiens
KIFKMADGGAASQDESSAAAAAAADSRMNNPSETSKPSMESGDGNTGTQTNGLDFQKQPVPVGGAISTAQAQAFLGHLHQVQLAGTSLQAAAQSLNVQSKSNEESGDSQQPSQPSQQPSVQAAIPQTQLMLAGGQITGLTLTPAQQQLLLQQAQAQAQLLAAAVQQHSASQQHSAAGATISASAATPMTQIPLSQPIQIAQDLQQLQQLQQQNLNLQQFVLVHPTTNLQPAQFIISQTPQGQQGLLQAQIFYRNYSESKPTSKVGSKDYLNSSKKPKEIGYPIDFPSSTKDGP

SEQ ID NO: 912609 - protein, 653 aa, Homo sapiens
MNNPSETSKPSMESGDGNTGTQTNGLDFQKQPVPVGGAISTAQAQAFLGHLHQVQLAGTSLQAAAQSLNVQSKSNEESGDSQQPSQPSQQPSVQAAIPQTQLMLAGGQITGLTLTPAQQQLLLQQAQAQAQLLAAAVQQHSASQQHSAAGATISASAATPMTQIPLSQPIQIAQDLQQLQQLQQQNLNLQQFVLVHPTTNLQPAQFIISQTPQGQQGLLQAQNLLTQLPQQSQANLLQSQPSITLTSQPATPTRTIAATPIQTLPQSQSTPKRIDTPSLEEPSDLEELEQFAKTFKQRRIKLGFTQGDVGLAMGKLYGNDFSQTTISRFEALNLSFKNMCKLKPLLEKWLNDAENLSSDSSLSSPSALNSPGIEGLSRRRKKRTSIETNIRVALEKSFLENQKPTSEEITMIADQLNMEKEVIRVWFCNRRQKEKRINPPSSGGTSSSPIKAIFPSPTSLVATTPSLVTSSAATTLTVSPVLPLTSAAVTNLSVTGTSDTTSNNTATVISTAPPASSAVTSPSLSPSPSASASTSEASSASETSTTQTTSTPLSSPLGTSQVMVTASGLQTAAAAALQGAAQLPANASLAAMAAAAGLNPSLMAPSQFAAGGALLSLNPGTLSGALSPALMSNSTLATIQGLLHGLENFLTKN

SEQ ID NO: 912610 - protein, 763 aa, Homo sapiens
KIFKMADGGAASQDESSAAAAAAADSRMNNPSETSKPSMESGDGNTGTQTNGLDFQKQPVPVGGAISTAQAQAFLGHLHQVQLAGTSLQAAAQSLNVQSKSNEESGDSQQPSQPSQQPSVQAAIPQTQLMLAGGQITGLTLTPAQQQLLLQQAQAQAQLLAAAVQQHSASQQHSAAGATISASAATPMTQIPLSQPIQIAQDLQQLQQLQQQNLNLQQFVLVHPTTIISQTPQGQQGLLQAQNLLTQLPQQSQANLLQSQPSITLTSQPATPTRTIAATPIQTLPQSQSTPKRIDTPSLEEPSDLEELEQFAKTFKQRRIKLGFTQGDVGLAMGKLYGNDFSQTTISRFEALNLSFKNMCKLKPLLEKWLNDAENLSSDSSLSSPSALNSPGIEGLSRRRKKRTSIETNIRVALEKSFLENQKPTSEEITMIADQLNMEKEVIRVWFCNRRQKEKRINPPSSGGTSSSPIKAIFPSPTSLVATTPSLVTSSAATTLTVSPVLPLTSAAVTNLSVTGTSDTTSNNTATVISTAPPASSAVTSPSLSPSPSASASTSEASSASETSTTQTTSTPLSSPLGTSQVMVTASGLQTAAAAALQGAAQLPANASLAAMAAAAGLNPSLMAPSQFAAGGALLSLNPGTLSGALSPALMSNSTLATIQALASGGSLPITSLDATGNLVFANAGGAPNIVTAPLFLNPQNLSLLTSNPVSLVSAAAASAGNSAPVASLHATSTSAESIQNSLFTVASASGAASTTTTASKAQ

SEQ ID NO: 912611 - protein, 583 aa, Homo sapiens [sequence omitted]

SEQ ID NO: 912612 - protein, 780 aa, Homo sapiens
LTAASTFWVQAVLPLSAQVAGTTGTQTNGLDFQKQPVPVGGAISTAQAQAFLGHLHQVQLAGTSLQAAAQSLNVQSKSNEESGDSQQPSQPSQQPSVQAAIPQTQLMLAGGQITGLTLTPAQQQLLLQQAQAQAQLLAAAVQQHSASQQHSAAGATISASAATPMTQIPLSQPIQIAQDLQQLQQLQQQNLNLQQFVLVHPTTNLQPAQFIISQTPQGQQGGKTAIIETTNLSPASAKSSNATTSAKPSQPPTVAAKHHPHLPDLAQSSLRFWSWGNLSVTTPLKPATPTRTIAATPIQTLPQSQSTPKRIDTPSLEEPSDLEELEQFAKTFKQRRIKLGFTQGDVGLAMGKLYGNDFSQTTISRFEALNLSFKNMCKLKPLLEKWLNDAENLSSDSSLSSPSALNSPGIEGLSRRRKKRTSIETNIRVALEKSFLENQKPTSEEITMIADQLNMEKEVIRVWFCNRRQKEKRINPPSSGGTSSSPIKAIFPSPTSLVATTPSLVTSSAATTLTVSPVLPLTSAAVTNLSVTGTSDTTSNNTATVISTAPPASSAVTSPSLSPSPSASASTSEASSASETSTTQTTSTPLSSPLGTSQVMVTASGLQTAAAAALQGAAQLPANASLAAMAAAAGLNPSLMAPSQFAAGGALLSLNPGTLSGALSPALMSNSTLATIQALASGGSLPITSLDATGNLVFANAGGAPNIVTAPLFLNPQNLSLLTSNPVSLVSAAAASAGNSAPVASLHATSTSAESIQNSLFTVASASGAASTTTTASKAQ

SEQ ID NO: 912613 - protein, 291 aa, Homo sapiens
MYSLNLMKNRGIRSSQASLPSSLQCRQPFLPLTSAAVTNLSVTGTSDTTSNNTATVISTAPPASSAVTSPSLSPSPSASASTSEASSASETSTTQTTSTPLSSPLGTSQVMVTASGLQTAAAAALQGAAQLPANASLAAMAAAAGLNPSLMAPSQFAAGGALLSLNPGTLSGALSPALMSNSTLATIQALASGGSLPITSLDATGNLVFANAGGAPNIVTAPLFLNPQNLSLLTSNPVSLVSAAAASAGNSAPVASLHATSTSAESIQNSLFTVASASGAASTTTTASKAQ

SEQ ID NO: 912614 - protein, 113 aa, Homo sapiens
MSNSTLATIQALASGGSLPITSLDATGNLVFANAGGAPNIVTAPLFLNPQNLSLLTSNPVSLVSAAAASAGNSAPVASLHATSTSAESIQNSLFTVASASGAASTTTTASKAQ

SEQ ID NO: 912615 - protein, 303 aa, Homo sapiens
QHARRTQRPTGTHNVSRYEAWVFTAMLDCSDYVLDSRMNNPSETSKPSMESGDGNTGTQTNGLDFQKQPVPVGGAISTAQAQAFLGHLHQVQLAGTSLQAAAQSLNVQSKSNEESGDSQQPSQPSQQPSVQAAIPQTQLMLAGGQITGLTLTPAQQQLLLQQAQAQAQLLAAAVQQHSASQQHSAAGATISASAATPMTQIPLSQPIQIAQDLQQLQQLQQQNLNLQQFVLVHPTTNLQPAQFIISQTPQGQQGLLQAQIFYRNYSESKPTSKVGSKDYLNSSKKPKEIGYPIDFPSSTKDGP

SEQ ID NO: 912616 - protein, 770 aa, Homo sapiens
KIFKMADGGAASQDESSAAAAAAADSRMNNPSETSKPSMESGDGNTGTQTNGLDFQKQPVPVGGAISTAQAQAFLGHLHQVQLAGTSLQAAAQSLNVQSKSNEESGDSQQPSQPSQQPSVQAAIPQTQLMLAGGQITGLTLTPAQQQLLLQQAQAQAQLLAAAVQQHSASQQHSAAGATISASAATPMTQIPLSQPIQIAQDLQQLQQLQQQNLNLQQFVLVHPTTNLQPAQFIISQTPQGQQGLLQAQNLLTQLPQQSQANLLQSQPSITLTSQPATPTRTIAATPIQTLPQSQSTPKRIDTPSLEEPSDLEELEQFAKTFKQRRIKLGFTQGDVGLAMGKLYGNDFSQTTISRFEALNLSFKNMCKLKPLLEKWLNDAENLSSDSSLSSPSALNSPGIEGLSRRRKKRTSIETNIRVALEKSFLENQKPTSEEITMIADQLNMEKEVIRVWFCNRRQKEKRINPPSSGGTSSSPIKAIFPSPTSLVATTPSLVTSSAATTLTVSPVLPLTSAAVTNLSVTGTSDTTSNNTATVISTAPPASSAVTSPSLSPSPSASASTSEASSASETSTTQTTSTPLSSPLGTSQVMVTASGLQTAAAAALQGAAQLPANASLAAMAAAAGLNPSLMAPSQFAAGGALLSLNPGTLSGALSPALMSNSTLATIQALASGGSLPITSLDATGNLVFANAGGAPNIVTAPLFLNPQNLSLLTSNPVSLVSAAAASAGNSAPVASLHATSTSAESIQNSLFTVASASGAASTTTTASKAQ

SEQ ID NO: 912617 - protein, 665 aa, Homo sapiens
MLDCSDYVLDSRMNNPSETSKPSMESGDGNTGTQTNGLDFQKQPVPVGGAISTAQAQAFLGHLHQVQLAGTSLQAAAQSLNVQSKSNEESGDSQQPSQPSQQPSVQAAIPQTQLMLAGGQITGLTLTPAQQQLLLQQAQAQAQLLAAAVQQHSASQQHSAAGATISASAATPMTQIPLSQPIQIAQDLQQLQQLQQQNLNLQQFVLVHPTTNLQPAQFIISQTPQGQQGLLQAQNLLTQLPQQSQANLLQSQPSITLTSQPATPTRTIAATPIQTLPQSQSTPKRIDTPSLEEPSDLEELEQFAKTFKQRRIKLGFTQGDVGLAMGKLYGNDFSQTTISRFEALNLSFKNMCKLKPLLEKWLNDAENLSSDSSLSSPSALNSPGIEGLSRRRKKRTSIETNIRVALEKSFLENQKPTSEEITMIADQLNMEKEVIRVWFCNRRQKEKRINPPSSGGTSSSPIKAIFPSPTSLVATTPSLVTSSAATTLTVSPVLPLTSAAVTNLSVTGTSDTTSNNTATVISTAPPASSAVTSPSLSPSPSASASTSEASSASETSTTQTTSTPLSSPLGTSQVMVTASGLQTAAAAALQGAAQLPANASLAAMAAAAGLNPSLMAPSQFAAGGALLSLNPGTLSGALSPALMSNSTLATIQGLLHGLENFLTKN

SEQ ID NO: 912618 - protein, 517 aa, Homo sapiens
MLDCSDYVLDSRMNNPSETSKPSMESGDGNTGTQTNGLDFQKQPVPVGGAISTAQAQAFLGHLHQVQLAGTSLQAAAQSLNVQSKSNEESGDSQQPSQPSQQPSVQAAIPQTQLMLAGGQITGLTLTPAQQQLLLQQAQAQAQLLAAAVQQHSASQQHSAAGATISASAATPMTQIPLSQPIQIAQDLQQLQQLQQQNLNLQQFVLVHPTTNLQPAQFIISQTPQGQQGLLQAQNLLTQLPQQSQANLLQSQPSITLTSQPATPTRTIAATPIQTLPQSQSTPKRIDTPSLEEPSDLEELEQFAKTFKQRRIKLGFTQGDVGLAMGKLYGNDFSQTTISRFEALNLSFKNMCKLKPLLEKWLNDAENLSSDSSLSSPSALNSPGIEGLSRRRKKRTSIETNIRVALEKSFLENQKPTSEEITMIADQLNMEKEVIRVWFCNRRQKEKRINPPSSGGTSSSPIKAIFPSPTSLVATTPSLVTSSAATTLTVSPVLPLTSAAVTNLSVTGTSDTTSNNT

SEQ ID NO: 912619 - protein, 600 aa, Homo sapiens
MNKGIVEATISASAATPMTQIPLSQPIQIAQDLQQLQQLQQQNLNLQQFVLVHPTTNLQPAQFIISQTPQGQQGLLQAQNLLTQLPQQSQANLLQSQPSITLTSQPATPTRTIAATPIQTLPQSQSTPKRIDTPSLEEPSDLEELEQFAKTFKQRRIKLGFTQGDVGLAMGKLYGNDFSQTTISRFEALNLSFKNMCKLKPLLEKWLNDAENLSSDSSLSSPSALNSPGIEGLSRRRKKRTSIETNIRVALEKSFLENQKPTSEEITMIADQLNMEKEVIRVWFCNRRQKEKRINPPSSGGTSSSPIKAIFPSPTSLVATTPSLVTSSAATTLTVSPVLPLTSAAVTNLSVTGTSDTTSNNTATVISTAPPASSAVTSPSLSPSPSASASTSEASSASETSTTQTTSTPLSSPLGTSQVMVTASGLQTAAAAALQGAAQLPANASLAAMAAAAGLNPSLMAPSQFAAGGALLSLNPGTLSGALSPALMSNSTLATIQALASGGSLPITSLDATGNLVFANAGGAPNIVTAPLFLNPQNLSLLTSNPVSLVSAAAASAGNSAPVASLHATSTSAESIQNSLFTVASASGAASTTTTASKAQ

SEQ ID NO: 912620 - protein, 353 aa, Homo sapiens
MLDCSDYVLDSRMNNPSETSKPSMESGDGNTGTQTNGLDFQKQPVPVGGAISTAQAQAFLGHLHQVQLAGTSLQAAAQSLNVQSKSNEESGDSQQPSQPSQQPSVQAAIPQTQLMLAGGQITGLTLTPAQQQLLLQQAQAQAQLLAAAVQQHSASQQHSAAGATISASAATPMTQIPLSQPIQIAQDLQQLQQLQQQNLNLQQFVLVHPTTNLQPAQFIISQTPQGQQGLLQAQNLLTQLPQQSQANLLQSQPSITLTSQPATPTRTIAATPIQTLPQSQSTPKRIDTPSLEEPSDLEELEQFAKTFKQRRIKLGFTQLHATSTSAESIQNSLFTVASASGAASTTTTASKAQ

SEQ ID NO: 912621 - protein, 82 aa, Homo sapiens
YWQSRFPLHHVMLLEESHQNLSLLTSNPVSLVSAAAASAGNSAPVASLHATSTSAESIQNSLFTVASASGAASTTTTASKAQ

SEQ ID NO: 912622 - protein, 393 aa, Homo sapiens [sequence omitted]

SEQ ID NO: 912623 - protein, 291 aa, Homo sapiens
VQSIPMAVGASCDRGTAKSVTCTYSPALNKMFCQLAKTCPVQLWVDSTPPPGTRVRAMAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSSGNLLGRNSFEVRVCACPGRDRRTEEENLRKKGEPHHELPPGSTKRALPNNTSSSPQPKKKPLDGEYFTLQIRGRERFEMFRELNEALELKDAQAGKEPGGSRAHSSHLKSKKGQSTSRHKKLMFKTEGPDSD

SEQ ID NO: 912624 - protein, 380 aa, Homo sapiens
MEEPQSDPSVEPPLSQETFSDLWKLLPENNVLSPLPSQAMDDLMLSPDDIEQWFTEDPGPDEAPRMPEAAPRVAPAPAAPTPAAPAPAPSWPLSSSVPSQKTYQGSYGFRLGFLHSGTAKSVTCTYSPALNKMFCQLAKTCPVQLWVDSTPPPGTRVRAMAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSSGNLLGRNSFEVRVCACPGRDRRTEEENLRKKGEPHHELPPGSTKRALPNNTSSSPQPKKKPLDGEYFTLQIRGRERFEMFRELNEALELKDAQAGKEPGGSRAHSSHMKSTKGQSRYRA

SEQ ID NO: 912625 - protein, 393 aa, Homo sapiens [sequence omitted]

SEQ ID NO: 912626 - protein, 351 aa, Homo sapiens
MEEPQSDPSVEPPLSQETFSDLWKLLPENNVLSPLPSQAMDDLMLSPDDIEQWFTEDPGPDEAPRMPEAAPRVAPAPAAPTPAAPAPAPSWPLSSSVPSQKTYQGSYGFRLGFLHSGTAKSVTCTYSPALNKMFCQLAKTCPVQLWVDSTPPPGTRVRAMAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSSGNLLGRNSFEVRVCACPGRDRRTEEENLRKKGEPHHELPPGSTKRALPNNTSSSPQPKKKPLDGEYFTLQIRGRQRGYMSRDVVKPRTVT

SEQ ID NO: 912627 - protein, 632 aa, Homo sapiens
MSRVRDAGCVAAGIVIGAGAWYCVYKYTRGRDQTKKRMAKPKNRAVAGTGARARAGLRAGFTIDLGSGFSPPTPVRAEAEDRAQDEASALDTVGAEAVAPAASSAEAQSGAGSQAQEADGAGVGPKAESVVGAAMASAIAPPPGVTEALGAAEAPAMAGAPKVAEAPREAETSRAAVPPGTVVPTEAAAPTEVTEGPGVAAPTKVAEAPGVASPTEAAEAPVPATPTGAAAPTGAAESPGTSGSPRTAVVPGTSAAKKATPGAHTGAIPKATSATGAVPKGGGKGVTRSRNGGKGKGKKSKVEVDELGMGFRPGDGAAAAAAASANGGQAFLAEVPDSEEGESGWTDTESDSDSEPETQRRGRGRRPVAMQKRPFPYEIDEILGVRDLRKVLALLQKSDDPFIQQVALLTLSNNANYSCNQETIRKLGGLPIIANMINKTDPHIKEKALMAMNNLSENYENQGRLQVYMNKVMDDIMASNLNSAVQVVGLKFLTNMTITNDYQHLLVNSIANFFRLLSQGGGKIKVEILKILSNFAENPDMLKKLLSTQVPASFSSLYNSYVESEILINALTLFEIIYDNLRAEVFNYREFNKGSLFYLCTTSGVCVKKIRALANHHDLLVKVKVIKLVNKF

SEQ ID NO: 912628 - protein, 632 aa, Homo sapiens; identical to SEQ ID NO: 912627

SEQ ID NO: 912629 - protein, 614 aa, Homo sapiens
MSRVRDAGCVAAGIVIGAGAWYCVYKYTRGRDQTKKRMAKPKNRAVAGTGARARAGLRAGFTIDLGSGFSPPTPVRAEAEDRAQDEASALDTVGAEAVAPAASSAEAQSGAGSQAQEADGAGVGPKAESVVGAAMASAIAPPPGVTEALGAAEAPAMAGAPKVAEAPREAETSRAAVPPGTVVPTEAAAPTEVTEGPGVAAPTKVAEAPGVASPTEAAEAPVPATPTGAAAPTGAAESPGTSGSPRTAVVPGTSAAKKATPGAHTGAIPKATSATGAVPKGGGKGVTRSRNGGKGKGKAAAAAAASANGGQAFLAEVPDSEEGESGWTDTESDSDSEPETQRRGRGRRPVAMQKRPFPYEIDEILGVRDLRKVLALLQKSDDPFIQQVALLTLSNNANYSCNQETIRKLGGLPIIANMINKTDPHIKEKALMAMNNLSENYENQGRLQVYMNKVMDDIMASNLNSAVQVVGLKFLTNMTITNDYQHLLVNSIANFFRLLSQGGGKIKVEILKILSNFAENPDMLKKLLSTQVPASFSSLYNSYVESEILINALTLFEIIYDNLRAEVFNYREFNKGSLFYLCTTSGVCVKKIRALANHHDLLVKVKVIKLVNKF

SEQ ID NO: 912630 - protein, 632 aa, Homo sapiens; identical to SEQ ID NO: 912627

SEQ ID NO: 912631 - protein, 605 aa, Homo sapiens
MSRVRDAGCVAAGIVIGAGAWYCVYKYTGLWLGLEPGLELGFSPPTPVRAEAEDRAQDEASALDTVGAEAVAPAASSAEAQSGAGSQAQEADGAGVGPKAESVVGAAMASAIAPPPGVTEALGAAEAPAMAGAPKVAEAPREAETSRAAVPPGTVVPTEAAAPTEVTEGPGVAAPTKVAEAPGVASPTEAAEAPVPATPTGAAAPTGAAESPGTSGSPRTAVVPGTSAAKKATPGAHTGAIPKATSATGAVPKGGGKGVTRSRNGGKGKGKKSKVEVDELGMGFRPGDGAAAAAAASANGGQAFLAEVPDSEEGESGWTDTESDSDSEPETQRRGRGRRPVAMQKRPFPYEIDEILGVRDLRKVLALLQKSDDPFIQQVALLTLSNNANYSCNQETIRKLGGLPIIANMINKTDPHIKEKALMAMNNLSENYENQGRLQVYMNKVMDDIMASNLNSAVQVVGLKFLTNMTITNDYQHLLVNSIANFFRLLSQGGGKIKVEILKILSNFAENPDMLKKLLSTQVPASFSSLYNSYVESEILINALTLFEIIYDNLRAEVFNYREFNKGSLFYLCTTSGVCVKKIRALANHHDLLVKVKVIKLVNKF

SEQ ID NO: 912632 - protein, 632 aa, Homo sapiens; identical to SEQ ID NO: 912627

SEQ ID NO: 912633 - protein, 632 aa, Homo sapiens; identical to SEQ ID NO: 912627

SEQ ID NO: 912634 - protein, 632 aa, Homo sapiens; identical to SEQ ID NO: 912627

SEQ ID NO: 912635 - protein, 632 aa, Homo sapiens; identical to SEQ ID NO: 912627

SEQ ID NO: 912636 - protein, 632 aa, Homo sapiens; identical to SEQ ID NO: 912627

SEQ ID NO: 912637 - protein, 632 aa, Homo sapiens; identical to SEQ ID NO: 912627

SEQ ID NO: 912638 - protein, 1136 aa, Homo sapiens
MEFRRPARQVALMAPPSEETPLIPQRSCSLLSTEAGALHVLLPARGPGPPQRLSFSFGDHLAEDLCVQAAKASGILPVYHSLFALATEDLSCWFPPSHIFSVEDASTQVLLYRIRFYFPNWFGLEKCHRFGLRKDLASAILDLPVLEHLFAQHRSDLVSGRLPVGLSLKEQGECLSLAVLDLARMAREQAQRPGELLKTVSYKACLPPSLRDLIQGLSFVTRRRIRRTVRRALRRVAACQADRHSLMAKYIMDLERLDPAGAAETFHVGLPGALGGHDGLGLLRVAGDGGIAWTQGEQEVLQPFCDFPEIVDISIKQAPRVGPAGEHRLVTVTRTDNQILEAEFPGLPEALSFVALVDGYFRLTTDSQHFFCKEVAPPRLLEEVAEQCHGPITLDFAINKLKTGGSRPGSYVLRRSPQDFDSFLLTVCVQNPLGPDYKGCLIRRSPTGTFLLVGLSRPHSSLRELLATCWDGGLHVDGVAVTLTSCCIPRPKEKSNLIVVQRGHSPPTSSLVQPQSQYQLSQMTFHKIPADSLEWHENLGHGSFTKIYRGCRHEVVDGEARKTEVLLKVMDAKHKNCMESFLEAASLMSQVSYRHLVLLHGVCMAGDSTMVQEFVHLGAIDMYLRKRGHLVPASWKLQVVKQLAYALNYLEDKGLPHGNVSARKVLLAREGADGSPPFIKLSDPGVSPAVLSLEMLTDRIPWVAPECLREAQTLSLEADKWGFGATVWEVFSGVTMPISALDPAKKLQFYEDRQQLPAPKWTELALLIQQCMAYEPVQRPSFRAVIRDLNSLISSDYELLSDPTPGALAPRDGLWNGAQLYACQDPTIFEERHLKYISQLGKGNFGSVELCRYDPLGDNTGALVAVKQLQHSGPDQQRDFQREIQILKALHSDFIVKYRGVSYGPGRQSLRLVMEYLPSGCLRDFLQRHRARLDASRLLLYSSQICKGMEYLGSRRCVHRDLAARNILVESEAHVKIADFGLAKLLPLDKDYYVVREPGQSPIFWYAPESLSDNIFSRQSDVWSFGVVLYELFTYCDKSCSPSAEFLRMMGCERDVPALCRLLELLEEGQRLPAPPACPAEVHELMKLCWAPSPQDRPSFSALGPQLDMLWSGSRGCETHAFTAHPEGKHHSLSFS

SEQ ID NO: 912639 - protein, 1094 aa, Homo sapiens
MAPPSEETPLIPQRSCSLLSTEAGALHVLLPARGPGPPQRLSFSFGDHLAEDLCVQAAKASGILPVYHSLFALATEDLSCWFPPSHIFSVEDASTQVLLYRIRFYFPNWFGLEKCHRFGLRKDLASAILDLPVLEHLFAQHRSDLVSGRLPVGLSLKEQGECLSLAVLDLARMAREQAQRPGELLKTVSYKACLPPSLRDLIQGLSFVTRRRIRRTVRRALRRVAACQADRHSLMAKYIMDLERLDPAGAAETFHVGLPGALGGHDGLGLLRVAGDGGIAWTQGEQEVLQPFCDFPEIVDISIKQAPRVGPAGEHRLVTVTRTDNQILEAEFPGLPEALSFVALVDGYFRLTTDSQHFFCKEVAPPRLLEEVAEQCHGPITLDFAINKLKTGGSRPGSYVLRRSPQDFDSFLLTVCVQNPLGPDYKGCLIRRSPTGTFLLVGLSRPHSSLRELLATCWDGGLHVDGVAVTLTSCCIPRPKEKSNLIVVQRGHSPPTSSLVQPQSQYQLSQMTFHKIPADSLEWHENLGHGSFTKIYRGCRHEVVDGEARKTEVLLKVMDAKHKNCMESFLEAASLMSQVSYRHLVLLHGVCMAGDSTMVQEFVHLGAIDMYLRKRGHLVPASWKLQVVKQLAYALNYLEDKGLPHGNVSARKVLLAREGADGSPPFIKLSDPGVSPAVLSLEMLTDRIPWVAPECLREAQTLSLEADKWGFGATVWEVFSGVTMPISALDPAKKLQFYEDRQQLPAPKWTELALLIQQCMAYEPVQRPSFRAVIRDLNSLISSDYELLSDPTPGALAPRDGLWNGAQLYACQDPTIFEERHLKYISQLGKGNFGSVELCRYDPLGDNTGALVAVKQLQHSGPDQQRDFQREIQILKALHSDFIVKYRGVSYGPGRQSLRLVMEYLPSGCLRDFLQRHRARLDASRLLLYSSQICKGMEYLGSRRCVHRDLAARNILVESEAHVKIADFGLAKLLPLDKDYYVVREPGQSPIFWYAPESLSDNIFSRQSDVWSFGVVLYELFTYCDKSCSPSAEFLRMMGCERDVPALCRLLELLEEGQRLPAPPACPAEVSAAGLASVSQSVDWAGVSGKPAGA

SEQ ID NO: 912640 - protein, 199 aa, Homo sapiens
MCCCPLGAPGPPQRLSFSFGDHLAEDLCVQAAKASGILPVYHSLFALATEDLSCWFPPSHIFSVEDASTQVLLYRIRFYFPNWNRAGRSGTGFGDYDKGNLGQVANPLNHAKYLGSHPPNGPDTGTVNLGGDRSAITPMGPQILQREQGVSGLEHWDRSTEPGPRNGTREAGTQRPGKKLAGKNQVKQTRGLSLTPQRP

SEQ ID NO: 912641 - protein, 500 aa, Homo sapiens
MEFRRPARQVALMAPPSEETPLIPQRSCSLLSTEAGALHVLLPARGPGPPQRLSFSFGDHLAEDLCVQAAKASGILPVYHSLFALATEDLSCWFPPSHIFSVEDASTQVLLYRIRFYFPNWFGLEKCHRFGLRKDLASAILDLPVLEHLFAQHRSDLVSGRLPVGLSLKEQGECLSLAVLDLARMAREQAQRPGELLKTVSYKACLPPSLRDLIQGLSFVTRRRIRRTVRRALRRVAACQADRHSLMAKYIMDLERLDPAGAAETFHVGLPGALGGHDGLGLLRVAGDGGIAWTQGEQEVLQPFCDFPEIVDISIKQAPRVGPAGEHRLVTVTRTDNQILEAEFPGLPEALSFVALVDGYFRLTTDSQHFFCKEVAPPRLLEEVAEQCHGPITLDFAINKLKTGGSRPGSYVLRRSPQDFDSFLLTVCVQNPLGPDYKGCLIRRSPTGTFLLVGLSRPHSSLRELLATCWDGGLHVDGVAVTLTSCCIPRPKGEPLPPLE

SEQ ID NO: 912642 - protein, 171 aa, Homo sapiens
MCPEVFISGSASRGYLKLRHELANPWGLFTSDFWFFSLILSSIEKSNLIVVQRGHSPPTSSLVQPQSQYQLSQMTFHKIPADSLEWHENLGHGSFTKIYRGCRHEVVDGEARKTEVLLKVMDAKHKNCMESFLEAASLMSQVSYRHLVLLHGVCMAGDSEKPHEKTKTHNT

SEQ ID NO: 912643 - protein, 1231 aa, Homo sapiens
MEFRRPARQVALMAPPSEETPLIPQRSCSLLSTEAGALHVLLPARGPGPPQRLSFSFGDHLAEDLCVQAAKASGILPVYHSLFALATEDLSCWFPPSHIFSVEDASTQVLLYRIRFYFPNWFGLEKCHRFGLRKDLASAILDLPVLEHLFAQHRSDLVSGRLPVGLSLKEQGECLSLAVLDLARMAREQAQRPGELLKTVSYKACLPPSLRDLIQGLSFVTRRRIRRTVRRALRRVAACQADRHSLMAKYIMDLERLDPAGAAETFHVGLPGALGGHDGLGLLRVAGDGGIAWTQGEQEVLQPFCDFPEIVDISIKQAPRVGPAGEHRLVTVTRTDNQILEAEFPGLPEALSFVALVDGYFRLTTDSQHFFCKEVAPPRLLEEVAEQCHGPITLDFAINKLKTGGSRPGSYVLRRSPQDFDSFLLTVCVQNPLGPDYKGCLIRRSPTGTFLLVGLSRPHSSLRELLATCWDGGLHVDGVAVTLTSCCIPRPKEKSNLIVVQRGHSPPTSSLVQPQSQYQLSQMTFHKIPADSLEWHENLGHGSFTKIYRGCRHEVVDGEARKTEVLLKVMDAKHKNCMESFLEAASLMSQVSYRHLVLLHGVCMAGDSTMVQEFVHLGAIDMYLRKRGHLVPASWKLQVVKQLAYALNYLEDKGLPHGNVSARKVLLAREGADGSPPFIKLSDPGVSPAVLSLEMLTDRIPWVAPECLREAQTLSLEADKWGFGATVWEVFSGVTMPISALDPAKKLQFYEDRQQLPAPKWTELALLIQQCMAYEPVQRPSFRAVIRDLNSLISSDYELLSDPTPGALAPRDGLWNGAQLYACQDPTIFEERHLKYISQLGKGNFGSVELCRYDPLGDNTGALVAVKQLQHSGPDQQRDFQREIQILKALHSDFIVKYRGVSYGPGRQSLRLVMEYLPSGCLRDFLQRHRARLDASRLLLYSSQICKGMEYLGSRRCVHRDLAARNILVESEAHVKIADFGLAKLLPLDKDYYVVREPGQSPIFWYAPESLSDNIFSRQSDVWSFGVVLYELFTYCDKSCSPSAVSRLPRAPSLLLPPRPSWPVSNLSAPASLFSMGSPGPSIIGPSGEDASSPFLTPSRFRQPLPAPSQMAPTPTTGGPSPSTHGGSSPTTCAPPWLQEFLRMMGCERDVPALCRLLELLEEGQRLPAPPACPAEVHELMKLCWAPSPQDRPSFSALGPQLDMLWSGSRGCETHAFTAHPEGKHHSLSFS

SEQ ID NO: 912644 - protein, 57 aa, Homo sapiens
KKGRRTEKESVCRSVPLRGHSSLQNPLGPDYKGCLIRRSPTGTFLLVGLSRPHSSLR

SEQ ID NO: 912645 - protein, 280 aa, Homo sapiens
MAAVVALSLRRRLPATTLGGACLQASRGAQTAAATAPRIKKFAIYRWDPDKAGDKPHMQTYEVDLNKCGPMVLDALIKIKNEVDSTLTFRRSCREGICGSCAMNINGGNTLACTRRIDTNLNKVSKIYPLPHMYVIKDLVPDLSNFYAQYKSIEPYLKKKDESQEGKQQYLQSIEEREKLDGLYECILCACCSTSCPSYWWNGDKYLGPAVLMQAYRWMIDSRDDFTEERLAKLQDPFSLYRCHTIMNCTRTCPKGLNPGKAIAEIKKMMATYKEKKASV

SEQ ID NO: 912646 - protein, 280 aa, Homo sapiens; identical to SEQ ID NO: 912645

SEQ ID NO: 912647 - protein, 223 aa, Homo sapiens
MQTYEVDLNKCGPMVLDALIKIKNEVDSTLTFRRSCREGICGSCAMNINGGNTLACTRRIDTNLNKVSKIYPLPHMYVIKDLVPDLSNFYAQYKSIEPYLKKKDESQEGKQQYLQSIEEREKLDGLYECILCACCSTSCPSYWWNGDKYLGPAVLMQAYRWMIDSRDDFTEERLAKLQDPFSLYRCHTIMNCTRTCPKGLNPGKAIAEIKKMMATYKEKKASV

SEQ ID NO: 912648 - protein, 255 aa, Homo sapiens
MFSMETVKLKLSSPYKFAIYRWDPDKAGDKPHMQTYEVDLNKCGPMVLDALIKIKNEVDSTLTFRRSCREGICGSCAMNINGGNTLACTRRIDTNLNKVSKIYPLPHMYVIKDLVPDLSNFYAQYKSIEPYLKKKDESQEGKQQYLQSIEEREKLDGLYECILCACCSTSCPSYWWNGDKYLGPAVLMQAYRWMIDSRDDFTEERLAKLQDPFSLYRCHTIMNCTRTCPKGLNPGKAIAEIKKMMATYKEKKASV

SEQ ID NO: 912649 - protein, 132 aa, Homo sapiens
MAAVVALSLRRRLPATTLGGACLQASRGAQTAAATAPRIKKFAIYRWDPDKAGDKPHMQTYEVDLNKCGPMVLDALIKIKNEVDSTLTFRRSCREGEHFIPVGLQILVVFQRGLGWPKLIETSGKQLQLSAG

SEQ ID NO: 912650 - protein, 280 aa, Homo sapiens; identical to SEQ ID NO: 912645

SEQ ID NO: 912651 - protein, 369 aa, Homo sapiens
SRAFPPPTRETGSRLPLGCSYAASGSSVDVGWAPRCSTGHRRRATSGLRGGADVRSQDGGGGRTLLEAPVAGHNPWRSLPAVGTGFHHVGWAGLESLTQVISQPQPPKVLGLQASRGAQTAAATAPRIKKFAIYRWDPDKAGDKPHMQTYEVDLNKCGPMVLDALIKIKNEVDSTLTFRRSCREGICGSCAMNINGGNTLACTRRIDTNLNKVSKIYPLPHMYVIKDLVPDLSNFYAQYKSIEPYLKKKDESQEGKQQYLQSIEEREKLDGLYECILCACCSTSCPSYWWNGDKYLGPAVLMQAYRWMIDSRDDFTEERLAKLQDPFSLYRCHTIMNCTRTCPKGLNPGKAIAEIKKMMATYKEKKASV

SEQ ID NO: 912652 - protein, 127 aa, Homo sapiens
MAAVVALSLRRRLPATTLGGACLQASRGAQTAAATAPRIKKFAIYRWDPDKAGDKPHMQTYEVDLNKCGPMVLDALIKIKNEVDSTLTFRRSCREGICGSCAMNINGGNTLACTRRIDTNLNKVSKI

SEQ ID NO: 912653 - protein, 447 aa, Homo sapiens
MAGAGGGNDIQWCFSQVKGAVDDDVAEADIISTVEFNHSGELLATGDKGGRVVIFQQEQENKIQSHSRGEYNVYSTFQSHEPEFDYLKSLEIEEKINKIRWLPQKNAAQFLLSTNDKTIKLWKISERDKRPEGYNLKEEDGRYRDPTTVTTLRVPVFRPMDLMVEASPRRIFANAHTYHINSISINSDYETYLSADDLRINLWHLEITDRSFNIVDIKPANMEELTEVITAAEFHPNSCNTFVYSSSKGTIRLCDMRASALCDRHSKLFEEPEDPSNRSFFSEIISSISDVKFSHSGRYMMTRDYLSVKIWDLNMENRPVETYQVHEYLRSKLCSLYENDCIFDKFECCWNGSDSVVMTGSYNNFFRMFDRNTKRDITLEASRENNKPRTVLKPRKVCASGKRKKDEISVDSLDFNKKILHTAWHPKENIIAVATTNNLYIFQDKVN

SEQ ID NO: 912654 - protein, 285 aa, Homo sapiens
MVEASPRRIFANAHTYHINSISINSDYETYLSADDLRINLWHLEITDRSFNIVDIKPANMEELTEVITAAEFHPNSCNTFVYSSSKGTIRLCDMRASALCDRHSKLFEEPEDPSNRSFFSEIISSISDVKFSHSGRYMMTRDYLSVKIWDLNMENRPVETYQVHEYLRSKLCSLYENDCIFDKFECCWNGSDSVVMTGSYNNFFRMFDRNTKRDITLEASRENNKPRTVLKPRKVCASGKRKKDEISVDSLDFNKKILHTAWHPKENIIAVATTNNLYIFQDKVN

SEQ ID NO: 912655 - protein, 285 aa, Homo sapiens; identical to SEQ ID NO: 912654

SEQ ID NO: 912656 - protein, 204 aa, Homo sapiens
IRGPHCHARLCDMRASALCDRHSKLFEEPEDPSNRSFFSEIISSISDVKFSHSGRYMMTRDYLSVKIWDLNMENRPVETYQVHEYLRSKLCSLYENDCIFDKFECCWNGSDSVVMTGSYNNFFRMFDRNTKRDITLEASRENNKPRTVLKPRKVCASGKRKKDEISVDSLDFNKKILHTAWHPKENIIAVATTNNLYIFQDKVN

SEQ ID NO: 912657 - protein, 447 aa, Homo sapiens; identical to SEQ ID NO: 912653

SEQ ID NO: 912658 - protein, 285 aa, Homo sapiens
MAGAGGGNDIQWCFSQVKGAVDDDVAEADIISTVEFNHSGELLATGDKGGRVVIFQQEQENKIQSHSRGEYNVYSTFQSHEPEFDYLKSLEIEEKINKIRWLPQKNAAQFLLSTNDKTIKLWKISERDKRPEGYNLKEEDGRYRDPTTVTTLRVPVFRPMDLMVEASPRRIFANAHTYHINSISINSDYETYLSADDLRINLWHLEITDRSFNIVDIKPANMEELTEVITAAEFHPNSCNTFVYSSSKGTIRLCDMRASALCDRHSKCKFIVSFLKMITYSVCLK

SEQ ID NO: 912659 - protein, 461 aa, Homo sapiens
TQAVMFPKFSLRSMFHGAGGGNDIQWCFSQVKGAVDDDVAEADIISTVEFNHSGELLATGDKGGRVVIFQQEQENKIQSHSRGEYNVYSTFQSHEPEFDYLKSLEIEEKINKIRWLPQKNAAQFLLSTNDKTIKLWKISERDKRPEGYNLKEEDGRYRDPTTVTTLRVPVFRPMDLMVEASPRRIFANAHTYHINSISINSDYETYLSADDLRINLWHLEITDRSFNIVDIKPANMEELTEVITAAEFHPNSCNTFVYSSSKGTIRLCDMRASALCDRHSKLFEEPEDPSNRSFFSEIISSISDVKFSHSGRYMMTRDYLSVKIWDLNMENRPVETYQVHEYLRSKLCSLYENDCIFDKFECCWNGSDSVVMTGSYNNFFRMFDRNTKRDITLEASRENNKPRTVLKPRKVCASGKRKKDEISVDSLDFNKKILHTAWHPKENIIAVATTNNLYIFQDKVN

SEQ ID NO: 912660 - protein, 447 aa, Homo sapiens; identical to SEQ ID NO: 912653

SEQ ID NO: 912661 - protein, 447 aa, Homo sapiens; identical to SEQ ID NO: 912653

SEQ ID NO: 912662 - protein, 141 aa, Homo sapiens
MAGAGGGNDIQWCFSQVKGAVDDDVAEADIISTVEFNHSGELLATGDKGGRVVIFQQEQENKIQSHSRGEYNVYSTFQSHEPEFDYLKSLEIEEKINKIRWLPQKNAAQFLLSTNDKTIKLWKISERDKRPEGCQSLGLWI

SEQ ID NO: 912663 - protein, 727 aa, Homo sapiens
MRPLLLLALLGWLLLAEAKGDAKPEDNLLVLTVATKETEGFRRFKRSAQFFNYKIQALGLGEDWNVEKGTSAGGGQKVRLLKKALEKHADKEDLVILFADSYDVLFASGPRELLKKFRQARSQVVFSAEELIYPDRRLETKYPVVSDGKRFLGSGGFIGYAPNLSKLVAEWEGQDSDSDQLFYTKIFLDPEKREQINITLDHRCRIFQNLDGALDEVVLKFEMGHVRARNLAYDTLPVLIHGNGPTKLQLNYLGNYIPRFWTFETGCTVCDEGLRSLKGIGDEALPTVLVGVFIEQPTPFVSLFFQRLLRLHYPQKHMRLFIHNHEQHHKAQVEEFLAQHGSEYQSVKLVGPEVRMANADARNMGADLCRQDRSCTYYFSVDADVALTEPNSLRLLIQQNKNVIAPLMTRHGRLWSNFWGALSADGYYARSEDYVDIVQGRRVGVWNVPYISNIYLIKGSALRGELQSSDLFHHSKLDPDMAFCANIRQQDVFMFLTNRHTLGHLLSLDSYRTTHLHNDLWEVFSNPEDWKEKYIHQNYTKALAGKLVETPCPDVYWFPIFTEVACDELVEEMEHFGQWSLGNNKDNRIQGGYENVPTIDIHMNQIGFEREWHKFLLEYIAPMTEKLYPGYYTRAQFDLAFVVRYKPDEQPSLMPHHDASTFTINIALNRVGVDYEGGGCRFLRYNCSIRAPRKGWTLMHPGRLTHYHEGLPTTRGTRYIAVSFVDP

SEQ ID NO: 912664 - protein, 727 aa, Homo sapiens; identical to SEQ ID NO: 912663

SEQ ID NO: 912665 - protein, 727 aa, Homo sapiens; identical to SEQ ID NO: 912663

SEQ ID NO: 912666 - protein, 586 aa, Homo sapiens
MRPLLLLALLGWLLLAEAKGDAKPEDNLLVLTVATKETEGFRRFKRSAQFFNYKIQALGLGEDWNVEKGTSAGGGQKVRLLKKALEKHADKEDLVILFADSYDVLFASGPRELLKKFRQARSQVVFSAEELIYPDRRLETKYPVVSDGKRFLGSGGFIGYAPNLSKLVAEWEGQDSDSDQLFYTKIFLDPEKREQINITLDHRCRIFQNLDGALDEVVLKFEMGHVRARNLAYDTLPVLIHGNGPTKLQLNYLGNYIPRFWTFETGCTVCDEGLRSLKGIGDEALPTVLVGVFIEQPTPFVSLFFQRLLRLHYPQKHMRLFIHNHEQHHKAQVEEFLAQHGSEYQSVKLVGPEVRMANADARNMGADLCRQDRSCTYYFSVDADVALTEPNSLRLLIQQNKNVIAPLMTRHGRLWSNFWGALSADGYYARSEDYVDIVQGRRVGVWNVPYISNIYLIKGSALRGELQSSDLFHHSKLDPDMAFCANIRQQDVFMFLTNRHTLGHLLSLDSYRTTHLHNDLWEVFSNPEDWKEKYIHQNYTKALAGKLVETVRAMDTLLDQPCLLQGAGHRRETACPGEWGTAGWEL

SEQ ID NO: 912667 - protein, 244 aa, Homo sapiens
MRPLLLLALLGWLLLAEAKGDAKPEDNLLVLTVATKETEGFRRFKRSAQFFNYKIQALGLGEDWNVEKGTSAGGGQKVRLLKKALEKHADKEDLVILFADSYDVLFASGPRELLKKFRQARSQVVFSAEELIYPDRRLETKYPVVSDGKRFLGSGGFIGYAPNLSKLVAEWEGQDSDSDQLFYTKIFLDPEKREQINITLDHRCRIFQNLDGALAQGPASGWLVMEMLQRDHGMLVMNDANSLH

SEQ ID NO: 912668 - protein, 119 aa, Homo sapiens
MFSLLGSPRGRPIVPHTSAMRPLLLLALLGWLLLAEAKGDAKPEDNLLVLTVATKETEGFRRFKRSAQFFNYKIQALGLGEDWNVEKGTSAGGGQKVRLLKKALESGTSASMAGHESKP

SEQ ID NO: 912669 - protein, 727 aa, Homo sapiens; identical to SEQ ID NO: 912663

SEQ ID NO: 912670 - protein, 702 aa, Homo sapiens
MRPLLLLALLGWLLLAEAKGDAKPEDNLLVLTVATKETEGFRRFKRSAQFFNYKIQALGLGEDWNVEKGTSAGGGQKVRLLKKALEKHADKEDLVILFADSYDVLFASGPRELLKKFRQARSQVVFSAEELIYPDRRLETKYPVVSDGKRFLGSGGFIGYAPNLSKLVAEWEGQDSDSDQLFYTKIFLDPEKREQINITLDHRCRIFQNLDGALDEVVLKFEMGHVRARNLAYDTLPVLIHGNGPTKLQLNYLGNYIPRFWTFETGCTVCDEGLRSLKGIGRLLRLHYPQKHMRLFIHNHEQHHKAQVEEFLAQHGSEYQSVKLVGPEVRMANADARNMGADLCRQDRSCTYYFSVDADVALTEPNSLRLLIQQNKNVIAPLMTRHGRLWSNFWGALSADGYYARSEDYVDIVQGRRVGVWNVPYISNIYLIKGSALRGELQSSDLFHHSKLDPDMAFCANIRQQDVFMFLTNRHTLGHLLSLDSYRTTHLHNDLWEVFSNPEDWKEKYIHQNYTKALAGKLVETPCPDVYWFPIFTEVACDELVEEMEHFGQWSLGNNKDNRIQGGYENVPTIDIHMNQIGFEREWHKFLLEYIAPMTEKLYPGYYTRAQFDLAFVVRYKPDEQPSLMPHHDASTFTINIALNRVGVDYEGGGCRFLRYNCSIRAPRKGWTLMHPGRLTHYHEGLPTTRGTRYIAVSFVDP

SEQ ID NO: 912671 - protein, 727 aa, Homo sapiens; identical to SEQ ID NO: 912663

SEQ ID NO: 912672 - protein, 521 aa, Homo sapiens
MRPLLLLALLGWLLLAEAKGDAKPEDNLLVLTVATKETEGFRRFKRSAQFFNYKIQALGLGEDWNVEKGTSAGGGQKVRLLKKALEKHADKEDLVILFADSYDVLFASGPRELLKKFRQARSQVVFSAEELIYPDRRLETKYPVVSDGKRFLGSGGFIGYAPNLSKLVAEWEGQDSDSDQLFYTKIFLDPEKREQINITLDHRCRIFQNLDGALDEVVLKFEMGHVRARNLAYDTLPVLIHGNGPTKLQLNYLGNYIPRFWTFETGCTVCDEGLRSLKGIGDEALPTVLVGVFIEQPTPFVSLFFQRLLRLHYPQKHMRLFIHNHEQHHKAQVEEFLAQHGSEYQSVKLVGPEVRMANADARNMGADLCRQDRSCTYYFSVDADVALTEPNSLRLLIQQNKNVIAPLMTRHGRLWSNFWGALSADGYYARSEDYVDIVQGRRVGVWNVPYISNIYLITFSVDADVALTEPNSLRLLIQQNKNVIAPLMTRHGRLWSNFWGALSADGYYARSEDYVDIVQGR

SEQ ID NO: 912673 - protein, 199 aa, Homo sapiens
MRPLLLLALLGWLLLAEAKGDAKPEDNLLVLTVATKETEGFRRFKRSAQFFNYKIQALGLGEDWNVEKGTSAGGGQKVRLLKKALEKHADKEDLVILFADSYDVLFASGPRELLKKFRQARSQVVFSAEELIYPDRRLETKYPVVSDGKRFLGSGGFIGYAPNLSKLVAEWEGQDSDSDQLFYTKIFLDPEKRVSRLHS

SEQ ID NO: 912674 - protein, 585 aa, Homo sapiens
MGTWLCCLQPLCCSTPTLHCSKESSTSKVLVLWGQGCLGVQSCGCAPSAFFLPVPRCATDHNVDNTTEMLQEWLAAVGDDYAAVVWRPEGEPRFYPDEEGPKHWTKERHQFLMELKQEALTFARNWGADYILFADTDNILTNNQTLRLLMGQGLPVVAPMLDSQTYYSNFWCGITPQGYYRRTAEYFPTKNRQRRGCFRVPMVHSTFLASLRAEGADQLAFYPPHPNYTWPFDDIIVFAYACQAAGVSVHVCNEHRYGYMNVPVKSHQGLEDERVNFIHLILEALVDGPRMQASAHVTRPSKRPSKIGFDEVFVISLARRPDRRERMLASLWEMEISGRVVDAVDGWMLNSSAIRNLGVDLLPGYQDPYSGRTLTKGEVGCFLSHYSIWEEVVARGLARVLVFEDDVRFESNFRGRLERLMEDVEAEKLSWDLIYLGRKQVNPEKETAVEGLPGLVVAGYSYWTLAYALRLAGARKLLASQPLRRMLPVDEFLPIMFDQHPNEQYKAHFWPRDLVAFSAQPLLAAPTHYAGDAEWLSDTETSSPWDDDSGRLISWSGSQKTLRSPRLDLTGSSGHSLQPQPRDEL

SEQ ID NO: 912675 - protein, 585 aa, Homo sapiens; identical to SEQ ID NO: 912674

SEQ ID NO: 912676 - protein, 561 aa, Homo sapiens
PGSQSNLRLGTRLGGGQSCGCAPSAFFLPVPRCATDHNVDNTTEMLQEWLAAVGDDYAAVVWRPEGEPRFYPDEEGPKHWTKERHQFLMELKQEALTFARNWGADYILFADTDNILTNNQTLRLLMGQGLPVVAPMLDSQTYYSNFWCGITPQGYYRRTAEYFPTKNRQRRGCFRVPMVHSTFLASLRAEGADQLAFYPPHPNYTWPFDDIIVFAYACQAAGVSVHVCNEHRYGYMNVPVKSHQGLEDERVNFIHLILEALVDGPRMQASAHVTRPSKRPSKIGFDEVFVISLARRPDRRERMLASLWEMEISGRVVDAVDGWMLNSSAIRNLGVDLLPGYQDPYSGRTLTKGEVGCFLSHYSIWEEVVARGLARVLVFEDDVRFESNFRGRLERLMEDVEAEKLSWDLIYLGRKQVNPEKETAVEGLPGLVVAGYSYWTLAYALRLAGARKLLASQPLRRMLPVDEFLPIMFDQHPNEQYKAHFWPRDLVAFSAQPLLAAPTHYAGDAEWLSDTETSSPWDDDSGRLISWSGSQKTLRSPRLDLTGSSGHSLQPQPRDEL

SEQ ID NO: 912677 - protein, 558 aa, Homo sapiens
MGTWLCCLQPLCCSTPTLHCSKESSTSKVCATDHNVDNTTEMLQEWLAAVGDDYAAVVWRPEGEPRFYPDEEGPKHWTKERHQFLMELKQEALTFARNWGADYILFADTDNILTNNQTLRLLMGQGLPVVAPMLDSQTYYSNFWCGITPQGYYRRTAEYFPTKNRQRRGCFRVPMVHSTFLASLRAEGADQLAFYPPHPNYTWPFDDIIVFAYACQAAGVSVHVCNEHRYGYMNVPVKSHQGLEDERVNFIHLILEALVDGPRMQASAHVTRPSKRPSKIGFDEVFVISLARRPDRRERMLASLWEMEISGRVVDAVDGWMLNSSAIRNLGVDLLPGYQDPYSGRTLTKGEVGCFLSHYSIWEEVVARGLARVLVFEDDVRFESNFRGRLERLMEDVEAEKLSWDLIYLGRKQVNPEKETAVEGLPGLVVAGYSYWTLAYALRLAGARKLLASQPLRRMLPVDEFLPIMFDQHPNEQYKAHFWPRDLVAFSAQPLLAAPTHYAGDAEWLSDTETSSPWDDDSGRLISWSGSQKTLRSPRLDLTGSSGHSLQPQPRDEL

SEQ ID NO: 912678 - protein, 592 aa, Homo sapiens
TCLRLVTDTQFDPICGAARPLPFLLLSREAAEFFPSQQGPKDPGGAPGEPTSPALEDGRVGSQCATDHNVDNTTEMLQEWLAAVGDDYAAVVWRPEGEPRFYPDEEGPKHWTKERHQFLMELKQEALTFARNWGADYILFADTDNILTNNQTLRLLMGQGLPVVAPMLDSQTYYSNFWCGITPQGYYRRTAEYFPTKNRQRRGCFRVPMVHSTFLASLRAEGADQLAFYPPHPNYTWPFDDIIVFAYACQAAGVSVHVCNEHRYGYMNVPVKSHQGLEDERVNFIHLILEALVDGPRMQASAHVTRPSKRPSKIGFDEVFVISLARRPDRRERMLASLWEMEISGRVVDAVDGWMLNSSAIRNLGVDLLPGYQDPYSGRTLTKGEVGCFLSHYSIWEEVVARGLARVLVFEDDVRFESNFRGRLERLMEDVEAEKLSWDLIYLGRKQVNPEKETAVEGLPGLVVAGYSYWTLAYALRLAGARKLLASQPLRRMLPVDEFLPIMFDQHPNEQYKAHFWPRDLVAFSAQPLLAAPTHYAGDAEWLSDTETSSPWDDDSGRLISWSGSQKTLRSPRLDLTGSSGHSLQPQPRDEL

SEQ ID NO: 912679 - protein, 585 aa, Homo sapiens; identical to SEQ ID NO: 912674

SEQ ID NO: 912680 - protein, 627 aa, Homo sapiens
MGTWLCCLQPLCCSTPTLHCSKESSTSKVLVLWGQGCLGVQSCGCAPSAFFLPVPRCATDHNVDNTTEMLQEWLAAVGDDYAAVVWRPEGEPRFYPDEEGPKHWTKERHQFLMELKQEALTFARNWGADYILFADTDNILTNNQTLRLLMGQGLPVVAPMLDSQTYYSNFWCGITPQGYYRRTAEYFPTKNRQRRGCFRVPMVHSTFLASLRAEGADQLAFYPPHPNYTWPFDDIIVFAYACQAAATQEAEAGELLNLGDRGCNEPRSHHCTPASVTEQDSISKKKKGVSVHVCNEHRYGYMNVPVKSHQGLEDERVNFIHLILEALVDGPRMQASAHVTRPSKRPSKIGFDEVFVISLARRPDRRERMLASLWEMEISGRVVDAVDGWMLNSSAIRNLGVDLLPGYQDPYSGRTLTKGEVGCFLSHYSIWEEVVARGLARVLVFEDDVRFESNFRGRLERLMEDVEAEKLSWDLIYLGRKQVNPEKETAVEGLPGLVVAGYSYWTLAYALRLAGARKLLASQPLRRMLPVDEFLPIMFDQHPNEQYKAHFWPRDLVAFSAQPLLAAPTHYAGDAEWLSDTETSSPWDDDSGRLISWSGSQKTLRSPRLDLTGSSGHSLQPQPRDEL

SEQ ID NO: 912681 - protein, 586 aa, Homo sapiens
MGTWLCCLQPLCCSTPTLHCSKESSTSKVLVLWGQGCLGVQSCGCAPSAFFLPVPRCATDHNVDNTTEMLQEWLAAVGDDYAAVVWRPEGEPRFYPDEEGPKHWTKERHQFLMELKQEALTFARNWGADYILFADTDNILTNNQTLRLLMGQGLPVVAPMLDSQTYYSNFWCGITPQGYYRRTAEYFPTKNRQRRGCFRVPMVHSTFLASLRAEGADQLAFYPPHPNYTWPFDDIIVFAYACQAAGVSVHVCNEHRYGYMNVPVKSHQGLEDERVNFIHLILEALVDGPRMQASAHVTRPSKRPSKIGFDEVFVISLARRPDRRERMLASLWEMEISGRVVDAVDGWMLNSSAIRNLGVDLLPGYQDPYSGRTLTKGEVGCFLSHYSIWEEVVARGLARVLVFEDDVRFESNFRGRLERLMEDVEAEKLSWDLIYLGRKQVNPEKETAVEGLPGLVVAGYSYWTLAYALRLAGARKLLASQPLRRMLPVDEFLPIMFDQHPNEQYKAHFWPRDLVAFSAQPLLAAPTHYAGDAEWLSDTETSSPWDDDSGRLISWSVQKTWGPLTDGGGKLTTSRRTSQEDGSGGS

SEQ ID NO: 912682 - protein, 552 aa, Homo sapiens
MRAARAAPLLQLLLLLGPWLEAAGVAESPLPAVVLAILARNAEHSLPHYLGALERLDYPRARMALWCATDHNVDNTTEMLQEWLAAVGDDYAAVVWRPEGEPRFYPDEEGPKHWTKERHQFLMELKQEALTFARNWGADYILFADTDNILTNNQTLRLLMGQGLPVVAPMLDSQTYYSNFWCGITPQGYYRRTAEYFPTKNRQRRGCFRVPMVHSTFLASLRAEGADQLAFYPPHPNYTWPFDDIIVFAYACQAAGVSVHVCNEHRYGYMNVPVKSHQGLEDERVNFIHLILEALVDGPRMQASAHVTRPSKRPSKIGFDEVFVISLARRPDRRERMLASLWEMEISGRVVDAVDGWMLNSSAIRNLGVDLLPGYQDPYSGRTLTKGEVGCFLSHYSIWEEVVARGLARVLVFEDDVRFESNFRGRLERLMEDVEAEKLSWDLIPTGRWPMPCVWRVPASCWPHSLCAACCPWTSSCPSCSTSTPTSSTRHTSGHGTWWPSPPSPCSLPLPTMPGTPSGSVTRRHPLHGMMTAAASSAGAAPKRPCAAPAWT

SEQ ID NO: 912683 - protein, 196 aa, Homo sapiens
MSPYCSRTPGRPRRTRPSTPPLSGPPAPPPSPLRGPAGRGCSRVAAGAGPRALALRCPGPRRENLSIHAQGWGAGSHSEGALPRPLRVCLGPARAPGPAPSPRPARELRGPLQPPKRPPCALPAPRRCSSCCSCWGRGWRLRALRSRRCPPWSLPSWPAMPNTRCPTTWALWSGWTTPGPGWPSGERPGHWHRVGT

SEQ ID NO: 912684 - protein, 437 aa, Homo sapiens
MRAARAAPLLQLLLLLGPWLEAAGVAESPLPAVVLAILARNAEHSLPHYLGALERLDYPRARMALWCATDHNVDNTTEMLQEWLAAVGDDYAAVVWRPEGEPRFYPDEEGPKHWTKERHQFLMELKQEALTFARNWGADYILFADTDNILTNNQTLRLLMGQGLPVVAPMLDSQTYYSNFWCGITPQGYYRRTAEYFPTKNRQRRGCFRVPMVHSTFLASLRAEGADQLAFYPPHPNYTWPFDDIIVFAYACQAAGVSVHVCNEHRYGYMNVPVKSHQGLEDERVNFIHLILEALVDGPRMQASAHVTRPSKRPSKIGFDEVFVISLARRPDRRERMLASLWEMEISGRVVDAVDGWMLNSSAIRNLGVDLLPGYQDPYSGRTLTKGEVGCFLSHYSIWEEVVARGLARVLVFEDDVRFESNFRGRLERLMEDRHAP

SEQ ID NO: 912685 - protein, 276 aa, Homo sapiens
MRAARAAPLLQLLLLLGPWLEAAGVAESPLPAVVLAILARNAEHSLPHYLGALERLDYPRARMALWCATDHNVDNTTEMLQEWLAAVGDDYAAVVWRPEGEPRFYPDEEGPKHWTKERHQFLMELKQEALTFARNWGADYILFADTDNILTNNQTLRLLMGQGLPVVAPMLDSQTYYSNFWCGITPQGYYRRTAEYFPTKNRQRRGCFRVPMVHSTFLASLRAEGADQLAFYPPHPNYTWPSQKNDHSRLRPIALQGLNGEYPVPPVIQPTDPIIG

SEQ ID NO: 912686 - protein, 321 aa, Homo sapiens
PGSQSNLRLGTRLGGGSAEGHFIHLILEALVDGPRMQASAHVTRPSKRPSKIGFDEVFVISLARRPDRRERMLASLWEMEISGRVVDAVDGWMLNSSAIRNLGVDLLPGYQDPYSGRTLTKGEVGCFLSHYSIWEEVVARGLARVLVFEDDVRFESNFRGRLERLMEDVEAEKLSWDLIYLGRKQVNPEKETAVEGLPGLVVAGYSYWTLAYALRLAGARKLLASQPLRRMLPVDEFLPIMFDQHPNEQYKAHFWPRDLVAFSAQPLLAAPTHYAGDAEWLSDTETSSPWDDDSGPQEERFKNLEPAGLWEGKHQRKSGMK

SEQ ID NO: 912687 - protein, 595 aa, Homo sapiens
MRAARAAPLLQLLLLLGPWLEAAGVAESPLPAVVLAILARNAEHSLPHYLGALERLDYPRARMALWCATDHNVDNTTEMLQEWLAAVGDDYAAVVWRPEGEPRFYPDEEGPKHWTKERHQFLMELKQEALTFARNWGADYILFADTDNILTNNQTLRLLMGQGLPVVAPMLDSQTYYSNFWCGITPQGYYRRTAEYFPTKNRQRRGCFRVPMVHSTFLASLRAEGADQLAFYPPHPNYTWPFDDIIVFAYACQAAGVSVHVCNEHRYGYMNVPVKSHQGLEDERVNFIHLILEALVDGPRMQASAHVTRPSKRPSKIGFDEVFVISLARRPDRRERMLASLWEMEISGRVVDAVDGWMLNSSAIRNLGVDLLPGYQDPYSGRTLTKGEVGCFLSHYSIWEEVVARGLARVLVFEDDVRFESNFRGRLERLMEDVEAEKLSWDLIYLGRKQVNPEKETAVEGLPGLVVAGYSYWTLAYALRLAGARKLLASQPLRRMLPVDEFLPIMFDQHPNEQYKAHFWPRDLVAFSAQPLLAAPTHYAGDAEWLSDTETSSPWDDDSGRLISWSGSQKTLRSPRLDLTGSSGHSLQPQPRDEL

SEQ ID NO: 912688 - protein, 555 aa, Homo sapiens
MLWGQGCLGVQSCGCAPSAFFLPVPRCATDHNVDNTTEMLQEWLAAVGDDYAAVVWRPEGEPRFYPDEEGPKHWTKERHQFLMELKQEALTFARNWGADYILFADTDNILTNNQTLRLLMGQGLPVVAPMLDSQTYYSNFWCGITPQGYYRRTAEYFPTKNRQRRGCFRVPMVHSTFLASLRAEGADQLAFYPPHPNYTWPFDDIIVFAYACQAAGVSVHVCNEHRYGYMNVPVKSHQGLEDERVNFIHLILEALVDGPRMQASAHVTRPSKRPSKIGFDEVFVISLARRPDRRERMLASLWEMEISGRVVDAVDGWMLNSSAIRNLGVDLLPGYQDPYSGRTLTKGEVGCFLSHYSIWEEVVARGLARVLVFEDDVRFESNFRGRLERLMEDVEAEKLSWDLIYLGRKQVNPEKETAVEGLPGLVVAGYSYWTLAYALRLAGARKLLASQPLRRMLPVDEFLPIMFDQHPNEQYKAHFWPRDLVAFSAQPLLAAPTHYAGDAEWLSDTETSSPWDDDSGRLISWSGSQKTLRSPRLDLTGSSGHSLQPQPRDEL

SEQ ID NO: 912689 - protein, 517 aa, Homo sapiens
MLQEWLAAVGDDYAAVVWRPEGEPRFYPDEEGPKHWTKERHQFLMELKQEALTFARNWGADYILFADTDNILTNNQTLRLLMGQGLPVVAPMLDSQTYYSNFWCGITPQGYYRRTAEYFPTKNRQRRGCFRVPMVHSTFLASLRAEGADQLAFYPPHPNYTWPFDDIIVFAYACQAAGVSVHVCNEHRYGYMNVPVKSHQGLEDERVNFIHLILEALVDGPRMQASAHVTRPSKRPSKIGFDEVFVISLARRPDRRERMLASLWEMEISGRVVDAVDGWMLNSSAIRNLGVDLLPGYQDPYSGRTLTKGEVGCFLSHYSIWEEVVARGLARVLVFEDDVRFESNFRGRLERLMEDVEAEKLSWDLIYLGRKQVNPEKETAVEGLPGLVVAGYSYWTLAYALRLAGARKLLASQPLRRMLPVDEFLPIMFDQHPNEQYKAHFWPRDLVAFSAQPLLAAPTHYAGDAEWLSDTETSSPWDDDSGRLISWSGSQKTLRSPRLDLTGSSGHSLQPQPRDEL

SEQ ID NO: 912690 - protein, 534 aa, Homo sapiens [sequence omitted]

SEQ ID NO: 912691 - protein, 439 aa, Homo sapiens
MVDLEYHGGEKLVHHLVQTYYSNFWCGITPQGYYRRTAEYFPTKNRQRRGCFRVPMVHSTFLASLRAEGADQLAFYPPHPNYTWPFDDIIVFAYACQAAGVSVHVCNEHRYGYMNVPVKSHQGLEDERVNFIHLILEALVDGPRMQASAHVTRPSKRPSKIGFDEVFVISLARRPDRRERMLASLWEMEISGRVVDAVDGWMLNSSAIRNLGVDLLPGYQDPYSGRTLTKGEVGCFLSHYSIWEEVVARGLARVLVFEDDVRFESNFRGRLERLMEDVEAEKLSWDLIYLGRKQVNPEKETAVEGLPGLVVAGYSYWTLAYALRLAGARKLLASQPLRRMLPVDEFLPIMFDQHPNEQYKAHFWPRDLVAFSAQPLLAAPTHYAGDAEWLSDTETSSPWDDDSGRLISWSGSQKTLRSPRLDLTGSSGHSLQPQPRDEL

SEQ ID NO: 912692 - protein, 586 aa, Homo sapiens
MRAARAAPLLQLLLLLGPWLEAAGVAESPLPAVVLAILARNAEHSLPHYLGALERLDYPRARMALWCATDHNVDNTTEMLQEWLAAVGDDYAAVVWRPEGEPRFYPDEEGPKHWTKERHQFLMELKQEALTFARNWGADYILFADTDNILTNNQTLRLLMGQGLPVVAPMLDSQTYYSNFWCGITPQGYYRRTAEYFPTKNRQRRGCFRVPMVHSTFLASLRAEGADQLAFYPPHPNYTWPFDDIIVFAYACQAAGVSVHVCNEHRYGYMNVPVKSHQGLEDERVNFIHLILEALVDGPRMQASAHVTRPSKRPSKIGFDEVFVISLARRPDRRERMLASLWEMEISGRVVDAVDGWMLNSSAIRNLGVDLLPGYQDPYSGRTLTKGEVGCFLSHYSIWEEVVARGLARVLVFEDDVRFESNFRGRLERLMEDVEAEKLSWDLIYLGRKQVNPEKETAVEGLPGLVVAGYSYWTLAYALRLAGARKLLASQPLRRMLPVDEFLPIMFDQHPNEQYKAHFWPRDLVAFSAQPLLAAPTHYAGDAEWLSDTETSSPWDDDSGPQEERFKNLEPAGLWEGKHQRKSGMK

SEQ ID NO: 912693 - protein, 436 aa, Homo sapiens
MRAARAAPLLQLLLLLGPWLEAAGVAESPLPAVVLAILARNAEHSLPHYLGALERLDYPRARMALWCATDHNVDNTTEMLQEWLAAVGDDYAAVVWRPEGEPRFYPDEEGPKHWTKERHQFLMELKQEALTFARNWGADYILFADTDNILTNNQTLRLLMGQGLPVVAPMLDSQTYYSNFWCGITPQGYYRRTAEYFPTKNRQRRGCFRVPMVHSTFLASLRAEGADQLAFYPPHPNYTWPFDDIIVFAYACQAAGVSVHVCNEHRYGYMNVPVKSHQGLEDERVNFIHLILEALVDGPRMQASAHVTRPSKRPSKIGFDEVFVISLARRPDRRERMLASLWEMEISGRVVDAVDGWMLNSSAIRNLGVDLLPGYQDPYSGRTLTKGEVGCFLSHYSIWEERAVQGTLLATGPGGLLRPAPARCPYPLCRGRRVAQ

SEQ ID NO: 912694 - protein, 508 aa, Homo sapiens
MRAARAAPLLQLLLLLGPWLEAAGVAESPLPAVVLAILARNAEHSLPHYLGALERLDYPRARMALWCATDHNVDNTTEMLQEWLAAVGDDYAAVVWRPEGEPRFYPDEEGPKHWTKERHQFLMELKQEALTFARNWGADYILFADTDNILTNNQTLRLLMGQGLPVVAPMLDSQTYYSNFWCGITPQGYYRRTAEYFPTKNRQRRGCFRVPMVHSTFLASLRAEGADQLAFYPPHPNYTWPFDDIIVFAYACQAAGVSVHVCNEHRYGYMNVPVKSHQGLEDERVNFIHLILEALVDGPRMQASAHVTRPSKRPSKIGFDEVFVISLARRPDRRERMLASLWEMEISGRVVDAVDGWMLNSSAIRNLGVDLLPGYQDPYSGRTLTKGEVGCFLSHYSIWEEVAHGALGPWSCAAVERLTMPLIESNTFRGATESRLALDGCEHGSRKSACRGERCFLDIRDLEKRRVIYAASKEHRTECCRGSTGGPCECEWTSVEYIAYHGNGVSRN

SEQ ID NO: 912695 - protein, 68 aa, Homo sapiens
RKQVNPEKETAVEGLPGLVVAGYSYWTLAYALRLAGARKLLASQPLRRMLPVDEFLPIMFDQHPKLRL

SEQ ID NO: 912696 - protein, 764 aa, Homo sapiens
AGAGFAERRAAAAEPDVCAKMAGRSMQAARCPTDELSLTNCAVVNEKDFQSGQHVIVRTSPNHRYTFTLKTHPSVVPGSIAFSLPQRKWAGLSIGQEIEVSLYTFDKAKQCIGTMTIEIDFLQKKSIDSNPYDTDKMAAEFIQQFNNQAFSVGQQLVFSFNEKLFGLLVKDIESMDPSILKGEPATGKRQKIEVGLVVGNSQVAFEKAENSSLNLIGKAKTKENRQSIINPDWNFEKMGIGGLDKEFSDIFRRAFASRVFPPEIVEQMGCIHVKGILLYGPPGCGKTLLARQIGKMLNAREPKVVNGPEILNKYVGESEANIRKLFADAEEEQRRLGANSGLHIIIFDEIDAICKQRGSMAGSTGVHDTVVNQLLSKIDGVEQLNNILVIGMTNRPDLIDEALLRPGRLEVKMEIGLPDEKGRLQILHIHTARMRGHQLLSADVDIKELAVETKNFSGAELEGLVRAAQSTAMNRHIKASTKVEVDMEKAESLQVTRGDFLASLENDIKPAFGTNQEDYASYIMNGIIKWGDPVTRVLDDGELLVQQTKNSDRTPLVSVLLEGPPHSGKTALAAKIAEESNFPFIKICSPDKMIGFSETAKCQAMKKIFDDAYKSQLSCVVVDDIERLLDYVPIGPRFSNLVLQALLVLLKKAPPQGRKLLIIGTTSRKDVLQEMEMLNAFSTTIHVPNIATGEQLLEALELLGNFKDKERTTIAQQVKGKKVWIGIKKLLMLIEMSLQMDPEYRVRKFLALLREEGASPLDFD

SEQ ID NO: 912697 - protein, 764 aa, Homo sapiens; identical to SEQ ID NO: 912696

SEQ ID NO: 912698 - protein, 764 aa, Homo sapiens; identical to SEQ ID NO: 912696

SEQ ID NO: 912699 - protein, 96 aa, Homo sapiens
AGAGFAERRAAAAEPDVCAKMAGRSMQAARCPTDELSLTNCAVVNEKDFQSGQHVIVRTSPNHRYTFTLKTHPSVVPGSIAFSLPQMTTVLVVTSP

SEQ ID NO: 912700 - protein, 764 aa, Homo sapiens; identical to SEQ ID NO: 912696

SEQ ID NO: 912701 - protein, 764 aa, Homo sapiens; identical to SEQ ID NO: 912696

SEQ ID NO: 912702 - protein, 764 aa, Homo sapiens; identical to SEQ ID NO: 912696

SEQ ID NO: 912703 - protein, 764 aa, Homo sapiens; identical to SEQ ID NO: 912696

SEQ ID NO: 912704 - protein, 139 aa, Homo sapiens
MQAARCPTDELSLTNCAVVNEKDFQSGQHVIVRTSPNHRYTFTLKTHPSVVPGSIAFSLPQRKWAGLSIGQEIEVSLYTFDKAKQCIGTMTIEIDFLQKKSIDSNPYDTDKMAAEFIQQFNNQAFSVGQQVVFNFLSFL

SEQ ID NO: 912705 - protein, 45 aa, Homo sapiens
HSGSLGMGPMATELEPLCTPVVTCTPSCTAYTSSFVFGSFGDPLE

SEQ ID NO: 912706 - protein, 135 aa, Homo sapiens
KQWLRRLVLEPHLQRATEKPRLSRRPRRSERAVTVLLPSSASQRPPVSAPRPLARLCLTATMMFSGFNADYEASSSRCSSASPAGDSLSYYHSPADSFSSMGSPVNAQVRLASRRRGAGGLGSRRRRHRAGRSSR

SEQ ID NO: 912707 - protein, 145 aa, Homo sapiens
MMFSGFNADYEASSSRCSSASPAGDSLSYYHSPADSFSSMGSPVNAQDFCTDLAVSSANFIPTVTVLPAALLTRLPSSSPTPRLTPSPAVQLPTARAAAAMSLPLTRSAHPRCWPCEGAGKGRQPAPTSATARAGALQRGETHLP

SEQ ID NO: 912708 - protein, 207 aa, Homo sapiens
MMFSGFNADYEASSSRCSSASPAGDSLSYYHSPADSFSSMGSPVNAQDFCTDLAVSSANFIPTVTAISTSPDLQWLVQPALVSSVAPSQTRAPHPFGVPAPSAGAYSRAGVVKTMTGGRAQSIGRRGKVEQLSPEEEEKRRIRRERNKMAAAKCRNRRRELTDTLQAETDQLEDEKSALQTGDCQPAEGEGKTRVHPGSSPTCLQDP

SEQ ID NO: 912709 - protein, 170 aa, Homo sapiens
MMFSGFNADYEASSSRCSSASPAGDSLSYYHSPADSFSSMGSPVNAQDFCTDLAVSSANFIPTVTAISTSPDLQWLVQPALVSSVAPSQTRAPHPFGVPAPSAGAYSRAGVVKTMTGGRAQSIGRRGKVEQVRNSSVLFLGMWGLGGKQPRRCRSPVQRMKPLMGLAAHP

SEQ ID NO: 912710 - protein, 170 aa, Homo sapiens; identical to SEQ ID NO: 912709

SEQ ID NO: 912711 - protein, 170 aa, Homo sapiens; identical to SEQ ID NO: 912709

SEQ ID NO: 912712 - protein, 74 aa, Homo sapiens
HSGSLGMGPMATELEPLCTPVVTCTPSCTAYTSSFVFTYPEADSFPSCAAAHRKGSSSNEPSSDSLSSPTLLAL

SEQ ID NO: 912713 - protein, 207 aa, Homo sapiens; identical to SEQ ID NO: 912708

SEQ ID NO: 912714 - protein, 74 aa, Homo sapiens; identical to SEQ ID NO: 912712

SEQ ID NO: 912715 - protein, 117 aa, Homo sapiens
MRHWELAPPVSGTCSLTSAFPFCFVLGLLHGPGRLQCQLHSHGHCHLDQSGPAVAGAARPRLLCGPIADQSPSPFRSPRPLRWGLLQGWRCEDHDRRPSAEHWQEGQGGTGDRPTRR

SEQ ID NO: 912716 - protein, 76 aa, Homo sapiens
KQWLRRLVLEPHLQRATEKPRLSRRPRRSERAVTVLLPSSASQRPPVYLQKKKRKGESEGKGIRWLQPNAATGGGS

SEQ ID NO: 912717 - protein, 79 aa, Homo sapiens
PETEDHLMEMNLRVLQAPEAEVSLCSHMEHPILRLPVARDTSVWGPPVLSQSRITSRMQPPEEPRVSIPASLTLQRAGS

SEQ ID NO: 912718 - protein, 207 aa, Homo sapiens; identical to SEQ ID NO: 912708

SEQ ID NO: 912719 - protein, 207 aa, Homo sapiens; identical to SEQ ID NO: 912708

SEQ ID NO: 912720 - protein, 74 aa, Homo sapiens; identical to SEQ ID NO: 912712

SEQ ID NO: 912721 - protein, 170 aa, Homo sapiens; identical to SEQ ID NO: 912709

SEQ ID NO: 912722 - protein, 74 aa, Homo sapiens; identical to SEQ ID NO: 912712

SEQ ID NO: 912723 - protein, 66 aa, Homo sapiens
KQWLRRLVLEPHLQRATEKPRLSRRPRRSERAVTVSFPSCAAAHRKGSSSNEPSSDSLSSPTLLAL

SEQ ID NO: 912724 - protein, 265 aa, Homo sapiens
MMFSGFNADYEASSSRCSSASPAGDSLSYYHSPADSFSSMGSPVNAQDFCTDLAVSSANFIPTVTAISTSPDLQWLVQPALVSSVAPSQTRAPHPFGVPAPSAGAYSRAGVVKTMTGGRAQSIGRRGKVEQLSPEEEEKRRIRRERNKMAAAKCRNRRRELTDTLQAETDQLEDEKSALQTGDCQPAEGEGPGLPRRDVCGLPLILTGGLPEVATPESEEAFTLPLLNDPEAQALRGTCQEHQEHGAEDRSPLMTSCSHDTSESW

SEQ ID NO: 912725 - protein, 114 aa, Homo sapiens
MRHWELAPPVSGTCSLTSAFPFCFVLGLLHGPGRLQCQLHSHGHCHLDQSGPAVAGAARPRLLCGPIADQSPSPFRSPRPLRWGLLQGWRCEDHDRRPSAEHWQEGQGGTGEEL

SEQ ID NO: 912726 - protein, 74 aa, Homo sapiens; identical to SEQ ID NO: 912712

SEQ ID NO: 912727 - protein, 170 aa, Homo sapiens; identical to SEQ ID NO: 912709

SEQ ID NO: 912728 - protein, 74 aa, Homo sapiens; identical to SEQ ID NO: 912712

SEQ ID NO: 912729 - protein, 100 aa, Homo sapiens
GWLEDPKRPEDYFSSIGRRGKVEQLSPEEEEKRRIRRERNKMAAAKCRNRRRELTDTLQAETDQLEDEKSALQTGDCQPAEGEGKTRVHPGSSPTCLQDP

SEQ ID NO: 912730 - protein, 93 aa, Homo sapiens
SRGSRLSKLAGGAGLEQLSPEEEEKRRIRRERNKMAAAKCRNRRRELTDTLQAETDQLEDEKSALQTGDCQPAEGEGKTRVHPGSSPTCLQDP

SEQ ID NO: 912731 - protein, 135 aa, Homo sapiens; identical to SEQ ID NO: 912706

SEQ ID NO: 912732 - protein, 74 aa, Homo sapiens; identical to SEQ ID NO: 912712

SEQ ID NO: 912733 - protein, 188 aa, Homo sapiens
MMFSGFNADYEASSSRCSSASPAGDSLSYYHSPADSFSSMGSPVNAQDFCTDLAVSSANFIPTVTAISTSPDLQWLVQPALVSSVAPSQTRAPHPFGVPAPSAGAYSRAGVVKTMTGGRAQSIGRRGKVEQLSPEEEEKRRIRRERNKMAAAKCRNRRRELTDTLQARKAWNRCSFQPPEGANAAPSG

SEQ ID NO: 912734 - protein, 170 aa, Homo sapiens; identical to SEQ ID NO: 912709

SEQ ID NO: 912735 - protein, 669 aa, Homo sapiens
GSVDGHYQSRNRSRACIPHHPPAPGPGRRQTELPPPPPQQQQSGSQAQPGPREAGAPGPWMSRSAAASGGPRRPERHLPPAPCGAPGPPETCRTEPDGAGTMNKLRQSLRRRKPAYVPEASRPHQWQADEDAVRKGTCSFPVRYLGHVEVEESRGMHVCEDAVKKLKAMGRKSVKSVLWVSADGLRVVDDKTKDLLVDQTIEKVSFCAPDRNLDKAFSYICRDGTTRRWICHCFLALKDSGERLSHAVGCAFAACLERKQRREKECGVTAAFDASRTSFAREGSFRLSGGGRPAEREAPDKKKAEAAAAPTVAPGPAQPGHVSPTPATTSPGEKGEAGTPVAAGTTAAAIPRRHAPLEQLVRQGSFRGFPALSQKNSPFKRQLSLRLNELPSTLQRRTDFQVKGTVPEMEPPGAGDSDSINALCTQISSSFASAGAPAPGPPPATTGTSAWGEPSVPPAAAFQPGHKRTPSEAERWLEEVSQVAKAQQQQQQQQQQQQQQQQQQQQAASVAPVPTMPPALQPFPAPVGPFDAAPAQVAVFLPPPHMQPPFVPAYPGLGYPPMPRVPVVGITPSQMVANAFCSAAQLQPQPATLLGKAGAFPPPAIPSAPGSQARPRPNGAPWPPEPAPAPAPELDPFEAQWAALEGKATVEKPSNPFSGDLQKTFEIEL

SEQ ID NO: 912736 - protein, 135 aa, Homo sapiens
PPNFHRGQFMDRNYPSAGFGDPLGAGAGWSYERSAKASLVYGSSRTSHPETDILHRQAYAAPHPLQSYATNHHPAGLSGLFDTGLHHAGSAGPDASVMNLISALESRGPQPGPSASSLLSQFRSPSWQTGMHSAR

SEQ ID NO: 912737 - protein, 666 aa, Homo sapiens
RNPPGSRGGSRACIPHHPPAPGPGRRQTELPPPPPQQQQSGSQAQPGPREAGAPGPWMSRSAAASGGPRRPERHLPPAPCGAPGPPETCRTEPDGAGTMNKLRQSLRRRKPAYVPEASRPHQWQADEDAVRKGTCSFPVRYLGHVEVEESRGMHVCEDAVKKLKAMGRKSVKSVLWVSADGLRVVDDKTKDLLVDQTIEKVSFCAPDRNLDKAFSYICRDGTTRRWICHCFLALKDSGERLSHAVGCAFAACLERKQRREKECGVTAAFDASRTSFAREGSFRLSGGGRPAEREAPDKKKAEAAAAPTVAPGPAQPGHVSPTPATTSPGEKGEAGTPVAAGTTAAAIPRRHAPLEQLVRQGSFRGFPALSQKNSPFKRQLSLRLNELPSTLQRRTDFQVKGTVPEMEPPGAGDSDSINALCTQISSSFASAGAPAPGPPPATTGTSAWGEPSVPPAAAFQPGHKRTPSEAERWLEEVSQVAKAQQQQQQQQQQQQQQQQQQQQAASVAPVPTMPPALQPFPAPVGPFDAAPAQVAVFLPPPHMQPPFVPAYPGLGYPPMPRVPVVGITPSQMVANAFCSAAQLQPQPATLLGKAGAFPPPAIPSAPGSQARPRPNGAPWPPEPAPAPAPELDPFEAQWAALEGKATVEKPSNPFSGDLQKTFEIEL

SEQ ID NO: 912738 - protein, 666 aa, Homo sapiens; identical to SEQ ID NO: 912737

SEQ ID NO: 912739 - protein, 666 aa, Homo sapiens; identical to SEQ ID NO: 912737

SEQ ID NO: 912740 - protein, 666 aa, Homo sapiens
RNPPGSRGGSRACIPHHPPAPGPGRRQTELPPPPPQQQQSGSQAQPGPREAGAPGPWMSRSAAASGGPRRPERHLPPAPCGAPGPPETCRTEPDGAGTMNKLRQSLRRRKPAYVPEASRPHQWQADEDAVRKGTCSFPVRYLGHVEVEESRGMHVCEDAVKKLKAMGRKSVKSVLWVSADGLRVVDDKTKDLLVDQTIEKVSFCAPDRNLDKAFSYICRDGTTRRWICHCFLALKDSGERLSHAVGCAFAACLERKQRREKECGVTAAFDASRTSFAREGSFRLSGGGRPAEREAPDKKKAEAAAAPTVAPGPAQPGHVSPTPATTSPGEKGEAGTPVAAGTTAAAIPRRHAPLEQLVRQGSFRGFPALSQKNSPFKRQLSLRLNELPSTLQRRTDFQVKGTVPEMEPPGAGDSDSINALCTQISSSFASAGAPAPGPPPATTGTSAWGEPSVPPAAAFQPGHKRTPSEAERWLEEVSQVAKAQQQQQQQQQQQQQQQQQQQQAASVAPVPTMPPALQPFPAPVGPFDAAPAQVAVFLPPPHMQPPFVPAYPGLGYPPMPRVPVVGITPSQMVANAFCSAAQLQPQPATLLGKAGAFPPPAIPSAPGSQARPRPNGAPWPPEPAPAPAPELDPFEAQWAALEGKATVEKAAFPLSLPFKHRLRFGL

SEQ ID NO: 912741 - protein, 568 aa, Homo sapiens
MNKLRQSLRRRKPAYVPEASRPHQWQADEDAVRKGTCSFPVRYLGHVEVEESRGMHVCEDAVKKLKAMGRKSVKSVLWVSADGLRVVDDKTKDLLVDQTIEKVSFCAPDRNLDKAFSYICRDGTTRRWICHCFLALKDSGERLSHAVGCAFAACLERKQRREKECGVTAAFDASRTSFAREGSFRLSGGGRPAEREAPDKKKAEAAAAPTVAPGPAQPGHVSPTPATTSPGEKGEAGTPVAAGTTAAAIPRRHAPLEQLVRQGSFRGFPALSQKNSPFKRQLSLRLNELPSTLQRRTDFQVKGTVPEMEPPGAGDSDSINALCTQISSSFASAGAPAPGPPPATTGTSAWGEPSVPPAAAFQPGHKRTPSEAERWLEEVSQVAKAQQQQQQQQQQQQQQQQQQQQAASVAPVPTMPPALQPFPAPVGPFDAAPAQVAVFLPPPHMQPPFVPAYPGLGYPPMPRVPVVGITPSQMVANAFCSAAQLQPQPATLLGKAGAFPPPAIPSAPGSQARPRPNGAPWPPEPAPAPAPELDPFEAQWAALEGKATVEKPSNPFSGDLQKTFEIEL

SEQ ID NO: 912742 - protein, 666 aa, Homo sapiens; identical to SEQ ID NO: 912737

SEQ ID NO: 912743 - protein, 666 aa, Homo sapiens; identical to SEQ ID NO: 912737

SEQ ID NO: 912744 - protein, 613 aa, Homo sapiens
ASAVTVTAALCVGGPRRPERHLPPAPCGAPGPPETCRTEPDGAGTMNKLRQSLRRRKPAYVPEASRPHQWQADEDAVRKGTCSFPVRYLGHVEVEESRGMHVCEDAVKKLKAMGRKSVKSVLWVSADGLRVVDDKTKDLLVDQTIEKVSFCAPDRNLDKAFSYICRDGTTRRWICHCFLALKDSGERLSHAVGCAFAACLERKQRREKECGVTAAFDASRTSFAREGSFRLSGGGRPAEREAPDKKKAEAAAAPTVAPGPAQPGHVSPTPATTSPGEKGEAGTPVAAGTTAAAIPRRHAPLEQLVRQGSFRGFPALSQKNSPFKRQLSLRLNELPSTLQRRTDFQVKGTVPEMEPPGAGDSDSINALCTQISSSFASAGAPAPGPPPATTGTSAWGEPSVPPAAAFQPGHKRTPSEAERWLEEVSQVAKAQQQQQQQQQQQQQQQQQQQQAASVAPVPTMPPALQPFPAPVGPFDAAPAQVAVFLPPPHMQPPFVPAYPGLGYPPMPRVPVVGITPSQMVANAFCSAAQLQPQPATLLGKAGAFPPPAIPSAPGSQARPRPNGAPWPPEPAPAPAPELDPFEAQWAALEGKATVEKPSNPFSGDLQKTFEIEL

SEQ ID NO: 912745 - protein, 122 aa, Homo sapiens [sequence omitted]

SEQ ID NO: 912746 - protein, 174 aa, Homo sapiens
MTVLTTPIRQQLALTFYQKLCTWRIEQSRLQLWDTAGQERFRSLIPSYIRDSTVAVVVYDITNVNSFQQTTKWIDDVRTERGSDVIIMLVGNKTDLADKRQVSIEEGERKAKELNVMFIETSAKAGYNVKQLFRRVAAALPGMESTQDRSREDMIDIKLEKPQEQPVSEGGCSC

SEQ ID NO: 912747 - protein, 174 aa, Homo sapiens; identical to SEQ ID NO: 912746

SEQ ID NO: 912748 - protein, 174 aa, Homo sapiens; identical to SEQ ID NO: 912746

SEQ ID NO: 912749 - protein, 174 aa, Homo sapiens; identical to SEQ ID NO: 912746

SEQ ID NO: 912750 - protein, 174 aa, Homo sapiens; identical to SEQ ID NO: 912746

SEQ ID NO: 912751 - protein, 106 aa, Homo sapiens
MHARTHAAAGGAAGSRPGSPRAAPEARALSRLGCGGGGSCGSSGAARERSQIRLRFRLRHPQLLFPRSGSRVRKEGTALALGSQRTPLAPADTALLPFPAAGLARC

SEQ ID NO: 912752 - protein, 208 aa, Homo sapiens
MSTGGDFGNPLRKFKLVFLGEQSVGKTSLITRFMYDSFDNTYQATIGIDFLSKTMYLEDRTIRLQLWDTAGQERFRSLIPSYIRDSAAAVVVYDITNVNSFQQTTKWIDDVRTERGSDVIIMLVGNKTDLADKRQVSIEEGERKAKELNVMFIETSAKAGYNVKQLFRRVAAALPGMESTQDRSREDMIDIKLEKPQEQPVSEGGCSC

SEQ ID NO: 912753 - protein, 106 aa, Homo sapiens; identical to SEQ ID NO: 912751

SEQ ID NO: 912754 - protein, 174 aa, Homo sapiens; identical to SEQ ID NO: 912746

SEQ ID NO: 912755 - protein, 174 aa, Homo sapiens; identical to SEQ ID NO: 912746

SEQ ID NO: 912756 - protein, 174 aa, Homo sapiens; identical to SEQ ID NO: 912746

SEQ ID NO: 912757 - protein, 134 aa, Homo sapiens
MTVLTTPIRQQLALTFYQKLCTWRIEQSRLQLWDTAGQERFRSLIPSYIRDSTVAVVVYDITNVNSFQQTTKWIDDVRTERGSDVIIMLVGNKTDLADKRQVSIEEGFRPESGPRRLATVSPVFSLAGAWAGGN

SEQ ID NO: 912758 - protein, 106 aa, Homo sapiens; identical to SEQ ID NO: 912751

SEQ ID NO: 912759 - protein, 174 aa, Homo sapiens; identical to SEQ ID NO: 912746

SEQ ID NO: 912760 - protein, 174 aa, Homo sapiens; identical to SEQ ID NO: 912746

SEQ ID NO: 912761 - protein, 208 aa, Homo sapiens; identical to SEQ ID NO: 912752

SEQ ID NO: 912762 - protein, 174 aa, Homo sapiens; identical to SEQ ID NO: 912746

SEQ ID NO: 912763 - protein, 106 aa, Homo sapiens; identical to SEQ ID NO: 912751

SEQ ID NO: 912764 - protein, 92 aa, Homo sapiens
AGPCGIVVLLHPFFAGRRQVSIEEGERKAKELNVMFIETSAKAGYNVKQLFRRVAAALPGMESTQDRSREDMIDIKLEKPQEQPVSEGGCSC

SEQ ID NO: 912765 - protein, 104 aa, Homo sapiens
LNALYFPQRFILSQRFILLSTRAVCSQPTLSLLAFLTSHLPPFPITLFLPSLPRLPQNKQEMAKQQFYQAHWNYPLILQIPLAVGYGPRCPKLFLSTDKNYGLL

SEQ ID NO: 912766 - protein, 174 aa, Homo sapiens; identical to SEQ ID NO: 912746

SEQ ID NO: 912767 - protein, 161 aa, Homo sapiens
GRSSSSTMSTGGDFGNPLRKFKLVFLGEQSGECVAPLLLAAGRSVPAPPPVGPSVRGGSLPASRPRSLPPQPFPMCPPVPLALRQWPSFYPVPRVLQSSTPRLRSSQSGHLRSICPPSPDLTPPSLLSIPFFLRSRSLPVPRPPFLSPTLIPCSFPSSSAL

SEQ ID NO: 912768 - protein, 355 aa, Homo sapiens
AGIPDSRPEARGDHVVRPSRGLRVTGATRSIMGPWGEPELLVWRPEAVASEPPVPVGLEVKLGALVLLLVLTLLCSLVPICVLRRPGANHEGSASRQKALSLVSCFAGGVFLATCLLDLLPDYLAAIDEALAALHVTLQFPLQEFILAMGFFLVLVMEQITLAYKEQSGPSPLEETRALLGTVNGGPQHWHDGPGVPQASGAPATPSALRACVLVFSLALHSVFEGLAVGLQRDRARAMELCLALLLHKGILAVSLSLRLLQSHLRAQVVAGCGILFSCMTPLGIGLGAALAESAGPLHQLAQSVLEGMAAGTFLYITFLEILPQELASSEQRILKVILLLAGFALLTGLLFIQI

SEQ ID NO: 912769 - protein, 343 aa, Homo sapiens
RERERERESLRVTGATRSIMGPWGEPELLVWRPEAVASEPPVPVGLEVKLGALVLLLVLTLLCSLVPICVLRRPGANHEGSASRQKALSLVSCFAGGVFLATCLLDLLPDYLAAIDEALAALHVTLQFPLQEFILAMGFFLVLVMEQITLAYKEQSGPSPLEETRALLGTVNGGPQHWHDGPGVPQASGAPATPSALRACVLVFSLALHSVFEGLAVGLQRDRARAMELCLALLLHKGILAVSLSLRLLQSHLRAQVVAGCGILFSCMTPLGIGLGAALAESAGPLHQLAQSVLEGMAAGTFLYITFLEILPQELASSEQRILKVILLLAGFALLTGLLFIQI

SEQ ID NO: 912770 - protein, 324 aa, Homo sapiens
MGPWGEPELLVWRPEAVASEPPVPVGLEVKLGALVLLLVLTLLCSLVPICVLRRPGANHEGSASRQKALSLVSCFAGGVFLATCLLDLLPDYLAAIDEALAALHVTLQFPLQEFILAMGFFLVLVMEQITLAYKEQSGPSPLEETRALLGTVNGGPQHWHDGPGVPQASGAPATPSALRACVLVFSLALHSVFEGLAVGLQRDRARAMELCLALLLHKGILAVSLSLRLLQSHLRAQVVAGCGILFSCMTPLGIGLGAALAESAGPLHQLAQSVLEGMAAGTFLYITFLEILPQELASSEQRILKVILLLAGFALLTGLLFIQI

SEQ ID NO: 912771 - protein, 324 aa, Homo sapiens; identical to SEQ ID NO: 912770

SEQ ID NO: 912772 - protein, 324 aa, Homo sapiens; identical to SEQ ID NO: 912770

SEQ ID NO: 912773 - protein, 367 aa, Homo sapiens
HQKYLAVLGHPRLFIIQVTRLSFMYMLLRSLACLRVTGATRSIMGPWGEPELLVWRPEAVASEPPVPVGLEVKLGALVLLLVLTLLCSLVPICVLRRPGANHEGSASRQKALSLVSCFAGGVFLATCLLDLLPDYLAAIDEALAALHVTLQFPLQEFILAMGFFLVLVMEQITLAYKEQSGPSPLEETRALLGTVNGGPQHWHDGPGVPQASGAPATPSALRACVLVFSLALHSVFEGLAVGLQRDRARAMELCLALLLHKGILAVSLSLRLLQSHLRAQVVAGCGILFSCMTPLGIGLGAALAESAGPLHQLAQSVLEGMAAGTFLYITFLEILPQELASSEQRILKVILLLAGFALLTGLLFIQI

SEQ ID NO: 912774 - protein, 297 aa, Homo sapiens
MGPWGEPELLVWRPEAVASEPPVPVGLEVKLGALVLLLVLTLLCSLVPICVLRRPGANHEGSASRQKALSLVSCFAGGVFLATCLLDLLPDYLAAIDEALAALHVTLQFPLQEFILAMGFFLVLVMEQITLAYKEQSGPSPLEETRALLGTVNGGPQHWHDGPGVPQASGAPATPSALRACVLVFSLALHSVFEGLAVGLQRDRARAMELCLALLLHKGILAVSLSLRLLQSHLRAQVVAGCGILFSCMTPLGIGLGAALAESAGPLHQLAQSVLEGMAAGTFLYITFLEILLFIQI

SEQ ID NO: 912775 - protein, 324 aa, Homo sapiens; identical to SEQ ID NO: 912770

SEQ ID NO: 912776 - protein, 207 aa, Homo sapiens [sequence omitted]

SEQ ID NO: 912777 - protein, 117 aa, Homo sapiens [sequence omitted]

SEQ ID NO: 912778 - protein, 324 aa, Homo sapiens; identical to SEQ ID NO: 912770

SEQ ID NO: 912779 - protein, 127 aa, Homo sapiens
MFRRVRPMGPQFFLFFFFILIFGDRVSLCCPGWSAVVRSRFHAAPDLPGSGDSPASAPRAARTTGASHCVRPAGLICQAGIGFRQPKGRGKRQNMNRREAGRKLRETLSSQVACSARSRSRSLIAPN

SEQ ID NO: 912780 - protein, 809 aa, Homo sapiens
MGPWGEPELLVWRPEAVASEPPVPVGLEVKLGALVLLLVLTLLCSLVPICVLRRPGANHEGSASRQKALSLVSCFAGGVFLATCLLDLLPDYLAAIDEALAALHVTLQFPLQEFILAMGFFLVLVMEQITLAYKEQSGPSPLEETRALLGTVNGGPQHWHDGPGVPQLQAQKLRLAYTRSSHYGGSLPNVNQIGSGLAEFQSPLHSPLDSSRSTRHHGLVERVQRDPRRMVSPLRRYTRHIDSSPYSPAYLSPPPESSWRRTMAWGNFPAEKGQLFRLPSALNRTSSDSALHTSVMNPSPQDTYPGPTPPSILPSRRGGILDGEMDPKVPAIEENLLDDKHLLKPWDAKKLSSSSSRPRSCEVPGINIFPSPDQPANVPVLPPAMNTGGSLPDLTNLHFPPPLPTPLDPEETAYPSLSGGNSTSNLTHTMTHLGISRGMGLGPGYDAPGLHSPLSHPSLQSSLSNPNLQASLSSPQPQLQGSHSHPSLPASSLARHVLPTTSLGHPSLSAPALSSSSSSSSTSSPVLGAPSYPASTPGASPHHRRVPLSPLSLLAGPADARRSQQQLPKQFSPTMSPTLSSITQGVPLDTSKLSTDQRLPPYPYSSPSLVLPTQPHTPKSLQQPGLPSQSCSVQSSGGQPPGRQSHYGTPYPPGPSGHGQQSYHRPMSDFNLGNLEQFSMESPSASLVLDPPGFSEGPGFLGGEGPMGGPQDPHTFNHQNLTHCSRHGSGPNIILTGDSSPGFSKEIAAALAGVPGFEVSAAGLELGLGLEDELRMEPLGLEGLNMLSDPCALLPDPAVEESFRSDRLQ

SEQ ID NO: 912781 - protein, 834 aa, Homo sapiens
MGPWGEPELLVWRPEAVASEPPVPVGLEVKLGALVLLLVLTLLCSLVPICVLRRPGANHEGSASRQKALSLVSCFAGGVFLATCLLDLLPDYLAAIDEALAALHVTLQFPLQEFILAMGFFLVLVMEQITLAYKEQSGPSPLEETRALLGTVNGGPQHWHDGPGVPQLQAQKLRLAYTRSSHYGGSLPNVNQIGSGLAEFQVSRPQPGRSGVSEAASSADFCPFWQSPLHSPLDSSRSTRHHGLVERVQRDPRRMVSPLRRYTRHIDSSPYSPAYLSPPPESSWRRTMAWGNFPAEKGQLFRLPSALNRTSSDSALHTSVMNPSPQDTYPGPTPPSILPSRRGGILDGEMDPKVPAIEENLLDDKHLLKPWDAKKLSSSSSRPRSCEVPGINIFPSPDQPANVPVLPPAMNTGGSLPDLTNLHFPPPLPTPLDPEETAYPSLSGGNSTSNLTHTMTHLGISRGMGLGPGYDAPGLHSPLSHPSLQSSLSNPNLQASLSSPQPQLQGSHSHPSLPASSLARHVLPTTSLGHPSLSAPALSSSSSSSSTSSPVLGAPSYPASTPGASPHHRRVPLSPLSLLAGPADARRSQQQLPKQFSPTMSPTLSSITQGVPLDTSKLSTDQRLPPYPYSSPSLVLPTQPHTPKSLQQPGLPSQSCSVQSSGGQPPGRQSHYGTPYPPGPSGHGQQSYHRPMSDFNLGNLEQFSMESPSASLVLDPPGFSEGPGFLGGEGPMGGPQDPHTFNHQNLTHCSRHGSGPNIILTGDSSPGFSKEIAAALAGVPGFEVSAAGLELGLGLEDELRMEPLGLEGLNMLSDPCALLPDPAVEESFRSDRLQ

SEQ ID NO: 912782 - protein, 580 aa, Homo sapiens
MVSPLRRYTRHIDSSPYSPAYLSPPPESSWRRTMAWGNFPAEKGQLFRLPSALNRTSSDSALHTSVMNPSPQDTYPGPTPPSILPSRRGGILDGEMDPKVPAIEENLLDDKHLLKPWDAKKLSSSSSRPRSCEVPGINIFPSPDQPANVPVLPPAMNTGGSLPDLTNLHFPPPLPTPLDPEETAYPSLSGGNSTSNLTHTMTHLGISRGMGLGPGYDAPGLHSPLSHPSLQSSLSNPNLQASLSSPQPQLQGSHSHPSLPASSLARHVLPTTSLGHPSLSAPALSSSSSSSSTSSPVLGAPSYPASTPGASPHHRRVPLSPLSLLAGPADARRSQQQLPKQFSPTMSPTLSSITQGVPLDTSKLSTDQRLPPYPYSSPSLVLPTQPHTPKSLQQPGLPSQSCSVQSSGGQPPGRQSHYGTPYPPGPSGHGQQSYHRPMSDFNLGNLEQFSMESPSASLVLDPPGFSEGPGFLGGEGPMGGPQDPHTFNHQNLTHCSRHGSGPNIILTGDSSPGFSKEIAAALAGVPGFEVSAAGLELGLGLEDELRMEPLGLEGLNMLSDPCALLPDPAVEESFRSDRLQ

SEQ ID NO: 912783 - protein, 580 aa, Homo sapiens; identical to SEQ ID NO: 912782

SEQ ID NO: 912784 - protein, 580 aa, Homo sapiens; identical to SEQ ID NO: 912782

SEQ ID NO: 912785 - protein, 809 aa, Homo sapiens; identical to SEQ ID NO: 912780

SEQ ID NO: 912786 - protein, 589 aa, Homo sapiens
STCLGLPKCWDYRHEPPYPASMELFKAGRQVSTAANATVSLAGILDGEMDPKGMCSSLLWVLNAKEFLGWCWDCVQVQGAGLLPTCFCFLSCLTGSFSNSPITSLSLQVPAIEENLLDDKHLLKPWDAKKLSSSSSRPRSCEVPGINIFPSPDQPANVPVLPPAMNTGGSLPDLTNLHFPPPLPTPLDPEETAYPSLSGGNSTSNLTHTMTHLGISRGMGLGPGYDAPGLHSPLSHPSLQSSLSNPNLQASLSSPQPQLQGSHSHPSLPASSLARHVLPTTSLGHPSLSAPALSSSSSSSSTSSPVLGAPSYPASTPGASPHHRRVPLSPLSLLAGPADARRSQQQLPKQFSPTMSPTLSSITQGVPLDTSKLSTDQRLPPYPYSSPSLVLPTQPHTPKSLQQPGLPSQSCSVQSSGGQPPGRQSHYGTPYPPGPSGHGQQSYHRPMSDFNLGNLEQFSMESPSASLVLDPPGFSEGPGFLGGEGPMGGPQDPHTFNHQNLTHCSRHGSGPNIILTGDSSPGFSKEIAAALAGVPGFEVSAAGLELGLGLEDELRMEPLGLEGLNMLSDPCALLPDPAVEESFRSDRLQ

SEQ ID NO: 912787 - protein, 478 aa, Homo sapiens
PGFSAEHCPHFPYSPFSPQLSSSSSRPRSCEVPGINIFPSPDQPANVPVLPPAMNTGGSLPDLTNLHFPPPLPTPLDPEETAYPSLSGGNSTSNLTHTMTHLGISRGMGLGPGYDAPGLHSPLSHPSLQSSLSNPNLQASLSSPQPQLQGSHSHPSLPASSLARHVLPTTSLGHPSLSAPALSSSSSSSSTSSPVLGAPSYPASTPGASPHHRRVPLSPLSLLAGPADARRSQQQLPKQFSPTMSPTLSSITQGVPLDTSKLSTDQRLPPYPYSSPSLVLPTQPHTPKSLQQPGLPSQSCSVQSSGGQPPGRQSHYGTPYPPGPSGHGQQSYHRPMSDFNLGNLEQFSMESPSASLVLDPPGFSEGPGFLGGEGPMGGPQDPHTFNHQNLTHCSRHGSGPNIILTGDSSPGFSKEIAAALAGVPGFEVSAAGLELGLGLEDELRMEPLGLEGLNMLSDPCALLPDPAVEESFRSDRLQ

SEQ ID NO: 912788 - protein, 806 aa, Homo sapiens
MGPWGEPELLVWRPEAVASEPPVPVGLEVKLGALVLLLVLTLLCSLVPICVLRRPGANHEGSASRQKALSLVSCFAGGVFLATCLLDLLPDYLAAIDEALAALHVTLQFPLQEFILAMGFFLVLVMEQITLAYKEQSGPSPLEETRALLGTVNGGPQHWHDGPGVPQLQAQKLRLAYTRSSHYGGSLPNVNQIGSGLAEFQSPLHSPLDSSRSTRHHGLVERVQRDPRRMVSPLRRYTRHIDSSPYSPAYLSPPPESSWRRTMAWGNFPAEKGQLFRLPSALNRTSSDSALHTSVMNPSPQDTYPGPTPPSILPSRRGGILDGEMDPKVPAIEENLLDDKHLLKPWDAKKLSSSSSRPRSCEVPGINIFPSPDQPANVPVLPPAMNTGGSLPDLTNLHFPPPLPTPLDPEETAYPSLSGGNSTSNLTHTMTHLGISRGMGLGPGYDAPGLHSPLSHPSLQSSLSNPNLQASLSSPQPQLQGSHSHPSLPASSLARHVLPTTSLGHPSLSAPALSSSSSSSSTSSPVLGAPSYPASTPGASPHHRRVPLSPLSLLAGPADARRSQQQLPKQFSPTMSPTLSSITQGVPLDTSKLSTDQRLPPYPYSSPSLVLPTQPHTPKSLQQPGLPSQSCSVQSSGGQPPGRQSHYGTPYPPGPSGHGQQSYHRPMSDFNLGNLEQFSMESPSASLVLDPPGFSEGPGFLGGEGPMGGPQDPHTFNHQNLTHCSRHGSGPNIILTGDSSPGFSKEIAAALAGVPGFEVSAAGLELGLGLEDELRMEPLAGTVGQVLVVEGVGILGATHWPLTPAV

SEQ ID NO: 912789 - protein, 461 aa, Homo sapiens
MGPWGEPELLVWRPEAVASEPPVPVGLEVKLGALVLLLVLTLLCSLVPICVLRRPGANHEGSASRQKALSLVSCFAGGVFLATCLLDLLPDYLAAIDEALAALHVTLQFPLQEFILAMGFFLVLVMEQITLAYKEQSGPSPLEETRALLGTVNGGPQHWHDGPGVPQLQAQKLRLAYTRSSHYGGSLPNVNQIGSGLAEFQSPLHSPLDSSRSTRHHGLVERVQRDPRRMVSPLRRYTRHIDSSPYSPAYLSPPPESSWRRTMAWGNFPAEKGQLFRLPSALNRTSSDSALHTSVMNPSPQDTYPGPTPPSILPSRRGGILDGEMDPKVPAIEENLLDDKHLLKPWDAKKLSSSSSRPRSCEVPGINIFPSPDQPANVPVLPPAMNTGGSLPDLTNLHFPPPLPTPLDPEETAYPSLSGGNSTSNLTHTMTHLGISRGMGLGPGYDAPDFIHLSERPVCFG

SEQ ID NO: 912790 - protein, 297 aa, Homo sapiens
MGPWGEPELLVWRPEAVASEPPVPVGLEVKLGALVLLLVLTLLCSLVPICVLRRPGANHEGSASRQKALSLVSCFAGGVFLATCLLDLLPDYLAAIDEALAALHVTLQFPLQEFILAMGFFLVLVMEQITLAYKEQSGPSPLEETRALLGTVNGGPQHWHDGPGVPQLQAQKLRLAYTRSSHYGGSLPNVNQIGSGLAEFQSPLHSPLDSSRSTRHHGLVERVQRDPRRMVSPLRRYTRHIDSSPYNPSLICPSPKSTAKTGSAILRGMVDTAFRGRDSHKGQTSIRATITCWSEPH

SEQ ID NO: 912791 - protein, 324 aa, Homo sapiens; identical to SEQ ID NO: 912770

SEQ ID NO: 912792 - protein, 104 aa, Homo sapiens
MAILKISIFKLRALDANNTCSASDSDAELCAGDSSPGFSKEIAAALAGVPGFEVSAAGLELGLGLEDELRMEPLGLEGLNMLSDPCALLPDPAVEESFRSDRLQ

SEQ ID NO: 912793 - protein, 324 aa, Homo sapiens; identical to SEQ ID NO: 912770

SEQ ID NO: 912794 - protein, 324 aa, Homo sapiens; identical to SEQ ID NO: 912770

SEQ ID NO: 912795 - protein, 324 aa, Homo sapiens; identical to SEQ ID NO: 912770

SEQ ID NO: 912796 - protein, 324 aa, Homo sapiens; identical to SEQ ID NO: 912770

SEQ ID NO: 912797 - protein, 324 aa, Homo sapiens; identical to SEQ ID NO: 912770

SEQ ID NO: 912798 - protein, 324 aa, Homo sapiens; identical to SEQ ID NO: 912770

SEQ ID NO: 912799 - protein, 324 aa, Homo sapiens; identical to SEQ ID NO: 912770

SEQ ID NO: 912800 - protein, 748 aa, Homo sapiens
TIPGGPRAQQVRARLGPGSRCSLRRRWLRLEEPGRGRGGGRGWYWEGGREGRGRKMATSGANGPGSATASASNPRKFSEKIALQKQRQAEETAAFEEVMMDIGSTRLQAQKLRLAYTRSSHYGGSLPNVNQIGSGLAEFQSPLHSPLDSSRSTRHHGLVERVQRDPRRMVSPLRRYTRHIDSSPYSPAYLSPPPESSWRRTMAWGNFPAEKGQLFRLPSALNRTSSDSALHTSVMNPSPQDTYPGPTPPSILPSRRGGILDGEMDPKVPAIEENLLDDKHLLKPWDAKKLSSSSSRPRSCEVPGINIFPSPDQPANVPVLPPAMNTGGSLPDLTNLHFPPPLPTPLDPEETAYPSLSGGNSTSNLTHTMTHLGISRGMGLGPGYDAPGLHSPLSHPSLQSSLSNPNLQASLSSPQPQLQGSHSHPSLPASSLARHVLPTTSLGHPSLSAPALSSSSSSSSTSSPVLGAPSYPASTPGASPHHRRVPLSPLSLLAGPADARRSQQQLPKQFSPTMSPTLSSITQGVPLDTSKLSTDQRLPPYPYSSPSLVLPTQPHTPKSLQQPGLPSQSCSVQSSGGQPPGRQSHYGTPYPPGPSGHGQQSYHRPMSDFNLGNLEQFSMESPSASLVLDPPGFSEGPGFLGGEGPMGGPQDPHTFNHQNLTHCSRHGSGPNIILTGDSSPGFSKEIAAALAGVPGFEVSAAGLELGLGLEDELRMEPLGLEGLNMLSDPCALLPDPAVEESFRSDRLQ

SEQ ID NO: 912801 - protein, 674 aa, Homo sapiens
MGPWGEPELLVWRPEAVASEPPVPVGLEVKLGALVLLLVLTLLCSLVPICVLRRPGANHEGSASRQKALSLVSCFAGGVFLATCLLDLLPDYLAAIDEALAALHVTLQFPLQEFILAMGFFLVLVMEQITLAYKEQSGPSPLEETRALLGTVNGGPQHWHDGPGVPQLQAQKLRLAYTRSSHYGGSLPNVNQIGSGLAEFQSPLHSPLDSSRSTRHHGLVERVQRDPRRMVSPLRRYTRHIDSSPYSPAYLSPPPESSWRRTMAWGNFPAEKGQLFRLPSALNRTSSDSALHTSVMNPSPQDTYPGPTPPSILPSRRGGILDGEMDPKVPAIEENLLDDKHLLKPWDAKKLSSSSSRPRSCEVPGINIFPSPDQPANVPVLPPAMNTGGSLPDLTNLHFPPPLPTPLDPEETAYPSLSGGNSTSNLTHTMTHLGISRGMGLGPGYDAPGRPPGYTVNCPLTSGYPHTHTAPQVWFCLPSPTPQSLYSSQGCPLSLVQCSPQVEQPPGRQSHYGTPYPPGPSGHGQQSYHRPMSDFNLGNLEQFSMESPSASLVLDPPGFSEGPGFLGGEGPMGGPQDPHTFNHQNLTHCSRHGSGPNIILTGDSSPGFSKEIAAALAGVPGFEVSAAGLELGLGLEDELRMEPLGLEGLNMLSDPCALLPDPAVEESFRSDRLQ

SEQ ID NO: 912802 - protein, 809 aa, Homo sapiens; identical to SEQ ID NO: 912780

SEQ ID NO: 912803 - protein, 626 aa, Homo sapiens
MGPWGEPELLVWRPEAVASEPPVPVGLEVKLGALVLLLVLTLLCSLVPICVLRRPGANHEGSASRQKALSLVSCFAGGVFLATCLLDLLPDYLAAIDEALAALHVTLQFPLQEFILAMGFFLVLVMEQITLAYKEQSGPSPLEETRALLGTVNGGPQHWHDGPGVPQLQAQKLRLAYTRSSHYGGSLPNVNQIGSGLAEFQSPLHSPLDSSRSTRHHGLVERVQRDPRRMVSPLRRYTRHIDSSPYSPAYLSPPPESSWRRTMAWGNFPAEKGQLFRLPSALNRTSSDSALHTSVMNPSPQDTYPGPTPPSILPSRRGGILDGEMDPKVPAIEENLLDDKHLLKPWDAKKLSSSSSRPRSCEVPGINIFPSPDQPANVPVLPPAMNTGGSLPDLTNLHFPPPLPTPLDPEETAYPSLSGGNSTSNLTHTMTHLGISRGMGLGPGYDAPGLHSPLSHPSLQSSLSNPNLQASLSSPQPQLQGSHSHPSLPASSLARHVLPTTSLGHPSLSAPALSSSSSSSSTSSPVLGAPSYPASTPGASPHHRRVPLSPLSLLAGPADARRSQQQLPKQFSPTMSPTLSSITQGVPLDTSKLSTDQRLPPYPYSSPSLVLPDPAVEESFRSDRLQ

SEQ ID NO: 912804 - protein, 455 aa, Homo sapiens
MGPWGEPELLVWRPEAVASEPPVPVGLEVKLGALVLLLVLTLLCSLVPICVLRRPGANHEGSASRQKALSLVSCFAGGVFLATCLLDLLPDYLAAIDEALAALHVTLQFPLQEFILAMGFFLVLVMEQITLAYKEQSGPSPLEETRALLGTVNGGPQHWHDGPGVPQLQAQKLRLAYTRSSHYGGSLPNVNQIGSGLAEFQSPLHSPLDSSRSTRHHGLVERVQRDPRRMVSPLRRYTRHIDSSPYSPAYLSPPPESSWRRTMAWGNFPAEKGQLFRLPSALNRTSSDSALHTSVMNPSPQDTYPGPTPPSILPSRRGGILDGEMDPKVPAIEENLLDDKHLLKPWDAKKLSSSSSRPRSCEVPGINIFPSPDQPANVPVLPPAMNTGGSLPDLTNLHFPPPLPTPLDPEETAYPSLSGGNSTSNLTHTMTHLGISRGMGLGPGYDAPGRPPGYQ

SEQ ID NO: 912805 - protein, 235 aa, Homo sapiens
MSPTLSSITQGVPLDTSKLSTDQRLPPYPYSSPSLVLPTQPHTPKSLQQPGLPSQSCSVQSSGGQPPGRQSHYGTPYPPGPSGHGQQSYHRPMSDFNLGNLEQFSMESPSASLVLDPPGFSEGPGFLGGEGPMGGPQDPHTFNHQNLTHCSRHGSGPNIILTGDSSPGFSKEIAAALAGVPGFEVSAAGLELGLGLEDELRMEPLGLEGLNMLSDPCALLPDPAVEESFRSDRLQ

SEQ ID NO: 912806 - protein, 465 aa, Homo sapiens
MGPWGEPELLVWRPEAVASEPPVPVGLEVKLGALVLLLVLTLLCSLVPICVLRRPGANHEGSASRQKALSLVSCFAGGVFLATCLLDLLPDYLAAIDEALAALHVTLQFPLQEFILAMGFFLVLVMEQITLAYKEQSGPSPLEETRALLGTVNGGPQHWHDGPGVPQLQAQKLRLAYTRSSHYGGSLPNVNQIGSGLAEFQSPLHSPLDSSRSTRHHGLVERVQRDPRRMVSPLRRYTRHIDSSPYSPAYLSPPPESSWRRTMAWGNFPAEKGQLFRLPSALNRTSSDSALHTSVMNPSPQDTYPGPTPPSILPSRRGGILDGEMDPKVPAIEENLLDDKHLLKPWDAKKLSSSSSRPRSCEVPGINIFPSPDQPANVPVLPPAMNTGGSLPDLTNLHFPPPLPTPLDPEETAYPSLSGGNSTSNLTHTMTHLGISRGMGLGPGYDAPDFIHLSATPTGVSNVGV

SEQ ID NO: 912807 - protein, 371 aa, Homo sapiens
TIPGGPRAQQVRARLGPGSRCSLRRRWLRLEEPGRGRGGGRGWYWEGGREGRGRKMATSGANGPGSATASASNPRKFSEKIALQKQRQAEETAAFEEVMMDIGSTRLQAQKLRLAYTRSSHYGGSLPNVNQIGSGLAEFQSPLHSPLDSSRSTRHHGLVERVQRDPRRMVSPLRRYTRHIDSSPYSPAYLSPPPESSWRRTMAWGNFPAEKGQLFRLPSALNRTSSDSALHTSVMNPSPQDTYPGPTPPSILPSRRGGILDGEMDPKVPAIEENLLDDKHLLKPWDAKKLSSSSSRPRSCEVPGINICPSPDQAAKCGWSPNYPVKQRRGSPTLEHDQTLHNPEPKATTWNLNQTTEPGPQGPKHQKDPNR

SEQ ID NO: 912808 - protein, 106 aa, Homo sapiens
INAEWPLSGGKMVAMAAGPSGCLVPAFGLRLLLATVLQAVSAFGAEFSSEACRELGFSSNLLCSSCDLLGQFNLLQLDPDCRGCCQEEAQFETKKLYAGAILEVCG

SEQ ID NO: 912809 - protein, 115 aa, Homo sapiens
AGAQGSLIKLISPPPRNLRKMVAMAAGPSGCLVPAFGLRLLLATVLQAVSAFGAEFSSEACRELGFSSNLLCSSCDLLGQFNLLQLDPDCRGCCQEEAQFETKKLYAGAILEVCG

SEQ ID NO: 912810 - protein, 115 aa, Homo sapiens; identical to SEQ ID NO: 912809

SEQ ID NO: 912811 - protein, 158 aa, Homo sapiens
AGAQGSLIKLISPPPRNLRKMVAMAAGPSGCLVPAFGLRLLLATVLQAVSAFGAEFSSEACRELGFSSNLLCSSCDLLGQFNLLQLDPDCRGCCQEEAQFETKKYSSIVSKQECHHSNCMQELFLKFVDENWEGSLKSKYVRGSDPVLKLCGRQWEHC

SEQ ID NO: 912812 - protein, 129 aa, Homo sapiens
AGAQGSLIKLISPPPRNLRKMVAMAAGPSGCLVPAFGLRLLLATVLQAVSAFGAEFSSEACRELGFSSNLLCSSCDLLGQFNLLQLDPDCRGCCQEEAQFETKKLYAGAILEVCGCKALWTTMGTLLKN

SEQ ID NO: 912813 - protein, 115 aa, Homo sapiens; identical to SEQ ID NO: 912809

SEQ ID NO: 912814 - protein, 115 aa, Homo sapiens; identical to SEQ ID NO: 912809

SEQ ID NO: 912815 - protein, 164 aa, Homo sapiens
AGAQGSLIKLISPPPRNLRKMVAMAAGPSGCLVPAFGLRLLLATVLQAVSAFGAEFSSEACRELGFSSNLLCSSCDLLGQFNLLQLDPDCRGCCQEEAQFETKKYSSIVSKQECHHSNCMQELFLKFVDENWEGSLKSKLLLGVINPNCSEDCKSSMSVVQTLY

SEQ ID NO: 912816 - protein, 157 aa, Homo sapiens
AGAQGSLIKLISPPPRNLRKMVAMAAGPSGCLVPAFGLRLLLATVLQAVSAFGAEFSSEACRELGFSSNLLCSSCDLLGQFNLLQLDPDCRGCCQEEAQFETKKLLLGVINPNCSEDCKSRVIKRSYCSTSSPALVCPWFRPCIKALWTTMGTLLKN

SEQ ID NO: 912817 - protein, 115 aa, Homo sapiens; identical to SEQ ID NO: 912809

SEQ ID NO: 912818 - protein, 335 aa, Homo sapiens
MPAVLGFEGSANKIGVGVVRDGKVLANPRRTYVTPPGTGFLPGDTARHHRAVILDLLQEALTESGLTSQDIDCIAYTKGPGMGAPLVSVAVVARTVAQLWNKPLVGVNHCIGHIEMGRLITGATSPTVLYVSGGNTQVIAYSEHRYRIFGETIDIAVGNCLDRFARVLKISNDPSPGYNIEQMAKRGKKLVELPYTVKGMDVSFSGILSFIEDVAHRMLATGECTPEDLCFSLQETVFAMLVEITERAMAHCGSQEALIVGGVGCNVRLQEMMATMCQERGARLFATDERFCIDNGAMIAQAGWEMFRAGHRTPLSDSGVTQRYRTDEVEVTWRD

SEQ ID NO: 912819 - protein, 335 aa, Homo sapiens; identical to SEQ ID NO: 912818

SEQ ID NO: 912820 - protein, 268 aa, Homo sapiens
MPAVLGFEGSANKIGVGVVRDGKVLANPRRTYVTPPGTGFLPGDTARHHRAVILDLLQEALTESGLTSQDIDCIAYTKGPGMGAPLVSVAVVARTVAQLWNKPLVGVNHCIGHIEMGRLITGATSPTVLYVSGGNTQVIAYSEHRYRIFGETIDIAVGNCLDRFARVLKISNDPSPGYNIEQMAKRGKKLVELPYTVKGMDVSFSGILSFIEDVAHRMLATGECTPEDLCFSLQETVFAMLVEITERAMAHCGSQEALIVGGVGCMYY

SEQ ID NO: 912821 - protein, 268 aa, Homo sapiens; identical to SEQ ID NO: 912820

SEQ ID NO: 912822 - protein, 335 aa, Homo sapiens; identical to SEQ ID NO: 912818

SEQ ID NO: 912823 - protein, 257 aa, Homo sapiens
MPAVLGFEGSANKIGVGVVRDGKVLANPRRTYVTPPGTGFLPGDTARHHRAVILDLLQEALTESGLTSQDIDCIAYTKGPGMGAPLVSVAVVARTVAQLWNKPLVGVNHCIGHIEMGRLITGATSPTVLYVSGGNTQVIAYSEHRYRIFGETIDIAVGNCLDRFARVLKISNDPSPGYNIEQMAKRGKKLVELPYTVKGMDVSFSGILSFIEDVAHRMLATGECTPEDLCFSLQKRRFAASLDSHRPGPWGSPKAHV

SEQ ID NO: 912824 - protein, 227 aa, Homo sapiens
MPAVLGFEGSANKIGVGVVRDGKVLANPRRTYVTPPGTGFLPGDTARHHRAVILDLLQEALTESGLTSQDIDCIAYTKGPGMGAPLVSVAVVARTVAQLWNKPLVGVNHCIGHIEMGRLITGATSPTVLYVSGGNTQVIAYSEHRYRIFGETIDIAVGNCLDRFARVLKISNDPSPGYNIEQMAKRGKKLVELPYTVKGMDVSFSGILSFIEVSVRGDETGTFMLFK

SEQ ID NO: 912825 - protein, 254 aa, Homo sapiens [sequence omitted]

SEQ ID NO: 912826 - protein, 149 aa, Homo sapiens [sequence omitted]

SEQ ID NO: 912827 - protein, 149 aa, Homo sapiens [sequence omitted]

SEQ ID NO: 912828 - protein, 276 aa, Homo sapiens
PLGFIGTRLQDIDCIAYTKGPGMGAPLVSVAVVARTVAQLWNKPLVGVNHCIGHIEMGRLITGATSPTVLYVSGGNTQVIAYSEHRYRIFGETIDIAVGNCLDRFARVLKISNDPSPGYNIEQMAKRGKKLVELPYTVKGMDVSFSGILSFIEDVAHRMLATGECTPEDLCFSLQETVFAMLVEITERAMAHCGSQEALIVGGVGCNVRLQEMMATMCQERGARLFATDERFCIDNGAMIAQAGWEMFRAGHRTPLSDSGVTQRYRTDEVEVTWRD

SEQ ID NO: 912829 - protein, 153 aa, Homo sapiens
MAKRGKKLVELPYTVKGMDVSFSGILSFIEDVAHRMLATGECTPEDLCFSLQETVFAMLVEITERAMAHCGSQEALIVGGVGCNVRLQEMMATMCQERGARLFATDERFCIDNGAMIAQAGWEMFRAGHRTPLSDSGVTQRYRTDEVEVTWRD

SEQ ID NO: 912830 - protein, 227 aa, Homo sapiens; identical to SEQ ID NO: 912824

SEQ ID NO: 912831 - protein, 197 aa, Homo sapiens
AAESAVKGLPVWYYSFKAEIKKTNSATGGDRILSACTGLGLNCFGGLMTDRPGSSEQQPQQRILLAWFRFIHYVHACSPAPPTGECTPEDLCFSLQETVFAMLVEITERAMAHCGSQEALIVGGVGCNVRLQEMMATMCQERGARLFATDERFCIDNGAMIAQAGWEMFRAGHRTPLSDSGVTQRYRTDEVEVTWRD

SEQ ID NO: 912832 - protein, 103 aa, Homo sapiens
MPAVLGFEGSANKIGVGVVRDGKVLANPRRTYVTPPGTGFLPGDTARHHRAVILDLLQEALTESGLTSQDIDCIAYTKDRTPLSDSGVTQRYRTDEVEVTWRD

SEQ ID NO: 912833 - protein, 335 aa, Homo sapiens; identical to SEQ ID NO: 912818

SEQ ID NO: 912834 - protein, 268 aa, Homo sapiens; identical to SEQ ID NO: 912820

SEQ ID NO: 912835 - protein, 331 aa, Homo sapiens
MPAVLGFEGSANKIGVGVVRDGKVLANPRRTYVTPPGTGFLPGDTARHHRAVILDLLQEALTESGLTSQDIDCIAYTKGPGMGAPLVSVAVVARTVAQLWNKPLVGVNHCIGHIEMGRLITGATSPTVLYVSGGNTQVIAYSEHRYRIFGETIDIAVGNCLDRFARVLKISNDPSPGYNIEQMAKRGKKLVELPYTVKGMDVSFSGILSFIEDVAHRMLATGECTPEDLCFSLQETVFAMLVEITERAMAHCGSQEALIVGGVGCNVRLQEMMATMCQERGARLFATDERFCIDNGAMIAQAGWEMFRAGHRTPLSDSGVTQSRSYLNQMK

SEQ ID NO: 912836 - protein, 178 aa, Homo sapiens
MPAVLGFEGSANKIGVGVVRDGKVLANPRRTYVTPPGTGFLPGDTARHHRAVILDLLQEALTESGLTSQDIDCIAYTKGPGMGAPLVSVAVVARTVAQLWNKPLVGVNHCIGHIEMGRLITGATSPTVLYVSGGNTQVIAYSEHRYRIFGETIDIAVGNCLDRFARVLKVSQWGLQRT

SEQ ID NO: 912837 - protein, 400 aa, Homo sapiens
MPAVLGFEGSANKIGVGVVRDGKVLANPRRTYVTPPGTGFLPGDTARHHRAVILDLLQEALTESGLTSQDIDCIAYTKGPGMGAPLVSVAVVARTVAQLWNKPLVGVNHCIGHIEMGRLITGATSPTVLYVSGGNTQVPVILATPEAGQENHLNPGGRSCGEPRSHHCIPAWATRAKLRLKQTNKQKTKKNNKGHYLIYYFGVIAYSEHRYRIFGETIDIAVGNCLDRFARVLKISNDPSPGYNIEQMAKRGKKLVELPYTVKGMDVSFSGILSFIEDVAHRMLATGECTPEDLCFSLQETVFAMLVEITERAMAHCGSQEALIVGGVGCNVRLQEMMATMCQERGARLFATDERFCIDNGAMIAQAGWEMFRAGHRTPLSDSGVTQRYRTDEVEVTWRD

SEQ ID NO: 912838 - protein, 297 aa, Homo sapiens
DLEVPSCYSSTRAVILDLLQEALTESGLTSQDIDCIAYTKGPGMGAPLVSVAVVARTVAQLWNKPLVGVNHCIGHIEMGRLITGATSPTVLYVSGGNTQVIAYSEHRYRIFGETIDIAVGNCLDRFARVLKISNDPSPGYNIEQMAKRGKKLVELPYTVKGMDVSFSGILSFIEDVAHRMLATGECTPEDLCFSLQETVFAMLVEITERAMAHCGSQEALIVGGVGCNVRLQEMMATMCQERGARLFATDERFCIDNGAMIAQAGWEMFRAGHRTPLSDSGVTQRYRTDEVEVTWRD

SEQ ID NO: 912839 - protein, 395 aa, Homo sapiens
MPAVLGFEGSANKIGVGVVRDGKVLANPRRTYVTPPGTGFLPGDTARHHRAVILDLLQEALTESGLTSQDIDCIAYTKGYGWESGQRWRNIPATWLGQNSQHLTSATITTPTPPHIPYVPHYCFFPISRIITSISISLGPGMGAPLVSVAVVARTVAQLWNKPLVGVNHCIGHIEMGRLITGATSPTVLYVSGGNTQVIAYSEHRYRIFGETIDIAVGNCLDRFARVLKISNDPSPGYNIEQMAKRGKKLVELPYTVKGMDVSFSGILSFIEDVAHRMLATGECTPEDLCFSLQETVFAMLVEITERAMAHCGSQEALIVGGVGCNVRLQEMMATMCQERGARLFATDERFCIDNGAMIAQAGWEMFRAGHRTPLSDSGVTQRYRTDEVEVTWRD

SEQ ID NO: 912840 - protein, 421 aa, Homo sapiens
MPAVLGFEGSANKIGVGVVRDGKVLANPRRTYVTPPGTGFLPGDTARHHRAVILDLLQEALTESGLTSQDIDCIAYTKGPGMGAPLVSVAVVARTVAQLWNKPLVGVNHCIGHIEMGRLITGATSPTVLYVSGGNTQVPVILATPEAGQENHLNPGGRSCGEPRSHHCIPAWATRAKLRLKQTNKQKTKKNNKGHYLIYYFGVIAYSEHRYRIFGETIDIAVGNCLDRFARVLKISNDPSPGYNIEQMAKRYRGHKVEAGWLLGLQGFPHIRGKKLVELPYTVKGMDVSFSGILSFIEDVAHRMLATGECTPEDLCFSLQETVFAMLVEITERAMAHCGSQEALIVGGVGCNVRLQEMMATMCQERGARLFATDERFCIDNGAMIAQAGWEMFRAGHRTPLSDSGVTQRYRTDEVEVTWRD

SEQ ID NO: 912841 - protein, 178 aa, Homo sapiens; identical to SEQ ID NO: 912836

SEQ ID NO: 912842 - protein, 244 aa, Homo sapiens
MPAVLGFEGSANKIGVGVVRDGKVLANPRRTYVTPPGTGFLPGDTARHHRAVILDLLQEALTESGLTSQDIDCIAYTKGPGMGAPLVSVAVVARTVAQLWNKPLVGVNHCIGHIEMGRLITGATSPTVLYVSGGNTQVIAYSEHRYRIFGETIDIAVGNCLDRFARVLKISIRPSPGYTIDRWAAGQKWVAAYLDGGGPPRLLLGGPSVPAGPGTVPAPWRGHTPHCPPWGVWPHPRRKLDRGA

SEQ ID NO: 912843 - protein, 194 aa, Homo sapiens
DTLVRGWVMNRHEGEGEWASGGVRSFSRAAAAMAPIKVGDAIPAVEVFEGEPGNKVNLAELFKGKKGVLFGVPGAFTPGCSKTHLPGFVEQAEALKAKGVQVVACLSVNDAFVTGEWGRAHKAEGKVRLLADPTGAFGKETDLLLDDSLVSIFGNRRLKRFSMVVQDGIVKALNVEPDGTGLTCSLAPNIISQL

SEQ ID NO: 912844 - protein, 214 aa, Homo sapiens
MGLAGVCALRRSAGYILVGGAGGQSAAAAARRCSEGEWASGGVRSFSRAAAAMAPIKVGDAIPAVEVFEGEPGNKVNLAELFKGKKGVLFGVPGAFTPGCSKTHLPGFVEQAEALKAKGVQVVACLSVNDAFVTGEWGRAHKAEGKVRLLADPTGAFGKETDLLLDDSLVSIFGNRRLKRFSMVVQDGIVKALNVEPDGTGLTCSLAPNIISQL

SEQ ID NO: 912845 - protein, 255 aa, Homo sapiens
PSARYEASVFTRRCRRCAASGAPPAAVAPARRRSGSGRGAGMGLAGVCALRRSAGYILVGGAGGQSAAAAARRCSEGEWASGGVRSFSRAAAAMAPIKVGDAIPAVEVFEGEPGNKVNLAELFKGKKGVLFGVPGAFTPGCSKTHLPGFVEQAEALKAKGVQVVACLSVNDAFVTGEWGRAHKAEGKVRLLADPTGAFGKETDLLLDDSLVSIFGNRRLKRFSMVVQDGIVKALNVEPDGTGLTCSLAPNIISQL

SEQ ID NO: 912846 - protein, 214 aa, Homo sapiens; identical to SEQ ID NO: 912844

SEQ ID NO: 912847 - protein, 214 aa, Homo sapiens; identical to SEQ ID NO: 912844

SEQ ID NO: 912848 - protein, 214 aa, Homo sapiens; identical to SEQ ID NO: 912844

SEQ ID NO: 912849 - protein, 214 aa, Homo sapiens; identical to SEQ ID NO: 912844

SEQ ID NO: 912850 - protein, 214 aa, Homo sapiens; identical to SEQ ID NO: 912844

SEQ ID NO: 912851 - protein, 167 aa, Homo sapiens
GTWPFSRTPAVGDAIPAVEVFEGEPGNKVNLAELFKGKKGVLFGVPGAFTPGCSKTHLPGFVEQAEALKAKGVQVVACLSVNDAFVTGEWGRAHKAEGKVRLLADPTGAFGKETDLLLDDSLVSIFGNRRLKRFSMVVQDGIVKALNVEPDGTGLTCSLAPNIISQL

SEQ ID NO: 912852 - protein, 230 aa, Homo sapiens
MGLAGVCALRRSAGYILVGGAGGQSAAAAARRCSEGEWASGGVRSFSRAAAAMAPIKVGDAIPAVEVFEGEPGNKVNLAELFKGKKGVLFGVPGAFTPGCSKTHLPGFVEQAEALKAKGVQVVACLSVNDAFVTGEWGRAHKAEGKVRLLADPTGAFGKETDLLLDDSLVSIFGNRRLKSLQAQADAAAWAPLSGRFSMVVQDGIVKALNVEPDGTGLTCSLAPNIISQL

SEQ ID NO: 912853 - protein, 167 aa, Homo sapiens
APAQWRRPGPPSAGCRRCAASGAPPAAVAPARRRSGSGRGAGMGLAGVCALRRSAGYILVGGAGGQSAAAAARRCSEGEWASGGVRSFSRAAAAMAPIKVRLLADPTGAFGKETDLLLDDSLVSIFGNRRLKRFSMVVQDGIVKALNVEPDGTGLTCSLAPNIISQL

SEQ ID NO: 912854 - protein, 170 aa, Homo sapiens
MGLAGVCALRRSAGYILVGGAGGQSAAAAARRCSEGEWASGGVRSFSRAAAAMAPIKVGDAIPAVEVFEGEPGNKVNLAELFKGKKGVLFGVPGAFTPGCSKVRLLADPTGAFGKETDLLLDDSLVSIFGNRRLKRFSMVVQDGIVKALNVEPDGTGLTCSLAPNIISQL

SEQ ID NO: 912855 - protein, 167 aa, Homo sapiens; identical to SEQ ID NO: 912853

SEQ ID NO: 912856 - protein, 214 aa, Homo sapiens; identical to SEQ ID NO: 912844

SEQ ID NO: 912857 - protein, 79 aa, Homo sapiens
IRWCPSWESSSNKVCLLPKGPSGKETDLLLDDSLVSIFGNRRLKRFSMVVQDGIVKALNVEPDGTGLTCSLAPNIISQL

SEQ ID NO: 912858 - protein, 214 aa, Homo sapiens; identical to SEQ ID NO: 912844

SEQ ID NO: 912859 - protein, 214 aa, Homo sapiens; identical to SEQ ID NO: 912844

SEQ ID NO: 912860 - protein, 214 aa, Homo sapiens; identical to SEQ ID NO: 912844

SEQ ID NO: 912861 - protein, 102 aa, Homo sapiens
PSARYEASVFTRRCRRCAASGAPPAAVAPARRRSGSGRGAGMGLAGVCALRRSAGYILVGGAGGQSAAAAARRCSEGEWASGGVRSFSRAAAAMAPIKAGVQ

SEQ ID NO: 912862 - protein, 119 aa, Homo sapiens
PFVPLPQTHLPGFVEQAEALKAKGVQVVACLSVNDAFVTGEWGRAHKAEGKVRLLADPTGAFGKETDLLLDDSLVSIFGNRRLKRFSMVVQDGIVKALNVEPDGTGLTCSLAPNIISQL

SEQ ID NO: 912863 - protein, 403 aa, Homo sapiens
APAQWRRPGPPSAGCRRCAASGAPPAAVAPARRRSGSGRGAGMGLAGVCALRRSAGYILVGGAGGQSAAAAARRCSEGEWASGGVRSFSRAAAAMAPIKVGDAIPAVEVFEGEPGNKVNLAELFKGKKGVLFGVPGAFTPGCSKTHLPGFVEQAEALKAKGVQVVACLSVNDAFVTGEWGRAHKAEGKVRLLADPTGAFGKETDLLLDDSLVSIFGNRRLKRVKVESPLWRESSVGESPLWERVLCGEGPLWEESSVGESPLCGRVVCGESPVWGESSVERVLCGGESCVGESPLWGESSVWRESCVGESPVWGESSVGESPLGRESCVGESSLWGESSVWRESCVVVSPLWGRVLCGGSPLWSSLGPLAVHCLSPCPASKPKLMQLPGPLFPAGSPWWYRMA

SEQ ID NO: 912864 - protein, 170 aa, Homo sapiens; identical to SEQ ID NO: 912854

SEQ ID NO: 912865 - protein, 203 aa, Homo sapiens
APAQWRRPGPPSAGCRRCAASGAPPAAVAPARRRSGSGRGAGMGLAGVCALRRSAGYILVGGAGGQSAAAAARRCSEGEWASGGVRSFSRAAAAMAPIKVGDAIPAVEVFEGEPGNKVNLAELFKGKKGVLFGVPGAFTPGCSKTHLAEFVGRLKALGQREFQGLALSRKEPLRWGRHGERPRVRLGLDPGGPFGKGTLAEGV

SEQ ID NO: 912866 - protein, 702 aa, Homo sapiens
MASPPCEEAVVSEEITSRSPVRADLPISLFWGTARIHCGQLRATHPNVLALPPCCVLSVLELELGGISVMPVVWQESWSGEGLIDGVVTMLAPQVEVIVICLVSKEACERKAGDCAEFIVGHLSKILGERETCYSFVQPRVSQSYLITDSSPHPLTHLTPFFFFHITSTGTWIPLGNTKIIKGSYLLSPHQLYITRHCGEHFYIHLSICPVAQSGATRYLHFTNEEAEVQRAKITCPELHSKIQIQLDLRAGLVELQYCTTPKHFIPEASSILSFVNNIAGNIFRLKIGDFFSLGHVSVLKDYYTISDDISNRQNGHFSRNVPLLNVQVRKKIFMVGGTYRVYNRILKLGYTFFRKVCILSVCVSCVSFPTCEMPVQVLYQAGSLTLAGLSVVHELLSDWGWAGRRYRISFFPLLEPRTFKAKELWEKNGAVIMAVRRPGCFLCREVSADEDLFRERILASRGHCFPARTKGREASFSLLPTCSVLLFALGISLICALFFFFLNNSPSPTGVSNTSQFPLVLPGLSPCAVPSESWTIFQFNQGRDQVQFHASDAQQQIYDVPGLLLIRVWSVPPCDEAAVSEETLQGYLLEQTCLSLFPWGALRVHRGQLRATFSHVSSASLLCALSIESVAQWDFSHASSAFGMRVCRKLELTDWVVSRLAPRREDIIYFVGDGAYQWKEGTVIVETQNASVRRNIATTWI

SEQ ID NO: 912867 - protein, 246 aa, Homo sapiens
WIYFFVKRSRGVDAVYEMSFLQDPSFFTMGMWSIGAGALGAAALALLLANTDVFLSKPQKAALEYLEDIDLKTLEKEPRTFKAKELWEKNGAVIMAVRRPGCFLCREEAADLSSLKSMLDQLGVPLYAVVKEHIRTEVKDFQPYFKGEIFLDEKKKFYGPQRRKMMFMGFIRLGVWYNFFRAWNGGFSGNLEGEGFILGGVFVVGSGKQGILLEHREKEFGDKVNLLSVLEAAKMIKPQTLASEKK

SEQ ID NO: 912868 - protein, 229 aa, Homo sapiens
MSFLQDPSFFTMGMWSIGAGALGAAALALLLANTDVFLSKPQKAALEYLEDIDLKTLEKEPRTFKAKELWEKNGAVIMAVRRPGCFLCREEAADLSSLKSMLDQLGVPLYAVVKEHIRTEVKDFQPYFKGEIFLDEKKKFYGPQRRKMMFMGFIRLGVWYNFFRAWNGGFSGNLEGEGFILGGVFVVGSGKQGILLEHREKEFGDKVNLLSVLEAAKMIKPQTLASEKK

SEQ ID NO: 912869 - protein, 245 aa, Homo sapiens
MDRGVGEIGRGDAVYEMSFLQDPSFFTMGMWSIGAGALGAAALALLLANTDVFLSKPQKAALEYLEDIDLKTLEKEPRTFKAKELWEKNGAVIMAVRRPGCFLCREEAADLSSLKSMLDQLGVPLYAVVKEHIRTEVKDFQPYFKGEIFLDEKKKFYGPQRRKMMFMGFIRLGVWYNFFRAWNGGFSGNLEGEGFILGGVFVVGSGKQGILLEHREKEFGDKVNLLSVLEAAKMIKPQTLASEKK

SEQ ID NO: 912870 - protein, 252 aa, Homo sapiens
MKFQLPCGSSNAFFLLLNLQKCQMSFLQDPSFFTMGMWSIGAGALGAAALALLLANTDVFLSKPQKAALEYLEDIDLKTLEKEPRTFKAKELWEKNGAVIMAVRRPGCFLCREEAADLSSLKSMLDQLGVPLYAVVKEHIRTEVKDFQPYFKGEIFLDEKKKFYGPQRRKMMFMGFIRLGVWYNFFRAWNGGFSGNLEGEGFILGGVFVVGSGKQGILLEHREKEFGDKVNLLSVLEAAKMIKPQTLASEKK

SEQ ID NO: 912871 - protein, 585 aa, Homo sapiens
MASPPCEEAVVSEEITSRSPVRADLPISLFWGTARIHCGQLRATHPNVLALPPCCVLSVLELELGGISVMPVVWQESWSGEGLIDGVVTMLAPQVEVIVICLVSKEACERKAGDCAEFIVGHLSKILGERETCYSFVQPRVSQSYLITDSSPHPLTHLTPFFFFHITSTGTWIPLGNTKIIKGSYLLSPHQLYITRHCGEHFYIHLSICPVAQSGATRYLHFTNEEAEVQRAKITCPELHSKIQIQLDLRAGLVELQYCTTPKHFIPEASSILSFVNNIAGNIFRLKIGDFFSLGHVSVLKDYYTISDDISNRQNGHFSRNVPLLNVQVRKKIFMVGGTYRVYNRILKLGYTFFRKVCILSVCVSCVSFPTCEMPVQVLYQAGSLTLAGLSVVHELLSDWGWAGRRYRISFFPLLEPRTFKAKELWEKNGAVIMAVRRPGCFLCREEAADLSSLKSMLDQLGVPLYAVVKEHIRTEVKDFQPYFKGEIFLDEKKKFYGPQRRKMMFMGFIRLGVWYNFFRAWNGGFSGNLEGEGFILGGVFVVGSGKQGILLEHREKEFGDKVNLLSVLEAAKMIKPQTLASEKK

SEQ ID NO: 912872 - protein, 229 aa, Homo sapiens; identical to SEQ ID NO: 912868

SEQ ID NO: 912873 - protein, 229 aa, Homo sapiens; identical to SEQ ID NO: 912868

SEQ ID NO: 912874 - protein, 709 aa, Homo sapiens
MTLLLRLYVHAHHIRTLLKWRLKKLDAKGNNDRFYSITTAEGESPQYRTELSSNLCRGDGILKGEGGGSNRTREVQNYKKLVRRLVNVIRLSVSTNFSNLFIKVRILASHRDQESALSFLIIIDKGMAPRKSEKHIPVQQKIHISPKGTERIYNCKFYKVCPLRRGRDWVPWLMPIIPALWVAKWVHHLRSGVQEQPGQHGETLSLLKIQKLACCGGAHLYSQLLGWLRQENRLNPGGGGCSEPGSRHCTSAWVTECDSISRKTREIEKPMIRHWLKQMVNSFGSLELPQAGTQRGLGYSLRQGLELLETMLVFVQVSPCPGGAKLFVLKINDLQLSRFQWAVWVGLSFCFFFFFMYRVLLCHLGYSVISGPSHGSLQLQTGCKLFWLSLPSYWAYRWMPPYPTDFIFVGMGVSLYCPGWSQTPGLPKCLDYRCKPPHVASLCISNRFQVILMFCWSMGHNFEKHGSKGLYRLKSLISVGFGLEVSAAFDKHCRFPFYLFDKLRIHMQRNARKFKERKKMSLLYKLVVLNLGYTVESPGAGVGGGVQCEKLLNQNLWGRPQATFFFFFLDRSCLSPRLECSNAIMAHCRLNFWAQVISSHLSLPSSWDYRRGLPHPTNFKIFCRGKLLYYLAQAGLELLGSSSHPASAFQSSGITDMSHSTRPTIFLKAPGDDSNMQPRLKTTTLKGSASSVEDQHTHVRRPYLEPGCP

SEQ ID NO: 912875 - protein, 229 aa, Homo sapiens; identical to SEQ ID NO: 912868

SEQ ID NO: 912876 - protein, 229 aa, Homo sapiens; identical to SEQ ID NO: 912868

SEQ ID NO: 912877 - protein, 229 aa, Homo sapiens; identical to SEQ ID NO: 912868

SEQ ID NO: 912878 - protein, 229 aa, Homo sapiens; identical to SEQ ID NO: 912868

SEQ ID NO: 912879 - protein, 152 aa, Homo sapiens
MAVRRPGCFLCREEAADLSSLKSMLDQLGVPLYAVVKEHIRTEVKDFQPYFKGEIFLDEKKKFYGPQRRKMMFMGFIRLGVWYNFFRAWNGGFSGNLEGEGFILGGVFVVGSGKQGILLEHREKEFGDKVNLLSVLEAAKMIKPQTLASEKK

SEQ ID NO: 912880 - protein, 178 aa, Homo sapiens
PLLSTGEDKEPGLQREPDTLCGGPQPAGTDVPEPLCLLQEAADLSSLKSMLDQLGVPLYAVVKEHIRTEVKDFQPYFKGEIFLDEKKKFYGPQRRKMMFMGFIRLGVWYNFFRAWNGGFSGNLEGEGFILGGVFVVGSGKQGILLEHREKEFGDKVNLLSVLEAAKMIKPQTLASEKK

SEQ ID NO: 912881 - protein, 498 aa, Homo sapiens
ECAKPKGRLGHKRRQLPCLSLPPACIQAPPSPAALGPGSPEARGPYSGWGSGRRSPEGWRTESCQRRLGAGPGGPALLGPRPLVSSGVSQAPYQARPGSLALICTGPASSGRCAARGEREETGPPGAGRRRAGPGAAHFPWGGPTRRPRLSWPSEAHEEARPNAGAWSIEAGPSRDSRAWPDAGNHTLAQTASPDGTEPGHSPGCKNSAGVSTPTSGSMCPPQAQAEVGPTMTEKAEMVCAPSPSPAARPKAASPGPPQVEEVGHRGGSSPPRLPPGVPVISLGHSRPPGVAMPTTELGTLRPPLLQLSTLGTAPPTLALHYHPHPFLNSVYIGPAGPFSIFPSSRLKRRPSHCELDLAEGHQPQKVARRVFTNSRERWRQQNVNGAFAELRKLLPTHPPDRKLSKNEVLRLAMKYIGFLVRLLRDQAAALAAGPTPPGPRKRPVHRVPDDGARRGSGRRAEAAARSQPAPPADPDGSPGGAARPIKMEQTALSPEVR

SEQ ID NO: 912882 - protein, 131 aa, Homo sapiens
MAEPDYIEDDNPELIRPQKLINPVKTSRNHQDLHRELLMNQKRGLAPQNKPELQKVMEKRKRDQVIKQKEEEAQKKKSDLEIELLKRQQKLEQLELEKQKLQEEQENAPEFVKVKGNLRRTGQEVAQAQES

SEQ ID NO: 912883 - protein, 204 aa, Homo sapiens
REPPCAGLACGPGRRPRSRPRAASGRRRAVGPLGAAAGAGSELGGSRAPLCARRDSPPEDIDHKDSYLITRSIMAEPDYIEDDNPELIRPQKLINPVKTSRNHQDLHRELLMNQKRGLAPQNKPELQKVMEKRKRDQVIKQKEEEAQKKKSDLEIELLKRQQKLEQLELEKQKLQEEQENAPEFVKVKGNLRRTGQEVAQAQES

SEQ ID NO: 912884 - protein, 131 aa, Homo sapiens; identical to SEQ ID NO: 912882

SEQ ID NO: 912885 - protein, 107 aa, Homo sapiens
RSPQDYSRSSQRNFLNQKRGLAPQNKPELQKVMEKRKRDQVIKQKEEEAQKKKSDLEIELLKRQQKLEQLELEKQKLQEEQENAPEFVKVKGNLRRTGQEVAQAQES

SEQ ID NO: 912886 - protein, 204 aa, Homo sapiens; identical to SEQ ID NO: 912883

SEQ ID NO: 912887 - protein, 148 aa, Homo sapiens
REPPCAGLACGPGRRPRSRPRAASGRRRAVGPLGAAAGAGSELGGSRAPLCARRDSPPEDIDHKDSYLITRSIMAEPDYIEDDNPELIRPQKLINPVKTSRNHQDLHRELLMNQKRTGLPLREADPLQVAITVVASSASRLLQSRVPF

SEQ ID NO: 912888 - protein, 131 aa, Homo sapiens; identical to SEQ ID NO: 912882

SEQ ID NO: 912889 - protein, 192 aa, Homo sapiens
ECFSLNLNCGSFDIQKESSLWGWLILVLGAFLHRSKELPQSEDSPPEDIDHKDSYLITRSIMAEPDYIEDDNPELIRPQKLINPVKTSRNHQDLHRELLMNQKRGLAPQNKPELQKVMEKRKRDQVIKQKEEEAQKKKSDLEIELLKRQQKLEQLELEKQKLQEEQENAPEFVKVKGNLRRTGQEVAQAQES

SEQ ID NO: 912890 - protein, 204 aa, Homo sapiens; identical to SEQ ID NO: 912883

SEQ ID NO: 912891 - protein, 103 aa, Homo sapiens
GSFEFFFILTMKLLMVLMLAALSQHCYAGSGCPLLENVISKTINPQVSKTEYKELLQEFIDDNATTNAIDELKECFLNQTDETLSNVEVFMQLIYDSSLCDLF

SEQ ID NO: 912892 - protein, 113 aa, Homo sapiens
HSGFLDPCHPRLNTDSSSLTMKLLMVLMLAALSQHCYAGSGCPLLENVISKTINPQVSKTEYKELLQEFIDDNATTNAIDELKECFLNQTDETLSNVEVFMQLIYDSSLCDLF

SEQ ID NO: 912893 - protein, 767 aa, Homo sapiens
FPGLESDLSTLIVWLSKNRSIQHLALGKNFNNMKSKNLTPVLDNLVQMIQDEESPLQSLSLADSKLKTEVTIIINALGSNTSLTKVDISGNGMGDMGAKMLAKALQINTKLRTVIWDKNNITAQGFQDIAVAMEKNYTLRFMPIPMYDASQALKTNPEKTEDALQKIENYLLRNHETRKYLQEQAYRLQQGIVTSTTQQMIDRICVKVQDHLNSLRNCGGDAIQEDLKSAERLMRDAKNSKTLLPNLYHVGGASWAGASGLLSSPIQETLESMAGEVTRVVDEQLKALLESMVDAAENLCPNVMKKAHIRQDLIHASTEKISIPRTFVKNVLLEQSGIDILNKISEVKLTVASFLSDRIVDEILDALSHCHHKLADHFSRRGKTLPQQESLEIELAEEKPVKRSIITVEELTEIERLEDLDTCMMTPKSKRKSIHSRMLRPVSRAFEMEFDLDKALEEVPIHIEDPPFPSLRQEKRSSGFISELPSEEGKKLEHFTKLRPKRNKKQQPTQAAVCAANIVSQDGEQNGLMGRVDEGVDEFFTKKVTKMDSKKWSTRGSESHELNEGGDEKKKRDSRKSSGFLNLIKSRSKSERPPTILMTEEPSSPKGAVRSPPVDCPRKDTKAAEHNGNSERIEEIKTPDSFEESQGEEIGKVERSDSKSSPQAGRRYGVQVMGSGLLAEMKAKQVQRTALVWEHQKRIPKQNPKRKQAPGLGAHPAHLRARSPSCSPPNPVWQHGPSSRRNQEPPHGLMTFQTLHLARKLPFFHLS

SEQ ID NO: 912894 - protein, 758 aa, Homo sapiens
FPGLESDLSTLIVWLSKNRSIQHLALGKNFNNMKSKNLTPVLDNLVQMIQDEESPLQSLSLADSKLKTEVTIIINALGSNTSLTKVDISGNGMGDMGAKMLAKALQINTKLRTVIWDKNNITAQGFQDIAVAMEKNYTLRFMPIPMYDASQALKTNPEKTEDALQKIENYLLRNHETRKYLQEQAYRLQQGIVTSTTQQMIDRICVKVQDHLNSLRNCGGDAIQEDLKSAERLMRDAKNSKTLLPNLYHVGGASWAGASGLLSSPIQETLESMAGEVTRVVDEQLKALLESMVDAAENLCPNVMKKAHIRQDLIHASTEKISIPRTFVKNVLLEQSGIDILNKISEVKLTVASFLSDRIVDESWMHSHIAIINWLTISADVARPFLNKEKPVKRSIITVEELTEIERLEDLDTCMMTPKSKRKSIHSRMLRPVSRAFEMEFDLDKALEEVPIHIEDPPFPSLRQEKRSSGFISELPSEEGKKLEHFTKLRPKRNKKQQPTQAAVCAANIVSQDGEQNGLMGRVDEGVDEFFTKKVTKMDSKKWSTRGSESHELNEGGDEKKKRDSRKSSGFLNLIKSRSKSERPPTILMTEEPSSPKGAVRSPPVDCPRKDTKAAEHNGNSERIEEIKTPDSFEESQGEEIGKVERSDSKSSPQAGRRYGVQVMGSGLLAEMKAKQVQRTALVWEHQKRIPKQNPKRKQAPGLGAHPAHLRARSPSCSPPNPVWQHGPSSRRNQEPPHGLMTFQTLHLARKLPFFHLS

SEQ ID NO: 912895 - protein, 671 aa, Homo sapiens
LVLEVSIALQINTKLRTVIWDKNNITAQGFQDIAVAMEKNYTLRFMPIPMYDASQALKTNPEKTEDALQKIENYLLRNHETRKYLQEQAYRLQQGIVTSTTQQMIDRICVKVQDHLNSLRNCGGDAIQEDLKSAERLMRDAKNSKTLLPNLYHVGGASWAGASGLLSSPIQETLESMAGEVTRVVDEQLKALLESMVDAAENLCPNVMKKAHIRQDLIHASTEKISIPRTFVKNVLLEQSGIDILNKISEVKLTVASFLSDRIVDEILDALSHCHHKLADHFSRRGKTLPQQESLEIELAEEKPVKRSIITVEELTEIERLEDLDTCMMTPKSKRKSIHSRMLRPVSRAFEMEFDLDKALEEVPIHIEDPPFPSLRQEKRSSGFISELPSEEGKKLEHFTKLRPKRNKKQQPTQAAVCAANIVSQDGEQNGLMGRVDEGVDEFFTKKVTKMDSKKWSTRGSESHELNEGGDEKKKRDSRKSSGFLNLIKSRSKSERPPTILMTEEPSSPKGAVRSPPVDCPRKDTKAAEHNGNSERIEEIKTPDSFEESQGEEIGKVERSDSKSSPQAGRRYGVQVMGSGLLAEMKAKQVQRTALVWEHQKRIPKQNPKRKQAPGLGAHPAHLRARSPSCSPPNPVWQHGPSSRRNQEPPHGLMTFQTLHLARKLPFFHLS

SEQ ID NO: 912896 - protein, 767 aa, Homo sapiens; identical to SEQ ID NO: 912893

SEQ ID NO: 912897 - protein, 124 aa, Homo sapiens [sequence omitted]

SEQ ID NO: 912898 - protein, 323 aa, Homo sapiens; identical to SEQ ID NO: 813767

SEQ ID NO: 912899 - protein, 152 aa, Homo sapiens
MKLFRLSAGRAAQTRQVCSRRPRGRVPRSLQIELRQNTSQKAAGDVDIGDAAYYFERDIKGESLFQGRGGLDLRVRGEPLQVERTLIYYLDEIPPKFSMKRLTAGLIAVIVVVVVALVAGMAVLVITNRRKSGKYKKVEIKELGELRKEPSL

SEQ ID NO: 912900 - protein, 323 aa, Homo sapiens; identical to SEQ ID NO: 813767

SEQ ID NO: 912901 - protein, 323 aa, Homo sapiens; identical to SEQ ID NO: 813767

SEQ ID NO: 912902 - protein, 323 aa, Homo sapiens; identical to SEQ ID NO: 813767

SEQ ID NO: 912903 - protein, 349 aa, Homo sapiens
MSKSKDDAPHELESQFILRLPPEYASTVRRAVQSGHVNLKDRLTIELHPDGRHGIVRVDRVPLASKLVDLPCVMESLKTIDKKTFYKTADICQMLVSTVDGDLYPPVEEPVASTDPKASKKKDKDKEKKFIWNHGITLPLKNVRKRRFRKTAKKKYIESPDVEKEVKRLLSTDAEAVSTRWEIIAEDETKEAENQGLDISSPGMSGHRQGHDSLEHDELREIFNDLSSSSEDEDETQHQDEEDINIIDTEEDLERQLQDKLNESDEQHQENEGTNQLVMGIQKQIDNMKGKLQETQDRAKRQEDLIMKVENLALKNRFQAVLDELKQKEDREKEQLSSLQEELESLLEK

SEQ ID NO: 912904 - protein, 271 aa, Homo sapiens
MSKSKDDAPHELESQFILRLPPEYASTVRRAVQSGHVNLKDRLTIELHPDGRHGIVRVDRVPLASKLVDLPCVMESLKTIDKKTFYKTADICQMLVSTVDGDLYPPVEEPVASTDPKASKKKDKDKEKKFIWNHGITLPLKNVRKRRFRKTAKKKYIESPDVEKEVKRLLSTDAEAVSTRWEIIAEDETKEAENQGLDISSPGMSGHRQGHDSLEHDELREIFNDLSSSSEDEDETQHQDEEDINIIDTEEDLERQLQDKLNESDEQHQEK

SEQ ID NO: 912905 - protein, 349 aa, Homo sapiens; identical to SEQ ID NO: 912903

SEQ ID NO: 912906 - protein, 250 aa, Homo sapiens
MSKSKDDAPHELESQFILRLPPEYASTVRRAVQSGHVNLKDRLTIELHPDGRHGIVRVDRVPLASKLVDLPCVMESLKTIDKKTFYKTADICQMLVSTVDGDLYPPVEEPVASTDPKASKKKDKDKEKKFIWNHGITLPLKNVRKRRFRKTAKKKYIESPDVEKEVKRLLSTDAEAVSTRWEIIAEDETKEAENQGLDISSPGMSGHRQGHDSLEHDELREIFNDLSSSSEDEDETQHQDEKMIVGKLQD

SEQ ID NO: 912907 - protein, 98 aa, Homo sapiens
PPAPRRDVALPFLLGRRPGRRAGEVRGLVMRAAPLGKISRCPSRALSSVIGSGSLCQAAGRIKETTRRRSALSRLAPCGLLFPSLRPGETELIIVTGL

SEQ ID NO: 912908 - protein, 132 aa, Homo sapiens
PPAPRRDVALPFLLGRRPGRRAGEVRGLVMRAAPLGKISRCPSRALSSVIGSGSLCQAAGRIKETTRRRSALSRLAPCGLLFPSLRPGETELIIVTGLWSLALSSRLECNGTISAHCNLRLLNSTNSSASAS

SEQ ID NO: 912909 - protein, 132 aa, Homo sapiens; identical to SEQ ID NO: 912908

SEQ ID NO: 912910 - protein, 349 aa, Homo sapiens; identical to SEQ ID NO: 912903

SEQ ID NO: 912911 - protein, 276 aa, Homo sapiens [sequence omitted]

SEQ ID NO: 912912 - protein, 255 aa, Homo sapiens
LALGSVLATGASQEDRDHHQLWIQASDRYQLSCKKFIWNHGITLPLKNVRKRRFRKTAKKKYIESPDVEKEVKRLLSTDAEAVSTRWEIIAEDETKEAENQGLDISSPGMSGHRQGHDSLEHDELREIFNDLSSSSEDEDETQHQDEEDINIIDTEEDLERQLQDKLNESDEQHQENEGTNQLVMGIQKQIDNMKGKLQETQDRAKRQEDLIMKVENLALKNRFQAVLDELKQKEDREKEQLSSLQEELESLLEK

SEQ ID NO: 912913 - protein, 218 aa, Homo sapiens
MKRYIISSTKTARQDERITKTADVDVEHKTSSNRHPHSRWNKRTPKQVRAGEGTKIRETKTNHTKTRRLTTHRREIVNAIHRRKEYVAVKHQAAIIPRHDKTITVQPGRLDYKTQENTGGRGIEISSEEEERQQENREEAEKETGEDMRRERSRKKKEGGAKTARDREHNEGERTKRKKEGGGRDKAERQETERDEDERRARRKDEEERVDGAKKEEE

SEQ ID NO: 912914 - protein, 586 aa, Homo sapiens
MVPRTFCKETGYLVLIAVMLVSRTYCDVWMIQNGTLIESGIIGRSRKDFKRYLLNFIAAMPLISLVNNFLKYGLNELKLCFRVRLTKYLYEEYLQAFTYYKMGNLDNRIANPDQLLTQDVEKFCNSVVDLYSNLSKPFLDIVLYIFKLTSAIGAQGPASMMAYLVVSGLFLTRLRRPIGKMTITEQKYEGEYRYVNSRLITNSEEIAFYNGNKREKQTVHSVFRKLVEHLHNFILFRFSMGFIDSIIAKYLATVVGYLVVSRPFLDLSHPRHLKSTHSELLEDYYQSGRMLLRMSQALGRIVLAGREMTRLAGFTARITELMQVLKDLNHGKYERTMVSQQEKGIEGVQVIPLIPGAGEIIIADNIIKFDHVPLATPNGDVLIRDLNFEVRSGANVLICGPNGCGKSSLFRVLGELWPLFGGRLTKPERGKLFYVPQRPYMTLGTLRDQVIYPDGREDQKRKGISDLVLKEYLDNVQLGHILEREGGWDSVQDWMDVLSGGEKQRMAMARLFYHKPQFAILDECTSAVSVDVEGYIYSHCRKVGITLFTVSHRKSLWKHHEYYLHMDGRGNYEFKQITEDTVEFGS

SEQ ID NO: 912915 - protein, 586 aa, Homo sapiens; identical to SEQ ID NO: 912914

SEQ ID NO: 912916 - protein, 426 aa, Homo sapiens [sequence omitted]

SEQ ID NO: 912917 - protein, 138 aa, Homo sapiens
WRGSTHASEKRTGILNLDLVLKEYLDNVQLGHILEREGGWDSVQDWMDVLSGGEKQRMAMARLFYHKPQFAILDECTSAVSVDVEGYIYSHCRKVGITLFTVSHRKSLWKHHEYYLHMDGRGNYEFKQITEDTVEFGS

SEQ ID NO: 912918 - protein, 659 aa, Homo sapiens
MAAFSKYLTARNSSLAGAAFLLLCLLHKRRRALGLHGKKSGKPPLQNNEKEGKKERAVVDKVFFSRLIQILKIMVPRTFCKETGYLVLIAVMLVSRTYCDVWMIQNGTLIESGIIGRSRKDFKRYLLNFIAAMPLISLVNNFLKYGLNELKLCFRVRLTKYLYEEYLQAFTYYKMGNLDNRIANPDQLLTQDVEKFCNSVVDLYSNLSKPFLDIVLYIFKLTSAIGAQGPASMMAYLVVSGLFLTRLRRPIGKMTITEQKYEGEYRYVNSRLITNSEEIAFYNGNKREKQTVHSVFRKLVEHLHNFILFRFSMGFIDSIIAKYLATVVGYLVVSRPFLDLSHPRHLKSTHSELLEDYYQSGRMLLRMSQALGRIVLAGREMTRLAGFTARITELMQVLKDLNHGKYERTMVSQQEKGIEGVQVIPLIPGAGEIIIADNIIKFDHVPLATPNGDVLIRDLNFEVRSGANVLICGPNGCGKSSLFRVLGELWPLFGGRLTKPERGKLFYVPQRPYMTLGTLRDQVIYPDGREDQKRKGISDLVLKEYLDNVQLGHILEREGGWDSVQDWMDVLSGGEKQRMAMARLFYHKPQFAILDECTSAVSVDVEGYIYSHCRKVGITLFTVSHRKSLWKHHEYYLHMDGRGNYEFKQITEDTVEFGS

SEQ ID NO: 912919 - protein, 259 aa, Homo sapiens
RSEVAAAAAAAASPRRLAGTGSAMAAFSKYLTARNSSLAGAAFLLLCLLHKRRRALGLHGKKSGKPPLQNNEKEGKKERAVVDKVFFSRLIQILKIMVPRTFCKETGYLVLIAVMLVSRTYCDVWMIQNGTLIESGIIGRSRKDFKRYLLNFIAAMPLISLVNNFLKYGLNELKLCFRVRLTKYLYEEYLQAFTYYKMGNLDNRIANPDQLLTQDVEKFCNSVVDLYSNLSKPFLDIVLYIFKLTSAIGAQVLGKILWH

SEQ ID NO: 912920 - protein, 659 aa, Homo sapiens; identical to SEQ ID NO: 912918

SEQ ID NO: 912921 - protein, 664 aa, Homo sapiens
RSEVAAAAAAAASPRRLAGTGSAMAAFSKYLTARNSSLAGAAFLLLCLLHKRRRALGLHGKKSGKPPLQNNEKEGKKERAVVDKVFFSRLIQILKIMVPRTFCKETGYLVLIAVMLVSRTYCDVWMIQNGTLIESGIIGRSRKDFKRYLLNFIAAMPLISLVNNFLKYGLNELKLCFRVRLTKYLYEEYLQAFTYYKMGNLDNRIANPDQLLTQDVEKFCNSVVDLYSNLSKPFLDIVLYIFKLTSAIGAQGPASMMAYLVVSGLFLTRLRRPIGKMTITEQKYEGEYRYVNSRLITNSEEIAFYNGNKREKQTVHSVFRKLVEHLHNFILFRFSMGFIDSIIAKYLATVVGYLVVSRPFLDLSHPRHLKSTHSELLEDYYQSGRMLLRMSQALGRIVLAGREMTRLAGFTARITELMQVLKDLNHGKYERTMVSQQEKGIEGVQVIPLIPGAGEIIIADNIIKFDHVPLATPNGDVLIRDLNFEVRSGANVLICGPNGCGKSSLFRVLGELWPLFGGRLTKPERGQVIYPDGREDQKRKGISDLVLKEYLDNVQLGHILEREGGWDSVQDWMDVLSGGEKQRMAMARLFYHKPQFAILDECTSAVSVDVEGYIYSHCRKVGITLFTVSHRKSLWKHHEYYLHMDGRGNYEFKQITEDTVEFGS

SEQ ID NO: 912922 - protein, 664 aa, Homo sapiens
RSEVAAAAAAAASPRRLAGTGSAMAAFSKYLTARNSSLAGAAFLLLCLLHKRRRALGLHGKKSGKPPLQNNEKEGKKERAVVDKVFFSRLIQILKIMVPRTFCKETGYLVLIAVMLVSRTYCDVWMIQNGTLIESGIIGRSRKDFKRYLLNFIAAMPLISLVNNFLKYGLNELKLCFRVRLTKYLYEEYLQAFTYYKMGNLDNRIANPDQLLTQDVEKFCNSVVDLYSNLSKPFLDIVLYIFKLTSAIGAQGPASMMAYLVVSGLFLTRLRRPIGKMTITEQKYEGEYRYVNSRLITNSEEIAFYNGNKREKQTVHSVFRKLVEHLHNFILFRFSMGFIDSIIAKYLATVVGYLVVSRPFLDLSHPRHLKSTHSELLEDYYQSGRMLLRMSQALGRIVLAGREMTRLAGFTARITELMQVLKDLNHGKYERTMVSQQEKGIEGVQVIPLIPGAGEIIIADNIIKFDHVPLATPNGDVLIRDLNFEVRSGANVLICGPNGCGKSSLFRVLGELWPLFGGRLTKPERGKLFYVPQRPYMTLGTLRDQVIYPDGREDQLGHILEREGGWDSVQDWMDVLSGGEKQRMAMARLFYHKPQFAILDECTSAVSVDVEGYIYSHCRKVGITLFTVSHRKSLWKHHEYYLHMDGRGNYEFKQITEDTVEFGS

SEQ ID NO: 912923 - protein, 659 aa, Homo sapiens; identical to SEQ ID NO: 912918

SEQ ID NO: 912924 - protein, 659 aa, Homo sapiens; identical to SEQ ID NO: 912918

SEQ ID NO: 912925 - protein, 435 aa, Homo sapiens
MGRTREAGCVAAGVVIGAGACYCVYRLAWGRDENEKIWDEDEESTDTSEIGVETVKGAKTNAGAGSGAKLQGDSEVKPEVSLGLEDCPGVKEKAHSGSHSGGGLEAKAKALFNTLKEQASAKAGKGARVGTISGNRTLAPSLPCPGGRGGGCHPTRSGSRAGGRASGKSKGKARSKSTRAPATTWPVRRGKFNFPYKIDDILSAPDLQKVLNILERTNDPFIQEVALVTLGNNAAYSFNQNAIRELGGVPIIAKLIKTKDPIIREKTYNALNNLSVNAENQGKIKTYISQVCDDTMVCRLDSAVQMAGLRLLTNMTVTNHYQHLLSYSFPDFFALLFLGNHFTKIQIMKLIINFTENPAMTRELVSCKVPSELISLFNKEWDREILLNILTLFENINDNIKNEGLASSRKEFSRSSLFFLFKESGVCVKKILTKL

SEQ ID NO: 912926 - protein, 453 aa, Homo sapiens
MGRTREAGCVAAGVVIGAGACYCVYRLAWGRDENEKIWDEDEESTDTSEIGVETVKGAKTNAGAGSGAKLQGDSEVKPEVSLGLEDCPGVKEKAHSGSHSGGGLEAKAKALFNTLKEQASAKAGKGARVGTISGNRTLAPSLPCPGGRGGGCHPTRSGSRAGGRASGKSKGKARSKSTRAPATTWPVRRGKFNFPYKIDDILSAPDLQKVLNILERTNDPFIQEVALVTLGNNAAYSFNQNAIRELGGVPIIAKLIKTKDPIIREKTYNALNNLSVNAENQGKIKTYISQVCDDTMVCRLDSAVQMAGLRLLTNMTVTNHYQHLLSYSFPDFFALLFLGNHFTKIQIMKLIINFTENPAMTRELVSCKVPSELISLFNKEWDREILLNILTLFENINDNIKNEGLASSRKEFSRSSLFFLFKESGVCVKKIKALANHNDLVVKVKVLKVLTKL

SEQ ID NO: 912927 - protein, 134 aa, Homo sapiens
SSGINAEWPLRPGLFSFFSFFLFSGVQDVEARGTWWVLWCEIPDFLGSSGRSPVINCADNTGAKNLYIISVKGIKGRLNRLPAAGVGDMVMATVKKGKPELRKKVHPAVVIRQRKSYRRKRWACFFILKIMQES

SEQ ID NO: 912928 - protein, 115 aa, Homo sapiens
KTARWRTLKMSKRGTWWVLWCEIPDFLGSSGRSPVINCADNTGAKNLYIISVKGIKGRLNRLPAAGVGDMVMATVKKGKPELRKKVHPAVVIRQRKSYRRKRWACFFILKIMQES

SEQ ID NO: 912929 - protein, 113 aa, Homo sapiens
PRVRGRVGSKRGTWWVLWCEIPDFLGSSGRSPVINCADNTGAKNLYIISVKGIKGRLNRLPAAGVGDMVMATVKKGKPELRKKVHPAVVIRQRKSYRRKRWACFFILKIMQES

SEQ ID NO: 912930 - protein, 115 aa, Homo sapiens; identical to SEQ ID NO: 912928

SEQ ID NO: 912931 - protein, 107 aa, Homo sapiens
FFPAKNSLLGRGGGAKSRFLLKLAGAPPINADNTGAKNLYIISVKGIKGRLNRLPAAGVGDMVMATVKKGKPELRKKVHPAVVIRQRKSYRRKRWACFFILKIMQES

SEQ ID NO: 912932 - protein, 259 aa, Homo sapiens
MWGARPGALETPSKPHEKGPRGPQRHTGNRGQTMTPKENREPKHKATEIPPKYKPPEDNPKRRDTTPQEHTSENTTRRPQPQRAQSEATVNKNSGPKRGKHNTPQKQHAKPQTAPTQSNTQKHTTANPPPQHDTPQHATNIYGHHIPYSLPSHITLINQFIHTTTLTSSVPFSHNAECHPSVVRSVRVRLLLAALTPGAAISGGRALGVGVESVGDCGVIGRRYGRGQLDWRVERGTTPWRAGGRYTGEAGGRSGRRRE

SEQ ID NO: 912933 - protein, 135 aa, Homo sapiens
DHASRTRGLDPKRPKMSKRSFFLFSGVQDVEARGTWWVLWCEIPDFLGSSGRRPVINCADNTGAKNLYIISVKGIKGRLNRLPAAGVGDMVMATVKKGKPELRKKVHPAVVIRQRKSYRRKRWACFFILKIMQES

SEQ ID NO: 912934 - protein, 133 aa, Homo sapiens
VAITMSPTPAAGSLFSRSFFLFSGVQDVEARGTWWVLWCEIPDFLGSSGRSPVINCADNTGAKNLYIISVKGIKGRLNRLPAAGVGDMVMATVKKGKPELRKKVHPAVVIRQRKSYRRKRWACFFILKIMQES

SEQ ID NO: 912935 - protein, 140 aa, Homo sapiens
SGLGPREEGGRGVKVHIPVSFESTSFFLFSGVQDVEARGTWWVLWCEIPDFLGSSGRSPVINCADNTGAKNLYIISVKGIKGRLNRLPAAGVGDMVMATVKKGKPELRKKVHPAVVIRQRKSYRRKRWACFFILKIMQES

SEQ ID NO: 912936 - protein, 140 aa, Homo sapiens; identical to SEQ ID NO: 912935

SEQ ID NO: 912937 - protein, 140 aa, Homo sapiens; identical to SEQ ID NO: 912935

SEQ ID NO: 912938 - protein, 140 aa, Homo sapiens; identical to SEQ ID NO: 912935

SEQ ID NO: 912939 - protein, 140 aa, Homo sapiens; identical to SEQ ID NO: 912935

SEQ ID NO: 912940 - protein, 140 aa, Homo sapiens; identical to SEQ ID NO: 912935

SEQ ID NO: 912941 - protein, 140 aa, Homo sapiens; identical to SEQ ID NO: 912935

SEQ ID NO: 912942 - protein, 140 aa, Homo sapiens; identical to SEQ ID NO: 912935

SEQ ID NO: 912943 - protein, 118 aa, Homo sapiens
GRLLLLNSRPRRRSKRGTWWVLWCEIPDFLGSSGRSPVINCADNTGAKNLYIISVKGIKGRLNRLPAAGVGDMVMATVKKGKPELRKKVHPAVVIRQRKSYRRKRWACFFILKIMQES

SEQ ID NO: 912944 - protein, 112 aa, Homo sapiens
GLSFNQAVKRGTWWVLWCEIPDFLGSSGRSPVINCADNTGAKNLYIISVKGIKGRLNRLPAAGVGDMVMATVKKGKPELRKKVHPAVVIRQRKSYRRKRWACFFILKIMQES

SEQ ID NO: 912945 - protein, 128 aa, Homo sapiens
KQWYQRRVAITAGAFFFFPAFKMSKRGTWWVLWCEIPDFLGSSGRSPVINCADNTGAKNLYIISVKGIKGRLNRLPAAGVGDMVMATVKKGKPELRKKVHPAVVIRQRKSYRRKRWACFFILKIMQES

SEQ ID NO: 912946 - protein, 128 aa, Homo sapiens; identical to SEQ ID NO: 912945

SEQ ID NO: 912947 - protein, 133 aa, Homo sapiens; identical to SEQ ID NO: 912934

SEQ ID NO: 912948 - protein, 104 aa, Homo sapiens
VAITMSPTPAAGSLFSRSFFLFSGVQDVEARGTWWVLWCEIPDFLGSSGRSPVINCADNTGAKNLYIISVKGIKGRLNRLPAAGVGDMVMATVKKGKPELRKKG

SEQ ID NO: 912949 - protein, 126 aa, Homo sapiens
VAITMSPTPAAGSLFSRSFFLFSGVQDVEARGTWWVLWCEIPDFLGSSGRSPVINCADNTGAKNLYIISVKGIKGRLNRLPAAGVGDMVMATVKKGKPELRKKVHPAVVIRQRKSYRRKVLPLQDQ

SEQ ID NO: 912950 - protein, 136 aa, Homo sapiens
VAITMSPTPAAGSLFSRSFFLFSGVQDVEARGTWWVLWCEIPDFLGSSGRSPVINCADNTGAKNLYIISVKGIKGRLNRLPAAGVGDMVMATVKKGKPELRKKVHPAVVIRQRKSYRRKEEENDPDHFLLPEEEND

SEQ ID NO: 912951 - protein, 124 aa, Homo sapiens
VAITMSPTPAAGSLFSRSFFLFSGVQDVEARGTWWVLWCEIPDFLGSSGRSPVINCADNTGAKNLYIISVKGIKGRLNRLPAAGVGDMVMATVKKGKPELRKKGYIQQCHSQRSHSLKDACFLF

SEQ ID NO: 912952 - protein, 63 aa, Homo sapiens
LSSTQEEVHQLRRGIEKLRVRIEADEKKQLHIAEKLKERERENDSLKDKVENLERELQMSQES

SEQ ID NO: 912953 - protein, 140 aa, Homo sapiens; identical to SEQ ID NO: 912935

SEQ ID NO: 912954 - protein, 128 aa, Homo sapiens; identical to SEQ ID NO: 912945

SEQ ID NO: 912955 - protein, 113 aa, Homo sapiens; identical to SEQ ID NO: 912929

SEQ ID NO: 912956 - protein, 121 aa, Homo sapiens
DHASRTRGLDPKRPKMSKRGTWWVLWCEIPDFLGSSGRSPVINCADNTGAKNLYIISVKGIKGRLNRLPAAGVGDMVMATVKKGKPELRKKVHPAVVIRQRKSYRRKRWACFFILKIMQES

SEQ ID NO: 912957 - protein, 80 aa, Homo sapiens
GRLLLLNSRPRRRVEAVKGIKGRLNRLPAAGVGDMVMATVKKGKPELRKKVHPAVVIRQRKSYRRKRWACFFILKIMQES

SEQ ID NO: 912958 - protein, 63 aa, Homo sapiens; identical to SEQ ID NO: 912952

SEQ ID NO: 912959 - protein, 140 aa, Homo sapiens; identical to SEQ ID NO: 912935

SEQ ID NO: 912960 - protein, 140 aa, Homo sapiens; identical to SEQ ID NO: 912935

SEQ ID NO: 912961 - protein, 140 aa, Homo sapiens; identical to SEQ ID NO: 912935

SEQ ID NO: 912962 - protein, 140 aa, Homo sapiens; identical to SEQ ID NO: 912935

SEQ ID NO: 912963 - protein, 140 aa, Homo sapiens; identical to SEQ ID NO: 912935

SEQ ID NO: 912964 - protein, 140 aa, Homo sapiens; identical to SEQ ID NO: 912935

SEQ ID NO: 912965 - protein, 113 aa, Homo sapiens
MPCRSNCVLRKGTWWVLWCEIPDFLGSSGRSPVINCADNTGAKNLYIISVKGIKGRLNRLPAAGVGDMVMATVKKGKPELRKKVHPAVVIRQRKSYRRKRWACFFILKIMQES

SEQ ID NO: 912966 - protein, 106 aa, Homo sapiens
MSKRGTWWVLWCEIPDFLGSSGRSPVINCADNTGAKNLYIISVKGIKGRLNRLPAAGVGDMVMATVKKGKPELRKKVHPAVVIRQRKSYRRKRWACFFILKIMQES

SEQ ID NO: 912967 - protein, 140 aa, Homo sapiens; identical to SEQ ID NO: 912935

SEQ ID NO: 912968 - protein, 133 aa, Homo sapiens; identical to SEQ ID NO: 912934

SEQ ID NO: 912969 - protein, 133 aa, Homo sapiens; identical to SEQ ID NO: 912934

SEQ ID NO: 912970 - protein, 126 aa, Homo sapiens; identical to SEQ ID NO: 912949

SEQ ID NO: 912971 - protein, 124 aa, Homo sapiens
VAITMSPTPAAGSLFSRSFFLFSGVQDVEARGTWWVLWCEIPDFLGSSGRSPVINCADNTGAKNLYIISVKGIKGRLNRLPAAGVGDMVMATVKKGKPELRKKVHHLREGDQGTAEQTSRCWCG

SEQ ID NO: 912972 - protein, 136 aa, Homo sapiens
VAITMSPTPAAGSLFSRSFFLFSGVQDVEARGTWWVLWCEIPDFLGSSGRSPVINCADNTGAKNLYIISVKGIKGRLNRLPAAGVGDMVMATVKKGKPELRKKVHPAVDLKVRHDYMCCFLFCIETSYMILPYIDL

SEQ ID NO: 912973 - protein, 112 aa, Homo sapiens
DHASRTRGLDPKRPKMSKLPFFFFPAFKMSKRGEVLFLEDPPPSVVQWLADSSGAVALGSWGALLSFRPERESQATARALPGPSKVAVGCWRVEMAGSRRECSLDTARSLRE

SEQ ID NO: 912974 - protein, 867 aa, Homo sapiens
RATLSCTWASRKMVVMARLSRPERPDLVFEEEDLPYEEEIMRNQFSVKCWLRYIEFKQGAPKPRLNQLYERALKLLPCSYKLWYRYLKARRAQVKHRCVTDPAYEDVNNCHERAFVFMHKMPRLWLDYCQFLMDQGRVTHTRRTFDRALRALPITQHSRIWPLYLRFLRSHPLPETAVRGYRRFLKLSPESAEEYIEYLKSSDRLDEAAQRLATVVNDERFVSKAGKSNYQLWHELCDLISQNPDKVQSLNVDAIIRGGLTRFTDQLGKLWCSLADYYIRSGHFEKARDVYEEAIRTVMTVRDFTQVFDSYAQFEESMIAAKMETASELGREEEDDVDLELRLARFEQLISRRPLLLNSVLLRQNPHHVHEWHKRVALHQGRPREIINTYTEAVQTVDPFKATGKPHTLWVAFAKFYEDNGQLDDARVILEKATKVNFKQVDDLASVWCQCGELELRHENYDEALRLLRKATALPARRAEYFDGSEPVQNRVYKSLKVWSMLADLEESLGTFQSTKAVYDRILDLRIATPQIVINYAMFLEEHKYFEESFKAYERGISLFKWPNVSDIWSTYLTKFIARYGGRKLERARDLFEQALDGCPPKYAKTLYLLYAQLEEEWGLARHAMAVYERATRAVEPAQQYDMFNIYIKRAAEIYGVTHTRGIYQKAIEVLSDEHAREMCLRFADMECKLGEIDRARAIYSFCSQICDPRTTGAFWQTWKDFEVRHGNEDTIKEMLRIRRSVQATYNTQVNFMASQMLKVSGSATGTVSDLAPGQSGMDDMKLLEQRAEQLAAEAERDQPLRAQSKILFVRSDASREELAELAQQVNPEEIQLGEDEDEDEMDLEPNEVRLEQQSVPAAVFGSLKED

SEQ ID NO: 912975 - protein, 130 aa, Homo sapiens
ARGWKNSLPQETASELGREEEDDVDLELRLARFEQLISRRPLLLNSVLLRQNPHHVHEWHKRVALHQGRPREIINTYTEAVQTVDPFKATGKPHTLWVAFAKFYEDNGQLDDARILGKTKGELSSRLMTW

SEQ ID NO: 912976 - protein, 874 aa, Homo sapiens
LARQSAAGAGGAGQLGVQSSRRRDPRPTARDSLSGHSEMSSCHQWRGHRVTIRRVPKLGMHREVPGVELEGTTNRVTQAVCSAGEDYKLWYRYLKARRAQVKHRCVTDPAYEDVNNCHERAFVFMHKMPRLWLDYCQFLMDQGRVTHTRRTFDRALRALPITQHSRIWPLYLRFLRSHPLPETAVRGYRRFLKLSPESAEEYIEYLKSSDRLDEAAQRLATVVNDERFVSKAGKSNYQLWHELCDLISQNPDKVQSLNVDAIIRGGLTRFTDQLGKLWCSLADYYIRSGHFEKARDVYEEAIRTVMTVRDFTQVFDSYAQFEESMIAAKMETASELGREEEDDVDLELRLARFEQLISRRPLLLNSVLLRQNPHHVHEWHKRVALHQGRPREIINTYTEAVQTVDPFKATGKPHTLWVAFAKFYEDNGQLDDARVILEKATKVNFKQVDDLASVWCQCGELELRHENYDEALRLLRKATALPARRAEYFDGSEPVQNRVYKSLKVWSMLADLEESLGTFQSTKAVYDRILDLRIATPQIVINYAMFLEEHKYFEESFKAYERGISLFKWPNVSDIWSTYLTKFIARYGGRKLERARDLFEQALDGCPPKYAKTLYLLYAQLEEEWGLARHAMAVYERATRAVEPAQQYDMFNIYIKRAAEIYGVTHTRGIYQKAIEVLSDEHAREMCLRFADMECKLGEIDRARAIYSFCSQICDPRTTGAFWQTWKDFEVRHGNEDTIKEMLRIRRSVQATYNTQVNFMASQMLKVSGSATGTVSDLAPGQSGMDDMKLLEQRAEQLAAEAERDQPLRAQSKILFVRSDASREELAELAQQVNPEEIQLGEDEDEDEMDLEPNEVRLEQQSVPAAVFGSLKED

SEQ ID NO: 912977 - protein, 962 aa, Homo sapiens
RATLSCTWASRKMVVMARLSRPERPDLVFEEEDLPYEEEIMRNQFSVKCWLRYIEFKQGAPKPRLNQLYERALKLLPCSYKLWYRYLKARRAQVKHRCVTDPAYEDVNNCHERAFVFMHKFGARRGDESGSGAQSMVVGGAGTGAGLSMLGMGAWIPVASLLGSWAGLSPGAGGFWVPPHLCGGPRCGSATGHRVSVARPWSPWLSPSRLSPHPQMPRLWLDYCQFLMDQGRVTHTRRTFDRALRALPITQHSRIWPLYLRFLRSHPLPETAVRGYRRFLKLSPESAEEYIEYLKSSDRLDEAAQRLATVVNDERFVSKAGKSNYQLWHELCDLISQNPDKVQSLNVDAIIRGGLTRFTDQLGKLWCSLADYYIRSGHFEKARDVYEEAIRTVMTVRDFTQVFDSYAQFEESMIAAKMETASELGREEEDDVDLELRLARFEQLISRRPLLLNSVLLRQNPHHVHEWHKRVALHQGRPREIINTYTEAVQTVDPFKATGKPHTLWVAFAKFYEDNGQLDDARVILEKATKVNFKQVDDLASVWCQCGELELRHENYDEALRLLRKATALPARRAEYFDGSEPVQNRVYKSLKVWSMLADLEESLGTFQSTKAVYDRILDLRIATPQIVINYAMFLEEHKYFEESFKAYERGISLFKWPNVSDIWSTYLTKFIARYGGRKLERARDLFEQALDGCPPKYAKTLYLLYAQLEEEWGLARHAMAVYERATRAVEPAQQYDMFNIYIKRAAEIYGVTHTRGIYQKAIEVLSDEHAREMCLRFADMECKLGEIDRARAIYSFCSQICDPRTTGAFWQTWKDFEVRHGNEDTIKEMLRIRRSVQATYNTQVNFMASQMLKVSGSATGTVSDLAPGQSGMDDMKLLEQRAEQLAAEAERDQPLRAQSKILFVRSDASREELAELAQQVNPEEIQLGEDEDEDEMDLEPNEVRLEQQSVPAAVFGSLKED

SEQ ID NO: 912978 - protein, 361 aa, Homo sapiens
RATLSCTWASRKMVVMARLSRPERPDLVFEEEDLPYEEEIMRNQFSVKCWLRYIEFKQGAPKPRLNQLYERALKLLPCSYKLWYRYLKARRAQVKHRCVTDPAYEDVNNCHERAFVFMHKMPRLWLDYCQFLMDQGRVTHTRRTFDRALRALPITQHSRIWPLYLRFLRSHPLPETAVRGYRRFLKLSPESAEEYIEYLKSSDRLDEAAQRLATVVNDERFVSKAGKSNYQLWHELCDLISQNPDKVQSLNVDAIIRGGLTRFTDQLGKLWCSLADYYIRSGHFEKARDVYEEAIRTVMTVRDFTQVFDSYAQFEESMIAAKMETASELGREEEVAPAFPTEVRLEQQSVPAAVFGSLKED

SEQ ID NO: 912979 - protein, 502 aa, Homo sapiens
AVVPRIRDVETFQAVEALELCWDGRCQVFMRSTPDRHGIDCSAVTRWIEGSPQGWILEASAGIEPLVGYVAAELSKIAESMDAPHERMYTTDEAPSAGVPANEALGRCLGHCRAEYFDGSEPVQNRVYKSLKVWSMLADLEESLGTFQSTKAVYDRILDLRIATPQIVINYAMFLEEHKYFEESFKAYERGISLFKWPNVSDIWSTYLTKFIARYGGRKLERARDLFEQALDGCPPKYAKTLYLLYAQLEEEWGLARHAMAVYERATRAVEPAQQYDMFNIYIKRAAEIYGVTHTRGIYQKAIEVLSDEHAREMCLRFADMECKLGEIDRARAIYSFCSQICDPRTTGAFWQTWKDFEVRHGNEDTIKEMLRIRRSVQATYNTQVNFMASQMLKVSGSATGTVSDLAPGQSGMDDMKLLEQRAEQLAAEAERDQPLRAQSKILFVRSDASREELAELAQQVNPEEIQLGEDEDEDEMDLEPNEVRLEQQSVPAAVFGSLKED

SEQ ID NO: 912980 - protein, 317 aa, Homo sapiens
MAYERGISLFKWPNVSDIWSTYLTKFIARYGGRKLERARDLFEQALDGCPPKYAKTLYLLYAQLEEEWGLARHAMAVYERATRAVEPAQQYDMFNIYIKRAAEIYGVTHTRGIYQKAIEVLSDEHAREMCLRFADMECKLGEIDRARAIYSFCSQICDPRTTGAFWQTWKDFEVRHGNEDTIKEMLRIRRSVQATYNTQVNFMASQMLKVSGSATGTVSDLAPGQSGMDDMKLLEQRAEQLAAEAERDQPLRAQSKILFVRSDASREELAELAQQVNPEEIQLGEDEDEDEMDLEPNEVRLEQQSVPAAVFGSLKED

SEQ ID NO: 912981 - protein, 359 aa, Homo sapiens
HASADAWGFKAYERGISLFKWPNVSDIWSTYLTKFIARYGGRKLERARDLFEQALDGCPPKYAKTLYLLYAQLEEEWGLARHAMAVYERATRAVEPAQQYDMFNIYIKRAAEIYGVTHTRGIYQKAIEVLSDEHAREMCLRFADMECKLGEIDRARAIYSFCSQICDPRVGLWGGTGIRVGGCGGVSQLTGTHTHPCPAPQQTTGAFWQTWKDFEVRHGNEDTIKEMLRIRRSVQATYNTQVNFMASQMLKVSGSATGTVSDLAPGQSGMDDMKLLEQRAEQLAAEAERDQPLRAQSKILFVRSDASREELAELAQQVNPEEIQLGEDEDEDEMDLEPNEVRLEQQSVPAAVFGSLKED

SEQ ID NO: 912982 - protein, 867 aa, Homo sapiens; identical to SEQ ID NO: 912974

SEQ ID NO: 912983 - protein, 839 aa, Homo sapiens
RATLSCTWASRKMVVMARLSRPERPDLVFEEEDLPYEEEIMRNQFSVKCWLRYIEFKQGAPKPRLNQLYERALKLLPCSYKLWYRYLKARRAQVKHRCVTDPAYEDVNNCHERAFVFMHKMPRLWLDYCQFLMDQGRVTHTRRTFDRALRALPITQHSRIWPLYLRFLRSHPLPETAAVAAPPSYKPELLSSAEAVHCSTSSSLWHELCDLISQNPDKVQSLNVDAIIRGGLTRFTDQLGKLWCSLADYYIRSGHFEKARDVYEEAIRTVMTVRDFTQVFDSYAQFEESMIAAKMETASELGREEEDDVDLELRLARFEQLISRRPLLLNSVLLRQNPHHVHEWHKRVALHQGRPREIINTYTEAVQTVDPFKATGKPHTLWVAFAKFYEDNGQLDDARVILEKATKVNFKQVDDLASVWCQCGELELRHENYDEALRLLRKATALPARRAEYFDGSEPVQNRVYKSLKVWSMLADLEESLGTFQSTKAVYDRILDLRIATPQIVINYAMFLEEHKYFEESFKAYERGISLFKWPNVSDIWSTYLTKFIARYGGRKLERARDLFEQALDGCPPKYAKTLYLLYAQLEEEWGLARHAMAVYERATRAVEPAQQYDMFNIYIKRAAEIYGVTHTRGIYQKAIEVLSDEHAREMCLRFADMECKLGEIDRARAIYSFCSQICDPRTTGAFWQTWKDFEVRHGNEDTIKEMLRIRRSVQATYNTQVNFMASQMLKVSGSATGTVSDLAPGQSGMDDMKLLEQRAEQLAAEAERDQPLRAQSKILFVRSDASREELAELAQQVNPEEIQLGEDEDEDEMDLEPNEVRLEQQSVPAAVFGSLKED

SEQ ID NO: 912984 - protein, 351 aa, Homo sapiens
RATLSCTWASRKMVVMARLSRPERPDLVFEEEDLPYEEEIMRNQFSVKCWLRYIEFKQGAPKPRLNQLYERALKLLPCSYKLWYRYLKARRAQVKHRCVTDPAYEDVNNCHERAFVFMHKMPRLWLDYCQFLMDQGRVTHTRRTFDRALRALPITQHSRIWPLYLRFLRSHPLPETAVRGYRRFLKLSPESAEEYIEYLKSSDRLDEAAQRLATVVNDERFVSKAGKSNYQLWHELCDLISQNPDKVQSLNVDAIIRGGLTRFTDQLGKLWCSLADYYIRSGHFEKARDVYEEAIRTVMTVRDFTQVFDSYAQFEESMIAAKMETASELGREEEVWTWSCAWPAEDDVGIL

SEQ ID NO: 912985 - protein, 290 aa, Homo sapiens
TAVSGGSEAGWRDLFEQALDGCPPKYAKTLYLLYAQLEEEWGLARHAMAVYERATRAVEPAQQYDMFNIYIKRAAEIYGVTHTRGIYQKAIEVLSDEHAREMCLRFADMECKLGEIDRARAIYSFCSQICDPRTTGAFWQTWKDFEVRHGNEDTIKEMLRIRRSVQATYNTQVNFMASQMLKVSGSATGTVSDLAPGQSGMDDMKLLEQRAEQLAAEAERDQPLRAQSKILFVRSDASREELAELAQQVNPEEIQLGEDEDEDEMDLEPNEVRLEQQSVPAAVFGSLKED

SEQ ID NO: 912986 - protein, 223 aa, Homo sapiens
APQRVPASAGLMPQNGVIGLRHHFAIHYPAGGGLWDGLHGVAAVQGITKIKVLAIYSFCSQICDPRTTGAFWQTWKDFEVRHGNEDTIKEMLRIRRSVQATYNTQVNFMASQMLKVSGSATGTVSDLAPGQSGMDDMKLLEQRAEQLAAEAERDQPLRAQSKILFVRSDASREELAELAQQVNPEEIQLGEDEDEDEMDLEPNEVRLEQQSVPAAVFGSLKED

SEQ ID NO: 912987 - protein, 541 aa, Homo sapiens
VIFPVPQLTSGMACTGWTSPLPLCVCLLLTCGFAEAGKLLVVPMDGSHWFTMRSVVEKLILRGHEVVVVMPEVSWQLGRSLNCTVKTYSTSYTLEDLDREFKAFAHAQWKAQVRSIYSLLMGSYNDIFDLFFSNCRSLFNDRKLVEYLKESSFDAVFLDPFDTCGLIVAKYFSLPSVVFARGIFCHYLEEGAQCPAPLSYVPRISLRVLRCHDFQGESTEPHHALGGTFIMPRFFKNALEIASEILQTPVTEYDLYSHTSIWLLRTDFVLDYPKPVMPNMIFIGGINCHQGKPLPMEFEAYINASGEHGIVVFSLGSMVSEIPEKKAMAIADALGKIPQTVLWRYTGTRPSNLANNTILVKWLPQNDLLGHPMTRAFITHAGSHGVYESICNGVPMVMMPLFGDQMDNAKRMETKGAGVTLNVLEMTSEDLENALKAVINDKSYKENIMRLSSLHKDRPVEPLDLAVFWVEFVMRHKGAPHLRPAAHDLTWYQYHSLDVIGFLLAVVLTVAFITFKCCAYGYRKCLGKKGRVKKAHKSKTH

SEQ ID NO: 912988 - protein, 532 aa, Homo sapiens
MACLLRSFQRISAGVFFLALWGMVVGDKLLVVPQDGSHWLSMKDIVEVLSDRGHEIVVVVPEVNLLLKESKYYTRKIYPVPYDQEELKNRYQSFGNNHFAERSFLTAPQTEYRNNMIVIGLYFINCQSLLQDRDTLNFFKESKFDALFTDPALPCGVILAEYLGLPSVYLFRGFPCSLEHTFSRSPDPVSYIPRCYTKFSDHMTFSQRVANFLVNLLEPYLFYCLFSKYEELASAVLKRDVDIITLYQKVSVWLLRYDFVLEYPRPVMPNMVFIGGINCKKRKDLSQEFEAYINASGEHGIVVFSLGSMVSEIPEKKAMAIADALGKIPQTVLWRYTGTRPSNLANNTILVKWLPQNDLLGHPMTRAFITHAGSHGVYESICNGVPMVMMPLFGDQMDNAKRMETKGAGVTLNVLEMTSEDLENALKAVINDKSYKENIMRLSSLHKDRPVEPLDLAVFWVEFVMRHKGAPHLRPAAHDLTWYQYHSLDVIGFLLAVVLTVAFITFKCCAYGYRKCLGKKGRVKKAHKSKTH

SEQ ID NO: 912989 - protein, 538 aa, Homo sapiens
RSKGAMAVESQGGRPLVLGLLLCVLGPVVSHAGKILLIPVDGSHWLSMLGAIQQLQQRGHEIVVLAPDASLYIRDGAFYTLKTYPVPFQREDVKESFVSLGHNVFENDSFLQRVIKTYKKIKKDSAMLLSGCSHLLHNKELMASLAESSFDVMLTDPFLPCSPIVAQYLSLPTVFFLHALPCSLEFEATQCPNPFSYVPRPLSSHSDHMTFLQRVKNMLIAFSQNFLCDVVYSPYATLASEFLQREVTVQDLLSSASVWLFRSDFVKDYPRPIMPNMVFVGGINCLHQNPLSQEFEAYINASGEHGIVVFSLGSMVSEIPEKKAMAIADALGKIPQTVLWRYTGTRPSNLANNTILVKWLPQNDLLGHPMTRAFITHAGSHGVYESICNGVPMVMMPLFGDQMDNAKRMETKGAGVTLNVLEMTSEDLENALKAVINDKSYKENIMRLSSLHKDRPVEPLDLAVFWVEFVMRHKGAPHLRPAAHDLTWYQYHSLDVIGFLLAVVLTVAFITFKCCAYGYRKCLGKKGRVKKAHKSKTH

SEQ ID NO: 912990 - protein, 337 aa, Homo sapiens
FCAWYFSHLLYHSSLDSQLLALGCSSLMARAGWTSPVPLCVCLLLTCGFAEAGKLLVVPMDGSHWFTMQSVVEKLILRGHEVVVVMPEVSWQLERSLNCTVKTYSTSYTLEDQNREFMVFAHAQWKAQAQSIFSLLMSSSSGFLDLFFSHCRSLFNDRKLVEYLKESSFDAVFLDPFDTCGLIVAKYFSLPSVVFTRGILCHHLEEGAQCPAPLSYVPKYLLGFSDAMTFKERVRNHIVHLEEHLLCQYLFKNALEIALKFSKPLFTAYDLYSHTSIWLLRTDFVLDYPKPVMPNMIFIGGINCHQGKPLPMVSHLSFSTLRIIWLWKLKKDSLLNC

SEQ ID NO: 912991 - protein, 333 aa, Homo sapiens
PAAGSGCSSLMARTGWTSPIPLCVSLLLTCGFAEAGKLLVVPMDGSHWFTMQSVVEKLILRGHEVVVVMPEVSWQLGKSLNCTVKTYSTSYTLEDLDREFMDFADAQWKAQVRSLFSLFLSSSNGFFNLFFSHCRSLFNDRKLVEYLKESSFDAVFLDPFDACGLIVAKYFSLPSVVFARGIVCHYLEEGAQCPAPLSYVPRILLGFSDAMTFKERVRNHIMHLEEHLFCQYFSKNVLEIASEILQTPVTAYDLYSHTSIWLLRTDFVLEYPKPVMPNMIFIGGINCHQGKPVPMARIYFFHPTGICPKPESFSLQQSLRKKKKSALAWEHSK

SEQ ID NO: 912992 - protein, 541 aa, Homo sapiens; identical to SEQ ID NO: 912987

SEQ ID NO: 912993 - protein, 541 aa, Homo sapiens; identical to SEQ ID NO: 912987

SEQ ID NO: 912994 - protein, 265 aa, Homo sapiens
MPNMVFIGGINCANGKPLSQEFEAYINASGEHGIVVFSLGSMVSEIPEKKAMAIADALGKIPQTVLWRYTGTRPSNLANNTILVKWLPQNDLLGHPMTRAFITHAGSHGVYESICNGVPMVMMPLFGDQMDNAKRMETKGAGVTLNVLEMTSEDLENALKAVINDKSYKENIMRLSSLHKDRPVEPLDLAVFWVEFVMRHKGAPHLRPAAHDLTWYQYHSLDVIGFLLAVVLTVAFITFKCCAYGYRKCLGKKGRVKKAHKSKTH

SEQ ID NO: 912995 - protein, 281 aa, Homo sapiens
MACLLRSFQRISAGVFFLALWGMVVGDKLLVVPQDGSHWLSMKDIVEVLSDRGHEIVVVVPEVNLLLKESKYYTRKIYPVPYDQEELKNRYQSFGNNHFAERSFLTAPQTEYRNNMIVIGLYFINCQSLLQDRDTLNFFKESKFDALFTDPALPCGVILAEYLGLPSVYLFRGFPCSLEHTFSRSPDPVSYIPRCYTKFSDHMTFSQRVANFLVNLLEPYLFYCLFSKYEELASAVLKRDVDIITLYQKVSVWLLRYDFVLEYPRPVMPNMVFIGGINFCI

SEQ ID NO: 912996 - protein, 222 aa, Homo sapiens
MACLLRSFQRISAGVFFLALWGMVVGDKLLVVPQDGSHWLSMKDIVEVLSDRGHEIVVVVPEVNLLLKESKYYTRKIYPVPYDQEELKNRYQSFGNNHFAERSFLTAPQTEYRNNMIVIGLYFINCQSLLQDRDTLNFFKESKFDALFTDPALPCGVILAEYLGLPSVYLFRGFPCSLEHTFSRSPDPVSYIRPGMHIRPGTHAYLGVWRTVREAITSDGSF

SEQ ID NO: 912997 - protein, 543 aa, Homo sapiens
SQLSVASAEMARGLQVPLPRLATGLLLLLSVQPWAESGKVLVVPTDGSPWLSMREALRELHARGHQAVVLTPEVNMHIKEEKFFTLTAYAVPWTQKEFDRVTLGYTQGFFETEHLLKRYSRSMAIMNNVSLALHRCCVELLHNEALIRHLNATSFDVVLTDPVNLCGAVLAKYLSIPAVFFWRYIPCDLDFKGTQCPNPSSYIPKLLTTNSDHMTFLQRVKNMLYPLALSYICHTFSAPYASLASELFQREVSVVDLVSYASVWLFRGDFVMDYPRPIMPNMVFIGGINCANGKPLSQEFEAYINASGEHGIVVFSLGSMVSEIPEKKAMAIADALGKIPQTVLWRYTGTRPSNLANNTILVKWLPQNDLLGHPMTRAFITHAGSHGVYESICNGVPMVMMPLFGDQMDNAKRMETKGAGVTLNVLEMTSEDLENALKAVINDKSYKENIMRLSSLHKDRPVEPLDLAVFWVEFVMRHKGAPHLRPAAHDLTWYQYHSLDVIGFLLAVVLTVAFITFKCCAYGYRKCLGKKGRVKKAHKSKTH

SEQ ID NO: 912998 - protein, 532 aa, Homo sapiens; identical to SEQ ID NO: 912988

SEQ ID NO: 912999 - protein, 149 aa, Homo sapiens
GSVPAYWAYDQEELKNRYQSFGNNHFAERSFLTAPQTEYRNNMIVIGLYFINCQSLLQDRDTLNFFKESKFDALFTDPALPCGVILAEYLGLPSVYLFRGFPCSLEHTFSRSPDPVSYIRPGMHIRPGTHAYLGVWRTVREAITSDGSF

SEQ ID NO: 913000 - protein, 235 aa, Homo sapiens
MPNMVFIGGINCANGKPLSQEFEAYINASGEHGIVVFSLGSMVSEIPEKKAMAIADALGKIPQTVLWRYTGTRPSNLANNTILVKWLPQNDLLGHPMTRAFITHAGSHGVYESICNGVPMVMMPLFGDQMDNAKRMETKGAGVTLNVLEMTSEDLENALKAVINDKRFQGDFLRPPALQDAGGRGRRSCGVGSATGPHWRTRLPAAHRGGPEPTATPRSPEGTRDHTPGGRNSHR

SEQ ID NO: 913001 - protein, 540 aa, Homo sapiens
PAAGSGCSSLMARTGWTSPIPLCVSLLLTCGFAEAGKLLVVPMDGSHWFTMQSVVEKLILRGHEVVVVMPEVSWQLGKSLNCTVKTYSTSYTLEDLDREFMDFADAQWKAQVRSLFSLFLSSSNGFFNLFFSHCRSLFNDRKLVEYLKESSFDAVFLDPFDACGLIVAKYFSLPSVVFARGIVCHYLEEGAQCPAPLSYVPRILLGFSDAMTFKERVRNHIMHLEEHLFCQYFSKNVLEIASEILQTPVTAYDLYSHTSIWLLRTDFVLEYPKPVMPNMIFIGGINCHQGKPVPMEFEAYINASGEHGIVVFSLGSMVSEIPEKKAMAIADALGKIPQTVLWRYTGTRPSNLANNTILVKWLPQNDLLGHPMTRAFITHAGSHGVYESICNGVPMVMMPLFGDQMDNAKRMETKGAGVTLNVLEMTSEDLENALKAVINDKSYKENIMRLSSLHKDRPVEPLDLAVFWVEFVMRHKGAPHLRPAAHDLTWYQYHSLDVIGFLLAVVLTVAFITFKCCAYGYRKCLGKKGRVKKAHKSKTH

SEQ ID NO: 913002 - protein, 443 aa, Homo sapiens
MACLLRSFQRISAGVFFLALWGMVVGDKLLVVPQDGSHWLSMKDIVEVLSDRGHEIVVVVPEVNLLLKESKYYTRKIYPVPYDQEELKNRYQSFGNNHFAERSFLTAPQTEYRNNMIVIGLYFINCQSLLQDRDTLNFFKESKFDALFTDPALPCGVILAEYLGLPSVYLFRGFPCSLEHTFSRSPDPVSYIPRCYTKFSDHMTFSQRVANFLVNLLEPYLFYCLFSKYEELASAVLKRDVDIITLYQKVSVWLLRYDFVLEYPRPVMPNMVFIGGINCKKRKDLSQEFEAYINASGEHGIVVFSLGSMVSEIPEKKAMAIADALGKIPQTVLWRYTGTRPSNLANNTILVKWLPQNDLLGHPMTRAFITHAGSHGVYESICNGVPMVMMPLFGDQMDNAKRMETKGAGVTLNVLEMTSEDLENALKAVINDKRKKQQSGRQM

SEQ ID NO: 913003 - protein, 440 aa, Homo sapiens
MACLLRSFQRISAGVFFLALWGMVVGDKLLVVPQDGSHWLSMKDIVEVLSDRGHEIVVVVPEVNLLLKESKYYTRKIYPVPYDQEELKNRYQSFGNNHFAERSFLTAPQTEYRNNMIVIGLYFINCQSLLQDRDTLNFFKESKFDALFTDPALPCGVILAEYLGLPSVYLFRGFPCSLEHTFSRSPDPVSYIPRCYTKFSDHMTFSQRVANFLVNLLEPYLFYCLFSKYEELASAVLKRDVDIITLYQKVSVWLLRYDFVLEYPRPVMPNMVFIGGINCKKRKDLSQVFVELLHNEALIRHLNATSFDVVLTDPVNLCAAVLAKYLSIPTVFFLRNIPCDLDFKGTQCPNPSSYIPRLLTTNSDHMTFMQRVKNMLYPLALSYICHAFSAPYASLASELFQREVSVVDILSHASVWLFRGDFVMDYPRPIMPNMVFIGGI

SEQ ID NO: 913004 - protein, 261 aa, Homo sapiens
MRAKDACLKEAVAHENNRALFHAAKAYEQAGMMLKEMQKLPEAVQLIEKASMMYLENGTPDTAAMALERAGKLIENVDPEKAVQLYQQTANVFENEERLRQAVELLGKASRLLVRGRRFDEAALSIQKEKNIYKEIENYPTCYKKTIAQVLVHLHRNDYVAAERCVRESYSIPGFNGSEDCAALEQLLEGYDQQDQDQVSDVCNSPLFKYMDNDYAKLGLSLVVPGGGIKKKSPATPQAKPDGVTATAADEEEDEYSGGLC

SEQ ID NO: 913005 - protein, 261 aa, Homo sapiens; identical to SEQ ID NO: 913004

SEQ ID NO: 913006 - protein, 261 aa, Homo sapiens; identical to SEQ ID NO: 913004

SEQ ID NO: 913007 - protein, 261 aa, Homo sapiens; identical to SEQ ID NO: 913004

SEQ ID NO: 913008 - protein, 261 aa, Homo sapiens; identical to SEQ ID NO: 913004

SEQ ID NO: 913009 - protein, 106 aa, Homo sapiens
QEFGTRAERCVRESYSIPGFNGSEDCAALEQLLEGYDQQDQDQVSDVCNSPLFKYMDNDYAKLGLSLVVPGGGIKKKSPATPQAKPDGVTATAADEEEDEYSGGLC

SEQ ID NO: 913010 - protein, 225 aa, Homo sapiens [sequence omitted]

SEQ ID NO: 913011 - protein, 261 aa, Homo sapiens; identical to SEQ ID NO: 913004

SEQ ID NO: 913012 - protein, 261 aa, Homo sapiens; identical to SEQ ID NO: 913004

SEQ ID NO: 913013 - protein, 387 aa, Homo sapiens
FFSSQAAALLVVLGSSHTLQRARKHSAPGLPDTCALLQPPAASAAAAPSMSGPDVETPSAIQICRIMRPDDANVAGNVHGGTILKMIEEAGAIISTRHCNSQNGERCVAALARVERTDFLSPMCIGEVAHVSAEITYTSKHSVEVQVNVMSENILTGAKKLTNKATLWYVPLSLKNVDKVLEVPPVVYSRQEQEEEGRKRYEAQKLERMETKWRNGDIVQPVLNPEPNTVSYSQSSLIHLVGPSDCTLHGFVHGGVTMKLMDEVAGIVAARHCKTNIVTASVDAINFHDKIRKGCVITISGRMTFTSNKSMEIEVLVDADPVVDSSQKRYRAASAFFTYVSLSQEGRSLPVPQLVPETEDEKKRFEEGKGRYLQMKAKRQGHAEPQP

SEQ ID NO: 913014 - protein, 370 aa, Homo sapiens
MARPGLIHSAPGLPDTCALLQPPAASAAAAPSMSGPDVETPSAIQICRIMRPDDANVAGNVHGGTILKMIEEAGAIISTRHCNSQNGERCVAALARVERTDFLSPMCIGEVAHVSAEITYTSKHSVEVQVNVMSENILTGAKKLTNKATLWYVPLSLKNVDKVLEVPPVVYSRQEQEEEGRKRYEAQKLERMETKWRNGDIVQPVLNPEPNTVSYSQSSLIHLVGPSDCTLHGFVHGGVTMKLMDEVAGIVAARHCKTNIVTASVDAINFHDKIRKGCVITISGRMTFTSNKSMEIEVLVDADPVVDSSQKRYRAASAFFTYVSLSQEGRSLPVPQLVPETEDEKKRFEEGKGRYLQMKAKRQGHAEPQP

SEQ ID NO: 913015 - protein, 370 aa, Homo sapiens; identical to SEQ ID NO: 913014

SEQ ID NO: 913016 - protein, 321 aa, Homo sapiens
MRPDDANVAGNVHGGTILKMIEEAGAIISTRHCNSQNGERCVAALARVERTDFLSPMCIGEVAHVSAEITYTSKHSVEVQVNVMSENILTGAKKLTNKATLWYVPLSLKNVDKVLEVPPVVYSRQEQEEEGRKRYEAQKLERMETKWRNGDIVQPVLNPEPNTVSYSQSSLIHLVGPSDCTLHGFVHGGVTMKLMDEVAGIVAARHCKTNIVTASVDAINFHDKIRKGCVITISGRMTFTSNKSMEIEVLVDADPVVDSSQKRYRAASAFFTYVSLSQEGRSLPVPQLVPETEDEKKRFEEGKGRYLQMKAKRQGHAEPQP

SEQ ID NO: 913017 - protein, 367 aa, Homo sapiens
YNAVCYPQWKRHKGVTIPFFTMYRIIASLKKGNTFQNCGACITGRIMRPDDANVAGNVHGGTILKMIEEAGAIISTRHCNSQNGERCVAALARVERTDFLSPMCIGEVAHVSAEITYTSKHSVEVQVNVMSENILTGAKKLTNKATLWYVPLSLKNVDKVLEVPPVVYSRQEQEEEGRKRYEAQKLERMETKWRNGDIVQPVLNPEPNTVSYSQSSLIHLVGPSDCTLHGFVHGGVTMKLMDEVAGIVAARHCKTNIVTASVDAINFHDKIRKGCVITISGRMTFTSNKSMEIEVLVDADPVVDSSQKRYRAASAFFTYVSLSQEGRSLPVPQLVPETEDEKKRFEEGKGRYLQMKAKRQGHAEPQP

SEQ ID NO: 913018 - protein, 354 aa, Homo sapiens
RGETMLLLRRSLSLNVLRKEVDRACFGEKAKQIMRPDDANVAGNVHGGTILKMIEEAGAIISTRHCNSQNGERCVAALARVERTDFLSPMCIGEVAHVSAEITYTSKHSVEVQVNVMSENILTGAKKLTNKATLWYVPLSLKNVDKVLEVPPVVYSRQEQEEEGRKRYEAQKLERMETKWRNGDIVQPVLNPEPNTVSYSQSSLIHLVGPSDCTLHGFVHGGVTMKLMDEVAGIVAARHCKTNIVTASVDAINFHDKIRKGCVITISGRMTFTSNKSMEIEVLVDADPVVDSSQKRYRAASAFFTYVSLSQEGRSLPVPQLVPETEDEKKRFEEGKGRYLQMKAKRQGHAEPQP

SEQ ID NO: 913019 - protein, 262 aa, Homo sapiens
MARPGLIHSAPGLPDTCALLQPPAASAAAAPSMSGPDVETPSAIQICRIMRPDDANVAGNVHGGTILKMIEEAGAIISTRHCNSQNGERCVAALARVERTDFLSPMCIGEVAHVSAEITYTSKHSVEVQVNVMSENILTGAKKLTNKATLWYVPLSLKNVDKVLEVPPVVYSRQEQEEEGRKRYEAQKLERMETKWRNGDIVQPVLNPEPNTVSYSQSSLIHLVGPSDCTLHGFVHGGVTMKLMDEVAGIVAARHCKTNIGH

SEQ ID NO: 913020 - protein, 256 aa, Homo sapiens
IELVPLTLNLGCGSVRVNVMSKHLTGAKKLTNKATLWYVPLSLKNVDKVLEVPPVVYSRQEQEEEGRKRYEAQKLERMETKWRNGDIVQPVLNPEPNTVSYSQSSLIHLVGPSDCTLHGFVHGGVTMKLMDEVAGIVAARHCKTNIVTASVDAINFHDKIRKGCVITISGRMTFTSNKSMEIEVLVDADPVVDSSQKRYRAASAFFTYVSLSQEGRSLPVPQLVPETEDEKKRFEEGKGRYLQMKAKRQGHAEPQP

SEQ ID NO: 913021 - protein, 130 aa, Homo sapiens
MKLMDEVAGIVAARHCKTNIVTASVDAINFHDKIRKGCVITISGRMTFTSNKSMEIEVLVDADPVVDSSQKRYRAASAFFTYVSLSQEGRSLPVPQLVPETEDEKKRFEEGKGRYLQMKAKRQGHAEPQP

SEQ ID NO: 913022 - protein, 154 aa, Homo sapiens
MKLMDEVAGIVAARHCKTNIVTASVDAINFHDKIRKAHVCLLALTTQLLPPLPALARSAPCCVITISGRMTFTSNKSMEIEVLVDADPVVDSSQKRYRAASAFFTYVSLSQEGRSLPVPQLVPETEDEKKRFEEGKGRYLQMKAKRQGHAEPQP

SEQ ID NO: 913023 - protein, 108 aa, Homo sapiens
QTYTPKLYLYHSSINATQCCPERREALGRNPRECFRARCRVWEEPSTTNKAAAWLDPRVLGGHLSWGGCFPRGCGTLGLPWTVSALPAPAPACTLEPQAQPHRLVSGW

SEQ ID NO: 913024 - protein, 370 aa, Homo sapiens; identical to SEQ ID NO: 913014

SEQ ID NO: 913025 - protein, 380 aa, Homo sapiens
MKLLARALRLCEFGRQASSRRLVAGQGCVGPRRGCCAPVQVVGPRADLPPCGACITGRIMRPDDANVAGNVHGGTILKMIEEAGAIISTRHCNSQNGERCVAALARVERTDFLSPMCIGEVAHVSAEITYTSKHSVEVQVNVMSENILTGAKKLTNKATLWYVPLSLKNVDKVLEVPPVVYSRQEQEEEGRKRYEAQKLERMETKWRNGDIVQPVLNPEPNTVSYSQSSLIHLVGPSDCTLHGFVHGGVTMKLMDEVAGIVAARHCKTNIVTASVDAINFHDKIRKGCVITISGRMTFTSNKSMEIEVLVDADPVVDSSQKRYRAASAFFTYVSLSQEGRSLPVPQLVPETEDEKKRFEEGKGRYLQMKAKRQGHAEPQP

SEQ ID NO: 913026 - protein, 329 aa, Homo sapiens
MAFQLSRIMRPDDANVAGNVHGGTILKMIEEAGAIISTRHCNSQNGERCVAALARVERTDFLSPMCIGEVAHVSAEITYTSKHSVEVQVNVMSENILTGAKKLTNKATLWYVPLSLKNVDKVLEVPPVVYSRQEQEEEGRKRYEAQKLERMETKWRNGDIVQPVLNPEPNTVSYSQSSLIHLVGPSDCTLHGFVHGGVTMKLMDEVAGIVAARHCKTNIVTASVDAINFHDKIRKGCVITISGRMTFTSNKSMEIEVLVDADPVVDSSQKRYRAASAFFTYVSLSQEGRSLPVPQLVPETEDEKKRFEEGKGRYLQMKAKRQGHAEPQP

SEQ ID NO: 913027 - protein, 327 aa, Homo sapiens
MRGAGQVLPSCGGPSVKLIATECRVAHHSACPAFVKAVPDTAVRERCVAALARVERTDFLSPMCIGEVAHVSAEITYTSKHSVEVQVNVMSENILTGAKKLTNKATLWYVPLSLKNVDKVLEVPPVVYSRQEQEEEGRKRYEAQKLERMETKWRNGDIVQPVLNPEPNTVSYSQSSLIHLVGPSDCTLHGFVHGGVTMKLMDEVAGIVAARHCKTNIVTASVDAINFHDKIRKGCVITISGRMTFTSNKSMEIEVLVDADPVVDSSQKRYRAASAFFTYVSLSQEGRSLPVPQLVPETEDEKKRFEEGKGRYLQMKAKRQGHAEPQP

SEQ ID NO: 913028 - protein, 286 aa, Homo sapiens
MARPGLIHSAPGLPDTCALLQPPAASAAAAPSMSGPDVETPSAIQICRIMRPDDANVAGNVHGGTILKMIEEAGAIISTRHCNSQNGERCVAALARVERTDFLSPMCIGEVAHVSAEITYTSKHSVEVQVNVMSENILTGAKKLTNKATLWYVPLSLKNVDKVLEVPPVVYSRQEQEEEGRKRYEAQKLERMETKWRNGDIVQPVLNPEPNTVSYSQSSLIHLVGPSDCTLHGFVHGGVTMKLMDEVAGIVAARHCKTNIVTASVDAINFHDKIRKARDRGREEAL

SEQ ID NO: 913029 - protein, 249 aa, Homo sapiens
MARPGLIHSAPGLPDTCALLQPPAASAAAAPSMSGPDVETPSAIQICRIMRPDDANVAGNVHGGTILKMIEEAGAIISTRHCNSQNGERCVAALARVERTDFLSPMCIGEVAHVSAEITYTSKHSVEVQVNVMSENILTGAKKLTNKATLWYVPLSLKNVDKVLEVPPVVYSRQEQEEEGRKRYEAQKLERMETKWRNGDIVQPVLNPEPNTVSYSQSSLIHLVGPSDCTLHGFVHGGVTMKLIPQVPK

SEQ ID NO: 913030 - protein, 237 aa, Homo sapiens
MARPGLIHSAPGLPDTCALLQPPAASAAAAPSMSGPDVETPSAIQICRIMRPDDANVAGNVHGGTILKMIEEAGAIISTRHCNSQNGERCVAALARVERTDFLSPMCIGEVAHVSAEITYTSKHSVEVQVNVMSENILTGAKKLTNKATLWYVPLSLKNVDKVLEVPPVVYSRQEQEEEGRKRYEAQKLERMETKWRNGDIVQPVLNPATGASSSHGNGPSVQSLRSSPLGQKPNSH

SEQ ID NO: 913031 - protein, 176 aa, Homo sapiens
MALLVVKQRMQMYNSPYHRVTDCVRAVWQNEGAGAFYRSYTTQLTMNVPFQAIHFMTYEFLQEHFNPQRRYNPSSHVLSGACAGAVAAAATTPLDVCKTLLNTQESLALNSHITGHITGMASAFRTVYQVGGVTAYFRGVQARVIYQIPSTAIAWSVYEFFKYLITKRQEEWRAGK

SEQ ID NO: 913032 - protein, 405 aa, Homo sapiens
SGSRRPRALWAAPEADTTGPGGGGGSGGSGGGGGRRSWPGWMELEGRGAGGVAGGPAAGPGRSPGESALLDGWLQRGVGRGAGGGEAGACRPPVRQDPDSGPDYEALPAGATVTTHMVAGAVAGILEHCVMYPIDCVKTRMQSLQPDPAARYRNVLEALWRIIRTEGLWRPMRGLNVTATGAGPAHALYFACYEKLKKTLSDVIHPGGNSHIANGAAGCVATLLHDAAMNPAEVVKQRMQMYNSPYHRVTDCVRAVWQNEGAGAFYRSYTTQLTMNVPFQAIHFMTYEFLQEHFNPQRRYNPSSHVLSGACAGAVAAAATTPLDVCKTLLNTQESLALNSHITGHITGMASAFRTVYQVGGVTAYFRGVQARVIYQIPSTAIAWSVYEFFKYLITKRQEEWRAGK

SEQ ID NO: 913033 - protein, 209 aa, Homo sapiens [sequence omitted]

SEQ ID NO: 913034 - protein, 176 aa, Homo sapiens; identical to SEQ ID NO: 913031

SEQ ID NO: 913035 - protein, 176 aa, Homo sapiens; identical to SEQ ID NO: 913031

SEQ ID NO: 913036 - protein, 205 aa, Homo sapiens
SGSRRPRALWAAPEADTTGPGGGGGSGGSGGGGGRRSWPGWMELEGRGAGGVAGGPAAGPGRSPGESALLDGWLQRGVGRGAGGGEAGACRPPVRQDPDSGPDYEALPAGATVTTHMVAGAVAGILEHCVMYPIDCVKTRMQSLQPDPAARYRNVLEALWRIIRTEGLWRPMRGLNVTATGAGPAHALYFACYEKCGRVCGNITS

SEQ ID NO: 913037 - protein, 209 aa, Homo sapiens [sequence omitted]

SEQ ID NO: 913038 - protein, 176 aa, Homo sapiens; identical to SEQ ID NO: 913031

SEQ ID NO: 913039 - protein, 221 aa, Homo sapiens
MSWSALLALHVAVVFLFAGAAGCVATLLHDAAMNPAEVVKQRMQMYNSPYHRVTDCVRAVWQNEGAGAFYRSYTTQLTMNVPFQAIHFMTYEFLQEHFNPQRRYNPSSHVLSGACAGAVAAAATTPLDVCKTLLNTQESLALNSHITGHITGMASAFRTVYQVGGVTAYFRGVQARVIYQIPSTAIAWSVYEFFKYLSFQALSTCSKAHHSTFDNLSPSWA

SEQ ID NO: 913040 - protein, 245 aa, Homo sapiens
SGSRRPRALWAAPEADTTGPGGGGGSGGSGGGGGRRSWPGWMELEGRGAGGVAGGPAAGPGRSPGESALLDGWLQRGVGRGAGGGEAGACRPPVRQDPDSGPDYEALPAGATVTTHMVAGAVAGILEHCVMYPIDCVKTRMQSLQPDPAARYRNVLEALWRIIRTEGLWRPMRGLNVTATGAGPAHALYFACYEKLKKTLSDVIHPGGNSHIANGIEPSCAGSPTFPTLWALLLSVLSSLSMVWS

SEQ ID NO: 913041 - protein, 164 aa, Homo sapiens
SGSRRPRALWAAPEADTTGPGGGGGSGGSGGGGGRRSWPGWMELEGRGAGGVAGGPAAGPGRSPGESALLDGWLQRGVGRGAGGGEAGACRPPVRQDPDSGPDYEALPAGATVTTHMVAGAVAGILEHCVMYPIDCVKVRPAPGFEPDLGLTRPLGLVRSQDPG

SEQ ID NO: 913042 - protein, 265 aa, Homo sapiens
MQSLQPDPAARYRNVLEALWRIIRTEGLWRPMRGLNVTATGAGPAHALYFACYEKLKKTLSDVIHPGGNSHIANGAAGCVATLLHDAAMNPAEVVKQRMQMYNSPYHRVTDCVRAVWQNEGAGAFYRSYTTQLTMNVPFQAIHFMTYEFLQEHFNPQRRYNPSSHVLSGACAGAVAAAATTPLDVCKTLLNTQESLALNSHITGHITGMASAFRTVYQVGGVTAYFRGVQARVIYQIPSTAIAWSVYEFFKYLITKRQEEWRAGK

SEQ ID NO: 913043 - protein, 234 aa, Homo sapiens
NEARCSDDTAASWSHSTVFWNAPTSMSWSALLALHVAVVFLFAGAAGCVATLLHDAAMNPAEVVKQRMQMYNSPYHRVTDCVRAVWQNEGAGAFYRSYTTQLTMNVPFQAIHFMTYEFLQEHFNPQRRYNPSSHVLSGACAGAVAAAATTPLDVCKTLLNTQESLALNSHITGHITGMASAFRTVYQVGGVTAYFRGVQARVIYQIPSTAIAWSVYEFFKYLITKRQEEWRAGK

SEQ ID NO: 913044 - protein, 209 aa, Homo sapiens [sequence omitted]

SEQ ID NO: 913045 - protein, 209 aa, Homo sapiens [sequence omitted]

SEQ ID NO: 913046 - protein, 176 aa, Homo sapiens; identical to SEQ ID NO: 913031

SEQ ID NO: 913047 - protein, 401 aa, Homo sapiens [sequence omitted]

SEQ ID NO: 913048 - protein, 401 aa, Homo sapiens [sequence omitted]

SEQ ID NO: 913049 - protein, 401 aa, Homo sapiens [sequence omitted]

SEQ ID NO: 913050 - protein, 401 aa, Homo sapiens [sequence omitted]

SEQ ID NO: 913051 - protein, 401 aa, Homo sapiens [sequence omitted]

SEQ ID NO: 913052 - protein, 401 aa, Homo sapiens [sequence omitted]

SEQ ID NO: 913053 - protein, 597 aa, Homo sapiens
MLSRGWFHRDLSGLDAETLLKGRGVHGSFLARPSRKNQGDFSLSVRVGDQVTHIRIQNSGDFYDLYGGEKFATLTELVEYYTQQQGVLQDRDGTIIHLKYPLNCSDPTSERWYHGHMSGGQAETLLQAKGEPWTFLVRESLSQPGDFVLSVLSDQPKAGPGSPLRVTHIKVMCEGGRYTVGGLETFDSLTDLVEHFKKTGIEEASGAFVYLRQPYYATRVNAADIENRVLELNKKQESEDTAKAGFWEEFESLQKQEVKNLHQRLEGQRPENKGKNRYKNILPFDHSRVILQGRDSNIPGSDYINANYIKNQLLGPDENAKTYIASQGCLEATVNDFWQMAWQENSRVIVMTTREVEKGRNKCVPYWPEVGMQRAYGPYSVTNCGEHDTTEYKLRTLQVSPLDNGDLIREIWHYQYLSWPDHGVPSEPGGVLSFLDQINQRQESLPHAGPIIVHCSAGIGRTGTIIVIDMLMENISTKGLDCDIDIQKTIQMVRAQRSGMVQTEAQYKFIYVAIAQFIETTKKKLEVLQSQKGQESEYGNITYPPAMKNAHAKASRTSSKHKEDVYENLHTKNKREEKVKKQRSADKEKSKGSLKRK

SEQ ID NO: 913054 - protein, 595 aa, Homo sapiens
MVRWFHRDLSGLDAETLLKGRGVHGSFLARPSRKNQGDFSLSVRVGDQVTHIRIQNSGDFYDLYGGEKFATLTELVEYYTQQQGVLQDRDGTIIHLKYPLNCSDPTSERWYHGHMSGGQAETLLQAKGEPWTFLVRESLSQPGDFVLSVLSDQPKAGPGSPLRVTHIKVMCEGGRYTVGGLETFDSLTDLVEHFKKTGIEEASGAFVYLRQPYYATRVNAADIENRVLELNKKQESEDTAKAGFWEEFESLQKQEVKNLHQRLEGQRPENKGKNRYKNILPFDHSRVILQGRDSNIPGSDYINANYIKNQLLGPDENAKTYIASQGCLEATVNDFWQMAWQENSRVIVMTTREVEKGRNKCVPYWPEVGMQRAYGPYSVTNCGEHDTTEYKLRTLQVSPLDNGDLIREIWHYQYLSWPDHGVPSEPGGVLSFLDQINQRQESLPHAGPIIVHCSAGIGRTGTIIVIDMLMENISTKGLDCDIDIQKTIQMVRAQRSGMVQTEAQYKFIYVAIAQFIETTKKKLEVLQSQKGQESEYGNITYPPAMKNAHAKASRTSSKHKEDVYENLHTKNKREEKVKKQRSADKEKSKGSLKRK

SEQ ID NO: 913055 - protein, 604 aa, Homo sapiens
PTFSCKAPRMVRWFHRDLSGLDAETLLKGRGVHGSFLARPSRKNQGDFSLSVRVGDQVTHIRIQNSGDFYDLYGGEKFATLTELVEYYTQQQGVLQDRDGTIIHLKYPLNCSDPTSERWYHGHMSGGQAETLLQAKGEPWTFLVRESLSQPGDFVLSVLSDQPKAGPGSPLRVTHIKVMCEGGRYTVGGLETFDSLTDLVEHFKKTGIEEASGAFVYLRQPYYATRVNAADIENRVLELNKKQESEDTAKAGFWEEFESLQKQEVKNLHQRLEGQRPENKGKNRYKNILPFDHSRVILQGRDSNIPGSDYINANYIKNQLLGPDENAKTYIASQGCLEATVNDFWQMAWQENSRVIVMTTREVEKGRNKCVPYWPEVGMQRAYGPYSVTNCGEHDTTEYKLRTLQVSPLDNGDLIREIWHYQYLSWPDHGVPSEPGGVLSFLDQINQRQESLPHAGPIIVHCSAGIGRTGTIIVIDMLMENISTKGLDCDIDIQKTIQMVRAQRSGMVQTEAQYKFIYVAIAQFIETTKKKLEVLQSQKGQESEYGNITYPPAMKNAHAKASRTSSKHKEDVYENLHTKNKREEKVKKQRSADKEKSKGSLKRK

SEQ ID NO: 913056 - protein, 578 aa, Homo sapiens
LRLGTRLGVNSPRASRKIQGDFSLSVRVGDQVTHIRIQNSGDFYDLYGGEKFATLTELVEYYTQQQGVLQDRDGTIIHLKYPLNCSDPTSERWYHGHMSGGQAETLLQAKGEPWTFLVRESLSQPGDFVLSVLSDQPKAGPGSPLRVTHIKVMCEGGRYTVGGLETFDSLTDLVEHFKKTGIEEASGAFVYLRQPYYATRVNAADIENRVLELNKKQESEDTAKAGFWEEFESLQKQEVKNLHQRLEGQRPENKGKNRYKNILPFDHSRVILQGRDSNIPGSDYINANYIKNQLLGPDENAKTYIASQGCLEATVNDFWQMAWQENSRVIVMTTREVEKGRNKCVPYWPEVGMQRAYGPYSVTNCGEHDTTEYKLRTLQVSPLDNGDLIREIWHYQYLSWPDHGVPSEPGGVLSFLDQINQRQESLPHAGPIIVHCSAGIGRTGTIIVIDMLMENISTKGLDCDIDIQKTIQMVRAQRSGMVQTEAQYKFIYVAIAQFIETTKKKLEVLQSQKGQESEYGNITYPPAMKNAHAKASRTSSKHKEDVYENLHTKNKREEKVKKQRSADKEKSKGSLKRK

SEQ ID NO: 913057 - protein, 633 aa, Homo sapiens
PTFSCKAPRMVRWFHRDLSGLDAETLLKGRGVHGSFLARPSRKNQGDFSLSVRVGDQVTHIRIQNSGDFYDLYGGEKFATLTELVEYYTQQQGVLQDRDGTIIHLKYPLNCSDPTSERWYHGHMSGGQAETLLQAKGEPWTFLVRESLSQPGDFVLSVLSDQPKAGPGSPLRVTHIKVMCEGGRYTVGGLETFDSLTDLVEHFKKTGIEEASGAFVYLRQPYYATRVNAADIENRVLELNKKQESEDTAKAGFWEEFESLQKQEVKNLHQRLEGQRPENKGKNRYKNILPFDHSRVILQGRDSNIPGSDYINANYIKNQLLGPDENAKTYIASQGCLEATVNDFWQMAWQENSRVIVMTTREVEKGRNKCVPYWPEVGMQRAYGPYSVTNCGEHDTTEYKLRTLQVSPLDNGDLIREIWHYQYLSWPDHGVPSEPGGVLSFLDQINQRQESLPHAGPIIVHCSAGIGRTGTIIVIDMLMENISTKGLDCDIDIQKTIQMVRAQRSGMVQTEAQYKFIYVAIAQFIETTKKKLEVLQSQKGQESEYGNITYPPAMKNAHAKASRTSSKSLESSAGTVAASPVRRGGQRGLPVPGPPVLSPDLHQLPVLAPLHPAADTRRMCMRTCTLRTRGRRK

SEQ ID NO: 913058 - protein, 126 aa, Homo sapiens
MGSPVSLGVSSASWTRSTSGRKVCLTQGPSSCTAAPASAAQAPSLSSTCSWRTSPPRAWTVTLTSRRPSRWCGRSARAWCRRRRSTSSSTWPSPSSLKPLRRSWRSCSRRRARSRSTGTSPIPHSP

SEQ ID NO: 913059 - protein, 454 aa, Homo sapiens
MVRWFHRDLSGLDAETLLKGRGVHGSFLARPSRKNQGDFSLSVRVGDQVTHIRIQNSGDFYDLYGGEKFATLTELVEYYTQQQGVLQDRDGTIIHLKYPLNCSDPTSERWYHGHMSGGQAETLLQAKGEPWTFLVRESLSQPGDFVLSVLSDQPKAGPGSPLRVTHIKVMCEGGRYTVGGLETFDSLTDLVEHFKKTGIEEASGAFVYLRQPYYATRVNAADIENRVLELNKKQESEDTAKAGFWEEFESLQKQEVKNLHQRLEGQRPENKGKNRYKNILPFDHSRVILQGRDSNIPGSDYINANYIKNQLLGPDENAKTYIASQGCLEATVNDFWQMAWQENSRVIVMTTREVEKGRNKCVPYWPEVGMQRAYGPYSVTNCGEHDTTEYKLRTLQVSPLDNGDLIREIWHYQYLSWPDHGVPSEPGGVLSFLDQINQRQESLPHAGPIIVHCR

SEQ ID NO: 913060 - protein, 219 aa, Homo sapiens
MVAAGEPASAPQSPRWSVSMQSWANLHHHLPGDPGHIPSHHWRLRLLLWCLGLELSAGYPPSRGGLDWPLMAPPSFPSAGIGRTGTIIVIDMLMENISTKGLDCDIDIQKTIQMVRAQRSGMVQTEAQYKFIYVAIAQFIETTKKKLEVLQSQKGQESEYGNITYPPAMKNAHAKASRTSSKHKEDVYENLHTKNKREEKVKKQRSADKEKSKGSLKRK

SEQ ID NO: 913061 - protein, 256 aa, Homo sapiens
MVRWFHRDLSGLDAETLLKGRGVHGSFLARPSRKNQGDFSLSVRVGDQVTHIRIQNSGDFYDLYGGEKFATLTELVEYYTQQQGVLQDRDGTIIHLKYPLNCSDPTSERWYHGHMSGGQAETLLQAKGEPWTFLVRESLSQPGDFVLSVLSDQPKAGPGSPLRVTHIKVMCEGGRYTVGGLETFDSLTDLVEHFKKTGIEEASGAFVYLRQPYYATRVNAADIENRVLELNKKQESEDTAKAGFWEEFESLLHSLD

SEQ ID NO: 913062 - protein, 193 aa, Homo sapiens
MLSRGWFHRDLSGLDAETLLKGRGVHGSFLARPSRKNQGDFSLSVRWYHGHMSGGQAETLLQAKGEPWTFLVRESLSQPGDFVLSVLSDQPKAGPGSPLRVTHIKVMCEGGRYTVGGLETFDSLTDLVEHFKKTGIEEASGAFVYLRQPYYATRVNAADIENRVLELNKKQESEDTAKAGFWEEFESLLHSLD

SEQ ID NO: 913063 - protein, 595 aa, Homo sapiens; identical to SEQ ID NO: 913054

SEQ ID NO: 913064 - protein, 597 aa, Homo sapiens; identical to SEQ ID NO: 913053

SEQ ID NO: 913065 - protein, 712 aa, Homo sapiens
KKTGIEEASGAFVYLRQPYYATRVNAADIENRVLELNKKAGSRRKWLITERFFLTWLGPLCTAVPLAQPRPLRPSAVASPSLQRDAVPWGGKGLPPTVDRRQGCLVPTGPLLTALPGPPRWFHRDLSGLDAETLLKGRGVHGSFLARPSRKNQGDFSLSVRVGDQVTHIRIQNSGDFYDLYGGEKFATLTELVEYYTQQQGVLQDRDGTIIHLKYPLNCSDPTSERWYHGHMSGGQAETLLQAKGEPWTFLVRESLSQPGDFVLSVLSDQPKAGPGSPLRVTHIKVMCEGGRYTVGGLETFDSLTDLVEHFKKTGIEEASGAFVYLRQPYYATRVNAADIENRVLELNKKQESEDTAKAGFWEEFESLQKQEVKNLHQRLEGQRPENKGKNRYKNILPFDHSRVILQGRDSNIPGSDYINANYIKNQLLGPDENAKTYIASQGCLEATVNDFWQMAWQENSRVIVMTTREVEKGRNKCVPYWPEVGMQRAYGPYSVTNCGEHDTTEYKLRTLQVSPLDNGDLIREIWHYQYLSWPDHGVPSEPGGVLSFLDQINQRQESLPHAGPIIVHCSAGIGRTGTIIVIDMLMENISTKGLDCDIDIQKTIQMVRAQRSGMVQTEAQYKFIYVAIAQFIETTKKKLEVLQSQKGQESEYGNITYPPAMKNAHAKASRTSSKHKEDVYENLHTKNKREEKVKKQRSADKEKSKGSLKRK

SEQ ID NO: 913066 - protein, 556 aa, Homo sapiens
MLSRGVGDQVTHIRIQNSGDFYDLYGGEKFATLTELVEYYTQQQGVLQDRDGTIIHLKYPLNCSDPTSERWYHGHMSGGQAETLLQAKGEPWTFLVRESLSQPGDFVLSVLSDQPKAGPGSPLRVTHIKVMCEGGRYTVGGLETFDSLTDLVEHFKKTGIEEASGAFVYLRQPYYATRVNAADIENRVLELNKKQESEDTAKAGFWEEFESLQKQEVKNLHQRLEGQRPENKGKNRYKNILPFDHSRVILQGRDSNIPGSDYINANYIKNQLLGPDENAKTYIASQGCLEATVNDFWQMAWQENSRVIVMTTREVEKGRNKCVPYWPEVGMQRAYGPYSVTNCGEHDTTEYKLRTLQVSPLDNGDLIREIWHYQYLSWPDHGVPSEPGGVLSFLDQINQRQESLPHAGPIIVHCSAGIGRTGTIIVIDMLMENISTKGLDCDIDIQKTIQMVRAQRSGMVQTEAQYKFIYVAIAQFIETTKKKLEVLQSQKGQESEYGNITYPPAMKNAHAKASRTSSKHKEDVYENLHTKNKREEKVKKQRSADKEKSKGSLKRK

SEQ ID NO: 913067 - protein, 481 aa, Homo sapiens
MSGGQAETLLQAKGEPWTFLVRESLSQPGDFVLSVLSDQPKAGPGSPLRVTHIKVMCEGGRYTVGGLETFDSLTDLVEHFKKTGIEEASGAFVYLRQPYYATRVNAADIENRVLELNKKQESEDTAKAGFWEEFESLQKQEVKNLHQRLEGQRPENKGKNRYKNILPFDHSRVILQGRDSNIPGSDYINANYIKNQLLGPDENAKTYIASQGCLEATVNDFWQMAWQENSRVIVMTTREVEKGRNKCVPYWPEVGMQRAYGPYSVTNCGEHDTTEYKLRTLQVSPLDNGDLIREIWHYQYLSWPDHGVPSEPGGVLSFLDQINQRQESLPHAGPIIVHCSAGIGRTGTIIVIDMLMENISTKGLDCDIDIQKTIQMVRAQRSGMVQTEAQYKFIYVAIAQFIETTKKKLEVLQSQKGQESEYGNITYPPAMKNAHAKASRTSSKHKEDVYENLHTKNKREEKVKKQRSADKEKSKGSLKRK

SEQ ID NO: 913068 - protein, 622 aa, Homo sapiens
MVRWFHRDLSGLDAETLLKGRGVHGSFLARPSRKNQGDFSLSVRVGDQVTHIRIQNSGDFYDLYGGEKFATLTELVEYYTQQQGVLQDRDGTIIHLKYPLNCSDPTSERWYHGHMSGGQAETLLQAKGEPWTFLVRESLSQPGDFVLSVLSDQPKAGPGSPLRVTHIKVMCEGGRYTVGGLETFDSLTDLVEHFKKTGIEEASGAFVYLRQPYYATRVNAADIENRVLELNKKQESEDTAKAGFWEEFESLQKQEVKNLHQRLEGQRPENKGKNRYKNILPFDHSRVILQGRDSNIPGSDYINANYIKNQLLGPDENAKTYIASQGCLEATVNDFWQMAWQENSRVIVMTTREVEKGRNKCVPYWPEVGMQRAYGPYSVTNCGEHDTTEYKLRTLQVSPLDNGDLIREIWHYQYLSWPDHGVPSEPGGVLSFLDQINQRQESLPHAGPIIVHCSAGIGRTGTIIVIDMLMENISTKGLDCDIDIQKTIQMVRAQRSGMVQTEAQYKFIYVAIAQFIETTKKKLEVLQSQKGQESEYGNITYPPAMKNAHAKASRTSSKHKEDVYENLHTKNKREEKVKKQRSADKEKSKGSLKRNLSPDPVEAFRDGQTHNLNLGVPHSFVI

SEQ ID NO: 913069 - protein, 340 aa, Homo sapiens
EDPHLDMRIGQRPENKGKNRYKNILPFDHSRVILQGRDSNIPGSDYINANYIKNQLLGPDENAKTYIASQGCLEATVNDFWQMAWQENSRVIVMTTREVEKGRNKCVPYWPEVGMQRAYGPYSVTNCGEHDTTEYKLRTLQVSPLDNGDLIREIWHYQYLSWPDHGVPSEPGGVLSFLDQINQRQESLPHAGPIIVHCSAGIGRTGTIIVIDMLMENISTKGLDCDIDIQKTIQMVRAQRSGMVQTEAQYKFIYVAIAQFIETTKKKLEVLQSQKGQESEYGNITYPPAMKNAHAKASRTSSKHKEDVYENLHTKNKREEKVKKQRSADKEKSKGSLKRK

SEQ ID NO: 913070 - protein, 317 aa, Homo sapiens
MVRWFHRDLSGLDAETLLKGRGVHGSFLARPSRKNQGDFSLSVRVGDQVTHIRIQNSGDFYDLYGGEKFATLTELVEYYTQQQGVLQDRDGTIIHLKYPLNCSDPTSERWYHGHMSGGQAETLLQAKGEPWTFLVRESLSQPGDFVLSVLSDQPKAGPGSPLRVTHIKVMCEGGRYTVGGLETFDSLTDLVEHFKKTGIEEASGAFVYLRQPYYATRVNAADIENRVLELNKKQESEDTAKAGFWEEFESLQKQEVKNLHQRLEGQRPENKGKNRYKNILPCEHPGCPIHPGYRPLPSCLPSSHRSPPSTPGGAISP

SEQ ID NO: 913071 - protein, 157 aa, Homo sapiens
MVRWFHRDLSGLDAETLLKGRGVHGSFLARPSRKNQGDFSLSVRVGDQVTHIRIQNSGDFYDLYGGEKFATLTELVEYYTQQQGVLQDRDGTIIHLKYPLNCSDPTSERWYHGHMSGGQAETLLQAKGEPLSPDPVEAFRDGQTHNLNLGVPHSFVI

SEQ ID NO: 913072 - protein, 65 aa, Homo sapiens
GGESEEAAVSRQGEEQGFPQEEVSGAVLRWPWYSSSAWVSSLPCPVSLAPLPSLGGWGGRSLILC

SEQ ID NO: 913073 - protein, 387 aa, Homo sapiens
MGAFLDKPKTEKHNAHGAGNGLRYGLSSMQGWRVEMEDAHTAVVGIPHGLEDWSFFAVYDGHAGSRVANYCSTHLLEHITTNEDFRAAGKSGSALELSVENVKNGIRTGFLKIDEYMRNFSDLRNGMDRSGSTAVGVMISPKHIYFINCGDSRAVLYRNGQVCFSTQDHKPCNPREKERIQNAGGSVMIQRVNGSLAVSRALGDYDYKCVDGKGPTEQLVSPEPEVYEILRAEEDEFIILACDGIWDVMSNEELCEYVKSRLEVSDDLENVCNWVVDTCLHKGSRDNMSIVLVCFSNAPKVSDEAVKKDSELDKHLESRVEEIMEKSGEEGMPDLAHVMRILSAENIPNLPPGGGLAGKRNVIEAVYSRLNPHRESDGGAGDLEDPW

SEQ ID NO: 913074 - protein, 479 aa, Homo sapiens
MGAFLDKPKTEKHNAHGAGNGLRYGLSSMQGWRVEMEDAHTAVVGIPHGLEDWSFFAVYDGHAGSRVANYCSTHLLEHITTNEDFRAAGKSGSALELSVENVKNGIRTGFLKIDEYMRNFSDLRNGMDRSGSTAVGVMISPKHIYFINCGDSRAVLYRNGQVCFSTQDHKPCNPREKERIQNAGGSVMIQRVNGSLAVSRALGDYDYKCVDGKGPTEQLVSPEPEVYEILRAEEDEFIILACDGIWDVMSNEELCEYVKSRLEVSDDLENVCNWVVDTCLHKGSRDNMSIVLVCFSNAPKVSDEAVKKDSELDKHLESRVEEIMEKSGEEGMPDLAHVMRILSAENIPNLPPGGGLAGKRNVIEAVYSRLNPHRESDGASDEAEESGSQGKLVEALRQMRINHRGNYRQLLEEMLTSYRLAKVEGEESPAEPAATATSSNSDAGNPVTMQESHTESESGLAELDSSNEDAGTKMSGEKI

SEQ ID NO: 913075 - protein, 387 aa, Homo sapiens; identical to SEQ ID NO: 913073

SEQ ID NO: 913076 - protein, 479 aa, Homo sapiens; identical to SEQ ID NO: 913074

SEQ ID NO: 913077 - protein, 479 aa, Homo sapiens; identical to SEQ ID NO: 913074

SEQ ID NO: 913078 - protein, 330 aa, Homo sapiens
MGAFLDKPKTEKHNAHGAGNGLRYGLSSMQGWRVEMEDAHTAVVGIPHGLEDWSFFAVYDGHAGSRVANYCSTHLLEHITTNEDFRAAGKSGSALELSVENVKNGIRTGFLKIDEYMRNFSDLRNGMDRSGSTAVGVMISPKHIYFINCGDSRAVLYRNGQVCFSTQDHKPCNPREKERIQNAGGSVMIQRVNGSLAVSRALGDYDYKCVDGKGPTEQLVSPEPEVYEILRAEEDEFIILACDGIWDVMSNEELCEYVKSRLEVSDDLENVCNWVVDTCLHKRLWRSLARKECLILPMSCASCLQKISQICLLGEVLLASVMLLKLFIVD

SEQ ID NO: 913079 - protein, 431 aa, Homo sapiens
MGAFLDKPKTEKHNAHGAGNGLRYGLSSMQGWRVEMEDAHTAVVGIPHGLEDWSFFAVYDGHAGSRVANYCSTHLLEHITTNEDFRAAGKSGSALELSVENVKNGIRTGFLKIDEYMRNFSDLRNGMDRSGSTAVGVMISPKHIYFINCGDSRAVLYRNGQVCFSTQDHKPCNPREKERIQNAGGSVMIQRVNGSLAVSRALGDYDYKCVDGKGPTEQLVSPEPEVYEILRAEEDEFIILACDGIWDVMSNEELCEYVKSRLEVSDDLENVCNWVVDTCLHKGSRDNMSIVLVCFSNAPKVSDEAVKKDSELDKHLESRVEEIMEKSGEEGMPDLAHVMRILSAENIPNLPPGGGLAGKRNVIEAVYSRLNPHRESDGMAVLGTSICKPAESSGDKKGSGWQTFQALRSTRTKRFFCKPERKINPALYNYK

SEQ ID NO: 913080 - protein, 337 aa, Homo sapiens
MGAFLDKPKTEKHNAHGAGNGLRYGLSSMQGWRVEMEDAHTAVVGIPHGLEDWSFFAVYDGHAGSRVANYCSTHLLEHITTNEDFRAAGKSGSALELSVENVKNGIRTGFLKIDEYMRNFSDLRNGMDRSGSTAVGVMISPKHIYFINCGDSRAVLYRNGQVCFSTQDHKPCNPREKERIQNAGGSVMIQRVNGSLAVSRALGDYDYKCVDGKGPTEQLVSPEPEVYEILRAEEDEFIILACDGIWDVMSNEELCEYVKSRLEVSDDLENVCNWVVDTCLHKRLWRSLARKECLILPMSCASCLQKISQICLLGEVLLASSNAIETSKLGVQLEFYM

SEQ ID NO: 913081 - protein, 192 aa, Homo sapiens
MSIVLVCFSNAPKVSDEAVKKDSELDKHLESRVEEIMEKSGEEGMPDLAHVMRILSAENIPNLPPGGGLAGKRNVIEAVYSRLNPHRESDGASDEAEESGSQGKLVEALRQMRINHRGNYRQLLEEMLTSYRLAKVEGEESPAEPAATATSSNSDAGNPVTMQESHTESESGLAELDSSNEDAGTKMSGEKI

SEQ ID NO: 913082 - protein, 330 aa, Homo sapiens; identical to SEQ ID NO: 913078

SEQ ID NO: 913083 - protein, 359 aa, Homo sapiens
MQGWRVEMEDAHTAVVGIPHGLEDWSFFAVYDGHAGSRVANYCSTHLLEHITTNEDFRAAGKSGSALELSVENVKNGIRTGFLKIDEYMRNFSDLRNGMDRSGSTAVGVMISPKHIYFINCGDSRAVLYRNGQVCFSTQDHKPCNPREKERIQNAGGSVMIQRVNGSLAVSRALGDYDYKCVDGKGPTEQLVSPEPEVYEILRAEEDEFIILACDGIWDVMSNEELCEYVKSRLEVSDDLENVCNWVVDTCLHKGSRDNMSIVLVCFSNAPKVSDEAVKKDSELDKHLESRVEEIMEKSGEEGMPDLAHVMRILSAENIPNLPPGGGLAGKRNVIEAVYSRLNPHRESDGGAGDLEDPW

SEQ ID NO: 913084 - protein, 387 aa, Homo sapiens; identical to SEQ ID NO: 913073

SEQ ID NO: 913085 - protein, 386 aa, Homo sapiens
MGAFLDKPKTEKHNAHGAGNGLRYGLSSMQGWRVEMEDAHTAVVGIPHGLEDWSFFAVYDGHAGSRVANYCSTHLLEHITTNEDFRAAGKSGSALELSVENVKNGIRTGFLKIDEYMRNFSDLRNGMDRSGSTAVGVMISPKHIYFINCGDSRAVLYRNGQVCFSTQDHKPCNPREKERIQNAGGSVMIQRVNGSLAVSRALGDYDYKCVDGKGPTEQLVSPEPEVYEILRAEEDEFIILACDGIWDVMSNEELCEYVKSRLEVSDDLENVCNWVVDTCLHKGSRDNMSIVLVCFSNAPKVSDEAVKKDSELDKHLESRVEEIMEKSGEEGMPDLAHVMRILSAENIPNLPPGGGLAGKRNVIEAVYSRLNPHRESDGVSFILFHK

SEQ ID NO: 913086 - protein, 571 aa, Homo sapiens
LPGEGGGRRAAGTGCGGGCGGGGGSSMDWGTELWDQFEVLERHTQWGLDLLDRYVKFVKERTEVEQAYAKQLRSLVKKYLPKRPAKDDPESKFSQQQSFVQILQEVNDFAGQRELVAENLSVRVCLELTKYSQEMKQERKMHFQEGRRAQQQLENGFKQLENSKRKFERDCREAEKAAQTAERLDQDINATKADVEKAKQQAHLRSHMAEESKNEYAAQLQRFNRDQAHFYFSQMPQIFDKLQDMDERRATRLGAGYGLLSEAELEVVPIIAKCLEGMKVAANAVDPKNDSHVLIELHKSGFARPGDVEFEDFSQPMNRAPSDSSLGTPSDGRPELRGPGRSRTKRWPFGKKNKTVVTEDFSHLPPEQQRKRLQQQLEERSRELQKEVDQREALKKMKDVYEKTPQMGDPASLEPQIAETLSNIERLKLEVQKYEAWLAEAESRVLSNRGDSLSRHARPPDPPASAPPDSSSNSASQDTKESSEEPPSEESQDTPIYTEFDEDFEEEPTSPIGHCVAIYHFEGSSEGTISMAEGEDLSLMEEDKGDGWTRVRRKEGGEGYVPTSYLRVTLN

SEQ ID NO: 913087 - protein, 571 aa, Homo sapiens; identical to SEQ ID NO: 913086

SEQ ID NO: 913088 - protein, 627 aa, Homo sapiens
LPGEGGGRRAAGTGCGGGCGGGGGSSMDWGTELWDQFEVLERHTQWGLDLLDRYVKFVKERTEVEQAYAKQLRSLVKKYLPKRPAKDDPESKFSQQQSFVQILQEVNDFAGQRELVAENLSVRVCLELTKYSQEMKQERKMHFQEGRRAQQQLENGFKQLENSKRKFERDCREAEKAAQTAERLDQDINATKADVEKAKQQAHLRSHMAEESKNEYAAQLQRFNRDQAHFYFSQMPQIFDKLQDMDERRATRLGAGYGLLSEAELEVVPIIAKCLEGMKVAANAVDPKNDSHVLIELHKSGFARPGDVEFEDFSQPMNRAPSDSSLGTPSDGRPELRGPGRSRTKRWPFGKKNKPRPPPLSPLGGPVPSALPNGPPSPRSGRDPLAILSEISKSVKPRLASFRSLRGSRGTVVTEDFSHLPPEQQRKRLQQQLEERSRELQKEVDQREALKKMKDVYEKTPQMGDPASLEPQIAETLSNIERLKLEVQKYEAWLAEAESRVLSNRGDSLSRHARPPDPPASAPPDSSSNSASQDTKESSEEPPSEESQDTPIYTEFDEDFEEEPTSPIGHCVAIYHFEGSSEGTISMAEGEDLSLMEEDKGDGWTRVRRKEGGEGYVPTSYLRVTLN

SEQ ID NO: 913089 - protein, 437 aa, Homo sapiens
MKQERKMHFQEGRRAQQQLENGFKQLENSKRKFERDCREAEKAAQTAERLDQDINATKADVEKAKQQAHLRSHMAEESKNEYAAQLQRFNRDQAHFYFSQMPQIFDKLQDMDERRATRLGAGYGLLSEAELEVVPIIAKCLEGMKVAANAVDPKNDSHVLIELHKSGFARPGDVEFEDFSQPMNRAPSDSSLGTPSDGRPELRGPGRSRTKRWPFGKKNKTVVTEDFSHLPPEQQRKRLQQQLEERSRELQKEVDQREALKKMKDVYEKTPQMGDPASLEPQIAETLSNIERLKLEVQKYEAWLAEAESRVLSNRGDSLSRHARPPDPPASAPPDSSSNSASQDTKESSEEPPSEESQDTPIYTEFDEDFEEEPTSPIGHCVAIYHFEGSSEGTISMAEGEDLSLMEEDKGDGWTRVRRKEGGEGYVPTSYLRVTLN

SEQ ID NO: 913090 - protein, 650 aa, Homo sapiens
LPGEGGGRRAAGTGCGGGCGGGGGSSMDWGTELWDQFEVLERHTQWGLDLLDRYVKFVKERTEVEQAYAKQLRSLVKKYLPKRPAKDDPESKFSQQQSFVQILQEVNDFAGQRELVAENLSVRVCLELTKYSQEMKQERKMHFQEGRRAQQQLENGFKQLENVSLQRYSDCGPEAWGQGCGSGVRELPSLSDLDLPSPIGFQYSLDPYLLDDIPIIPETLVSHPAVFGDGGSLTPVLSPTQSKRKFERDCREAEKAAQTAERLDQDINATKADVEKAKQQAHLRSHMAEESKNEYAAQLQRFNRDQAHFYFSQMPQIFDKLQDMDERRATRLGAGYGLLSEAELEVVPIIAKCLEGMKVAANAVDPKNDSHVLIELHKSGFARPGDVEFEDFSQPMNRAPSDSSLGTPSDGRPELRGPGRSRTKRWPFGKKNKTVVTEDFSHLPPEQQRKRLQQQLEERSRELQKEVDQREALKKMKDVYEKTPQMGDPASLEPQIAETLSNIERLKLEVQKYEAWLAEAESRVLSNRGDSLSRHARPPDPPASAPPDSSSNSASQDTKESSEEPPSEESQDTPIYTEFDEDFEEEPTSPIGHCVAIYHFEGSSEGTISMAEGEDLSLMEEDKGDGWTRVRRKEGGEGYVPTSYLRVTLN

SEQ ID NO: 913091 - protein, 586 aa, Homo sapiens
LPGEGGGRRAAGTGCGGGCGGGGGSSMDWGTELWDQFEVLERHTQWGLDLLDRYVKFVKERTEVEQAYAKQLRSLVKKYLPKRPAKDDPESKFSQQQSFVQILQEVNDFAGQRELVAENLSVRVCLELTKYSQEMKQERKMHFQEGRRAQQQLENGFKQLENSKRKFERDCREAEKAAQTAERLDQDINATKADVEKAKQQAHLRSHMAEESKNEYAAQLQRFNRDQAHFYFSQMPQIFDKLQDMDERRATRLGAGYGLLSEAELEVVPIIAKCLEGMKVAANAVDPKNDSHVLIELHKSGFARPGDVEFEDFSQPMNRAPSDSSLGTPSDGRPELRGPGRSRTKRWPFGKKNKTVVTEDFSHLPPEQQRKRLQQQLEERSRELQKEVDQREALKKMKDVYEKTPQMGDPASLEPQIAETLSNIERLKLEVQKYEAWLAEAESRVLSNRGDSLSRHARPPDPPASAPPDSSSNSASQDTKESSEEPPSEESQDTPIYTEFDEDFEEEPTSPIGHCVAIYHFEGPAKRGGGGAPNPLIWSSEGTISMAEGEDLSLMEEDKGDGWTRVRRKEGGEGYVPTSYLRVTLN

SEQ ID NO: 913092 - protein, 115 aa, Homo sapiens
KHPIICRLIHFSNSSSNSASQDTKESSEEPPSEESQDTPIYTEFDEDFEEEPTSPIGHCVAIYHFEGSSEGTISMAEGEDLSLMEEDKGDGWTRVRRKEGGEGYVPTSYLRVTLN

SEQ ID NO: 913093 - protein, 439 aa, Homo sapiens
LPGEGGGRRAAGTGCGGGCGGGGGSSMDWGTELWDQFEVLERHTQWGLDLLDRYVKFVKERTEVEQAYAKQLRSLVKKYLPKRPAKDDPESKFSQQQSFVQILQEVNDFAGQRELVAENLSVRVCLELTKYSQEMKQERKMHFQEGRRAQQQLENGFKQLENSKRKFERDCREAEKAAQTAERLDQDINATKADVEKAKQQAHLRSHMAEESKNEYAAQLQRFNRDQAHFYFSQMPQIFDKLQDMDERRATRLGAGYGLLSEAELEVVPIIAKCLEGMKVAANAVDPKNDSHVLIELHKSGFARPGDVEFEDFSQPMNRAPSDSSLGTPSDGRPELRGPGRSRTKRWPFGKKNKPRPPKPSPPVKTQPTAPLPPTTTPKNTHTTTSAENRRPQSNNRKGTRDPDKDCKNNQKEIGTTLKPNLHTRHHRDTGTRPAHATR

SEQ ID NO: 913094 - protein, 167 aa, Homo sapiens
LPGEGGGRRAAGTGCGGGCGGGGGSSMDWGTELWDQFEVLERHTQWGLDLLDRYVKFVKERTEVEQAYAKQLRSLVKKYLPKRPAKDDPESKFSQQQSFVQILQEVNDFAGQRELVAENLSVRVCLELTKYSQEMKQERKMHFQEGRRAQQQLENGFKQLENVSLQR

SEQ ID NO: 913095 - protein, 154 aa, Homo sapiens
GRRAVGSQNRDPGPSPLLPHHVPCQDQFEVLERHTQWGLDLLDRYVKFVKERTEVEQAYAKQLRSLVKKYLPKRPAKDDPESKFSQQQSFVQILQEVNDFAGQRELVAENLSVRVCLELTKYSQENCLNSGGRGFSELHPSLGNKSETPSQKKK

SEQ ID NO: 913096 - protein, 562 aa, Homo sapiens
GRRAVGSQNRDPGPSPLLPHHVPCQDQFEVLERHTQWGLDLLDRYVKFVKERTEVEQAYAKQLRSLVKKYLPKRPAKDDPESKFSQQQSFVQILQEVNDFAGQRELVAENLSVRVCLELTKYSQEMKQERKMHFQEGRRAQQQLENGFKQLENSKRKFERDCREAEKAAQTAERLDQDINATKADVEKAKQQAHLRSHMAEESKNEYAAQLQRFNRDQAHFYFSQMPQIFDKLQDMDERRATRLGAGYGLLSEAELEVVPIIAKCLEGMKVAANAVDPKNDSHVLIELHKSGFARPGDVEFEDFSQPMNRAPSDSSLGTPSDGRPELRGPGRSRTKRWPFGKKNKTVVTEDFSHLPPEQQRKRLQQQLEERSRELQKEVDQREALKKMKDVYEKTPQMGDPASLEPQIAETLSNIERLKLEVQKYEAWLAEAESRVLSNRGDSLSRHARPPDPPASAPPDSSSNSASQDTKESSEEPPSEESQDTPIYTEFDEDFEEEPTSPIGHCVAIYHFEGSSEGTISMAEGEDLSLMEEDKGDGWTRVRRKEGGEGYVPTSYLRVTLN

SEQ ID NO: 913097 - protein, 544 aa, Homo sapiens
LPGEGGGRRAAGTGCGGGCGGGGGSSMDWGTELWDQFEVLERHTQWGLDLLDRYVKFVKERTEVEQAYAKQLRSLVKKYLPKRPAKDDPESKFSQQQSFVQILQEVNDFAGQRELVAENLSVRVCLELTKYSQEMKQERKMHFQEGRRAQQQLENGFKQLENSKRKFERDCREAEKAAQTAERLDQDINATKADVEKAKQQAHLRSHMAEESKNEYAAQLQRFNRDQAHFYFSQMPQIFDKLQDMDERRATRLGAGYGLLSEAELEVVPIIAKCLEGMKVAANAVDPKNDSHVLIELHKSGFARPGDVEFEDFSQPMNRAPSDSSLGTPSDGRPELRGPGRSRTKRWPFGKKNKTVVTEDFSHLPPEQQRKRLQQQLEERSRELQKEVDQREALKKMKDVYEKTPQMGDPASLEPQIAETLSNIERLKLEVQKYEAWLAEAESRVLSNRGDSLSRHARPPDPPASAPPDSSSNSASQDTKESSEEPPSEESQDTPIYTEFDEDFEEEPTSPIGHCVAIYHFEDLGPPPPPSQGVQRGHYLYGRG

SEQ ID NO: 913098 - protein, 241 aa, Homo sapiens
ISDGCRVWQARLLDPKFSPLPTLQTVVTEDFSHLPPEQQRKRLQQQLEERSRELQKEVDQREALKKMKDVYEKTPQMGDPASLEPQIAETLSNIERLKLEVQKYEAWLAEAESRVLSNRGDSLSRHARPPDPPASAPPDSSSNSASQDTKESSEEPPSEESQDTPIYTEFDEDFEEEPTSPIGHCVAIYHFEGSSEGTISMAEGEDLSLMEEDKGDGWTRVRRKEGGEGYVPTSYLRVTLN

SEQ ID NO: 913099 - protein, 108 aa, Homo sapiens
DLAGSFSSPTGALQDIKESSEEPPSEESQDTPIYTEFDEDFEEEPTSPIGHCVAIYHFEGSSEGTISMAEGEDLSLMEEDKGDGWTRVRRKEGGEGYVPTSYLRVTLN

SEQ ID NO: 913100 - protein, 356 aa, Homo sapiens
LPGEGGGRRAAGTGCGGGCGGGGGSSMDWGTELWDQFEVLERHTQWGLDLLDRYVKFVKERTEVEQAYAKQLRSLVKKYLPKRPAKDDPESKFSQQQSFVQILQEVNDFAGQRELVAENLSVRVCLELTKYSQEMKQERKMHFQEGRRAQQQLENGFKQLENSKRKFERDCREAEKAAQTAERLDQDINATKADVEKAKQQAHLRSHMAEESKNEYAAQLQRFNRDQAHFYFSQMPQIFDKLQDMDERRATRLGAGYGLLSEAELEVVPIIAKCLEGMKVAANAVDPKNDSHVLIELHKSGFARPGDVEFEDFSQPMNRAPSDSSLGTPSDGRPELRGPGRSRTKRWPTAHAGTEL

SEQ ID NO: 913101 - protein, 151 aa, Homo sapiens
MEPVLVLCVHLVHLRSCIYPAHAIDPALFASPVAASGHEKDRITGSQIHKPHQEDHPRNAWRLRSSLRLLHLETQDEDPAWGCQRFFACLTPMTPPGPYGSTQKQFSPTGGQLQPITISSLPQPLSSKHLLPVHPHPFPQTAFEKSLTYEL

SEQ ID NO: 913102 - protein, 151 aa, Homo sapiens; identical to SEQ ID NO: 913101

SEQ ID NO: 913103 - protein, 93 aa, Homo sapiens
PAPRSSGQSACGGRAHGPAGRAGSGRPGRGGATTSCEQRCAPGPPAPSSGFPCGKDVGGPCDLWRHGQICPPMASPETKKMVRPGGGRAEEST

SEQ ID NO: 913104 - protein, 103 aa, Homo sapiens
PAPRSSGQSACGGRAHGPAGRAGSGRPGRGGATTSCEQRCAPGPPAPSSGFPCGKDVGGPCDLWRHGQICPPDLLGEKPSRKLQKDKYRIRVWEKPRGLVSII

SEQ ID NO: 913105 - protein, 72 aa, Homo sapiens
PAPRSSGQSACGGRAHGPAGRAGSGRPGRGGATTSCEQRCAPGPPAPSSGFPCGKDVGGPCDLWRHGQICPP

SEQ ID NO: 913106 - protein, 103 aa, Homo sapiens; identical to SEQ ID NO: 913104

SEQ ID NO: 913107 - protein, 165 aa, Homo sapiens
RQPRAPPGRARVAAEHMGPRAGRARGGRDEEGRRRAASKDVPRDPRHLPVDFLAERMLAVPVTCGDTARSALQPDLLARRRLKRCPSRWLCLSAAWSFVQVFSEPDGFTVIFSGLGNNAGGTMHWNDTRPAHFRILKVVLREAVAECLMDSYSLDVHGGRRTAAG

SEQ ID NO: 913108 - protein, 165 aa, Homo sapiens; identical to SEQ ID NO: 913107

SEQ ID NO: 913109 - protein, 165 aa, Homo sapiens; identical to SEQ ID NO: 913107

SEQ ID NO: 913110 - protein, 165 aa, Homo sapiens; identical to SEQ ID NO: 913107

SEQ ID NO: 913111 - protein, 165 aa, Homo sapiens; identical to SEQ ID NO: 913107

SEQ ID NO: 913112 - protein, 165 aa, Homo sapiens; identical to SEQ ID NO: 913107

SEQ ID NO: 913113 - protein, 165 aa, Homo sapiens; identical to SEQ ID NO: 913107

SEQ ID NO: 913114 - protein, 165 aa, Homo sapiens; identical to SEQ ID NO: 913107

SEQ ID NO: 913115 - protein, 74 aa, Homo sapiens
KGTGDLPGAGPLEWWVLGSFRGPLQVHSLLFSALFCAQKADLCGCIIRVDATQGCHALWYQFGRHWQDGKAGGE

SEQ ID NO: 913116 - protein, 131 aa, Homo sapiens
ATPPYAPPFLFTAYLPRLIKDRITGSQIHKPHQEDHPRNAWRLRSSLRLLHLETQDEDPAWGCQRFFACLTPMTPPGPYGSTQKQFSPTGGQLQPITISSLPQPLSSKHLLPVHPHPFPQTAFEKSLTYEL

SEQ ID NO: 913117 - protein, 165 aa, Homo sapiens; identical to SEQ ID NO: 913107

SEQ ID NO: 913118 - protein, 165 aa, Homo sapiens; identical to SEQ ID NO: 913107

SEQ ID NO: 913119 - protein, 165 aa, Homo sapiens; identical to SEQ ID NO: 913107

SEQ ID NO: 913120 - protein, 96 aa, Homo sapiens
PAPRSSGQSACGGRAHGPAGRAGSGRPGRGGATTSCEQRCAPGPPAPSSGFPCGKDVGGPCDLWRHGQICPPMASPETKKMVRPGGGRAEEVELVC

SEQ ID NO: 913121 - protein, 88 aa, Homo sapiens
RQPRAPPGRARVAAEHMGPRAGRARGGRDEEGRRRAASKDVPRDPRHLPVDFLAERMLAVPVTCGDTARSALQLNWFVELYGWSQPTG

SEQ ID NO: 913122 - protein, 159 aa, Homo sapiens
FGMKAVEAKRPLGQSQAGGSSQGPSRQVAFLPQRPEEAEHPRGAWGHHPASLWENGSRKCPLACVLHLGPRLPSFWKPCLTTGLPLLWESLLTLQLIIDLYVFCMSDTHDSTWTLWLHPEAIQPNRRTASTHYDFISAPTTQQQAPVTCPPPPLPPNCL

SEQ ID NO: 913123 - protein, 112 aa, Homo sapiens
RGLSLSEQQQRLFYTNPPTKLQTLFQKVIRYATFPIAPVNNTTITDWPFEISFQVFCMSDTHDSTWTLWLHPEAIQPNRRTASTHYDFISAPTTQQQAPVTCPPPPLPPNCL

SEQ ID NO: 913124 - protein, 174 aa, Homo sapiens
FNLDKWDSAIDLNLVLLLTQHSFSEPVLVLCVHLVHLRSCIYPAHAIDPALFASPVAASGHEKDRITGSQIHKPHQEDHPRNAWRLRSSLRLLHLETQDEDPAWGCQRFFACLTPMTPPGPYGSTQKQFSPTGGQLQPITISSLPQPLSSKHLLPVHPHPFPQTAFEKSLTYEL

SEQ ID NO: 913125 - protein, 165 aa, Homo sapiens; identical to SEQ ID NO: 913107

SEQ ID NO: 913126 - protein, 165 aa, Homo sapiens; identical to SEQ ID NO: 913107

SEQ ID NO: 913127 - protein, 117 aa, Homo sapiens
PLLSENKNGRLGRDGIVWICLKNMHKTTLPPNSISKSMEAESQECLQTQGLSMGGHGTKSHESDNKLEQKFWKAKEKTVTAHNKQKTFVLSVSIYHPNSQTWRKLLFLSTPTCMLFA

SEQ ID NO: 913128 - protein, 130 aa, Homo sapiens
PAPRSSGQSACGGRAHGPAGRAGSGRPGRGGATTSCEQRCAPGPPAPSSGFPCGKDVGGPCDLWRHGQICPPMGKGGREEEKHRAPEYLRTYRTAGAQDGLPLDTKKEPPGWLDAEERDTRPHDGRGHPH

SEQ ID NO: 913129 - protein, 165 aa, Homo sapiens; identical to SEQ ID NO: 913107

SEQ ID NO: 913130 - protein, 165 aa, Homo sapiens; identical to SEQ ID NO: 913107

SEQ ID NO: 913131 - protein, 165 aa, Homo sapiens; identical to SEQ ID NO: 913107

SEQ ID NO: 913132 - protein, 165 aa, Homo sapiens; identical to SEQ ID NO: 913107

SEQ ID NO: 913133 - protein, 126 aa, Homo sapiens
MDCGRVSLIWTVMRKDRITGSQIHKPHQEDHPRNAWRLRSSLRLLHLETQDEDPAWGCQRFFACLTPMTPPGPYGSTQKQFSPTGGQLQPITISSLPQPLSSKHLLPVHPHPFPQTAFEKSLTYEL

SEQ ID NO: 913134 - protein, 242 aa, Homo sapiens
RALETYQGLGHWSGGCWGASVGPSRSTPCSSLPCFVPRRLTCVDALSGWMQHRAAMLSGISLEGTGRMGRQAGSEVRGPILPLPPCCSLTDSEPVLVLCVHLVHLRSCIYPAHAIDPALFASPVAASGHEKDRITGSQIHKPHQEDHPRNAWRLRSSLRLLHLETQDEDPAWGCQRFFACLTPMTPPGPYGSTQKQFSPTGGQLQPITISSLPQPLSSKHLLPVHPHPFPQTAFEKSLTYEL

SEQ ID NO: 913135 - protein, 165 aa, Homo sapiens; identical to SEQ ID NO: 913107

SEQ ID NO: 913136 - protein, 165 aa, Homo sapiens; identical to SEQ ID NO: 913107

SEQ ID NO: 913137 - protein, 165 aa, Homo sapiens; identical to SEQ ID NO: 913107

SEQ ID NO: 913138 - protein, 165 aa, Homo sapiens; identical to SEQ ID NO: 913107

SEQ ID NO: 913139 - protein, 96 aa, Homo sapiens; identical to SEQ ID NO: 913120

SEQ ID NO: 913140 - protein, 127 aa, Homo sapiens
PAPRSSGQSACGGRAHGPAGRAGSGRPGRGGATTSCEQRCAPGPPAPSSGFPCGKDVGGPCDLWRHGQICPPMASPETKKMVRPGGGRAEEAWTLLLSPPSTYEGVWTVLEQDGLGFRNKRSQKLKT

SEQ ID NO: 913141 - protein, 103 aa, Homo sapiens; identical to SEQ ID NO: 913104

SEQ ID NO: 913142 - protein, 140 aa, Homo sapiens
RKLLHSCFREAGLQMGRSRSRSPRRERRRSRSTSRERERRRRERSRSRERDRRRSRSRSPHRRRSRSPRRHRSTSPSPSRLKERRDEEKKETKETKSKERQITEEDLEGKTEEEIEMMKLMGFASFDSTKKVDGSKCPYP

SEQ ID NO: 913143 - protein, 172 aa, Homo sapiens
RKLLHSCFREAGLQMGRSRSRSPRRERRRSRSTSRERERRRRERSRSRERDRRRSRSRSPHRRRSRSPRRHRSTSPSPSRLKERRDEEKKETKETKSKERQITEEDLEGKTEEEIEMMKLMGFASFDSTKGKKVDGSVNAYAINVSQKRKYRAVHESKRWIQQTLWISLHEN

SEQ ID NO: 913144 - protein, 172 aa, Homo sapiens; identical to SEQ ID NO: 913143

SEQ ID NO: 913145 - protein, 172 aa, Homo sapiens; identical to SEQ ID NO: 913143

SEQ ID NO: 913146 - protein, 172 aa, Homo sapiens; identical to SEQ ID NO: 913143

SEQ ID NO: 913147 - protein, 189 aa, Homo sapiens [sequence omitted]

SEQ ID NO: 913148 - protein, 189 aa, Homo sapiens [sequence omitted]

SEQ ID NO: 913149 - protein, 172 aa, Homo sapiens; identical to SEQ ID NO: 913143

SEQ ID NO: 913150 - protein, 189 aa, Homo sapiens [sequence omitted]

SEQ ID NO: 913151 - protein, 118 aa, Homo sapiens
RKLLHSCFREAGLQMGRSRSRSPRRERRRSRSTSRERERRRRERSRSRERDRRRSRSRSPHRRRSRSPRRHRSTSPSPSRLKERRDEEKKETKETKSKERQITEEDLEGKTEEEGEEY

SEQ ID NO: 913152 - protein, 152 aa, Homo sapiens
RKLLHSCFREAGLQMGRSRSRSPRRERRRSRSTSRERERRRRERSRSPRRHRSTSPSPSRLKERRDEEKKETKETKSKERQITEEDLEGKTEEEIEMMKLMGFASFDSTKGKKVDGSVNAYAINVSQKRKYRAVHESKRWIQQTLWISLHEN

SEQ ID NO: 913153 - protein, 172 aa, Homo sapiens; identical to SEQ ID NO: 913143

SEQ ID NO: 913154 - protein, 190 aa, Homo sapiens
RKLLHSCFREAGLQMGRSRSRSPRRERRRSRSTSRERERRRRERSRSRERDRRRSRSRSPHRRRSRSPRRHRSTSPSPSRLKERRDEEKKETKETKSKERQITEEDLEGKTEEEIEMMKLMGFASFDSTKGKKVDGSVNAYAINVSQKRKYRQYMNRKGGFNRPLDFIGMAVHESKRWIQQTLWISLHEN

SEQ ID NO: 913155 - protein, 150 aa, Homo sapiens
RKLLHSCFREAGLQMGRSRSRSPRRERRRSRSTSRERERRRRERSRSRERDRRRSRSRSPHRRRSRSPRRHRSTSPSPSRLKERRDEEKKETKETKSKERQITEEDLEGKTEEEIEMMKLMGFASFDSTKAVHESKRWIQQTLWISLHEN

SEQ ID NO: 913156 - protein, 381 aa, Homo sapiens
AELRILSPVGKRGWSPGLVKCDQPARGADFAGWSPEALSQSHKCRGGAFFGGPNEERGRSWPVKRRGWGRGDGESGINTPRRWRLLLCSGFCHCVGGAQLTGPLPLLSSVVAREAPSALLRGVHSGLHSGLHSGLHSGSGGGSEPVGSGGWSRGSGPRCRMAAAVRMNIQMLLEAADYLERREREAEHGYASMLPYNNKDRDALKRRNKSKKNNSSSRSTHNEMEKNRRAHLRLCLEKLKGLVPLGPESSRHTTLSLLTKAKLHIKKLEDCDRKAVHQIDQLQREQRHLKRQLEKLGIERIRMDSIGSTVSSERSDSDREEIDVDVESTDYLTGDLDWSSSSVSDSDERGSMQSLGSDEGYSSTSIKRIKLQDSHKACLGL

SEQ ID NO: 913157 - protein, 189 aa, Homo sapiens [sequence omitted]

SEQ ID NO: 913158 - protein, 175 aa, Homo sapiens
RKLLHSCFREAGLQMGRSRSRSPRRERRRSRSTSRERERRRRERSRSRERDRRRSRSRSPHRRRSRSPRRHRSTSPSPSRLKERRDEEKKETKETKSKERQITEEDLEGKTEEEIEMMKLMGFASFDSTKGKKVDGSVNAYAINVSQKRKYRVCIAPIIMFELINQFFTSNFIMR

SEQ ID NO: 913159 - protein, 109 aa, Homo sapiens
MKFISTSLLLMLLVSSLSPVQGVLEVYYTSLRCRCVQESSVFIPRRFIDRIQILPRGNGCPRKEIIVWKKNKSIVCVDPQAEWIQRMMEVLRKRSSSTLPVPVFKRKIP

SEQ ID NO: 913160 - protein, 109 aa, Homo sapiens; identical to SEQ ID NO: 913159

SEQ ID NO: 913161 - protein, 109 aa, Homo sapiens; identical to SEQ ID NO: 913159

SEQ ID NO: 913162 - protein, 444 aa, Homo sapiens
MSKKGRPQRQRREVHEDAHKQVSPILRRSPDITKSPLTKSEQLLRIDDHDFSMRPGFGGPAIPVGVDVQVESLDSISEVDMDFTMTLYLRHYWKDERLSFPSTNNLSMTFDGRLVKKIWVPDMFFVHSKRSFIHDTTTDNVMLRVQPDGKVLYSLRVTVTAMCNMDFSRFPLDTQTCSLEIESYAYTEDDLMLYWKKGNDSLKTDERISLSQFLIQEFHTTTKLAFYSSTGWYNRLYINFTLRRHIFFFLLQTYFPATLMVMLSWVSFWIDRRAVPARVPLGITTVLTMSTIITGVNASMPRVSYIKAVDIYLWVSFVFVFLSVLEYAAVNYLTTVQERKEQKLREKLPCTSGLPPPRTAMLDGNYSDGEVNDLDNYMPENGEKPDRMMVQLTLASERSSPQRKSQRSSYVSMRIDTHAIDKYSRIIFPAAYILFNLIYWSIFS

SEQ ID NO: 913163 - protein, 468 aa, Homo sapiens
MKAKAVASQNLTNLLSSVTGSISGWPKVKRPQRQRREVHEDAHKQVSPILRRSPDITKSPLTKSEQLLRIDDHDFSMRPGFGGPAIPVGVDVQVESLDSISEVDMDFTMTLYLRHYWKDERLSFPSTNNLSMTFDGRLVKKIWVPDMFFVHSKRSFIHDTTTDNVMLRVQPDGKVLYSLRVTVTAMCNMDFSRFPLDTQTCSLEIESYAYTEDDLMLYWKKGNDSLKTDERISLSQFLIQEFHTTTKLAFYSSTGWYNRLYINFTLRRHIFFFLLQTYFPATLMVMLSWVSFWIDRRAVPARVPLGITTVLTMSTIITGVNASMPRVSYIKAVDIYLWVSFVFVFLSVLEYAAVNYLTTVQERKEQKLREKLPCTSGLPPPRTAMLDGNYSDGEVNDLDNYMPENGEKPDRMMVQLTLASERSSPQRKSQRSSYVSMRIDTHAIDKYSRIIFPAAYILFNLIYWSIFS

SEQ ID NO: 913164 - protein, 462 aa, Homo sapiens
MLAVPNMRFGIFLLWWGWVLATESRMHWPGREVHEMSKKGSPILRRSPDITKSPLTKSEQLLRIDDHDFSMRPGFGGPAIPVGVDVQVESLDSISEVDMDFTMTLYLRHYWKDERLSFPSTNNLSMTFDGRLVKKIWVPDMFFVHSKRSFIHDTTTDNVMLRVQPDGKVLYSLRVTVTAMCNMDFSRFPLDTQTCSLEIESYAYTEDDLMLYWKKGNDSLKTDERISLSQFLIQEFHTTTKLAFYSSTGWYNRLYINFTLRRHIFFFLLQTYFPATLMVMLSWVSFWIDRRAVPARVPLGITTVLTMSTIITGVNASMPRVSYIKAVDIYLWVSFVFVFLSVLEYAAVNYLTTVQERKEQKLREKLPCTSGLPPPRTAMLDGNYSDGEVNDLDNYMPENGEKPDRMMVQLTLASERSSPQRKSQRSSYVSMRIDTHAIDKYSRIIFPAAYILFNLIYWSIFS

SEQ ID NO: 913165 - protein, 415 aa, Homo sapiens
MSKKGRPQRQRREVHEDAHKQVSPILRRSPDITKSPLTKSEQLLRIDDHDFSMRPGFGGPAIPVGVDVQVESLDSISEVDMDFTMTLYLRHYWKDERLSFPSTNNLSMTFDGRLVKKIWVPDMFFVHSKRSFIHDTTTDNVMLRVQPDGKVLYSLRVTVTAMCNMDFSRFPLDTQTCSLEIESYAYTEDDLMLYWKKGNDSLKTDERISLSQFLIQEFHTTTKLAFYSSTGWYNRLYINFTLRRHIFFFLLQTYFPATLMVMLSWVSFWIDRRAVPARVPLGITTVLTMSTIITGVNASMPRVSYIKAVDIYLWVSFVFVFLSVLEYAAVNYLTTVQERKEQKLREKLPCTSGLPPPRTAMLDGNYSDGEVNDLDNYMPENGEKPDRMMVQLTLASERSSPQRKSQRSSYVSMRI

SEQ ID NO: 913166 - protein, 410 aa, Homo sapiens
ARGLIRPSSAAGDRSSEMAGFGAMEKFLVEYKSAVEKKLAEYKCNTNTAIELKFETAFGYKGLKILLYYIAGSLSTMFRVEYASKVDENFDCVEADDVEGKIRQIIPPGFCTNTNDFLSLLEKEVDFKPFGTLLHTYSVLSPTGGENFTFQIYKADMTCRGFREYHERLQTFLMWFIETASFIDVDDERWHYFLVFEKYNKDGATLFATVGYMTVYNYYVYPDKTRPRVSQMLILTPFQGQGHGAQLLETVHRYYTEFPTVLDITAEDPSKSYVKLRDFVLVKLCQDLPCFSREKLMQGFNEDMAIEAQQKFKINKQHARRVYEILRLLVTDMSDAEQYRSYRLDIKRRLISPYKKKQRDLAKMRKCLRPEELTNQMNQIEISMQHEQLEESFQELVEDYRRVIERLAQE

SEQ ID NO: 913167 - protein, 378 aa, Homo sapiens
TRGSTHASAFFPEYTHQLFGDDETAFGYKGLKILLYYIAGSLSTMFRVEYASKVDENFDCVEADDVEGKIRQIIPPGFCTNTNDFLSLLEKEVDFKPFGTLLHTYSVLSPTGGENFTFQIYKADMTCRGFREYHERLQTFLMWFIETASFIDVDDERWHYFLVFEKYNKDGATLFATVGYMTVYNYYVYPDKTRPRVSQMLILTPFQGQGHGAQLLETVHRYYTEFPTVLDITAEDPSKSYVKLRDFVLVKLCQDLPCFSREKLMQGFNEDMAIEAQQKFKINKQHARRVYEILRLLVTDMSDAEQYRSYRLDIKRRLISPYKKKQRDLAKMRKCLRPEELTNQMNQIEISMQHEQLEESFQELVEDYRRVIERLAQE

SEQ ID NO: 913168 - protein, 272 aa, Homo sapiens
RAHISRGEYLDFEIYKADMTCRGFREYHERLQTFLMWFIETASFIDVDDERWHYFLVFEKYNKDGATLFATVGYMTVYNYYVYPDKTRPRVSQMLILTPFQGQGHGAQLLETVHRYYTEFPTVLDITAEDPSKSYVKLRDFVLVKLCQDLPCFSREKLMQGFNEDMAIEAQQKFKINKQHARRVYEILRLLVTDMSDAEQYRSYRLDIKRRLISPYKKKQRDLAKMRKCLRPEELTNQMNQIEISMQHEQLEESFQELVEDYRRVIERLAQE

SEQ ID NO: 913169 - protein, 284 aa, Homo sapiens
NSEAETLYPFTIYYRPDTAHCYDAPSPSNYSLQQAFSNPSLRLLASTLNTCLRFIDAGLMKRWHYLSELFEKYNKDGATLFATVGYMTVYNYYVYPDKTRPRVSQMLILTPFQGQGHGAQLLETVHRYYTEFPTVLDITAEDPSKSYVKLRDFVLVKLCQDLPCFSREKLMQGFNEDMAIEAQQKFKINKQHARRVYEILRLLVTDMSDAEQYRSYRLDIKRRLISPYKKKQRDLAKMRKCLRPEELTNQMNQIEISMQHEQLEESFQELVEDYRRVIERLAQE

SEQ ID NO: 913170 - protein, 419 aa, Homo sapiens
ARGLIRPSSAAGDRSSEMAGFGAMEKFLVEYKSAVEKKLAEYKCNTNTAIELKLVRFPEDLENDIRTFFPEYTHQLFGDDETAFGYKGLKILLYYIAGSLSTMFRVEYASKVDENFDCVEADDVEGKIRQIIPPGFCTNTNDFLSLLEKEVDFKPFGTLLHTYSVLSPTGGENFTFQIYKADMTCRGFREYHERLQTFLMWFIETASFIDVDDERWHYFLVFEKYNKDGATLFATVGYMTVYNYYVYPDKGHGAQLLETVHRYYTEFPTVLDITAEDPSKSYVKLRDFVLVKLCQDLPCFSREKLMQGFNEDMAIEAQQKFKINKQHARRVYEILRLLVTDMSDAEQYRSYRLDIKRRLISPYKKKQRDLAKMRKCLRPEELTNQMNQIEISMQHEQLEESFQELVEDYRRVIERLAQE

SEQ ID NO: 913171 - protein, 116 aa, Homo sapiens
ARGLIRPSSAAGDRSSEMAGFGAMEKFLVEYKSAVEKKLAEYKCNTNTAIELKLQMMLRAKLDKSFHLDFAQTRMISFLYWKRKLISSHSEPYFIPTQFSVQQEEKTLPFRYIRLT

SEQ ID NO: 913172 - protein, 362 aa, Homo sapiens
ARGLIRPSSAAGDRSSEMAGFGAMEKFLVEYKSAVEKKLAEYKCNTNTAIELKLVRFPEDLENDIRTFFPEYTHQLFGDDETAFGYKGLKILLYYIAGSLSTMFRVEYASKVDENFDCVEADDVEGKIRQIIPPGFCTNTNDFLSLLEKEVDFKPFGTLLHTYSVLSPTGGENFTFQIYKADMTCRGFREYHERLQTFLMWFIETASFIDVDDERWHYFLVFEKYNKDGATLFATVGYMTVYNYYVYPDKTRPRVSQMLILTPFQGQGHGAQLLETVHRYYTEFPTVLDITAEDPSKSYVKLRDFVLVKLCQDLPCFSREKLMQGFNEDMAIEAQQKFKINKQHARRVYEILRLLLRQSGPG

SEQ ID NO: 913173 - protein, 436 aa, Homo sapiens
ARGLIRPSSAAGDRSSEMAGFGAMEKFLVEYKSAVEKKLAEYKCNTNTAIELKLVRFPEDLENDIRTFFPEYTHQLFGDDETAFGYKGLKILLYYIAGSLSTMFRVEYASKVDENFDCVEADDVEGKIRQIIPPGFCTNTNDFLSLLEKEVDFKPFGTLLHTYSVLSPTGGENFTFQIYKADMTCRGFREYHERLQTFLMWFIETASFIDVDDERWHYFLVFEKYNKDGATLFATVGYMTVYNYYVYPDKTRPRVSQMLILTPFQGQGHGAQLLETVHRYYTEFPTVLDITAEDPSKSYVKLRDFVLVKLCQDLPCFSREKLMQGFNEDMAIEAQQKFKINKQHARRVYEILRLLVTDMSDAEQYRSYRLDIKRRLISPYKKKQRDLAKMRKCLRPEELTNQMNQIEISMQHEQLEESFQELVEDYRRVIERLAQE

SEQ ID NO: 913174 - protein, 436 aa, Homo sapiens; identical to SEQ ID NO: 913173

SEQ ID NO: 913175 - protein, 418 aa, Homo sapiens
ARGLIRPSSAAGDRSSEMAGFGAMEKFLVEYKSAVEKKLAEYKCNTNTAIELKLVRFPEDLENDIRTFFPEYTHQLFGDDETAFGYKGLKILLYYIAGSLSTMFRVEYASKVDENFDCVEADDVEGKIRQIIPPGFCTNTNDFLSLLEKEVDFKPFGTLLHTYSVLSPTGGEYHERLQTFLMWFIETASFIDVDDERWHYFLVFEKYNKDGATLFATVGYMTVYNYYVYPDKTRPRVSQMLILTPFQGQGHGAQLLETVHRYYTEFPTVLDITAEDPSKSYVKLRDFVLVKLCQDLPCFSREKLMQGFNEDMAIEAQQKFKINKQHARRVYEILRLLVTDMSDAEQYRSYRLDIKRRLISPYKKKQRDLAKMRKCLRPEELTNQMNQIEISMQHEQLEESFQELVEDYRRVIERLAQE

SEQ ID NO: 913176 - protein, 238 aa, Homo sapiens
VGGILFASQDLDVDDERWHYFLVFEKYNKDGATLFATVGYMTVYNYYVYPDKTRPRVSQMLILTPFQGQGHGAQLLETVHRYYTEFPTVLDITAEDPSKSYVKLRDFVLVKLCQDLPCFSREKLMQGFNEDMAIEAQQKFKINKQHARRVYEILRLLVTDMSDAEQYRSYRLDIKRRLISPYKKKQRDLAKMRKCLRPEELTNQMNQIEISMQHEQLEESFQELVEDYRRVIERLAQE

SEQ ID NO: 913177 - protein, 114 aa, Homo sapiens
MQGFNEDMAIEAQQKFKINKQHARRVYEILRLLVTDMSDAEQYRSYRLDIKRRLISPYKKKQRDLAKMRKCLRPEELTNQMNQIEISMQHEQLEESFQELVEDYRRVIERLAQE

SEQ ID NO: 913178 - protein, 212 aa, Homo sapiens
VGAMALAGAMALVGAMALVGAMALVGAMALAGAMALVGAMALVGAMALTLKEESKSGSEFPTVLNITAEDPSKSYVKLRDFVLVKLCQDLPCFSREKLMQGFNEDMAIEAQQKFKINKQHARRVYEILRLLVTDMSDAEQYRSYRLDIKRRLISPYKKKQRDLAKMRKCLRPEELTNQMNQIEISMQHEQLEESFQELVEDYRRVIERLAQE

SEQ ID NO: 913179 - protein, 461 aa, Homo sapiens
MYNTVWSMDRDDADWREVMMPYSTELIFYIEMDPPALPPKPPKPMTSAVPNGMKDSSVSLQDAEWYWGDISREEVNDKLRDMPDGTFLVRDASTKMQGDYTLTLRKGGNNKLIKIYHRDGKYGFSDPLTFNSVVELINHYHHESLAQYNPKLDVKLMYPVSRYQQDQLVKEDNIDAVGKKLQEYHSQYQEKSKEYDRLYEEYTRTSQEIQMKRTAIEAFNETIKIFEEQCHTQEQHSKEYIERFRREGNEKEIERIMMNYDKLKSRLGEIHDSKMRLEQDLKKQALDNREIDKKMNSIKPDLIQLRKIRDQHLVWLNHKGVRQKRLNVWLGIKNEDADENYFINEEDENLPHYDEKTWFVEDINRVQAEDLLYGKPDGAFLIRESSKKGCYACSVVADGEVKHCVIYSTARGYGFAEPYNLYSSLKELVLHYQQTSLVQHNDSLNVRLAYPVHAQMPSLCR

SEQ ID NO: 913180 - protein, 402 aa, Homo sapiens
MYNTVWSMDRDDADWREVMMPYSTELIFYIEMDPPALPPKPPKPMTSAVPNGMKDSSVSLQDAEWYWGDISREEVNDKLRDMPDGTFLVRDASTKMQGDYTLTLRKGGNNKLIKIYHRDGKYGFSDPLTFNSVVELINHYHHESLAQYNPKLDVKLMYPVSRYQQDQLVKEDNIDAVGKKLQEYHSQYQEKSKEYDRLYEEYTRTSQEIQMKRTAIEAFNETIKIFEEQCHTQEQHSKEYIERFRREGNEKEIERWLNHKGVRQKRLNVWLGIKNEDADENYFINEEDENLPHYDEKTWFVEDINRVQAEDLLYGKPDGAFLIRESSKKGCYACSVVADGEVKHCVIYSTARGYGFAEPYNLYSSLKELVLHYQQTSLVQHNDSLNVRLAYPVHAQMPSLCR

SEQ ID NO: 913181 - protein, 461 aa, Homo sapiens; identical to SEQ ID NO: 913179

SEQ ID NO: 913182 - protein, 417 aa, Homo sapiens
MTSAVPNGMKDSSVSLQDAEWYWGDISREEVNDKLRDMPDGTFLVRDASTKMQGDYTLTLRKGGNNKLIKIYHRDGKYGFSDPLTFNSVVELINHYHHESLAQYNPKLDVKLMYPVSRYQQDQLVKEDNIDAVGKKLQEYHSQYQEKSKEYDRLYEEYTRTSQEIQMKRTAIEAFNETIKIFEEQCHTQEQHSKEYIERFRREGNEKEIERIMMNYDKLKSRLGEIHDSKMRLEQDLKKQALDNREIDKKMNSIKPDLIQLRKIRDQHLVWLNHKGVRQKRLNVWLGIKNEDADENYFINEEDENLPHYDEKTWFVEDINRVQAEDLLYGKPDGAFLIRESSKKGCYACSVVADGEVKHCVIYSTARGYGFAEPYNLYSSLKELVLHYQQTSLVQHNDSLNVRLAYPVHAQMPSLCR

SEQ ID NO: 913183 - protein, 899 aa, Homo sapiens
MESCYNPGLDGIIEYDDFKLNSSIVEPKEPAPETADGPYLVIVEQPKQRGFRFRYGCEGPSHGGLPGASSEKGRKTYPTVKICNYEGPAKIEVDLVTHSDPPRAHAHSLVGKQCSELGICAVSVGPKDMTAQFNNLGVLHVTKKNMMGTMIQKLQRQRLRSRPQGLTEAEQRELEQEAKELKKVMDLSIVRLRFSAFLRASDGSFSLPLKPVISQPIHDSKSPGASNLKISRMDKTAGSVRGGDEVYLLCDKVQKDDIEVRFYEDDENGWQAFGDFSPTDVHKQYAIVFRTPPYHKMKIERPVTVFLQLKRKRGGDVSDSKQFTYYPLVEDKEEVQRKRRKALPTFSQPFGGGSHMGGGSGGAAGGYGGAGGGGSLGFFPSSLAYSPYQSGAGPMGCYPGGGGGAQMAATVPSRDSGEEAAEPSAPSRTPQCEPQAPEMLQRAREYNARLFGLAQRSARALLDYGVTADARALLAGQRHLLTAQDENGDTPLHLAIIHGQTSVIEQIVYVIHHAQDLGVVNLTNHLHQTPLHLAVITGQTSVVSFLLRVGADPALLDRHGDSAMHLALRAGAGAPELLRALLQSGAPAVPQLLHMPDFEGLYPVHLAVRARSPECLDLLVDSGAEVEATERQGGRTALHLATEMEELGLVTHLVTKLRANVNARTFAGNTPLHLAAGLGYPTLTRLLLKAGADIHAENEEPLCPLPSPPTSDSDSDSEGPEKDTRSSFRGHTPLDLTCSTKVKTLLLNAAQNTMEPPLTPPSPAGPGLSLGDTALQNLEQLLDGPEAQGSWAELAERLGLRSLVDTYRQTTSPSGSLLRSYELAGGDLAGLLEALSDMGLEEGVRLLRGPETRDKLPSTEVKEDSAYGSQSVEQEAEKLGPPPEPPGGLCHGHPQPQVH

SEQ ID NO: 913184 - protein, 403 aa, Homo sapiens
MESCYNPGLDGIIEYDDFKLNSSIVEPKEPAPETADGPYLVIVEQPKQRGFRFRYGCEGPSHGGLPGASSEKGRKTYPTVKICNYEGPAKIEVDLVTHSDPPRAHAHSLVGKQCSELGICAVSVGPKDMTAQFNNLGVLHVTKKNMMGTMIQKLQRQRLRSRPQGLTEAEQRELEQEAKELKKVMDLSIVRLRFSAFLRASDGSFSLPLKPVISQPIHDSKSPGASNLKISRMDKTAGSVRGGDEVYLLCDKVQKDDIEVRFYEDDENGWQAFGDFSPTDVHKQYAIVFRTPPYHKMKIERPVTVFLQLKRKRGGDVSDSKQFTYYPLVEDKEEVQRKRRKALPTFSQPFGGGSHMGGGSGGAAGGYGGAGGGEGVLMEGGVKVREAVEEKNLGEAGRGGSRL

SEQ ID NO: 913185 - protein, 899 aa, Homo sapiens; identical to SEQ ID NO: 913183

SEQ ID NO: 913186 - protein, 669 aa, Homo sapiens [sequence omitted]

SEQ ID NO: 913187 - protein, 928 aa, Homo sapiens
MESCYNPGLDGIIEYDDFKLNSSIVEPKEPAPETADGPYLVIVEQPKQRGFRFRYGCEGPSHGGLPGASSEKGRKTYPTVKICNYEGPAKIEVDLVTHSDPPRAHAHSLVGKQCSELGICAVSVGPKDMTAQFNNLGVLHVTKKNMMGTMIQKLQRQRLRSRPQGLTEAEQRELEQEAKELKKVMDLSIVRLRFSAFLRASDGSFSLPLKPVISQPIHDSKSPGASNLKISRMDKTAGSVRGGDEVYLLCDKVQKDDIEVRFYEDDENGWQAFGDFSPTDVHKQVPRARARARAGGKIRLRTHCHPVSPCTPQYAIVFRTPPYHKMKIERPVTVFLQLKRKRGGDVSDSKQFTYYPLVEDKEEVQRKRRKALPTFSQPFGGGSHMGGGSGGAAGGYGGAGGGGSLGFFPSSLAYSPYQSGAGPMGCYPGGGGGAQMAATVPSRDSGEEAAEPSAPSRTPQCEPQAPEMLQRAREYNARLFGLAQRSARALLDYGVTADARALLAGQRHLLTAQDENGDTPLHLAIIHGQTSVIEQIVYVIHHAQDLGVVNLTNHLHQTPLHLAVITGQTSVVSFLLRVGADPALLDRHGDSAMHLALRAGAGAPELLRALLQSGAPAVPQLLHMPDFEGLYPVHLAVRARSPECLDLLVDSGAEVEATERQGGRTALHLATEMEELGLVTHLVTKLRANVNARTFAGNTPLHLAAGLGYPTLTRLLLKAGADIHAENEEPLCPLPSPPTSDSDSDSEGPEKDTRSSFRGHTPLDLTCSTKVKTLLLNAAQNTMEPPLTPPSPAGPGLSLGDTALQNLEQLLDGPEAQGSWAELAERLGLRSLVDTYRQTTSPSGSLLRSYELAGGDLAGLLEALSDMGLEEGVRLLRGPETRDKLPSTEVKEDSAYGSQSVEQEAEKLGPPPEPPGGLCHGHPQPQVH

SEQ ID NO: 913188 - protein, 507 aa, Homo sapiens
MESCYNPGLDGIIEYDDFKLNSSIVEPKEPAPETADGPYLVIVEQPKQRGFRFRYGCEGPSHGGLPGASSEKGRKTYPTVKICNYEGPAKIEVDLVTHSDPPRAHAHSLVGKQCSELGICAVSVGPKDMTAQFNNLGVLHVTKKNMMGTMIQKLQRQRLRSRPQGLTEAEQRELEQEAKELKKVMDLSIVRLRFSAFLRASDGSFSLPLKPVISQPIHDSKSPGASNLKISRMDKTAGSVRGGDEVYLLCDKVQKDDIEVRFYEDDENGWQAFGDFSPTDVHKQYAIVFRTPPYHKMKIERPVTVFLQLKRKRGGDVSDSKQFTYYPLVEDKEEVQRKRRKALPTFSQPFGGGSHMGGGSGGAAGGYGGAGGGGSLGFFPSSLAYSPYQSGAGPMGCYPGGGGGAQMAATVPSRDSGEEAAEPSAPSRTPQCEPQAPEMLQRAREYNARLFGLAQRSARALLDYGVTADARALLAGQRHLLTAQDENGDTWLAGTWQVYWRPCLTWA

SEQ ID NO: 913189 - protein, 368 aa, Homo sapiens
MESCYNPGLDGIIEYDDFKLNSSIVEPKEPAPETADGPYLVIVEQPKQRGFRFRYGCEGPSHGGLPGASSEKGRKTYPTVKICNYEGPAKIEVDLVTHSDPPRAHAHSLVGKQCSELGICAVSVGPKDMTAQFNNLGVLHVTKKNMMGTMIQKLQRQRLRSRPQGLTEAEQRELEQEAKELKKVMDLSIVRLRFSAFLRASDGSFSLPLKPVISQPIHDSKSPGASNLKISRMDKTAGSVRGGDEVYLLCDKVQKDDIEVRFYEDDENGWQAFGDFSPTDVHKQYAIVFRTPPYHKMKIERPVTVFLQLKRKRGGDVSDSKQFTYYPLVEDKEEVQRKRRKALPTFSQPFGGGSRTPCTASPPISNLI

SEQ ID NO: 913190 - protein, 899 aa, Homo sapiens; identical to SEQ ID NO: 913183

SEQ ID NO: 913191 - protein, 75 aa, Homo sapiens
VVDGGGFKIGPHIVPADIIKQMQRGPETRDKLPSTEVKEDSAYGSQSVEQEAEKLGPPPEPPGGLCHGHPQPQVH

SEQ ID NO: 913192 - protein, 837 aa, Homo sapiens
MTGRGSLVIMALDLTTQIKICNYEGPAKIEVDLVTHSDPPRAHAHSLVGKQCSELGICAVSVGPKDMTAQFNNLGVLHVTKKNMMGTMIQKLQRQRLRSRPQGLTEAEQRELEQEAKELKKVMDLSIVRLRFSAFLRASDGSFSLPLKPVISQPIHDSKSPGASNLKISRMDKTAGSVRGGDEVYLLCDKVQKDDIEVRFYEDDENGWQAFGDFSPTDVHKQYAIVFRTPPYHKMKIERPVTVFLQLKRKRGGDVSDSKQFTYYPLVEDKEEVQRKRRKALPTFSQPFGGGSHMGGGSGGAAGGYGGAGGGGSLGFFPSSLAYSPYQSGAGPMGCYPGGGGGAQMAATVPSRDSGEEAAEPSAPSRTPQCEPQAPEMLQRAREYNARLFGLAQRSARALLDYGVTADARALLAGQRHLLTAQDENGDTPLHLAIIHGQTSVIEQIVYVIHHAQDLGVVNLTNHLHQTPLHLAVITGQTSVVSFLLRVGADPALLDRHGDSAMHLALRAGAGAPELLRALLQSGAPAVPQLLHMPDFEGLYPVHLAVRARSPECLDLLVDSGAEVEATERQGGRTALHLATEMEELGLVTHLVTKLRANVNARTFAGNTPLHLAAGLGYPTLTRLLLKAGADIHAENEEPLCPLPSPPTSDSDSDSEGPEKDTRSSFRGHTPLDLTCSTKVKTLLLNAAQNTMEPPLTPPSPAGPGLSLGDTALQNLEQLLDGPEAQGSWAELAERLGLRSLVDTYRQTTSPSGSLLRSYELAGGDLAGLLEALSDMGLEEGVRLLRGPETRDKLPSTEVKEDSAYGSQSVEQEAEKLGPPPEPPGGLCHGHPQPQVH

SEQ ID NO: 913193 - protein, 613 aa, Homo sapiens
MESCYNPGLDGIIEYDDFKLNSSIVEPKEPAPETADGPYLVIVEQPKQRGFRFRYGCEGPSHGGLPGASSEKGRKTYPTVKICNYEGPAKIEVDLVTHSDPPRAHAHSLVGKQCSELGICAVSVGPKDMTAQFNNLGVLHVTKKNMMGTMIQKLQRQRLRSRPQGLTEAEQRELEQEAKELKKVMDLSIVRLRFSAFLRASDGSFSLPLKPVISQPIHDSKSPGASNLKISRMDKTAGSVRGGDEVYLLCDKVQKDDIEVRFYEDDENGWQAFGDFSPTDVHKQYAIVFRTPPYHKMKIERPVTVFLQLKRKRGGDVSDSKQFTYYPLVEDKEEVQRKRRKALPTFSQPFGGGSHMGGGSGGAAGGYGGAGGGGSLGFFPSSLAYSPYQSGAGPMGCYPGGGGGAQMAATVPSRDSGEEAAEPSAPSRTPQCEPQAPEMLQRAREYNARLFGLAQRSARALLDYGVTADARALLAGQRHLLTAQDENGDTPLHLAIIHGQTSVIEQIVYVIHHAQDLGVVNLTNHLHQTPLHLAVITGQTSVVSFLLRVGADPALLDRHGDSAMHLALRAGAGAPELLRALLQSGAPAVPQLLHMPDFEGLYPVHLAVRPQVH

SEQ ID NO: 913194 - protein, 201 aa, Homo sapiens
MGEAEKFHYIYSCDLDINVQLKIGSLEGKREQKSYKAVLEDPMLKFSGLYQETCSDLYVTCQVFAEGKPLALPVRTSYKAFSTRWNWNEWLKLPVKYPDLPRNAQVALTIWDVYGPGKAVPVGGTTVSLFGKYGMFRQGMHDLKVWPNVEADGSEPTKTPGRTSSTLSEDQMSRLAKVKKVIWNRCKALTDVYCSIYTLTL

SEQ ID NO: 913195 - protein, 887 aa, Homo sapiens
MGEAEKFHYIYSCDLDINVQLKIGSLEGKREQKSYKAVLEDPMLKFSGLYQETCSDLYVTCQVFAEGKPLALPVRTSYKAFSTRWNWNEWLKLPVKYPDLPRNAQVALTIWDVYGPGKAVPVGGTTVSLFGKYGMFRQGMHDLKVWPNVEADGSEPTKTPGRTSSTLSEDQMSRLAKLTKAHRQGHMVKVDWLDRLTFREIEMINESEKRSSNFMYLMVEFRCVKCDDKEYGIVYYEKDGDESSPILTSFELVKVPDPQMSMENLVESKHHKLARSLRSGPSDHDLKPNAATRDQLNIIVSYPPTKQLTYEEQDLVWKFRYYLTNQEKALTKFLKCVNWDLPQEAKQALELLGKWKPMDVEDSLELLSSHYTNPTVRRYAVARLRQADDEDLLMYLLQLVQALKYENFDDIKNGLEPTKKDSQSSVSENVSNSGINSAEIDSSQIITSPLPSVSSPPPASKTKEVPDGENLEQDLCTFLISRACKNSTLANYLYWYVIVECEDQDTQQRDPKTHEMYLNVMRRFSQALLKGDKSVRVMRSLLAAQQTFVDRLVHLMKAVQRESGNRKKKNERLQALLGDNEKMNLSDVELIPLPLEPQVKIRGIIPETATLFKSALMPAQLFFKTEDGGKYPVIFKHGDDLRQDQLILQIISLMDKLLRKENLDLKLTPYKVLATSTKHGFMQFIQSVPVAEVLDTEGSIQNFFRKYAPSENGPNGISAEVMDTYVKSCAGYCVITYILGVGDRHLDNLLLTKTGKLFHIDFGYILGRDPKPLPPPMKLNKEMVEGMGGTQSEQYQEFRKQCYTAFLHLRRYSNLILNLFSLMVDANIPDIALEPDKTVKKVQDKFRLDLSDEEAVHYMQSLIDESVHALFAAVVEQIHKFAQYWRK

SEQ ID NO: 913196 - protein, 372 aa, Homo sapiens
MYLNVMRRFSQALLKGDKSVRVMRSLLAAQQTFVDRLVHLMKAVQRESGNRKKKNERLQALLGDNEKMNLSDVELIPLPLEPQVKIRGIIPETATLFKSALMPAQLFFKTEDGGKYPVIFKHGDDLRQDQLILQIISLMDKLLRKENLDLKLTPYKVLATSTKHGFMQFIQSVPVAEVLDTEGSIQNFFRKYAPSENGPNGISAEVMDTYVKSCAGYCVITYILGVGDRHLDNLLLTKTGKLFHIDFGYILGRDPKPLPPPMKLNKEMVEGMGGTQSEQYQEFRKQCYTAFLHLRRYSNLILNLFSLMVDANIPDIALEPDKTVKKVQDKFRLDLSDEEAVHYMQSLIDESVHALFAAVVEQIHKFAQYWRK

SEQ ID NO: 913197 - protein, 372 aa, Homo sapiens; identical to SEQ ID NO: 913196

SEQ ID NO: 913198 - protein, 508 aa, Homo sapiens
MGEAEKFHYIYSCDLDINVQLKIGSLEGKREQKSYKAVLEDPMLKFSGLYQETCSDLYVTCQVFAEGKPLALPVRTSYKAFSTRWNWNEWLKLPVKYPDLPRNAQVALTIWDVYGPGKAVPVGGTTVSLFGKYGMFRQGMHDLKVWPNVEADGSEPTKTPGRTSSTLSEDQMSRLAKLTKAHRQGHMVKVDWLDRLTFREIEMINESEKRSSNFMYLMVEFRCVKCDDKEYGIVYYEKDGDESSPILTSFELVKVPDPQMSMENLVESKHHKLARSLRSGPSDHDLKPNAATRDQLNIIVSYPPTKQLTYEEQDLVWKFRYYLTNQEKALTKFLKCVNWDLPQEAKQALELLGKWKPMDVEDSLELLSSHYTNPTVRRYAVARLRQADDEDLLMYLLQLVQALKYENFDDIKNGLEPTKKDSQSSVSENVSNSGINSAEIDSSQIITSPLPSVSSPPPASKTKEVPDGENLEQDLCTFLISRACKNSTLANYLYWYVKIIFCLFSYYP

SEQ ID NO: 913199 - protein, 887 aa, Homo sapiens; identical to SEQ ID NO: 913195

SEQ ID NO: 913200 - protein, 166 aa, Homo sapiens
RGLLGVRGRKGSLEGKREQKSYKAVLEDPMLKFSGLYQETCSDLYVTCQVFAEGKPLALPVRTSYKAFSTRWNWNEWLKLPVKYPDLPRNAQVALTIWDVYGPGKAVPVGGTTVSLFGKYGMFRQGMHDLKVWPNVEADGSEPTKTPGRTSSTLSEDQMSRLAKEH

SEQ ID NO: 913201 - protein, 757 aa, Homo sapiens
MGEAEKFHYIYSCDLDINVQLKIGSLEGKREQKSYKAVLEDPMLKFSGLYQETCSDLYVTCQVFAEGKPLALPVRTSYKAFSTRWNWNEWLKLPVKYPDLPRNAQVALTIWDVYGPGKAVPVGGTTVSLFGKYGMFRQGMHDLKVWPNVEADGSEPTKTPGRTSSTLSEDQMSRLAKLTKAHRQGHMVKVDWLDRLTFREIEMINESEKRSSNFMYLMVEFRCVKCDDKEYGIVYYEKDGDESSPILTSFELVKVPDPQMSMENLVESKHHKLARSLRSGPSDHDLKPNAATRDQLNIIVSYPPTKQLTYEEQDLVWKFRYYLTNQEKALTKFLKCVNWDLPQEAKQALELLGKWKPMDVEDSLELLSSHYTNPTVRRYAVARLRQADDEDLLMYLLQLVQALKYENFDDIKNGLEPTKKDSQSSVSENVSNSGINSAEIDSSQIITSPLPSVSSPPPASKTKEVPDGENLEQDLCTFLISRACKNSTLANYLYWYVIVECEDQDTQQRDPKTHEMYLNVMRRFSQALLKGDKSVRVMRSLLAAQQTFVDRLVHLMKAVQRESGNRKKKNERLQALLGDNEKMNLSDVELIPLPLEPQVKIRGIIPETATLFKSALMPAQLFFKTEDGGKYPVIFKHGDDLRQDQLILQIISLMDKLLRKENLDLKLTPYKVLATSTKHGFMQFIQSVPVAEVLDTEGSIQNFFRKYAPSENGPNGISAEVMDTYVKSCAGYCVITYILGVGDRHLDNLLLTKTGNN

SEQ ID NO: 913202 - protein, 756 aa, Homo sapiens
MGEAEKFHYIYSCDLDINVQLKIGSLEGKREQKSYKAVLEDPMLKFSGLYQETCSDLYVTCQVFAEGKPLALPVRTSYKAFSTRWNWNEWLKLPVKYPDLPRNAQVALTIWDVYGPGKAVPVGGTTVSLFGKYGMFRQGMHDLKVWPNVEADGSEPTKTPGRTSSTLSEDQMSRLAKLTKAHRQGHMVKVDWLDRLTFREIEMINESEKRSSNFMYLMVEFRCVKCDDKEYGIVYYEKDGDESSPILTSFELVKVPDPQMSMENLVESKHHKLARSLRSGPSDHDLKPNAATRDQLNIIVSYPPTKQLTYEEQDLVWKFRYYLTNQEKALTKFLKCVNWDLPQEAKQALELLGKWKPMDVEDSLELLSSHYTNPTVRRYAVARLRQADDEDLLMYLLQLVQALKYENFDDIKNGLEPTKKDSQSSVSENVSNSGINSAEIDSSQIITSPLPSVSSPPPASKTKEVPDGENLEQDLCTFLISRACKNSTLANYLYWYVIVECEDQDTQQRDPKTHEMYLNVMRRFSQALLKGDKSVRVMRSLLAAQQTFVDRLVHLMKAVQRESGNRKKKNERLQALLGDNEKMNLSDVELIPLPLEPQVKIRGIIPETATLFKSALMPAQLFFKTEDGGKYPVIFKHGDDLRQDQLILQIISLMDKLLRKENLDLKLTPYKVLATSTKHGFMQFIQSVPVAEVLDTEGSIQNFFRKYAPSENGPNGISAEVMDTYVKSCAGYCVITYILGVGDRHLDNLLLTKTGG

SEQ ID NO: 913203 - protein, 768 aa, Homo sapiens
MKKQFNRMRQLANQTVGRAEKTEVLSEDLLQVEKRLELVKQVSHSTHKKLTACLQGQQGAEADKRSKKLPLTTLAQCLMEGSAILGDDTLLGKMLKLCGETEDKLAQELIHFELQVERDVIEPLFLLAEVEIPNIQKQRKHLAKLVLDMDSSRTRWQQTSKSSGLSSSLQPAGAKADALREEMEEAANRVEICRDQLSADMYSFVAKEIDYANYFQTLIEVQAEYHRKSLTLLQAVLPQIKAQQEAWVEKPSFGKPLEEHLTISGREIAFPIEACVTMLLECGMQEEGLFRVAPSASKLKKLKAALDCCVVDVQEYSADPHAIAGALKSYLRELPEPLMTFELYDEWIQASNVQEQDKKLQALWNACEKLPKANHNNIRYLIKFLSKLSEYQDVNKMTPSNMAIVLGPNLLWPQAEGNITEMMTTVSLQIVGIIEPIIQHADWFFPGEIEFNITGNYGSPVHVNHNANYSSMPSPDMDPADRRQPEQARRPLSVATDNMMLEFYKKDGMGVRVMDTNWVARRGSSAGRKVSCAPPSMQPPAPPAELAAPLPSPLPEQPLDSPAAPALSPSGLGLQPGPERTSTTKSKELSPGSAQKGSPGSSQGTACAGTQPGAQPGAQPGASPSPSQPPADQSPHTLRKVSKKLAPIPPKVPFGQPGAMADQSAGQPSPVSLSPTPPSTPSPYGLSYPQGYSLASGQLSPAAAPPLASPSVFTSTLSKSRPTPKPRQRPTLPPPQPPTVNLSASSPQSTEAPMLDGMSPGESMSTAV

SEQ ID NO: 913204 - protein, 221 aa, Homo sapiens
ILSWLWQRVEAQLVAASAADCALLLASVRGPLLPGLGCPGLCLGRREQPGCWEHSPQCIASRAPGVLKLRCSSPNADLLECGGGSLSPVICYAWPPAPPAELAAPLPSPLPEQPLDSPAAPALSPSGLGLQPGPERTSFKEAGTDSTQGPLWPAGGYGRPVRWPAVPSQPVPHPAQHPVTLWTELPSGVLLGLGPALPSCSSSPGLSFCLYKHFEQIAAHS

SEQ ID NO: 913205 - protein, 768 aa, Homo sapiens; identical to SEQ ID NO: 913203

SEQ ID NO: 913206 - protein, 768 aa, Homo sapiens; identical to SEQ ID NO: 913203

SEQ ID NO: 913207 - protein, 780 aa, Homo sapiens
MKKQFNRMRQLANQTVGRAEKTEVLSEDLLQVEKRLELVKQVSHSTHKKLTACLQGQQGAEADKRSKKLPLTTLAQCLMEGSAILGDDTLLGKMLKLCGETEDKLAQELIHFELQVERDVIEPLFLLAEVEIPNIQKQRKHLAKLVLDMDSSRTRWQQTSKSSGLSSSLQPAGAKADALREEMEEAANRVEICRDQLSADMYSFVAKEIDYANYFQTLIEVQAEYHRKSLTLLQAVLPQIKAQQEAWVEKPSFGKPLEEHLTISGREIAFPIEACVTMLLECGMQEEGLFRVAPSASKLKKLKAALDCCVVDVQEYSADPHAIAGALKSYLRELPEPLMTFELYDEWIQASNVQEQDKKLQALWNACEKLPKANHNNIRYLIKFLSKLSEYQDVNKMTPSNMAIVLGPNLLWPQAEGNITEMMTTVSLQIVGIIEPIIQHADWFFPGEIEFNITGNYGSPVHVNHNANYSSMPSPDMDPADRRQPEQARRPLSVATDNMMLEFYKKDGMGVRVMDTNWVARRGSSAGRKVSCAPPSMQPPAPPAELAAPLPSPLPEQPLDSPAAPALSPSGLGLQPGPERTSTTKSKELSPGSAQKGSPGSSQGTACAGTQPGAQPGAQPGASPSPSQPPADQSPHTLRKVSKKLAPIPPKVPFGQPGAMADQSAGQPSPVSLSPTPPSTPSPYGLSYPQGYSLASGQLSPAAAPPLASPSVFTSTLSKSRPTPKPRQRPTLPPPQPPTVNLSASSPQSTEAPMLDGMSPGESMSTGNQATGSLTFFYEL

SEQ ID NO: 913208 - protein, 818 aa, Homo sapiens
MKKQFNRMRQLANQTVGRAEKTEVLSEDLLQVEKRLELVKQVSHSTHKKLTACLQGQQGAEADKRSKKLPLTTLAQCLMEGSAILGDDTLLGKMLKLCGETEDKLAQELIHFELQVERDVIEPLFLLAEVEIPNIQKQRKHLAKLVLDMDSSRTRWQQTSKSSGLSSSLQPAGAKADALREEMEEAANRVEICRDQLSADMYSFVAKEIDYANYFQTLIEVQAEYHRKSLTLLQAVLPQIKAQQEAWVEKPSFGKPLEEHLTISGREIAFPIEACVTMLLECGMQEEGLFRVAPSASKLKKLKAALDCCVVDVQEYSADPHAIAGALKSYLRELPEPLMTFELYDEWIQASNVQEQDKKLQALWNACEKLPKANHNNIRYLIKFLSKLSEYQDVNKMTPSNMAIVLGPNLLWPQAEGNITEMMTTVSLQIVGIIEPIIQHADWFFPGEIEFNITGNYGSPVHVNHNANYSSMPSPDMDPADRRQPEQARRPLSVATDNMMLEFYKKDGLRKIQSMGVRVMDTNWVARRGSSAGRKVSCAPPSMQPPAPPAELAAPLPSPLPEQPLDSPAAPALSPSGLGLQPGPERTSTTKSKELSPGSAQKGSPGSSQGTACAGTQPGAQPGAQPGASPSPSQPPADQSPHTLRKVSKKLAPIPPKVPFGQPGAMADQSAGQPSPVSLSPTPPSTPSPYGLSYPQGYSLASGQLSPAAAPPLASPSVFTSTLSKSRPTPKPRQRPTLPPPQPPTVNLSASSPQSTEAPMLDGMSPGESMSTDLVHFDIPSIHIELGSTLRLSPLEHMRRHSVTDKRDSEEESESTAL

SEQ ID NO: 913209 - protein, 153 aa, Homo sapiens
NFVFCCCVVFSLSVSKKLAPIPPKVPFGQPGAMADQSAGQPSPVSLSPTPPSTPSPYGLSYPQGYSLASGQLSPAAAPPLASPSVFTSTLSKSRPTPKPRQRPTLPPPQPPTVNLSASSPQSTEAPMLDGMSPGESMSTGNQATGSLTFFYEL

SEQ ID NO: 913210 - protein, 768 aa, Homo sapiens; identical to SEQ ID NO: 913203

SEQ ID NO: 913211 - protein, 768 aa, Homo sapiens; identical to SEQ ID NO: 913203

SEQ ID NO: 913212 - protein, 221 aa, Homo sapiens [sequence omitted]

SEQ ID NO: 913213 - protein, 457 aa, Homo sapiens
RVAGAPPPPLPKAARRRGAASLEPRSQPPPLTALGVQEEEQQRRRLLQRRAGARKNNIADPEELFTKLERIGKGSFGEVFKGIDNRTQQVVAIKIIDLEEAEDEIEDIQQEITVLSQCDSSYVTKYYGSYLKGSKLWIIMEYLGGGSALDLLRAGPFDEFQIATMLKEILKGLDYLHSEKKIHRDIKAANVLLSEQGDVKLADFGVAGQLTDTQIKRNTFVGTPFWMAPEVIQQSAYDSKADIWSLGITAIELAKGEPPNSDMHPMRVLFLIPKNNPPTLVGDFTKSFKEFIDACLNKDPSFRPTAKELLKHKFIVKNSKKTSYLTELIDRFKRWKAEGHSDDESDSEGSDSESTSRENNTHPEWSFTTVRKKPDPKKVQNGAEQDLVQTLSCLSMIITPAFAELKQQDENNASRNQAIEELEKSIAVAEAACPGITDKMVKKLIEKFQKCSADESP

SEQ ID NO: 913214 - protein, 445 aa, Homo sapiens
GGWGASTSSSYSGEAQRSGITRAQVPATTTHSARRSGRGAAAEAAASAAGGRQKGPDRKAWEGRRTTPGGRSQSEPKAPPPQKRSEAAFASMAHSPVAVQVPGMQNNIADPEELFTKLERIGKGSFGEVFKGIDNRTQQVVAIKIIDLEEAEDEIEDIQQEITVLSQCDSSYVTKYYGSYLKGSKLWIIMEYLGGGSALDLLRAGPFDEFQIATMLKEILKGLDYLHSEKKIHRDIKAANVLLSEQGDVKLADFGVAGQLTDTQIKRNTFVGTPFWMAPEVIQQSAYDSKRPTAKELLKHKFIVKNSKKTSYLTELIDRFKRWKAEGHSDDESDSEGSDSESTSRENNTHPEWSFTTVRKKPDPKKVQNGAEQDLVQTLSCLSMIITPAFAELKQQDENNASRNQAIEELEKSIAVAEAACPGITDKMVKKLIEKFQKCSADESP

SEQ ID NO: 913215 - protein, 409 aa, Homo sapiens
GGWGASTSSSYSGEAQRSGITRAQVPATTTHSARRSGRGAAAEAAASAAGGRQKGPDRKAWEGRRTTPGGRSQSEPKAPPPQKRSEAAFASMAHSPVAVQVPGMQNNIADPEELFTKLERIGKGSFGEVFKGIDNRTQQVVAIKIIDLEEAEDEIEDIQQEITVLSQCDSSYVTKYYGSYLKGSKLWIIMEYLGGGSALDLLRAGPFDEFQIATMLKEILKGLDYLHSEKKIHRDIKAANVLLSEQGDVKLADFGVAGQLTDTQIKRNTFVGTPFWMAPEVIQQSAYDSKADIWSLGITAIELAKGEPPNSDMHPMRVLFLIPKNNPPTLVGDFTKSFKEFIDACLNKDPSFRPTAKELLKHKFIVKNSKKTSYLTELIDRFKRWKAEGHSDDESDSEGSDSSKILCKP

SEQ ID NO: 913216 - protein, 507 aa, Homo sapiens
GGWGASTSSSYSGEAQRSGITRAQVPATTTHSARRSGRGAAAEAAASAAGGRQKGPDRKAWEGRRTTPGGRSQSEPKAPPPQKRSEAAFASMAHSPVAVQVPGMQNNIADPEELFTKLERIGKGSFGEVFKGIDNRTQQVVAIKIIDLEEAEDEIEDIQQEITVLSQCDSSYVTKYYGSYLKGSKLWIIMEYLGGGSALDLLRAGPFDEFQIATMLKEILKGLDYLHSEKKIHRDIKAANVLLSEQGDVKLADFGVAGQLTDTQIKRNTFVGTPFWMAPEVIQQSAYDSKADIWSLGITAIELAKGEPPNSDMHPMRVLFLIPKNNPPTLVGDFTKSFKEFIDACLNKDPSFRPTAKELLKHKFIVKNSKKTSYLTELIDRFKRWKAEGHSDDESDSEGSDSESTSRENNTHPEWSFTTVRKKPDPKKVQNGAEQDLVQTLSCLSMIITPAFAELKQQDENNASRNQAIEELEKSIAVAEAACPGITDKMVKKLIEKFQKCSADESP

SEQ ID NO: 913217 - protein, 507 aa, Homo sapiens; identical to SEQ ID NO: 913216

SEQ ID NO: 913218 - protein, 507 aa, Homo sapiens; identical to SEQ ID NO: 913216

SEQ ID NO: 913219 - protein, 228 aa, Homo sapiens
GGWGASTSSSYSGEAQRSGITRAQVPATTTHSARRSGRGAAAEAAASAAGGRQKGPDRKAWEGRRTTPGGRSQSEPKAPPPQKRSEAAFASMAHSPVAVQVPGMQNNIADPEELFTKLERIGKGSFGEVFKGIDNRTQQVVAIKIIDLEEAEDEIEDIQQEITVLSQCDSSYVTKYYGSYLKGSKLWIIMEYLGGGSALDLNGALPPYERSLIQRKYRMGQSKILCKP

SEQ ID NO: 913220 - protein, 99 aa, Homo sapiens
HRCLKDLSRPVGVRHPVDETARRFQSWGEAKTLPAPRSPGQPPPAAPCRLPAWARPAVLGLPSGDLGGQPSRDVTPRAPGSSAPAPSPIKQTPRRAATL

SEQ ID NO: 913221 - protein, 99 aa, Homo sapiens; identical to SEQ ID NO: 913220

SEQ ID NO: 913222 - protein, 99 aa, Homo sapiens; identical to SEQ ID NO: 913220

SEQ ID NO: 913223 - protein, 99 aa, Homo sapiens; identical to SEQ ID NO: 913220

SEQ ID NO: 913224 - protein, 163 aa, Homo sapiens
MPSIKLQSSDGEIFEVDVEIAKQSVTIKTMLEDLGMDDEGDDDPVPLPNVNAAILKKVIQWCTHHKDDPPPPEDDENKEKRTDDIPVWDQEFLKVDQGTLFELILAANYLDIKGLLDVTCKTVANMIKGKTPEEIRKTFNIKNDFTEEEEAQVRKENQWCEEK

SEQ ID NO: 913225 - protein, 99 aa, Homo sapiens; identical to SEQ ID NO: 913220

SEQ ID NO: 913226 - protein, 99 aa, Homo sapiens; identical to SEQ ID NO: 913220

SEQ ID NO: 913227 - protein, 99 aa, Homo sapiens; identical to SEQ ID NO: 913220

SEQ ID NO: 913228 - protein, 99 aa, Homo sapiens; identical to SEQ ID NO: 913220

SEQ ID NO: 913229 - protein, 99 aa, Homo sapiens; identical to SEQ ID NO: 913220

SEQ ID NO: 913230 - protein, 99 aa, Homo sapiens; identical to SEQ ID NO: 913220

SEQ ID NO: 913231 - protein, 99 aa, Homo sapiens; identical to SEQ ID NO: 913220

SEQ ID NO: 913232 - protein, 108 aa, Homo sapiens
MYSLDLNSSSQMPSIKLQSSDGEIFEVDVEIAKQSVTIKTMLEDLGMDDEGDDDPVPLPNVNAAILKKVHSQWLSPTTRDDPPPPEDDENKEKRTDDIPVVGPRIPES

SEQ ID NO: 913233 - protein, 99 aa, Homo sapiens; identical to SEQ ID NO: 913220

SEQ ID NO: 913234 - protein, 107 aa, Homo sapiens
PGSNSMRSVIKILRMVVLEVITVVYTIRDVRKRDLGIWITPRDLGMDDEGDDDPVPLPNVNAAILKKVHSQWLSPTTRDDPPPPEDDENKEKRTDDIPVVGPRIPES

SEQ ID NO: 913235 - protein, 99 aa, Homo sapiens; identical to SEQ ID NO: 913220

SEQ ID NO: 913236 - protein, 99 aa, Homo sapiens; identical to SEQ ID NO: 913220

SEQ ID NO: 913237 - protein, 99 aa, Homo sapiens; identical to SEQ ID NO: 913220

SEQ ID NO: 913238 - protein, 99 aa, Homo sapiens; identical to SEQ ID NO: 913220

SEQ ID NO: 913239 - protein, 99 aa, Homo sapiens; identical to SEQ ID NO: 913220

SEQ ID NO: 913240 - protein, 99 aa, Homo sapiens; identical to SEQ ID NO: 913220

SEQ ID NO: 913241 - protein, 99 aa, Homo sapiens; identical to SEQ ID NO: 913220

SEQ ID NO: 913242 - protein, 99 aa, Homo sapiens; identical to SEQ ID NO: 913220

SEQ ID NO: 913243 - protein, 99 aa, Homo sapiens; identical to SEQ ID NO: 913220

SEQ ID NO: 913244 - protein, 99 aa, Homo sapiens; identical to SEQ ID NO: 913220

SEQ ID NO: 913245 - protein, 99 aa, Homo sapiens; identical to SEQ ID NO: 913220

SEQ ID NO: 913246 - protein, 99 aa, Homo sapiens; identical to SEQ ID NO: 913220

SEQ ID NO: 913247 - protein, 99 aa, Homo sapiens; identical to SEQ ID NO: 913220

SEQ ID NO: 913248 - protein, 99 aa, Homo sapiens; identical to SEQ ID NO: 913220

SEQ ID NO: 913249 - protein, 99 aa, Homo sapiens; identical to SEQ ID NO: 913220

SEQ ID NO: 913250 - protein, 99 aa, Homo sapiens; identical to SEQ ID NO: 913220

SEQ ID NO: 913251 - protein, 99 aa, Homo sapiens; identical to SEQ ID NO: 913220

SEQ ID NO: 913252 - protein, 99 aa, Homo sapiens; identical to SEQ ID NO: 913220

SEQ ID NO: 913253 - protein, 354 aa, Homo sapiens
MATPLVAGPAALRFAAAASWQVVRGRCVEHFPRVLEFLRSLRAVAPGLVRYRHHERLCMGLKAKVVVELILQGRPWAQVLKALNHHFPESGPIVRDPKATKQDLRKILEAQETFYQQVKQLSEAPVDLASKLQELEQEYGEPFLAAMEKLLFEYLCQLEKALPTPQAQQLQDVLSWMQPGVSITSSLAWRQYGVDMGWLLPECSVTDSVNLAEPMEQNPPQQQRLALHNPLPKAKPGTHLPQGPSSRTHPEPLAGRHFNLAPLGRRRVQSQWASTRGGHKERPTVMLFPFRNLGSPTQVISKPESKEEHAIYTADLAMGTRAASTGKSKSPCQTLGGRALKENPVDLPATEQKE

SEQ ID NO: 913254 - protein, 372 aa, Homo sapiens
MATPLVAGPAALRFAAAASWQVVRGRCVEHFPRVLEFLRSLRAVAPGLVRYRHHERLCMGLKAKVVVELILQGRPWAQVLKALNHHFPESGPIVRDPKATKQDLRKILEAQETFYQQVKQLSEAPVDLASKLQELEQEYGEPFLAAMEKLLFEYLCQLEKALPTPQAQQLQDVLSWMQPGVSITSSLAWRQYGVDMGWLLPECSVTDSVNLAEPMEQNPPQQQRLALHNPLPKAKPGTHLPQGPSSRTHPEPLAGRHFNLAPLGRRRVQSQWASTRGGHKERPTVMLFPFRNLGSPTQVISKPESKEEHAIYTADLAMGTRAASTGKSKSPCQTLGGRALKENPVDLPATEQKDQELLGLLHGPPETIIITS

SEQ ID NO: 913255 - protein, 137 aa, Homo sapiens
MATPLVAGPAALRFAAAASWQVVRGRCVEHFPRVLEFLRSLRAVAPGLVRYRHHERLCMGLKAKVVVELILQGRPWAQVLKALNHHFPESGPIVRDPKATKQDLRKILEAQETFYQQVKQLSEAPVDLASKLQVRLV

SEQ ID NO: 913256 - protein, 354 aa, Homo sapiens; identical to SEQ ID NO: 913253

SEQ ID NO: 913257 - protein, 140 aa, Homo sapiens
MEQNPPQQQRLALHNPLPKAKPGTHLPQGPSSRTHPEPLAGRHFNLAPLGRRRVQSQWASTRGGHKERPTVMLFPFRNLGSPTQVISKPESKEEHAIYTADLAMGTRAASTGKSKSPCQTLGGRALKENPVDLPATEQKE

SEQ ID NO: 913258 - protein, 190 aa, Homo sapiens
MEKLLFEYLCQLEKALPTPQAQQLQDVLSWMQPGVSITSSLAWRQYGVDMGWLLPECSVTDSVNLAEPMEQNPPQQQRLALHNPLPEPLAGRHFNLAPLGRRRVQSQWASTRGGHKERPTVMLFPFRNLGSPTQVISKPESKEEHAIYTADLAMGTRAASTGKSKSPCQTLGGRALKENPVDLPATEQKE

SEQ ID NO: 913259 - protein, 243 aa, Homo sapiens
LVRGWFESAEAEAPVDLASKLQELEQEYGEPFLAAMEKLLFEYLCQLEKALPTPQAQQLQDVLSWMQPGVSITSSLAWRQYGVDMGWLLPECSVTDSVNLAEPMEQNPPQQQRLALHNPLPKAKPGTHLPQGPSSRTHPEPLAGRHFNLAPLGRRRVQSQWASTRGGHKERPTVMLFPFRNLGSPTQVISKPESKEEHAIYTADLAMGTRAASTGKSKSPCQTLGGRALKENPVDLPATEQKE

SEQ ID NO: 913260 - protein, 354 aa, Homo sapiens; identical to SEQ ID NO: 913253

SEQ ID NO: 913261 - protein, 373 aa, Homo sapiens
MATPLVAGPAALRFAAAASWQVVRGRCVEHFPRVLEFLRSLRAVAPGLVRYRHHERLCMGLKAKVVVELILQGRPWAQVLKALNHHFPESGPIVRDPKATKQDLRKILEAQETFYQQVKQLSEAPVDLASKLQELEQEYGEPFLAAMEKLLFEYLCQLEKALPTPQAQQLQDVLSWMQPGVSITSSLAWRQYGVDMGWLLPECSVTDSVNLAEPMEQNPPQQQRLALHNPLPKAKPGTHLPQGPSSRTHPEPLAGRHFNLAPLGRRRVQSQWASTRGGHKERPTVMLFPFRNLGSPTQVISKPESKEEHAIYTADLAMGTRAASTGKSKSPCQTLGGRALKENPVDLLRNCLDCYMDPLRLSLLPPRARKPGR

SEQ ID NO: 913262 - protein, 354 aa, Homo sapiens; identical to SEQ ID NO: 913253

SEQ ID NO: 913263 - protein, 372 aa, Homo sapiens; identical to SEQ ID NO: 913254

SEQ ID NO: 913264 - protein, 208 aa, Homo sapiens [sequence omitted]

SEQ ID NO: 913265 - protein, 354 aa, Homo sapiens; identical to SEQ ID NO: 913253

SEQ ID NO: 913266 - protein, 354 aa, Homo sapiens; identical to SEQ ID NO: 913253

SEQ ID NO: 913267 - protein, 288 aa, Homo sapiens
PGRPPWVRVKAPGGSVGHDPRAAGELKADSLLRNQAMAELEFVQIIIIVVVMMVMVVVITCLLSHYKLSARSFISRHSQGRRREDALSSEGCLWPSESTVSGNGIPEPQVYAPPRPTDRLAVPPFAQRERFHRFQPTYPYLQHEIDLPPTISLSDGEEPPPYQGPCTLQLRDPEQQLELNRESVRAPPNRTIFDSDLMDSARLGGPCPPSSNSGISATCYGSGGRMEGPPPTYSEVIGHYPGSSFQHQQSSGPPSLLEGTRLHHTHIAPLESAAIWSKEKDKQKGHPL

SEQ ID NO: 913268 - protein, 288 aa, Homo sapiens; identical to SEQ ID NO: 913267

SEQ ID NO: 913269 - protein, 381 aa, Homo sapiens
NPISLDLNEEEEAAAAAAAEALGWGKLAAEAQPRRQRAPRCQPIFRTPPAGTADAPGAAEGRPGGRSGARSRALSPAAPRELGGDPSPASRGAPPPPRASCMRGPSSGRRPEPPPAAPEPPAPRAAPPPPSMHRLMGVNSTAAAAAGQPNVSCTCNCKRSLFQSMEITELEFVQIIIIVVVMMVMVVVITCLLSHYKLSARSFISRHSQGRRREDALSSEGCLWPSESTVSGNGIPEPQVYAPPRPTDRLAVPPFAQRERFHRFQPTYPYLQHEIDLPPTISLSDGEEPPPYQGPCTLQLRDPNVSCTCNCKRSLFQSMEITELEFVSVIGHYPGSSFQHQQSSGPPSLLEGTRLHHTHIAPLESAAIWSKEKDKQKGHPL

SEQ ID NO: 913270 - protein, 288 aa, Homo sapiens; identical to SEQ ID NO: 913267

SEQ ID NO: 913271 - protein, 418 aa, Homo sapiens
NPISLDLNEEEEAAAAAAAEALGWGKLAAEAQPRRQRAPRCQPIFRTPPAGTADAPGAAEGRPGGRSGARSRALSPAAPRELGGDPSPASRGAPPPPRASCMRGPSSGRRPEPPPAAPEPPAPRAAPPPPSMHRLMGVNSTAAAAAGQPNVSCTCNCKRSLFQSMEITELEFVQIIIIVVVMMVMVVVITCLLSHYKLSARSFISRHSQGRRREDALSSEGCLWPSESTVSGNGIPEPQVYAPPRPTDRLAVPPFAQRERFHRFQPTYPYLQHEIDLPPTISLSDGEEPPPYQGPCTLQLRDPEQQLELNRESVRAPPNRTIFDSDLMDSARLGGPCPPSSNSGISATCYGSGGRMEGPPPTYSEVIGHYPGSSFQHQQSSGPPSLLEGTRLHHTHIAPLESAAIWSKEKDKQKGHPL

SEQ ID NO: 913272 - protein, 288 aa, Homo sapiens; identical to SEQ ID NO: 913267

SEQ ID NO: 913273 - protein, 288 aa, Homo sapiens; identical to SEQ ID NO: 913267

SEQ ID NO: 913274 - protein, 173 aa, Homo sapiens
RTAQQQQKSNKTLVGPCGALKSSSFFTASSLSVNRRISEDSFVIHNGQLVDISVGKPFYDRMSMCWDSPSFQDQIKTDVRAIIQVEVYLVLKYWLPFPGGMIPCSTNSNNGSSSSLTSVNLTFRSSISSKSSGDSFRNIFSFSFTETLAKSFIDPCLSLIYLRHCSCRIRHEG

SEQ ID NO: 913275 - protein, 340 aa, Homo sapiens
RESSQAVGGGAGREAPSSCASAKMAAAAGSCARVAAWGGKLRRGLAVSRQAVRSPGPLAAAVAGAALAGAGAAWHHSRVSVAARDGSFTVSAQKNVEHGIIYIGKPSLRKQRFMQFSSLEHEGEYYMTPRDFLFSVMFEQMERKTSVKKLTKKDIEDTLSGIQTAGCGSTFFRDLGDKGLISYTEYLFLLTILTKPHSGFHVAFKMLDTDGNEMIEKREFFKLQKIISKQDDLMTVKTNETGYQEAIVKEPEINTTLQMRFFGKRGQRKLHYKEFRRFMENLQTEIQEMEFLQFSKGLSFMRKEDFAEWLLFFTNTENKDIYWKNVREKLSAGERSLREL

SEQ ID NO: 913276 - protein, 344 aa, Homo sapiens
MQFSSLEHEGEYYMTPRDFLFSVMFEQMERKTSVKKLTKKDIEDTLSGIQTAGCGSTFFRDLGDKGLISYTEYLFLLTILTKPHSGFHVAFKMLDTDGNEMIEKREFFKLQKIISKQDDLMTVKTNETGYQEAIVKEPEINTTLQMRFFGKRGQRKLHYKEFRRFMENLQTEIQEMEFLQFSKGLSFMRKEDFAEWLLFFTNTENKDIYWKNVREKLSAGESISLDEFKSFCHFTTHLEDFAIAMQMFSLAHRPVRLAEFKRAVKVATGQELSNNILDTVFKIFDLDGDECLSHEEFLGVLKNRMHRGLWVPQHQSIQEYWKCVKKESIKGVKEVWKQAGKGLF

SEQ ID NO: 913277 - protein, 466 aa, Homo sapiens
RESSQAVGGGAGREAPSSCASAKMAAAAGSCARVAAWGGKLRRGLAVSRQAVRSPGPLAAAVAGAALAGAGAAWHHSRVSVAARDGSFTVSAQKNVEHGIIYIGKPSLRKQRFMQFSSLEHEGEYYMTPRDFLFSVMFEQMERKTSVKKLTKKDIEDTLSGIQTAGCGSTFFRDLGDKGLISYTEYLFLLTILTKPHSGFHVAFKMLDTDGNEMIEKREFFKDCTIDSERQLQKIISKQDDLMTVKTNETGYQEAIVKEPEINTTLQMRFFGKRGQRKLHYKEFRRFMENLQTEIQEMEFLQFSKGLSFMRKEDFAEWLLFFTNTENKDIYWKNVREKLSAGESISLDEFKSFCHFTTHLEDFAIAMQMFSLAHRPVRLAEFKRAVKVATGQELSNNILDTVFKIFDLDGDECLSHEEFLGVLKNRMHRGLWVPQHQSIQEYWKCVKKESIKGVKEVWKQAGKGLF

SEQ ID NO: 913278 - protein, 448 aa, Homo sapiens
RESSQAVGGGAGREAPSSCASAKMAAAAGSCARVAAWGGKLRRGLAVSRQAVRSPGPLAAAVAGAALAGAGAAWHHSRVSVAARDGSFTVSAQKNVEHGIIYIGKPSLRKQRFMQFSSLEHEGEYYMTPRDFLFSVMFEQMERKTSVKKLTKKDIEDTLSGIQTAGCGSTFFRDLGDKGLISYTEYLFLLTILTKPHSGFHVAFKMLDTDGNEMIEKREFFKLQKIISKQDDLMTVKTNETGYQEAIVKEPEINTTLQMRFFGKRGQRKLHYKEFRRFMENLQTEIQEMEFLQFSKGLSFMRKEDFAEWLLFFTNTENKDIYWKNVREKLSAGESISLDEFKSFCHFTTHLEDFAIAMQMFSLAHRPVRLAEFKRAVKVATGQELSNNILDTVFKIFDLDGDECLSHEEFLGVLKNRMHRGLWSPTFQGSENWKGWRKEPLRREGGNL

SEQ ID NO: 913279 - protein, 457 aa, Homo sapiens
RESSQAVGGGAGREAPSSCASAKMAAAAGSCARVAAWGGKLRRGLAVSRQAVRSPGPLAAAVAGAALAGAGAAWHHSRVSVAARDGSFTVSAQKNVEHGIIYIGKPSLRKQRFMQFSSLEHEGEYYMTPRDFLFSVMFEQMERKTSVKKLTKKDIEDTLSGIQTAGCGSTFFRDLGDKGLISYTEYLFLLTILTKPHSGFHVAFKMLDTDGNEMIEKREFFKLQKIISKQDDLMTVKTNETGYQEAIVKEPEINTTLQMRFFGKRGQRKLHYKEFRRFMENLQTEIQEMEFLQFSKGLSFMRKEDFAEWLLFFTNTENKDIYWKNVREKLSAGESISLDEFKSFCHFTTHLEDFAIAMQMFSLAHRPVRLAEFKRAVKVATGQELSNNILDTVFKIFDLDGDECLSHEEFLGVLKNRMHRGLWVPQHQSIQEYWKCVKKESIKGVKEVWKQAGKGLF

SEQ ID NO: 913280 - protein, 457 aa, Homo sapiens; identical to SEQ ID NO: 913279

SEQ ID NO: 913281 - protein, 365 aa, Homo sapiens
MKNVEHGIIYIGKPSLRKQRFMQFSSLEHEGEYYMTPRDFLFSVMFEQMERKTSVKKLTKKDIEDTLSGIQTAGCGSTFFRDLGDKGLISYTEYLFLLTILTKPHSGFHVAFKMLDTDGNEMIEKREFFKLQKIISKQDDLMTVKTNETGYQEAIVKEPEINTTLQMRFFGKRGQRKLHYKEFRRFMENLQTEIQEMEFLQFSKGLSFMRKEDFAEWLLFFTNTENKDIYWKNVREKLSAGESISLDEFKSFCHFTTHLEDFAIAMQMFSLAHRPVRLAEFKRAVKVATGQELSNNILDTVFKIFDLDGDECLSHEEFLGVLKNRMHRGLWVPQHQSIQEYWKCVKKESIKGVKEVWKQAGKGLF

SEQ ID NO: 913282 - protein, 405 aa, Homo sapiens
RESSQAVGGGAGREAPSSCASAKMAAAAGSCARVAAWGGKLRRGLAVSRQAVRSPGPLAAAVAGAALAGAGAAWHHSRVSVAARDGSFTVSAQKNVEHGIIYIGKPSLRKQRFMQFSSLEHEGEYYMTPRDFLFSVMFEQMERKTSVKKLTKKDIEDTLSGIQTAGCGSTFFRDLGDKGLISYTEYLFLLTILTKPHSGFHVAFKMLDTDGNEMIEKREFFKLQKIISKQDDLMTVKTNETGYQEAIVKEPEINTTLQMRFFGKRGQRKLHYKEFRRFMENLQTEIQEMEFLQFSKGLSFMRKEDFAEWLLFFTNTENKDIYWKNVREKLSAGESISLDEFKSFCHFTTHLEDFAIAIAKVQLTYMAGRQRGVKERWKGHTGRDLNNNLGNGLKTLFGLEESAKQ

SEQ ID NO: 913283 - protein, 222 aa, Homo sapiens
ISSPRRHVSRFLLRSLLCQRSQQDNMAPKKPEPKKEAAKPAPAPAPAPAPAPAPAPEAPKEPAFDPKSVKIDFTADQIEEFKEAFSLFDRTPTGEMKITYGQCGDVLRALGRNPTNAEVLRVLGKPKPEEMNVKMLDFETFLPILQHISRNKEQGTYEDFVEGLRVFDKESNGTVMGAELRHVLATLGEKMTEAEVEQLLAGQEDANGCINYEAFVKHIMSG

SEQ ID NO: 913284 - protein, 197 aa, Homo sapiens
MAPKKPEPKKEAAKPAPAPAPAPAPAPAPAPEAPKEPAFDPKSVKIDFTADQIEEFKEAFSLFDRTPTGEMKITYGQCGDVLRALGRNPTNAEVLRVLGKPKPEEMNVKMLDFETFLPILQHISRNKEQGTYEDFVEGLRVFDKESNGTVMGAELRHVLATLGEKMTEAEVEQLLAGQEDANGCINYEAFVKHIMSG

SEQ ID NO: 913285 - protein, 127 aa, Homo sapiens
MKITYGQCGDVLRALGRNPTNAEVLRVLGKPKPEEMNVKMLDFETFLPILQHISRNKEQGTYEDFVEGLRVFDKESNGTVMGAELRHVLATLGEKMTEAEVEQLLAGQEDANGCINYEAFVKHIMSG

SEQ ID NO: 913286 - protein, 222 aa, Homo sapiens; identical to SEQ ID NO: 913283

SEQ ID NO: 913287 - protein, 244 aa, Homo sapiens
ISSPRRHVSRFLLRSLLCQRSQQDNMAPKKPEPKKEAAKPAPAPAPAPAPAPAPAPEAPKEPAFDPKSVKIDFTADQIEEFKEAFSLFDRTPTGEMKITYGQCGDVLRALGRNPTNAEVLRVLGKPKPEEMNVKMLDFETFLPILQHISRNKEQGTYEDFVEGLRVFDKESNGTVMGAELRHVLATLGEKMTEAEVEQLLAGQEDANGCINYEVSQIAFPAAFLPPLTQYGTLYSQGHATSLLF

SEQ ID NO: 913288 - protein, 209 aa, Homo sapiens
ISSPRRHVSRFLLRSLLCQRSQQDNMAPKKPEPKKEAAKPAPAPAPAPAPAPAPAPEAPKEPAFDPKSVKIDFTADQIEEFKEAFSLFDRTPTGEMKITYGQCGDVLRALGRNPTNAEVLRVLGKPKPEEMNVKMLDFETFLPILQHISRNKEQGTYEDFVEGLRVFDKESNGTGEKMTEAEVEQLLAGQEDANGCINYEAFVKHIMSG

SEQ ID NO: 913289 - protein, 124 aa, Homo sapiens
ISSPRRHVSRFLLRSLLCQRSQQDNMAPKKPEPKKEAAKPAPAPAPAPAPAPAPAPEAPKEPAFDPKSVKIDFRQPMGRRAHLSLGRRVAEWVRRPQHSCSLRHFGRMSGASPAGSACKPGGST

SEQ ID NO: 913290 - protein, 278 aa, Homo sapiens
MDCQNGHQHISQELEVLRIHMQLVTVQFTQLGKGALEIIQVLYGISQGSQHLLAMCLDFGVAHDGRGRGQVLLCQRSQQDNMAPKKPEPKKEAAKPAPAPAPAPAPAPAPAPEAPKEPAFDPKSVKIDFTADQIEEFKEAFSLFDRTPTGEMKITYGQCGDVLRALGRNPTNAEVLRVLGKPKPEEMNVKMLDFETFLPILQHISRNKEQGTYEDFVEGLRVFDKESNGTVMGAELRHVLATLGEKMTEAEVEQLLAGQEDANGCINYEAFVKHIMSG

SEQ ID NO: 913291 - protein, 224 aa, Homo sapiens
NCSSQLISLAAPAYLRRLLCQRSQQDNMAPKKPEPKKEAAKPAPAPAPAPAPAPAPAPEAPKEPAFDPKSVKIDFTADQIEEFKEAFSLFDRTPTGEMKITYGQCGDVLRALGRNPTNAEVLRVLGKPKPEEMNVKMLDFETFLPILQHISRNKEQGTYEDFVEGLRVFDKESNGTVMGAELRHVLATLGEKMTEAEVEQLLAGQEDANGCINYEAFVKHIMSG

SEQ ID NO: 913292 - protein, 222 aa, Homo sapiens; identical to SEQ ID NO: 913283

SEQ ID NO: 913293 - protein, 175 aa, Homo sapiens
ISSPRRHVSRFLLRSLLCQRSQQDNMAPKKPEPKKEAAKPAPAPAPAPAPAPAPAPEAPKEPAFDPKSVKIDFTADQIEEFKEAFSLFDRTPTGEMKITYGQCGDVLRALGRNPTNAEVLRVLGKPKPEEMNVKMLDFETFLPILQHISRNKEQGTYEDFVEGLRVFDKESNGTG

SEQ ID NO: 913294 - protein, 171 aa, Homo sapiens
MDCQNGHQHISQELEVLRIHMQLVTVQFTQLGKGALEIIQVLYGIPKEVSTFLPCALTLGLPMMAEAEDRYSSAKDPNKTTWLPRSLSLRRRQPSQLQLQLQPLHQPDFVEGLRVFDKESNGTVMGAELRHVLATLGEKMTEAEVEQLLAGQEDANGCINYEAFVKHIMSG

SEQ ID NO: 913295 - protein, 187 aa, Homo sapiens
MPEVERKPKITASRKLLLKSLMLAKAKECWEQEHEEREAEKVRYLAERIPTLQTRGLSLSALQDLCRELHAKVEVVDEERYDIEAKCLHNTREIKDLKLKVMDLRGKFKRPPLRRVRVSADAMLRALLGSKHKVSMDLRANLKSVKKEDTEKERPVEVGDWRKNVEAMSGMEGRKKMFDAAKSPTSQ

SEQ ID NO: 913296 - protein, 70 aa, Homo sapiens
LGSAPRQSAVYGEAQASPAPRGLNKVLSHCHHAGSREKTQDHCLPQTLAEEPDAGQGQGMLGAGARGARG

SEQ ID NO: 913297 - protein, 187 aa, Homo sapiens; identical to SEQ ID NO: 913295

SEQ ID NO: 913298 - protein, 85 aa, Homo sapiens
GGGEGAHTALRSDELAVSDLTESQLAVLRSELLLHASSPTQLTHLSACVWSIPSHLSPTSSLQPACPPLELGLNRYPRGRKNASV

SEQ ID NO: 913299 - protein, 176 aa, Homo sapiens
MPEVERKPKITASRKLLLKSLMLAKAKECWEQEHEEREAEKVRYLAERIPTLQTRGLSLSALQDLCRELHAKVEVVDEERYDIEAKCLHNTREIKDLKLKVMDLRGKFKRPPLRRVRVSADAMLRALLGPTQLTHLSACVWSIPSHLSPTSSLQPACPPLELGLNRYPRGRKNASV

SEQ ID NO: 913300 - protein, 70 aa, Homo sapiens; identical to SEQ ID NO: 913296

SEQ ID NO: 913301 - protein, 187 aa, Homo sapiens; identical to SEQ ID NO: 913295

SEQ ID NO: 913302 - protein, 70 aa, Homo sapiens; identical to SEQ ID NO: 913296

SEQ ID NO: 913303 - protein, 187 aa, Homo sapiens; identical to SEQ ID NO: 913295

SEQ ID NO: 913304 - protein, 191 aa, Homo sapiens
MPEVERKPKITASRKLLLKSLMLAKAKECWEQEHEEREAEKVRYLAERIPTLQTRGLSLSALQDLCRELHAKVEVVDEERYDIEAKCLHNTREIKDLKLKVMDLRGKFKRPPLRRVRVSADAMLRALLGSKHKVSMDLRANLKSVKKEDTEKERPVEVGDWRKNVEAMSGMEGRKKMFDAAKLHALLWNWD

SEQ ID NO: 913305 - protein, 2215 aa, Homo sapiens
MVILQQGDHVWMDLRLGQEFDVPIGAVVKLCDSGQVQVVDDEDNEHWISPQNATHIKPMHPTSVHGVEDMIRLGDLNEAGILRNLLIRYRDHLIYTYTGSILVAVNPYQLLSIYSPEHIRQYTNKKIGEMPPHIFAIADNCYFNMKRNSRDQCCIISGESGAGKTESTKLILQFLAAISGQHSWIEQQVLEATPILEAFGNAKTIRNDNSSRFGKYIDIHFNKRGAIEGAKIEQYLLEKSRVCRQALDERNYHVFYCMLEGMSEDQKKKLGLGQASDYNYLAMGNCITCEGRVDSQEYANIRSAMKVLMFTDTENWEISKLLAAILHLGNLQYEARTFENLDACEVLFSPSLATAASLLEVNPPDLMSCLTSRTLITRGETVSTPLSREQALDVRDAFVKGIYGRLFVWIVDKINAAIYKPPSQDVKNSRRSIGLLDIFGFENFAVNSFEQLCINFANEHLQQFFVRHVFKLEQEEYDLESIDWLHIEFTDNQDALDMIANKPMNIISLIDEESKFPKGTDTTMLHKLNSQHKLNANYIPPKNNHETQFGINHFAGIVYYETQGFLEKNRDTLHGDIIQLVHSSRNKFIKQIFQADVAMGAETRKRSPTLSSQFKRSLELLMRTLGACQPFFVRCIKPNEFKKPMLFDRHLCVRQLRYSGMMETIRIRRAGYPIRYSFVEFVERYRVLLPGVKPAYKQGDLRGTCQRMAEAVLGTHDDWQIGKTKIFLKDHHDMLLEVERDKAITDRVILLQKVIRGFKDRSNFLKLKNAATLIQRHWRGHNCRKNYGLMRLGFLRLQALHRSRKLHQQYRLARQRIIQFQARCRAYLVRKAFRHRLWAVLTVQAYARGMIARRLHQRLRAEYLWRLEAEKMRLAEEEKLRKEMSAKKAKEEAERKHQERLAQLAREDAERELKEKEAARRKKELLEQMERARHEPVNHSDMVDKMFGFLGTSGGLPGQEGQAPSGFEDLERGRREMVEEDLDAALPLPDEDEEDLSEYKFAKFAATYFQGTTTHSYTRRPLKQPLLYHDDEGDQLAALAVWITILRFMGDLPEPKYHTAMSDGSEKIPVMTKIYETLGKKTYKRELQALQGEGEAQLPEGQKKSSVRHKLVHLTLKKKSKLTEEVTKRLHDGESTVQGNSMLEDRPTSNLEKLHFIIGNGILRPALRDEIYCQISKQLTHNPSKSSYARGWILVSLCVGCFAPSEKFVKYLRNFIHGGPPGYAPYCEERLRRTFVNGTRTQPPSWLELQATKSKKPIMLPVTFMDGTTKTLLTDSATTAKELCNALADKISLKDRFGFSLYIALFDKVSSLGSGSDHVMDAISQCEQYAKEQGAQERNAPWRLFFRKEVFTPWHSPSEDNVATNLIYQQVVRGVKFGEYRCEKEDDLAELASQQYFVDYGSEMILERLLNLVPTYIPDREITPLKTLEKWAQLAIAAHKKGIYAQRRTDAQKVKEDVVSYARFKWPLLFSRFYEAYKFSGPSLPKNDVIVAVNWTGVYFVDEQEQVLLELSFPEIMAVSSSRECRVWLSLGCSDLGCAAPHSGWAGLTPAGPCSPCWSCRGAKTTAPSFTLATIKGDEYTFTSSNAEDIRDLVVTFLEGLRKRSKYVVALQDNPNPAGEESGFLSFAKGDLIILDHDTGEQVMNSGWANGINERTKQRGDFPTDSVYVMPTVTMPPREIVALVTMTPDQRQDVVRLLQLRTAEPEVRAKPYTLEEFSYDYFRPPPKHTLSRVMVSKARGKDRLWSHTREPLKQALLKKLLGSEELSQEACLAFIAVLKYMGDYPSKRTRSVNELTDQIFEGPLKAEPLKDEAYVQILKQLTDNHIRYSEERGWELLWLCTGLFPPSNILLPHVQRFLQSRKHCPLAIDCLQRLQKALRNGSRKYPPHLVEVEAIQHKTTQIFHKVYFPDDTDEAFEVESSTKAKDFCQNIATRLLLKSSEGFSLFVKIADKVLSVPENDFFFDFVRHLTDWIKKARPIKDGIVPSLTYQVFFMKKLWTTTVPGKDPMADSIFHYYQELPKYLRGYHKCTREEVLQLGALIYRVKFEEDKSYFPSIPKLLRELVPQDLIRQVSPDDWKRSIVAYFNKHAGKSKEEAKLAFLKLIFKWPTFGSAFFEVKQTTEPNFPEILLIAINKYGVSLIDPKTKDILTTHPFTKISNWSSGNTYFHITIGNLVRGSKLLCETSLGYKMDDLLTSYISQMLTAMSKQRGSRSGK

SEQ ID NO: 913306 - protein, 1186 aa, Homo sapiens
MVILQQGDHVWMDLRLGQEFDVPIGAVVKLCDSGQVQVVDDEDNEHWISPQNATHIKPMHPTSVHGVEDMIRLGDLNEAGILRNLLIRYRDHLIYTYTGSILVAVNPYQLLSIYSPEHIRQYTNKKIGEMPPHIFAIADNCYFNMKRNSRDQCCIISGESGAGKTESTKLILQFLAAISGQHSWIEQQVLEATPILEAFGNAKTIRNDNSSRFGKYIDIHFNKRGAIEGAKIEQYLLEKSRVCRQALDERNYHVFYCMLEGMSEDQKKKLGLGQASDYNYLAMGNCITCEGRVDSQEYANIRSAMKVLMFTDTENWEISKLLAAILHLGNLQYEARTFENLDACEVLFSPSLATAASLLEVNPPDLMSCLTSRTLITRGETVSTPLSREQALDVRDAFVKGIYGRLFVWIVDKINAAIYKPPSQDVKNSRRSIGLLDIFGFENFAVNSFEQLCINFANEHLQQFFVRHVFKLEQEEYDLESIDWLHIEFTDNQDALDMIANKPMNIISLIDEESKFPKGTDTTMLHKLNSQHKLNANYIPPKNNHETQFGINHFAGIVYYETQGFLEKNRDTLHGDIIQLVHSSRNKFIKQIFQADVAMGAETRKRSPTLSSQFKRSLELLMRTLGACQPFFVRCIKPNEFKKPMLFDRHLCVRQLRYSGMMETIRIRRAGYPIRYSFVEFVERYRVLLPGVKPAYKQGDLRGTCQRMAEAVLGTHDDWQIGKTKIFLKDHHDMLLEVERDKAITDRVILLQKVIRGFKDRSNFLKLKNAATLIQRHWRGHNCRKNYGLMRLGFLRLQALHRSRKLHQQYRLARQRIIQFQARCRAYLVRKAFRHRLWAVLTVQAYARGMIARRLHQRLRAEYLWRLEAEKMRLAEEEKLRKEMSAKKAKEEAERKHQERLAQLAREDAERELKEKEAARRKKELLEQMERARHEPVNHSDMVDKMFGFLGTSGGLPGQEGQAPSGFEDLERGRREMVEEDLDAALPLPDEDEEDLSEYKFAKFAATYFQGTTTHSYTRRPLKQPLLYHDDEGDQLAALAVWITILRFMGDLPEPKYHTAMSDGSEKIPVMTKIYETLGKKTYKRELQALQGEGEAQLPEGQKKSSVRHKLVHLTLKKKSKLTEEVTKRLHDGESTVQGNSMLEDRPTSNLEKLHFIIGNGILRPALRCRKVFWWLSGASVNLARD

SEQ ID NO: 913307 - protein, 86 aa, Homo sapiens
MVILQQGDHVWMDLRLGQEFDVPIGAVVKLCDSGQVQVVDDEDNERWISRASPCGQHSNPARSTNGKPEIWPSCLAPWSARKARGA

SEQ ID NO: 913308 - protein, 1406 aa, Homo sapiens
MVILQQGDHVWMDLRLGQEFDVPIGAVVKLCDSGQVQVVDDEDNEHWISPQNATHIKPMHPTSVHGVEDMIRLGDLNEAGILRNLLIRYRDHLIYTYTGSILVAVNPYQLLSIYSPEHIRQYTNKKIGEMPPHIFAIADNCYFNMKRNSRDQCCIISGESGAGKTESTKLILQFLAAISGQHSWIEQQVLEATPILEAFGNAKTIRNDNSSRFGKYIDIHFNKRGAIEGAKIEQYLLEKSRVCRQALDERNYHVFYCMLEGMSEDQKKKLGLGQASDYNYLAMGNCITCEGRVDSQEYANIRSAMKVLMFTDTENWEISKLLAAILHLGNLQYEARTFENLDACEVLFSPSLATAASLLEVNPPDLMSCLTSRTLITRGETVSTPLSREQALDVRDAFVKGIYGRLFVWIVDKINAAIYKPPSQDVKNSRRSIGLLDIFGFENFAVNSFEQLCINFANEHLQQFFVRHVFKLEQEEYDLESIDWLHIEFTDNQDALDMIANKPMNIISLIDEESKFPKGTDTTMLHKLNSQHKLNANYIPPKNNHETQFGINHFAGIVYYETQGFLEKNRDTLHGDIIQLVHSSRNKFIKQIFQADVAMGAETRKRSPTLSSQFKRSLELLMRTLGACQPFFVRCIKPNEFKKPMLFDRHLCVRQLRYSGMMETIRIRRAGYPIRYSFVEFVERYRVLLPGVKPAYKQGDLRGTCQRMAEAVLGTHDDWQIGKTKIFLKDHHDMLLEVERDKAITDRVILLQKVIRGFKDRSNFLKLKNAATLIQRHWRGHNCRKNYGLMRLGFLRLQALHRSRKLHQQYRLARQRIIQFQARCRAYLVRKAFRHRLWAVLTVQAYARGMIARRLHQRLRAEYLWRLEAEKMRLAEEEKLRKEMSAKKAKEEAERKHQERLAQLAREDAERELKEKEAARRKKELLEQMERARHEPVNHSDMVDKMFGFLGTSGGLPGQEGQAPSGFEDLERGRREMVEEDLDAALPLPDEDEEDLSEYKFAKFAATYFQGTTTHSYTRRPLKQPLLYHDDEGDQLAALAVWITILRFMGDLPEPKYHTAMSDGSEKIPVMTKIYETLGKKTYKRELQALQGEGEAQLPEGQKKSSVRHKLVHLTLKKKSKLTEEVTKRLHDGESTVQGNSMLEDRPTSNLEKLHFIIGNGILRPALRDEIYCQISKQLTHNPSKSSYARGWILVSLCVGCFAPSEKFVKYLRNFIHGGPPGYAPYCEERLRRTFVNGTRTQPPSWLELQATKSKKPIMLPVTFMDGTTKTLLTDSATTAKELCNALADKISLKDRFGFSLYIALFDKVSSLGSGSDHVMDAISQCEQYAKEQGAQERNAPWRLFFRKEVFTPWHSPSEDNVATNLIYQQVVRGVKFGEYRCEKVSGRESSARLAWLTASCFPRLG

SEQ ID NO: 913309 - protein, 1533 aa, Homo sapiens
MVILQQGDHVWMDLRLGQEFDVPIGAVVKLCDSGQVQVVDDEDNEHWISPQNATHIKPMHPTSVHGVEDMIRLGDLNEAGILRNLLIRYRDHLIYTYTGSILVAVNPYQLLSIYSPEHIRQYTNKKIGEMPPHIFAIADNCYFNMKRNSRDQCCIISGESGAGKTESTKLILQFLAAISGQHSWIEQQVLEATPILEAFGNAKTIRNDNSSRFGKYIDIHFNKRGAIEGAKIEQYLLEKSRVCRQALDERNYHVFYCMLEGMSEDQKKKLGLGQASDYNYLAMGNCITCEGRVDSQEYANIRSAMKVLMFTDTENWEISKLLAAILHLGNLQYEARTFENLDACEVLFSPSLATAASLLEVNPPDLMSCLTSRTLITRGETVSTPLSREQALDVRDAFVKGIYGRLFVWIVDKINAAIYKPPSQDVKNSRRSIGLLDIFGFENFAVNSFEQLCINFANEHLQQFFVRHVFKLEQEEYDLESIDWLHIEFTDNQDALDMIANKPMNIISLIDEESKFPKGTDTTMLHKLNSQHKLNANYIPPKNNHETQFGINHFAGIVYYETQGFLEKNRDTLHGDIIQLVHSSRNKFIKQIFQADVAMGAETRKRSPTLSSQFKRSLELLMRTLGACQPFFVRCIKPNEFKKPMLFDRHLCVRQLRYSGMMETIRIRRAGYPIRYSFVEFVERYRVLLPGVKPAYKQGDLRGTCQRMAEAVLGTHDDWQIGKTKIFLKDHHDMLLEVERDKAITDRVILLQKVIRGFKDRSNFLKLKNAATLIQRHWRGHNCRKNYGLMRLGFLRLQALHRSRKLHQQYRLARQRIIQFQARCRAYLVRKAFRHRLWAVLTVQAYARGMIARRLHQRLRAEYLWRLEAEKMRLAEEEKLRKEMSAKKAKEEAERKHQERLAQLAREDAERELKEKEAARRKKELLEQMERARHEPVNHSDMVDKMFGFLGTSGGLPGQEGQAPSGFEDLERGRREMVEEDLDAALPLPDEDEEDLSEYKFAKFAATYFQGTTTHSYTRRPLKQPLLYHDDEGDQLAALAVWITILRFMGDLPEPKYHTAMSDGSEKIPVMTKIYETLGKKTYKRELQALQGEGEAQLPEGQKKSSVRHKLVHLTLKKKSKLTEEVTKRLHDGESTVQGNSMLEDRPTSNLEKLHFIIGNGILRPALRDEIYCQISKQLTHNPSKSSYARGWILVSLCVGCFAPSEKFVKYLRNFIHGGPPGYAPYCEERLRRTFVNGTRTQPPSWLELQATKSKKPIMLPVTFMDGTTKTLLTDSATTAKELCNALADKISLKDRFGFSLYIALFDKVSSLGSGSDHVMDAISQCEQYAKEQGAQERNAPWRLFFRKEVFTPWHSPSEDNVATNLIYQQVVRGVKFGEYRCEKEDDLAELASQQYFVDYGSEMILERLLNLVPTYIPDREITPLKTLEKWAQLAIAAHKKGIYAQRRTDAQKVKEDVVSYARFKWPLLFSRFYEAYKFSGTPQPAMLPVPCSVAPAHSLQILRYPAACNAPSPLLCSSSPQPTNSQVPHSLQ

SEQ ID NO: 913310 - protein, 2157 aa, Homo sapiens
MHPTSVHGVEDMIRLGDLNEAGILRNLLIRYRDHLIYTYTGSILVAVNPYQLLSIYSPEHIRQYTNKKIGEMPPHIFAIADNCYFNMKRNSRDQCCIISGESGAGKTESTKLILQFLAAISGQHSWIEQQVLEATPILEAFGNAKTIRNDNSSRFGKYIDIHFNKRGAIEGAKIEQYLLEKSRVCRQALDERNYHVFYCMLEGMSEDQKKKLGLGQASDYNYLAMGNCITCEGRVDSQEYANIRSAMKVLMFTDTENWEISKLLAAILHLGNLQYEARTFENLDACEVLFSPSLATAASLLEVNPPDLMSCLTSRTLITRGETVSTPLSREQALDVRDAFVKGIYGRLFVWIVDKINAAIYKPPSQDVKNSRRSIGLLDIFGFENFAVNSFEQLCINFANEHLQQFFVRHVFKLEQEEYDLESIDWLHIEFTDNQDALDMIANKPMNIISLIDEESKFPKGTDTTMLHKLNSQHKLNANYIPPKNNHETQFGINHFAGIVYYETQGFLEKNRDTLHGDIIQLVHSSRNKFIKQIFQADVAMGAETRKRSPTLSSQFKRSLELLMRTLGACQPFFVRCIKPNEFKKPMLFDRHLCVRQLRYSGMMETIRIRRAGYPIRYSFVEFVERYRVLLPGVKPAYKQGDLRGTCQRMAEAVLGTHDDWQIGKTKIFLKDHHDMLLEVERDKAITDRVILLQKVIRGFKDRSNFLKLKNAATLIQRHWRGHNCRKNYGLMRLGFLRLQALHRSRKLHQQYRLARQRIIQFQARCRAYLVRKAFRHRLWAVLTVQAYARGMIARRLHQRLRAEYLWRLEAEKMRLAEEEKLRKEMSAKKAKEEAERKHQERLAQLAREDAERELKEKEAARRKKELLEQMERARHEPVNHSDMVDKMFGFLGTSGGLPGQEGQAPSGFEDLERGRREMVEEDLDAALPLPDEDEEDLSEYKFAKFAATYFQGTTTHSYTRRPLKQPLLYHDDEGDQLAALAVWITILRFMGDLPEPKYHTAMSDGSEKIPVMTKIYETLGKKTYKRELQALQGEGEAQLPEGQKKSSVRHKLVHLTLKKKSKLTEEVTKRLHDGESTVQGNSMLEDRPTSNLEKLHFIIGNGILRPALRDEIYCQISKQLTHNPSKSSYARGWILVSLCVGCFAPSEKFVKYLRNFIHGGPPGYAPYCEERLRRTFVNGTRTQPPSWLELQATKSKKPIMLPVTFMDGTTKTLLTDSATTAKELCNALADKISLKDRFGFSLYIALFDKVSSLGSGSDHVMDAISQCEQYAKEQGAQERNAPWRLFFRKEVFTPWHSPSEDNVATNLIYQQVVRGVKFGEYRCEKEDDLAELASQQYFVDYGSEMILERLLNLVPTYIPDREITPLKTLEKWAQLAIAAHKKGIYAQRRTDAQKVKEDVVSYARFKWPLLFSRFYEAYKFSGPSLPKNDVIVAVNWTGVYFVDEQEQVLLELSFPEIMAVSSSRECRVWLSLGCSDLGCAAPHSGWAGLTPAGPCSPCWSCRGAKTTAPSFTLATIKGDEYTFTSSNAEDIRDLVVTFLEGLRKRSKYVVALQDNPNPAGEESGFLSFAKGDLIILDHDTGEQVMNSGWANGINERTKQRGDFPTDSVYVMPTVTMPPREIVALVTMTPDQRQDVVRLLQLRTAEPEVRAKPYTLEEFSYDYFRPPPKHTLSRVMVSKARGKDRLWSHTREPLKQALLKKLLGSEELSQEACLAFIAVLKYMGDYPSKRTRSVNELTDQIFEGPLKAEPLKDEAYVQILKQLTDNHIRYSEERGWELLWLCTGLFPPSNILLPHVQRFLQSRKHCPLAIDCLQRLQKALRNGSRKYPPHLVEVEAIQHKTTQIFHKVYFPDDTDEAFEVESSTKAKDFCQNIATRLLLKSSEGFSLFVKIADKVLSVPENDFFFDFVRHLTDWIKKARPIKDGIVPSLTYQVFFMKKLWTTTVPGKDPMADSIFHYYQELPKYLRGYHKCTREEVLQLGALIYRVKFEEDKSYFPSIPKLLRELVPQDLIRQVSPDDWKRSIVAYFNKHAGKSKEEAKLAFLKLIFKWPTFGSAFFEVKQTTEPNFPEILLIAINKYGVSLIDPKTKDILTTHPFTKISNWSSGNTYFHITIGNLVRGSKLLCETSLGYKMDDLLTSYISQMLTAMSKQRGSRSGK

SEQ ID NO: 913311 - protein, 313 aa, Homo sapiens
KVLGHQLPQQLGDTGEVGLVLLELDPENIATRLLLKSSEGFSLFVKIADKVLSVPENDFFFDFVRHLTDWIKKARPIKDGIVPSLTYQVFFMKKLWTTTVPGKDPMADSIFHYYQELPKYLRGYHKCTREEVLQLGALIYRVKFEEDKSYFPSIPKLLRELVPQDLIRQVSPDDWKRSIVAYFNKHAGKSKEEAKLAFLKLIFKWPTFGSAFFEVKQTTEPNFPEILLIAINKYGVSLIDPKTKDILTTHPFTKISNWSSGNTYFHITIGNLVRGSKLLCETSLGYKMDDLLTSYISQMLTAMSKQRGSRSGK

SEQ ID NO: 913312 - protein, 110 aa, Homo sapiens
CERRSPRCVPSPTRWRSFPMTTSGDASWGRMGATGLGAAGFRYCLVVCWGCFVKPPPVSRAWVRGSWRAVSVCQDDPSYVSHLIFLPSRDVTAPTPGWAFETESWWGCGL

SEQ ID NO: 913313 - protein, 2177 aa, Homo sapiens
MVILQQGDHVWMDLRLGQEFDVPIGAVVKLCDSGQVQVVDDEDNEHWISPQNATHIKPMHPTSVHGVEDMIRLGDLNEAGILRNLLIRYRDHLIYTYTGSILVAVNPYQLLSIYSPEHIRQYTNKKIGEMPPHIFAIADNCYFNMKRNSRDQCCIISGESGAGKTESTKLILQFLAAISGQHSWIEQQVLEATPILEAFGNAKTIRNDNSSRFGKYIDIHFNKRGAIEGAKIEQYLLEKSRVCRQALDERNYHVFYCMLEGMSEDQKKKLGLGQASDYNYLAMGNCITCEGRVDSQEYANIRSAMKVLMFTDTENWEISKLLAAILHLGNLQYEARTFENLDACEVLFSPSLATAASLLEVNPPDLMSCLTSRTLITRGETVSTPLSREQALDVRDAFVKGIYGRLFVWIVDKINAAIYKPPSQDVKNSRRSIGLLDIFGFENFAVNSFEQLCINFANEHLQQFFVRHVFKLEQEEYDLESIDWLHIEFTDNQDALDMIANKPMNIISLIDEESKFPKGTDTTMLHKLNSQHKLNANYIPPKNNHETQFGINHFAGIVYYETQGFLEKNRDTLHGDIIQLVHSSRNKFIKQIFQADVAMGAETRKRSPTLSSQFKRSLELLMRTLGACQPFFVRCIKPNEFKKPMLFDRHLCVRQLRYSGMMETIRIRRAGYPIRYSFVEFVERYRVLLPGVKPAYKQGDLRGTCQRMAEAVLGTHDDWQIGKTKIFLKDHHDMLLEVERDKAITDRVILLQKVIRGFKDRSNFLKLKNAATLIQRHWRGHNCRKNYGLMRLGFLRLQALHRSRKLHQQYRLARQRIIQFQARCRAYLVRKAFRHRLWAVLTVQAYARGMIARRLHQRLRAEYLWRLEAEKMRLAEEEKLRKEMSAKKAKEEAERKHQERLAQLAREDAERELKEKEAARRKKELLEQMERARHEPVNHSDMVDKMFGFLGTSGGLPGQEGQAPSGFEDLERGRREMVEEDLDAALPLPDEDEEDLSEYKFAKFAATYFQGTTTHSYTRRPLKQPLLYHDDEGDQLAALAVWITILRFMGDLPEPKYHTAMSDGSEKIPVMTKIYETLGKKTYKRELQALQGEGEAQLPEGQKKSSVRHKLVHLTLKKKSKLTEEVTKRLHDGESTVQGNSMLEDRPTSNLEKLHFIIGNGILRPALRDEIYCQISKQLTHNPSKSSYARGWILVSLCVGCFAPSEKFVKYLRNFIHGGPPGYAPYCEERLRRTFVNGTRTQPPSWLELQATKSKKPIMLPVTFMDGTTKTLLTDSATTAKELCNALADKISLKDRFGFSLYIALFDKVSSLGSGSDHVMDAISQCEQYAKEQGAQERNAPWRLFFRKEVFTPWHSPSEDNVATNLIYQQVVRGVKFGEYRCEKEDDLAELASQQYFVDYGSEMILERLLNLVPTYIPDREITPLKTLEKWAQLAIAAHKKGIYAQRRTDAQKVKEDVVSYARFKWPLLFSRFYEAYKFSGPSLPKNDVIVAVNWTGVYFVDEQEQVLLELSFPEIMAVSSSRGAKTTAPSFTLATIKGDEYTFTSSNAEDIRDLVVTFLEGLRKRSKYVVALQDNPNPAGEESGFLSFAKGDLIILDHDTGEQVMNSGWANGINERTKQRGDFPTDSVYVMPTVTMPPREIVALVTMTPDQRQDVVRLLQLRTAEPEVRAKPYTLEEFSYDYFRPPPKHTLSRVMVSKARGKDRLWSHTREPLKQALLKKLLGSEELSQEACLAFIAVLKYMGDYPSKRTRSVNELTDQIFEGPLKAEPLKDEAYVQILKQLTDNHIRYSEERGWELLWLCTGLFPPSNILLPHVQRFLQSRKHCPLAIDCLQRLQKALRNGSRKYPPHLVEVEAIQHKTTQIFHKVYFPDDTDEAFEVESSTKAKDFCQNIATRLLLKSSEGFSLFVKIADKVLSVPENDFFFDFVRHLTDWIKKARPIKDGIVPSLTYQVFFMKKLWTTTVPGKDPMADSIFHYYQELPKYLRGYHKCTREEVLQLGALIYRVKFEEDKSYFPSIPKLLRELVPQDLIRQVSPDDWKRSIVAYFNKHAGKSKEEAKLAFLKLIFKWPTFGSAFFEVKQTTEPNFPEILLIAINKYGVSLIDPKTKDILTTHPFTKISNWSSGNTYFHITIGNLVRGSKLLCETSLGYKMDDLLTSYISQMLTAMSKQRGSRSGK

SEQ ID NO: 913314 - protein, 2010 aa, Homo sapiens
MVILQQGDHVWMDLRLGQEFDVPIGAVVKLCDSGQVQVVDDEDNEHWISPQNATHIKPMHPTSVHGVEDMIRLGDLNEAGILRNLLIRYRDHLIYTYTGSILVAVNPYQLLSIYSPEHIRQYTNKKIGEMPPHIFAIADNCYFNMKRNSRDQCCIISGESGAGKTESTKLILQFLAAISGQHSWIEQQVLEATPILEAFGNAKTIRNDNSSRFGKYIDIHFNKRGAIEGAKIEQYLLEKSRVCRQALDERNYHVFYCMLEGMSEDQKKKLGLGQASDYNYLAMGNCITCEGRVDSQEYANIRSAMKVLMFTDTENWEISKLLAAILHLGNLQYEARTFENLDACEVLFSPSLATAASLLEVNPPDLMSCLTSRTLITRGETVSTPLSREQALDVRDAFVKGIYGRLFVWIVDKINAAIYKPPSQDVKNSRRSIGLLDIFGFENFAVNSFEQLCINFANEHLQQFFVRHVFKLEQEEYDLESIDWLHIEFTDNQDALDMIANKPMNIISLIDEESKFPKGTDTTMLHKLNSQHKLNANYIPPKNNHETQFGINHFAGIVYYETQGFLEKNRDTLHGDIIQLVHSSRNKFIKQIFQADVAMGAETRKRSPTLSSQFKRSLELLMRTLGACQPFFVRCIKPNEFKKPMLFDRHLCVRQLRYSGMMETIRIRRAGYPIRYSFVEFVERYRVLLPGVKPAYKQGDLRGTCQRMAEAVLGTHDDWQIGKTKIFLKDHHDMLLEVERDKAITDRVILLQKVIRGFKDRSNFLKLKNAATLIQRHWRGHNCRKNYGLMRLGFLRLQALHRSRKLHQQYRLARQRIIQFQARCRAYLVRKAFRHRLWAVLTVQAYARGMIARRLHQRLRAEYLWRLEAEKMRLAEEEKLRKEMSAKKAKEEAERKHQERLAQLAREDAERELKEKEAARRKKELLEQMERARHEPVNHSDMVDKMFGFLGTSGGLPGQEGQAPSGFEDLERGRREMVEEDLDAALPLPDEDEEDLSEYKFAKFAATYFQGTTTHSYTRRPLKQPLLYHDDEGDQLAALAVWITILRFMGDLPEPKYHTAMSDGSEKIPVMTKIYETLGKKTYKRELQALQGEGEAQLPEGQKKSSVRHKLVHLTLKKKSKLTEEVTKRLHDGESTVQGNSMLEDRPTSNLEKLHFIIGNGILRPALRDEIYCQISKQLTHNPSKSSYARGWILVSLCVGCFAPSEKFVKYLRNFIHGGPPGYAPYCEERLRRTFVNGTRTQPPSWLELQATKSKKPIMLPVTFMDGTTKTLLTDSATTAKELCNALADKISLKDRFGFSLYIALFDKVSSLGSGSDHVMDAISQCEQYAKEQGAQERNAPWRLFFRKEVFTPWHSPSEDNVATNLIYQQVVRGVKFGEYRCEKEDDLAELASQQYFVDYGSEMILERLLNLVPTYIPDREITPLKTLEKWAQLAIAAHKKGIYAQRRTDAQKVKEDVVSYARFKWPLLFSRFYEAYKFSGPSLPKNDVIVAVNWTGVYFVDEQEQVLLELSFPEIMAVSSSRECRVWLSLGCSDLGCAAPHSGWAGLTPAGPCSPCWSCRGAKTTAPSFTLATIKGDEYTFTSSNAEDIRDLVVTFLEGLRKRSKYVVALQDNPNPAGEESGFLSFAKGDLIILDHDTGEQVMNSGWANGINERTKQRGDFPTDSVYVMPTVTMPPREIVALVTMTPDQRQDVVRLLQLRTAEPEVRAKPYTLEEFSYDYFRPPPKHTLSRVMVSKARGKDRLWSHTREPLKQALLKKLLGSEELSQEACLAFIAVLKYMGDYPSKRTRSVNELTDQIFEGPLKAEPLKDEAYVQILKQLTDNHIRYSEERGWELLWLCTGLFPPSNILLPHVQRFLQSRKHCPLAIDCLQRLQKALRNGSRKYPPHLVEVEAIQHKTTQIFHKVYFPDDTDEVRVTGFYGLQCPGQGRASWVDTKGGLKPLPHHLTFAASSSCPVVESGLRTKAIDSPGQGPLVPDPTPASWSSFLQKGAPPSLSLRRTCLGEKRFSL

SEQ ID NO: 913315 - protein, 1351 aa, Homo sapiens
MVILQQGDHVWMDLRLGQEFDVPIGAVVKLCDSGQVQVVDDEDNEHWISPQNATHIKPMHPTSVHGVEDMIRLGDLNEAGILRNLLIRYRDHLIYTYTGSILVAVNPYQLLSIYSPEHIRQYTNKKIGEMPPHIFAIADNCYFNMKRNSRDQCCIISGESGAGKTESTKLILQFLAAISGQHSWIEQQVLEATPILEAFGNAKTIRNDNSSRFGKYIDIHFNKRGAIEGAKIEQYLLEKSRVCRQALDERNYHVFYCMLEGMSEDQKKKLGLGQASDYNYLAMGNCITCEGRVDSQEYANIRSAMKVLMFTDTENWEISKLLAAILHLGNLQYEARTFENLDACEVLFSPSLATAASLLEVNPPDLMSCLTSRTLITRGETVSTPLSREQALDVRDAFVKGIYGRLFVWIVDKINAAIYKPPSQDVKNSRRSIGLLDIFGFENFAVNSFEQLCINFANEHLQQFFVRHVFKLEQEEYDLESIDWLHIEFTDNQDALDMIANKPMNIISLIDEESKFPKGTDTTMLHKLNSQHKLNANYIPPKNNHETQFGINHFAGIVYYETQGFLEKNRDTLHGDIIQLVHSSRNKFIKQIFQADVAMGAETRKRSPTLSSQFKRSLELLMRTLGACQPFFVRCIKPNEFKKPMLFDRHLCVRQLRYSGMMETIRIRRAGYPIRYSFVEFVERYRVLLPGVKPAYKQGDLRGTCQRMAEAVLGTHDDWQIGKTKIFLKDHHDMLLEVERDKAITDRVILLQKVIRGFKDRSNFLKLKNAATLIQRHWRGHNCRKNYGLMRLGFLRLQALHRSRKLHQQYRLARQRIIQFQARCRAYLVRKAFRHRLWAVLTVQAYARGMIARRLHQRLRAEYLWRLEAEKMRLAEEEKLRKEMSAKKAKEEAERKHQERLAQLAREDAERELKEKEAARRKKELLEQMERARHEPVNHSDMVDKMFGFLGTSGGLPGQEGQAPSGFEDLERGRREMVEEDLDAALPLPDEDEEDLSEYKFAKFAATYFQGTTTHSYTRRPLKQPLLYHDDEGDQLAALAVWITILRFMGDLPEPKYHTAMSDGSEKIPVMTKIYETLGKKTYKRELQALQGEGEAQLPEGQKKSSVRHKLVHLTLKKKSKLTEEVTKRLHDGESTVQGNSMLEDRPTSNLEKLHFIIGNGILRPALRDEIYCQISKQLTHNPSKSSYARGWILVSLCVGCFAPSEKFVKYLRNFIHGGPPGYAPYCEERLRRTFVNGTRTQPPSWLELQATKSKKPIMLPVTFMDGTTKTLLTDSATTAKELCNALADKISLKDRFGFSLYIALFDKVWPPGSTSSRKHLLPAPLRAASAATYLPGLFTLEHLGFPLSLC

SEQ ID NO: 913316 - protein, 132 aa, Homo sapiens
QERLTLSQLGPGFIPVPKCFSCSGPPSDAFSSFFQQTTEPNFPEILLIAINKYGVSLIDPKTKDILTTHPFTKISNWSSGNTYFHITIGNLVRGSKLLCETSLGYKMDDLLTSYISQMLTAMSKQRGSRSGK

SEQ ID NO: 913317 - protein, 55 aa, Homo sapiens
GKWRDPGVGGGRGRLAGEHLGCCLYQVNPPDLMSCLTSRTLITRGETVSTPLSRE

SEQ ID NO: 913318 - protein, 267 aa, Homo sapiens
FRWALNPERLAMPLHKYPVWLWKRLQLREGICSRLPGHYLRSLEEERTPTPVHYRPHGAKFKINPKNGQRERVEDVPIPIYFPPESQRGLWGGEGWILGQIYANNDKLSKRLKKVWKPQLFEREFYSEILDKKFTVTVTMRTLDLIDEAYGLDFYILKTPKEDLCSKFGMDLKRGMLLRLARQDPQLHPEDPERRAAIYDKYKEFAIPEEEAEWVGLTLEEAIEKQRLLEEKDPVPLFKIYVAELIQQLQQQALSEPAVVQKRASGQ

SEQ ID NO: 913319 - protein, 189 aa, Homo sapiens
FRWALNPERLAMPLHKYPVWLWKRLQLREGICSRLPGHYLRSLEEERTPTPVHYRPHGAKFKINPKNGQRERVEDVPIPIYFPPESQRGLWGGEGWILGQIYANNDKLSKRLKKVWKPQLFEREFYSEILDKKFTVTVTMRTLDLIDEAYGLDFYILKASGVGRVSAHRVWDGPVRLTGAPGQHHTGAR

SEQ ID NO: 913320 - protein, 271 aa, Homo sapiens
KARYEAWVLEPERLAMPLHKYPVWLWKRLQLREGICSRLPGHYLRSLEEERTPTPVHYRPHGAKFKINPKNGQRERVEDVPIPIYFPPESQRGLWGGEGWILGQIYANNDKLSKRLKKVWKPQLFEREFYSEILDKKFTVTVTMRTLDLIDEAYGLDFYILKTPKEDLCSKFGMDLKRGMLLRLARQDPQLHPEDPERRAAIYDKYKEFAIPEEEAEWVGLTLEEAIEKQRLLEEKDPVPLFKIYVAELIQQLQQQALSEPAVVQKRASGQ

SEQ ID NO: 913321 - protein, 274 aa, Homo sapiens
RLRYEAWVVVGLNPERLAMPLHKYPVWLWKRLQLREGICSRLPGHYLRSLEEERTPTPVHYRPHGAKFKINPKNGQRERVEDVPIPIYFPPESQRGLWGGEGWILGQIYANNDKLSKRLKKVWKPQLFEREFYSEILDKKFTVTVTMRTLDLIDEAYGLDFYILKTPKEDLCSKFGMDLKRGMLLRLARQDPQLHPEDPERRAAIYDKYKEFAIPEEEAEWVGLTLEEAIEKQRLLEEKDPVPLFKIYVAELIQQLQQQALSEPAVVQKRASGQ

SEQ ID NO: 913322 - protein, 273 aa, Homo sapiens
QVGCGGAPGQKGRGRLAMPLHKYPVWLWKRLQLREGICSRLPGHYLRSLEEERTPTPVHYRPHGAKFKINPKNGQRERVEDVPIPIYFPPESQRGLWGGEGWILGQIYANNDKLSKRLKKVWKPQLFEREFYSEILDKKFTVTVTMRTLDLIDEAYGLDFYILKTPKEDLCSKFGMDLKRGMLLRLARQDPQLHPEDPERRAAIYDKYKEFAIPEEEAEWVGLTLEEAIEKQRLLEEKDPVPLFKIYVAELIQQLQQQALSEPAVVQKRASGQ

SEQ ID NO: 913323 - protein, 137 aa, Homo sapiens
MVFSHLAAEKGNSAHQWEAACVALIRQDRLNAGVGDELLLELEAALAAGAQQASRAPNCLRVQRKTLTFPIPVGSDFPREEAEWVGLTLEEAIEKQRLLEEKDPVPLFKIYVAELIQQLQQQALSEPAVVQKRASGQ

SEQ ID NO: 913324 - protein, 132 aa, Homo sapiens
FRWALNPERLAMPLHKYPVWLWKRLQLREGICSRLPGHYLRSLEEERTPTPVHYRPHGAKFKINPKNGQRERVEDVPIPIYFPPESQRGLWGGEGWILGQIYANNDKAAGTVRAGGGAEESQWPVTTQLLHA

SEQ ID NO: 913325 - protein, 333 aa, Homo sapiens
RLRYEAWVVVGLNPERLAMPLHKYPVWLWKRLQLREGICSRLPGHYLRSLEEERTPTPVHYRPHGAKFKINPKNGQRERVEDVPIPIYFPPESQRGLWGGEGWILGQIYANNDKLSKRLKKVWKPQLFEREFYSEILDKKFTVTVTMRTLDLIDEAYGLDFYILKTPKEDLCSKFGMDLKRGMLLRLARQDPQLHPEDPERRAAIYDKYKEFAIPEEEAEWVGLTLEEAIEKQRLLEEKDPVPLFKIYVAELIQQLQQQALSEPAVVQKRASGQWEPEVHAGQRPRSPGLGGPIRRRAREGDGRAAHGGSPDGKLRAEKSANREQTWGGYTAR

SEQ ID NO: 913326 - protein, 256 aa, Homo sapiens; identical to SEQ ID NO: 786580

SEQ ID NO: 913327 - protein, 256 aa, Homo sapiens; identical to SEQ ID NO: 786580

SEQ ID NO: 913328 - protein, 205 aa, Homo sapiens
FLKIIPCGGQARWLTPVVPALWKTEVGGSLEVRSSRPPLKEKSHKLSKRLKKVWKPQLFEREFYSEILDKKFTVTVTMRTLDLIDEAYGLDFYILKTPKEDLCSKFGMDLKRGMLLRLARQDPQLHPEDPERRAAIYDKYKEFAIPEEEAEWVGLTLEEAIEKQRLLEEKDPVPLFKIYVAELIQQLQQQALSEPAVVQKRASGQ

SEQ ID NO: 913329 - protein, 68 aa, Homo sapiens
QVGCGGAPGQKGRGRLAMPLHKYPVWLWKRLQLREGICSRLPGHYLRSLEEQQALSEPAVVQKRASGQ

SEQ ID NO: 913330 - protein, 354 aa, Homo sapiens
MALFVRLLALALALALGPAATLAGPAKSPYQLVLQHSRLRGRQHGPNVCAVQKVIGTNRKYFTNCKQWYQRKICGKSTVISYECCPGYEKVPGEKGCPAALPLSNLYETLGVVGSTTTQLYTDRTEKLRPEMEGPGSFTIFAPSNEAWASLPAEVLDSLVSNVNIELLNALRYHMVGRRVLTDELKHGMTLTSMYQNSNIQIHHYPNGIVTVNCARLLKADHHATNGVVHLIDKVISTITNNIQQIIEIEDTFETLRAAVAASGLNTMLEGNGQYTLLAPTNEAFEKIPSETLNRILGDPEALRDLLNNHILKSAMCAEAIVAGLSVETLEGTTLEVGCSGDMPHYQREGDHLQ

SEQ ID NO: 913331 - protein, 354 aa, Homo sapiens; identical to SEQ ID NO: 913330

SEQ ID NO: 913332 - protein, 354 aa, Homo sapiens; identical to SEQ ID NO: 913330

SEQ ID NO: 913333 - protein, 354 aa, Homo sapiens; identical to SEQ ID NO: 913330

SEQ ID NO: 913334 - protein, 312 aa, Homo sapiens
MLGPNVCAVQKVIGTNRKYFTNCKQWYQRKICGKSTVISYECCPGYEKVPGEKGCPAALPLSNLYETLGVVGSTTTQLYTDRTEKLRPEMEGPGSFTIFAPSNEAWASLPAEVLDSLVSNVNIELLNALRYHMVGRRVLTDELKHGMTLTSMYQNSNIQIHHYPNGIVTVNCARLLKADHHATNGVVHLIDKVISTITNNIQQIIEIEDTFETLRAAVAASGLNTMLEGNGQYTLLAPTNEAFEKIPSETLNRILGDPEALRDLLNNHILKSAMCAEAIVAGLSVETLEGTTLEVGCSGDMPHYQREGDHLQ

SEQ ID NO: 913335 - protein, 354 aa, Homo sapiens; identical to SEQ ID NO: 913330

SEQ ID NO: 913336 - protein, 354 aa, Homo sapiens; identical to SEQ ID NO: 913330

SEQ ID NO: 913337 - protein, 180 aa, Homo sapiens
MVGRRVLTDELKHGMTLTSMYQNSNIQIHHYPNGIVTVNCARLLKADHHATNGVVHLIDKVISTITNNIQQIIEIEDTFETLRAAVAASGLNTMLEGNGQYTLLAPTNEAFEKIPSETLNRILGDPEALRDLLNNHILKSAMCAEAIVAGLSVETLEGTTLEVGCSGDMPHYQREGDHLQ

SEQ ID NO: 913338 - protein, 354 aa, Homo sapiens; identical to SEQ ID NO: 913330

SEQ ID NO: 913339 - protein, 190 aa, Homo sapiens [sequence omitted]

SEQ ID NO: 913340 - protein, 344 aa, Homo sapiens
MPECLTINGKAIISNKDILATNGVIHYIDELLIPDSAKTLFELAAESDVSTAIDLFRQAGLGNHLSGSERLTLLAPLNSVFKDGTPPIDAHTRNLLRNHIIKDQLASKYLYHGQTLETLGGKKLRVFVYRNSLCIENSCIAAHDKRGRYGTLFTMDRVLTPPMGTVMDVLKGDNRFSMLVAAIQSAGLTETLNREGVYTVFAPTNEAFRALPPRERSRLLGDAKELANILKYHIGDEILVSGGIGALVRLKSLQGDKLEVSLKNNVVSVNKEPVAEPDIMATNGVVHVITNVLQPPANRPQERGDELADSALEIFKQASAFSRASQRSVRLAPVYQKLLERMKH

SEQ ID NO: 913341 - protein, 354 aa, Homo sapiens; identical to SEQ ID NO: 913330

SEQ ID NO: 913342 - protein, 147 aa, Homo sapiens
MYFYQCCGEKKKRKEKNGKCPEMCLVLNKIYLQPGDIGDEILVSGGIGALVRLKSLQGDKLEVSLKNNVVSVNKEPVAEPDIMATNGVVHVITNVLQPPANRPQERGDELADSALEIFKQASAFSRASQRSVRLAPVYQKLLERMKH

SEQ ID NO: 913343 - protein, 320 aa, Homo sapiens
MALFVRLLALALALALGPAATLAGPAKSPYQLVLQHSRLRGRQHGPNVCAVQKVIGTNRKYFTNCKQWYQRKICGKSTVISYECCPGYEKVPGEKGCPAALPLSNLYETLGVVGSTTTQLYTDRTEKLRPEMEGPGSFTIFAPSNEAWASLPAEVLDSLVSNVNIELLNALRYHMVGRRVLTDELKHGMTLTSMYQNSNIQIHHYPNGIVTVNCARLLKADHHATNGVVHLIDKVISTITNNIQQIIEIEDTFETLRAAVAASGLNTMLEGNGQYTLLAPTNEAFEKIPSETLNRILGDPEALRGEHPLAPAAASFVQLD

SEQ ID NO: 913344 - protein, 354 aa, Homo sapiens; identical to SEQ ID NO: 913330

SEQ ID NO: 913345 - protein, 354 aa, Homo sapiens; identical to SEQ ID NO: 913330

SEQ ID NO: 913346 - protein, 354 aa, Homo sapiens; identical to SEQ ID NO: 913330

SEQ ID NO: 913347 - protein, 354 aa, Homo sapiens; identical to SEQ ID NO: 913330

SEQ ID NO: 913348 - protein, 354 aa, Homo sapiens; identical to SEQ ID NO: 913330

SEQ ID NO: 913349 - protein, 471 aa, Homo sapiens
MALFVRLLALALALALGPAATLAGPAKSPYQLVLQHSRLRGRQHGPNVCAVQKVIGTNRKYFTNCKQWYQRKICGKSTVISYECCPGYEKVPGEKGCPAALPLSNLYETLGVVGSTTTQLYTDRTEKLRPEMEGPGSFTIFAPSNEAWASLPAVDDLRLPGGLLWGTALLPRGVGMMNGSLQSFPTVSGSFLLNPLEKAVELELKYVFQVASNAPRSLLGRKTWVLPEEGSLAEERPGLTRAENMFPRVARTHLLNTESAALTDTLSFLLEVLDSLVSNVNIELLNALRYHMVGRRVLTDELKHGMTLTSMYQNSNIQIHHYPNGIVTVNCARLLKADHHATNGVVHLIDKVISTITNNIQQIIEIEDTFETLRAAVAASGLNTMLEGNGQYTLLAPTNEAFEKIPSETLNRILGDPEALRDLLNNHILKSAMCAEAIVAGLSVETLEGTTLEVGCSGDMPHYQREGDHLQ

SEQ ID NO: 913350 - protein, 161 aa, Homo sapiens
QVRGWVVIGRGYPNGIVTVNCARLLKADHHATNGVVHLIDKVISTITNNIQQIIEIEDTFETLRAAVAASGLNTMLEGNGQYTLLAPTNEAFEKIPSETLNRILGDPEALRDLLNNHILKSAMCAEAIVAGLSVETLEGTTLEVGCSGDMPHYQREGDHLQ

SEQ ID NO: 913351 - protein, 354 aa, Homo sapiens; identical to SEQ ID NO: 913330

SEQ ID NO: 913352 - protein, 354 aa, Homo sapiens; identical to SEQ ID NO: 913330

SEQ ID NO: 913353 - protein, 354 aa, Homo sapiens; identical to SEQ ID NO: 913330

SEQ ID NO: 913354 - protein, 241 aa, Homo sapiens
MDILVSECSARLLQQEEEIKSLTAEIDRLKNCGCLGASPNLEQLQEENLKLKYRLNILRKSLQAERNKPTKNMINIISRLQEVFGHAIKAAYPDLENPPLLVTPSQQAKFGDYQCNSAMGISQMLKTKEQKVNPREIAENITKHLPDNECIEKVEIAGPGFINVHLRKDFVSEQLTSLLVNGVQLPALGENKKVIVDFSSPNIAKEMHVGHLRSTIIGESISRLFEFAGYDVLRFFKKKFS

SEQ ID NO: 913355 - protein, 205 aa, Homo sapiens
MDILVSECSARLLQQEEEIKSLTAEIDRLKNCGCLGASPNLEQLQEENLKLKYRLNILRKSLQAERNKPTKNMINIISRLQEVFGHAIKAAYPDLENPPLLVTPSQQAKFGDYQCNSAMGISQMLKTKEQKVNPREIAENITKHLPDNECIEKVEIAGPGFINVHLRKDFVSEQLTSLLVNGVQLPALGENKKVYVHSSINILVS

SEQ ID NO: 913356 - protein, 660 aa, Homo sapiens [sequence omitted]

SEQ ID NO: 913357 - protein, 674 aa, Homo sapiens
LRLGTRLGGGADGRMDILVSECSARLLQQEEEIKSLTAEIDRLKNCGCLGASPNLEQLQEENLKLKYRLNILRKSLQAERNKPTKNMINIISRLQEVFGHAIKAAYPDLENPPLLVTPSQQAKFGDYQCNSAMGISQMLKTKEQKVNPREIAENITKHLPDNECIEKVEIAGPGFINVHLRKDFVSEQLTSLLVNGVQLPALGENKKVIVDFSSPNIAKEMHVGHLRSTIIGESISRLFEFAGYDVLRLNHVGDWGTQFGMLIAHLQDKFPDYLTVSPPIGDLQVFYKESKKRFDTEEEFKKRAYQCVVLLQGKNPDITKAWKLICDVSRQELNKIYDALDVSLIERGESFYQDRMNDIVKEFEDRGFVQVDDGRKIVFVPGCSIPLTIVKSDGGYTYDTSDLAAIKQRLFEEKADMIIYVVDNGQSVHFQTIFAAAQMIGWYDPKVTRVFHAGFGVVLGEDKKKFKTRSGETVRLMDLLGEGLKRSMDKLKEKERDKVLTAEELNAAQTSVAYGCIKYADLSHNRLNDYIFSFDKMLDDRGNTAAYLLYAFTRIRSIARLANIDEEMLQKAARETKILLDHEKEWKLGRCILRFPEILQKILDDLFLHTLCDYIYELATAFTEFYDSCYCVEKDRQTGKILKVNMWRMLLCEAVAAVMAKGFDILGIKPVQRM

SEQ ID NO: 913358 - protein, 319 aa, Homo sapiens
MDILVSECSARLLQQEEEIKSLTAEIDRLKNCGCLGASPNLEQLQEENLKLKYRLNILRKSLQAERNKPTKNMINIISRLQEVFGHAIKAAYPDLENPPLLVTPSQQAKFGDYQCNSAMGISQMLKTKEQKVNPREIAENITKHLPDNECIEKVEIAGPGFINVHLRKDFVSEQLTSLLVNGVQLPALGENKKVIVDFSSPNIAKEMHVGHLRSTIIGESISRLFEFAGYDVLRYVLLPCVLFSFLIFLFGKFYRTWNISLKKEHSTKSVVHQLSSSLQPPSKLLKYVLSLSSEPFLLFYFFRLLVEPRTKLLHSTHVS

SEQ ID NO: 913359 - protein, 660 aa, Homo sapiens [sequence omitted]

SEQ ID NO: 913360 - protein, 351 aa, Homo sapiens
LRIPSSQQELNKIYDALDVSLIERGESFYQDRMNDIVKEFEDRGFVQVDDGRKIVFVPGCSIPLTIVKSDGGYTYDTSDLAAIKQRLFEEKADMIIYVVDNGQSVHFQTIFAAAQMIGWYDPKVTRVFHAGFGVVLGEDKKKFKTRSGETVRLMDLLGEGLKRSMDKLKEKERDKVLTAEELNAAQTSVAYGCIKYADLSHNRLNDYIFSFDKMLDDRGNTAAYLLYAFTRIRSIARLANIDEEMLQKAARETKILLDHEKEWKLGRCILRFPEILQKILDDLFLHTLCDYIYELATAFTEFYDSCYCVEKDRQTGKILKVNMWRMLLCEAVAAVMAKGFDILGIKPVQRM

SEQ ID NO: 913361 - protein, 187 aa, Homo sapiens
MDILVSECSARLLQQEEEIKSLTAEIDRLKNCGCLGASPNLEQLQEENLKLKYRLNILRKSLQAERNKPTKNMINIISRLQEVFGHAIKAAYPDLENPPLLVTPSQQAKFGDYQCNSAMGISQMLKTKEQKVNPREIAENITKHLPDNECIDVSEQLTSLLVNGVQLPALGENKKVYVHSSINILVS

SEQ ID NO: 913362 - protein, 127 aa, Homo sapiens
MDILVSECSARLLQQEEEIKSLTAEIDRLKNCGCLGASPNLEQLQEENLKLKYRLNILRKSLQAERNNFPNLFWLYFKSAKKAMGVYDTKVTYKLVWYIHHRKAYSLLSDKAKGSFFFPVFVPLPED

SEQ ID NO: 913363 - protein, 660 aa, Homo sapiens [sequence omitted]

SEQ ID NO: 913364 - protein, 138 aa, Homo sapiens [sequence omitted]

SEQ ID NO: 913365 - protein, 147 aa, Homo sapiens
MDILVSECSARLLQQEEEIKSLTAEIDRLKNCGCLGASPNLEQLQEENLKLKYRLNILRKSLQAERNKPTKNMINIISRLQEVFGHAIKAAYPDLENPPLLVTPSQQAKFGDYQCNSAMGISQVMYCHDSWLFDFFKYYYHHCHLQK

SEQ ID NO: 913366 - protein, 694 aa, Homo sapiens
MDILVSECSARLLQQEEEIKSLTAEIDRLKNCGCLGASPNLEQLQEENLKLKYRLNILRKSLQAERNKPTKNMINIISRLQEVFGHAIKAAYPDLENPPLLVTPSQQAKFGDYQCNSAMGISQMLKTKEQKVNPREIAENITKHLPDNECIEKVEIAGPGFINVHLRKDFVSEQLTSLLVNGVQLPALGENKKVIVDFSSPNIAKEMHVGHLRSTIIGESISRLFEFAGYDVLRLNHVGDWGTQFGMLIAHLQDKFPDYLTVSPPIGDLQVFYKVRCGGSVSVIPALGEAEASRLLEFQEFETSLSNKESKKRFDTEEEFKKRAYQCVVLLQGKNPDITKAWKLICDVSRQELNKIYDALDVSLIERGESFYQDRMNDIVKEFEDRGFVQVDDGRKIVFVPGCSIPLTIVKSDGGYTYDTSDLAAIKQRLFEEKADMIIYVVDNGQSVHFQTIFAAAQMIGWYDPKVTRVFHAGFGVVLGEDKKKFKTRSGETVRLMDLLGEGLKRSMDKLKEKERDKVLTAEELNAAQTSVAYGCIKYADLSHNRLNDYIFSFDKMLDDRGNTAAYLLYAFTRIRSIARLANIDEEMLQKAARETKILLDHEKEWKLGRCILRFPEILQKILDDLFLHTLCDYIYELATAFTEFYDSCYCVEKDRQTGKILKVNMWRMLLCEAVAAVMAKGFDILGIKPVQRM

SEQ ID NO: 913367 - protein, 660 aa, Homo sapiens [sequence omitted]

SEQ ID NO: 913368 - protein, 319 aa, Homo sapiens; identical to SEQ ID NO: 913358

SEQ ID NO: 913369 - protein, 162 aa, Homo sapiens
MDILVSECSARLLQQEEEIKSLTAEIDRLKNCGCLGASPNLEQLQEENLKLKYRLNILRKSLQAERNKPTKNMINIISRLQEVFGHAIKAAYPDLENPPLLVTPSQQAKFGDYQCNSAMGISQMLKTKEQKVNPREIAENITKHLPDNECIEKVEIAGPGMT

SEQ ID NO: 913370 - protein, 1833 aa, Homo sapiens
MDGVSSEANEENDNIERPVRRRHSSILKPPRSPLQDLRGGNETVQESNALRNKKNSRRVSFADTIKVFQTESHMKIVRKSEMEETETGENLLLIQNKKLEDNYCEITGMNTLLSAPIHTQMQQKEFSIIEHTRERKHANDQTVIFSDENQMDLTSSHTVMITKGLLDNPISEKSTKIDTTSFLANLKLHTEDSRMKKEVNFSVDQNTSSENKIDFNDFIKRLKTGKCSAFPDVPDKENFEIPIYSKEPNSASSTHQMHVSLKEDENNSNITRLFREKDDGMNFTQCHTANIQTLIPTSSETNSRESKGNDITIYGNDFMDLTFNHTLQILPATGNFSEIENQTQNAMDVTTGYGTKASGNKTVFKSKQNTAFQDLSINSADKIHITRSHIMGAETHIVSQTCNQDARILAMTPESIYSNPSIQGCKTVFYSSCNDAMEMTKCLSNMREEKNLLKHDSNYSKMYCNPDAMSSLTEKTIYSGEENMDITKSHTVAIDNQIFKQDQSNVQIAAAPTPEKEMMLQNLMTTSEDGKMNVNCNSVPHVSKERIQQSLSNPLSISLTDRKTELLSGENTDLTESHTSNLGSQVPLAAYNLAPESTSESHSQSKSSSDECEEITKSRNEPFQRSDIIAKNSLTDTWNKDKDWVLKILPYLDKDSPQSADCNQEIATSHNIVYCGGVLDKQITNRNTVSWEQSLFSTTKPLFSSGQFSMKNHDTAISSHTVKSVLGQNSKLAEPLRKSLSNPTPDYCHDKMIICSEEEQNMDLTKSHTVVIGFGPSELQELGKTNLEHTTGQLTTMNRQIAVKVEKCGKSPIEKSGVLKSNCIMDVLEDESVQKPKFPKEKQNVKIWGRKSVGGPKIDKTIVFSEDDKNDMDITKSYTIEINHRPLLEKRDCHLVPLAGTSETILYTCGQDDMEITRSHTTALECKTVSPDEITTRPMDKTVVFVDNHVELEMTESHTVFIDYQEKERTDRPNFELSQRKSLGTPTVICTPTEESVFFPGNGESDRLVANDSQLTPLEEWSNNRGPVEVADNMELSKSATCKNIKDVQSPGFLNEPLSSKSQRRKSLKLKNDKTIVFSENHKNDMDITQSCMVEIDNESALEDKEDFHLAGASKTILYSCGQDDMEITRSHTTALECKTLLPNEIAIRPMDKTVLFTDNYSDLEVTDSHTVFIDCQATEKILEENPKFGIGKGKNLGVSFPKDNSCVQEIAEKQALAVGNKIVLHTEQKQQLFAATNRTTNEIIKFHSAAMDEKVIGEVVDQACTLEKAQVESCQLNNRDRRNVDFTSSHATAVCGSSDNYSCLPNVISCTDNLEGSAMLLCDKDEEKANYCPVQNDLAYANDFASEYYLESEGQPLSAPCPLLEKEEVIQTSTKGQLDCVITLHKDQDLIKDPRNLLANQTLVYSQDLGEMTKLNSKRVSFKLPKDQMKVYVDDIYVIPQPHFSADQPPLPKKGQSSINKEEVILSKAGNKSLNIIENSSAPICENKPKILNSEEWFAAACKKELKENIQTTNYNTALDFHSNSDVTKQVIQTHVNAGEAPDPVITSNVPCFHSIKPNLNNLNGKTGEFLAFQTVHLPPLPEQLLELGNKAHNDMHIVQATEIHNINIISSNAKDSRDEENKKSHNGAETTSLPPKTVFKDKVRRCSLGIFLPRLPNKRNCSVTGIDDLEQIPADTTDINHLETQPVSSKDSGIGSVAGKLNLSPSQYINEENLPVYPDEINSSDSINIETEEKALIETYQKEISPYENKMGKTCNSQKRTWVQEEEDIHKEKKIRKNEIKFSDTTQDREVSSVLNQRMFLNFGFCFVFLNCGYSQILILVSGRQKIIIST

SEQ ID NO: 913371 - protein, 2316 aa, Homo sapiens
MDGVSSEANEENDNIERPVRRRHSSILKPPRSPLQDLRGGNETVQESNALRNKKNSRRVSFADTIKVFQTESHMKIVRKSEMEETETGENLLLIQNKKLEDNYCEITGMNTLLSAPIHTQMQQKEFSIIEHTRERKHANDQTVIFSDENQMDLTSSHTVMITKGLLDNPISEKSTKIDTTSFLANLKLHTEDSRMKKEVNFSVDQNTSSENKIDFNDFIKRLKTGKCSAFPDVPDKENFEIPIYSKEPNSASSTHQMHVSLKEDENNSNITRLFREKDDGMNFTQCHTANIQTLIPTSSETNSRESKGNDITIYGNDFMDLTFNHTLQILPATGNFSEIENQTQNAMDVTTGYGTKASGNKTVFKSKQNTAFQDLSINSADKIHITRSHIMGAETHIVSQTCNQDARILAMTPESIYSNPSIQGCKTVFYSSCNDAMEMTKCLSNMREEKNLLKHDSNYSKMYCNPDAMSSLTEKTIYSGEENMDITKSHTVAIDNQIFKQDQSNVQIAAAPTPEKEMMLQNLMTTSEDGKMNVNCNSVPHVSKERIQQSLSNPLSISLTDRKTELLSGENTDLTESHTSNLGSQVPLAAYNLAPESTSESHSQSKSSSDECEEITKSRNEPFQRSDIIAKNSLTDTWNKDKDWVLKILPYLDKDSPQSADCNQEIATSHNIVYCGGVLDKQITNRNTVSWEQSLFSTTKPLFSSGQFSMKNHDTAISSHTVKSVLGQNSKLAEPLRKSLSNPTPDYCHDKMIICSEEEQNMDLTKSHTVVIGFGPSELQELGKTNLEHTTGQLTTMNRQIAVKVEKCGKSPIEKSGVLKSNCIMDVLEDESVQKPKFPKEKQNVKIWGRKSVGGPKIDKTIVFSEDDKNDMDITKSYTIEINHRPLLEKRDCHLVPLAGTSETILYTCGQDDMEITRSHTTALECKTVSPDEITTRPMDKTVVFVDNHVELEMTESHTVFIDYQEKERTDRPNFELSQRKSLGTPTVICTPTEESVFFPGNGESDRLVANDSQLTPLEEWSNNRGPVEVADNMELSKSATCKNIKDVQSPGFLNEPLSSKSQRRKSLKLKNDKTIVFSENHKNDMDITQSCMVEIDNESALEDKEDFHLAGASKTILYSCGQDDMEITRSHTTALECKTLLPNEIAIRPMDKTVLFTDNYSDLEVTDSHTVFIDCQATEKILEENPKFGIGKGKNLGVSFPKDNSCVQEIAEKQALAVGNKIVLHTEQKQQLFAATNRTTNEIIKFHSAAMDEKVIGEVVDQACTLEKAQVESCQLNNRDRRNVDFTSSHATAVCGSSDNYSCLPNVISCTDNLEGSAMLLCDKDEEKANYCPVQNDLAYANDFASEYYLESEGQPLSAPCPLLEKEEVIQTSTKGQLDCVITLHKDQDLIKDPRNLLANQTLVYSQDLGEMTKLNSKRVSFKLPKDQMKVYVDDIYVIPQPHFSADQPPLPKKGQSSINKEEVILSKAGNKSLNIIENSSAPICENKPKILNSEEWFAAACKKELKENIQTTNYNTALDFHSNSDVTKQVIQTHVNAGEAPDPVITSNVPCFHSIKPNLNNLNGKTGEFLAFQTVHLPPLPEQLLELGNKAHNDMHIVQATEIHNINIISSNAKDSRDEENKKSHNGAETTSLPPKTVFKDKVRRCSLGIFLPRLPNKRNCSVTGIDDLEQIPADTTDINHLETQPVSSKDSGIGSVAGKLNLSPSQYINEENLPVYPDEINSSDSINIETEEKALIETYQKEISPYENKMGKTCNSQKRTWVQEEEDIHKEKKIRKNEIKFSDTTQDREIFDHHTEEDIDKSANSVLIKNLSRTPSSCSSSLDSIKADGTSLDFSTYRSSQMESQFLRDTICEESLREKLQDGRITIREFFILLQVHILIQKPRQSNLPGNFTVNTPPTPEDLMLSQYVYRPKIQIYREDCEARRQKIEELKLSASNQDKLLVDINKNLWEKMRHCSDKELKAFGIYLNKIKSCFTKMTKVFTHQGKVALYGKLVQSAQNEREKLQIKIDEMDKILKKIDNCLTEMETETKNLEDEEKNNPVEEWDSEMRAAEKELEQLKTEEEELQRNLLELEVQKEQTLAQIDFMQKQRNRTEELLDQLSLSEWDVVEWSDDQAVFTFVYDTIQLTITFEESVVGFPFLDKRYRKIVDVNFQSLLDEDQAPPSSLLVHKLIFQYVEEKESWKKTCTTQHQLPKMLEEFSLVVHHCRLLGEEIEYLKRWGPNYNLMNIDINNNELRLLFSSSAAFAKFEITLFLSAYYPSVPLPSTIQNHVGNTSQDDIATILSKVPLENNYLKNVVKQIYQDLFQDCHFYH

SEQ ID NO: 913372 - protein, 2316 aa, Homo sapiens; identical to SEQ ID NO: 913371

SEQ ID NO: 913373 - protein, 2202 aa, Homo sapiens
MDGVSSEANEENDNIERPVRRRHSSILKPPRSPLQDLRGGNETVQESNALRNKKNSRRVSFADTIKVFQTESHMKIVRKSEMEETETGENLLLIQNKKLEDNYCEITGMNTLLSAPIHTQMQQKEFSIIEHTRERKHANDQTVIFSDENQMDLTSSHTVMITKGLLDNPISEKSTKIDTTSFLANLKLHTEDSRMKKEVNFSVDQNTSSENKIDFNDFIKRLKTGKCSAFPDVPDKENFEIPIYSKEPNSASSTHQMHVSLKEDENNSNITRLFREKDDGMNFTQCHTANIQTLIPTSSETNSRESKGNDITIYGNDFMDLTFNHTLQILPATGNFSEIENQTQNAMDVTTGYGTKASGNKTVFKSKQNTAFQDLSINSADKIHITRSHIMGAETHIVSQTCNQDARILAMTPESIYSNPSIQGCKTVFYSSCNDAMEMTKCLSNMREEKNLLKHDSNYSKMYCNPDAMSSLTEKTIYSGEENMDITKSHTVAIDNQIFKQDQSNVQIAAAPTPEKEMMLQNLMTTSEDGKMNVNCNSVPHVSKERIQQSLSNPLSISLTDRKTELLSGENTDLTESHTSNLGSQVPLAAYNLAPESTSESHSQSKSSSDECEEITKSRNEPFQRSDIIAKNSLTDTWNKDKDWVLKILPYLDKDSPQSADCNQEIATSHNIVYCGGVLDKQITNRNTVSWEQSLFSTTKPLFSSGQFSMKNHDTAISSHTVKSVLGQNSKLAEPLRKSLSNPTPDYCHDKMIICSEEEQNMDLTKSHTVVIGFGPSELQELGKTNLEHTTGQLTTMNRQIAVKVEKCGKSPIEKSGVLKSNCIMDVLEDESVQKPKFPKEKQNVKIWGRKSVGGPKIDKTIVFSEDDKNDMDITKSYTIEINHRPLLEKRDCHLVPLAGTSETILYTCGQDDMEITRSHTTALECKTVSPDEITTRPMDKTVVFVDNHVELEMTESHTVFIDYQEKERTDRPNFELSQRKSLGTPTVICTPTEESVFFPGNGESDRLVANDSQLTPLEEWSNNRGPVEVADNMELSKSATCKNIKDVQSPGFLNEPLSSKSQRRKSLKLKNDKTIVFSENHKNDMDITQSCMVEIDNESALEDKEDFHLAGASKTILYSCGQDDMEITRSHTTALECKTLLPNEIAIRPMDKTVLFTDNYSDLEVTDSHTVFIDCQATEKILEENPKFGIGKGKNLGVSFPKDNSCVQEIAEKQALAVGNKIVLHTEQKQQLFAATNRTTNEIIKFHSAAMDEKVIGEVVDQACTLEKAQVESCQLNNRDRRNVDFTSSHATAVCGSSDNYSCLPNVISCTDNLEGSAMLLCDKDEEKANYCPVQNDLAYANDFASEYYLESEGQPLSAPCPLLEKEEVIQTSTKGQLDCVITLHKDQDLIKDPRNLLANQTLVYSQDLGEMTKLNSKRVSFKLPKDQMKVYVDDIYVIPQPHFSADQPPLPKKGQSSINKEEVILSKAGNKSLNIIENSSAPICENKPKILNSEEWFAAACKKELKENIQTTNYNTALDFHSNSDVTKQVIQTHVNAGEAPDPVITSNVPCFHSIKPNLNNLNGKTGEFLAFQTVHLPPLPEQLLELGNKAHNDMHIVQATEIHNINIISSNAKDSRDEENKKSHNGAETTSLPPKTVFKDKVRRCSLGIFLPRLPNKRNCSVTGIDDLEQIPADTTDINHLETQPVSSKDSGIGSVAGKLNLSPSQYINEENLPVYPDEINSSDSINIETEEKALIETYQKEISPYENKMGKTCNSQKRTWVQEEEDIHKEKKIRKNEIKFSDTTQDREIFDHHTEEDIDKSANSVLIKNLSRTPSSCSSSLDSIKADGTSLDFSTYRSSQMESQFLRDTICEESLREKLQDGRITIREFFILLQVHILIQKPRQSNLPGNFTVNTPPTPEDLMLSQYVYRPKIQIYREDCEARRQKIEELKLSASNQDKLLVDINKNLWEKMRHCSDKELKAFGIYLNKIKSCFTKMTKVFTHQGKVALYGKLVQSAQNEREKLQIKIDEMDKILKKIDNCLTEMETETKNLEDEEKNNPVEEWDSEMRAAEKELEQLKTEEEELQRNLLELEVQKEQTLAQIDFMQKQRNRTEELLDQLSLSEWDVVEWSDDQAVFTFVYDTIQLTITFEESVVGFPFLDKRYRKIVDVNFQSLLDEDQAPPSSLLVHKLIFQYVEEKESWKKTCTTQHQLPKVKPD

SEQ ID NO: 913374 - protein, 558 aa, Homo sapiens
VRFEYFTGGEPGVVSGLLEAAVCFRSKETQSVWTPNKSAQNLSRRFAAAEKFSSKMDGVSSEANEENDNIERPVRRRHSSILKPPRSPLQDLRGGNERVQESNALRNKKNSRRVSFADTIKVFQTESHMKIVRKSEMEETEAGENLLLIQNKKLEDNYCEITGMNTLLSAPIHTQMQQKEFSIIEHTRERKHANDQTVIFSDENQMDLTSSHTVMITKGLLDNPISEKSTKIDTTSFLANLKLHTEDSRMKKEVNFSVDQNTSSENKIDFNDFIKRLKTGKCSAFPDVPDKENFEIPIYSKEPNSASSTHQMHVSLKEDENNSNITRLFREKDDGMNFTQCHTANIQTLIPTSSETNSRESKGNDITIYGNDFMDLTFNHTLQILPATGNFSEIENQTQNAMDVTTGYGTKASGNKTVFKSKQNTAFQDLSINSADKIHITRSHIMGAETHIVSQTCNQDARILAMTPESIYSNPSIQGCKTVFYSSCNDAMEMTKCLSNMREEKNLLKHDSNYSKMYCNPDAMSSLTEKTIYSGEENMDITKSHTVAIDNQIFKQES

SEQ ID NO: 913375 - protein, 2316 aa, Homo sapiens; identical to SEQ ID NO: 913371

SEQ ID NO: 913376 - protein, 38 aa, Homo sapiens
MGLGLDLEEWMDGLFLDKWWISFETKLRCLSQRWCLSA

SEQ ID NO: 913377 - protein, 141 aa, Homo sapiens
CDQLHLRSRQGALYVDVIRVNSYYSWYRNYGTWELIQLQLTAQFENWCKTSQSHYSERYGVETLVRLHQDPPLMFSEEDRKSLLEQYHLGLDQKRRKYVVGELIWNFADFMTNQSKDEGKTGPHYGFTFGIHSLFQRRVKG

SEQ ID NO: 913378 - protein, 128 aa, Homo sapiens
CDQLHLRSRQGALYVDVIRVNSYYSWYRNYGTWELIQLQLTAQFENWCKTSQSHYSERYGVETLVRLHQDPPLMFSEEDRKSLLEQYHLGLDQKRRKYVVGELIWNFADFMTNQCVSFLVGNENSANL

SEQ ID NO: 913379 - protein, 128 aa, Homo sapiens; identical to SEQ ID NO: 913378

SEQ ID NO: 913380 - protein, 141 aa, Homo sapiens; identical to SEQ ID NO: 913377

SEQ ID NO: 913381 - protein, 128 aa, Homo sapiens; identical to SEQ ID NO: 913378

SEQ ID NO: 913382 - protein, 383 aa, Homo sapiens
MLSRKKTKNEVSKPAEVQGKYVKKETSPLLRNLMPSFIRHGPTIPRRTDICLPDSSPNAFSTSGDVVSRNQSFLRTPIQRTPHEIMRRESNRLSAPSYLARSLADVPREYGSSQSFVTEVSFAVENGDSGSRYYYSDNFFDGQRKRPLGDRAHEDYRYYEYNHDLFQRMPQNQGRHASGIGRVAATSLGNLTNHGSEDLPLPPGWSVDWTMRGRKYYIDHNTNTTHWSHPLEREGLPPGWERVESSEFGTYYVDHTNKKAQYRHPCAPSVPRYDQPPPVTYQPQQTERNQSLLVPANPYHTAEIPDWLQVYARAPVKYDHILKWELFQLADLDTYQGMLKLLFMKELEQIVKMYEAYRQALLTELENRKQRQQWYAQQHGKNF

SEQ ID NO: 913383 - protein, 160 aa, Homo sapiens
MVPPQTCWGVLSTQCIPPLCLLFPTHGFLLTRAAFLLLLYCSSLWGPLCYTKDLVILKFGAPPGGILLRPPPFCFFFFFFFFFFFVFFFVFVFVFYFLSWNLTLSLRLECSGGTILAHCNLLPGSSYSLASASPVAGTTGACHHTWLIFCIFSRDGASPC

SEQ ID NO: 913384 - protein, 383 aa, Homo sapiens; identical to SEQ ID NO: 913382

SEQ ID NO: 913385 - protein, 358 aa, Homo sapiens
MLSRKKTKNEVSKPAEVQGKYVKKETSPLLRNASRCASCLQTLRVSLDCAASCANSGAEFLSPAAGCRLEKILCLHSSGMVQQFQDELISVFQIQALMPFQLDSGSRYYYSDNFFDGQRKRPLGDRAHEDYRYYEYNHDLFQRMPQNQGRHASGIGRVAATSLGNLTNHGSEDLPLPPGWSVDWTMRGRKYYIDHNTNTTHWSHPLEREGLPPGWERVESSEFGTYYVDHTNKKAQYRHPCAPSVPRYDQPPPVTYQPQQTERNQSLLVPANPYHTAEIPDWLQVYARAPVKYDHILKWELFQLADLDTYQGMLKLLFMKELEQIVKMYEAYRQALLTELENRKQRQQWYAQQHGKNF

SEQ ID NO: 913386 - protein, 367 aa, Homo sapiens
MLSRKKTKNEVSKPAEVQGKYVKKETSPLLRNLMPSFIRHGPTIPRRTDICLPDSSPNAFSTSGDVVSRNQSFLRTPIQRTPHEIMRRESNRLSAPSYLARSLADVPREYGSSQSFVTEVSFAVENGRKRPLGDRAHEDYRYYEYNHDLFQRMPQNQGRHASGIGRVAATSLGNLTNHGSEDLPLPPGWSVDWTMRGRKYYIDHNTNTTHWSHPLEREGLPPGWERVESSEFGTYYVDHTNKKAQYRHPCAPSVPRYDQPPPVTYQPQQTERNQSLLVPANPYHTAEIPDWLQVYARAPVKYDHILKWELFQLADLDTYQGMLKLLFMKELEQIVKMYEAYRQALLTELENRKQRQQWYAQQHGKNF

SEQ ID NO: 913387 - protein, 211 aa, Homo sapiens
MLSRKKTKNEVSKPAEVQGKYVKKETSPLLRNLMPSFIRHGPTIPRRTDICLPDSSPNAFSTSGDVVSRNQSFLRTPIQRTPHEIMRRESNRLSAPSYLARSLADVPREYGSSQSFVTEVSFAVENGDSGSRYYYSDNFFDGQRKRPLGDRAHEDYRYYEYNHDLFQRMPQNQGRHASEDGLSPRGRGCRVKIAPLALQPERERARPCLKK

SEQ ID NO: 913388 - protein, 225 aa, Homo sapiens
MALARRRWAFLTASPSSVAERADFREGTDQRLRGSSARPRASSRRMLSRKKTKNEVSKPAEVQGKYVKKETSPLLRNLMPSFIRHGPTIPRRTDICLPDSSPNAFSTSGDVVSRNQSFLRTPIQRTPHEIMRRESNRLSAPSYLARSLADVPREYGSSQSFVTEVSFAVENGDSGSRYYYSDNFFDGQRKRPLGDRAHEDYRYYEYNHDLFQRMPQNQGRHASVR

SEQ ID NO: 913389 - protein, 383 aa, Homo sapiens; identical to SEQ ID NO: 913382

SEQ ID NO: 913390 - protein, 428 aa, Homo sapiens
MALARRRWAFLTASPSSVAERADFREGTDQRLRGSSARPRASSRRMLSRKKTKNEVSKPAEVQGKYVKKETSPLLRNLMPSFIRHGPTIPRRTDICLPDSSPNAFSTSGDVVSRNQSFLRTPIQRTPHEIMRRESNRLSAPSYLARSLADVPREYGSSQSFVTEVSFAVENGDSGSRYYYSDNFFDGQRKRPLGDRAHEDYRYYEYNHDLFQRMPQNQGRHASGIGRVAATSLGNLTNHGSEDLPLPPGWSVDWTMRGRKYYIDHNTNTTHWSHPLEREGLPPGWERVESSEFGTYYVDHTNKKAQYRHPCAPSVPRYDQPPPVTYQPQQTERNQSLLVPANPYHTAEIPDWLQVYARAPVKYDHILKWELFQLADLDTYQGMLKLLFMKELEQIVKMYEAYRQALLTELENRKQRQQWYAQQHGKNF

SEQ ID NO: 913391 - protein, 383 aa, Homo sapiens; identical to SEQ ID NO: 913382

SEQ ID NO: 913392 - protein, 180 aa, Homo sapiens
MLSRKKTKNEVSKPAEVQGKYVKKETSPLLRNLMPSFIRHGPTIPRRTDICLPDSSPNAFSTSGDVVSRNQSFLRTPIQRTPHEIMRRESNRLSAPSYLARSLADVPREYGSSQSFVTEVSFAVENGDSGSRYYYSDNFFDGQRKRPLGDRAHEDYRYYEYNHDLFQRMPQNQGRHASVR

SEQ ID NO: 913393 - protein, 582 aa, Homo sapiens
MMKLRHKNKKPGEGSKGHKKISWPYPQPAKQNGKKATSKVPSAPHFVHPNDHANREAELKKKWVEEMREKQQAAREQERQKRRTIESYCQDVLRRQEEFEHKEEVLQELNMFPQLDDEATRKAYYKEFRKVVEYSDVILEVLDARDPLGCRCFQMEEAVLRAQGNKKLVLVLNKIDLVPKEVVEKWLDYLRNELPTVAFKASTQHQVKNLNRCSVPVDQASESLLKSKACFGAENLMRVLGNYCRLGEVRTHIRVGVVGLPNVGKSSLINSLKRSRACSVGAVPGITKFMQEVYLDKFIRLLDAPGIVPGPNSEVGTILRNCVHVQKLADPVTPVETILQRCNLEEISNYYGVSGFQTTEHFLTAVAHRLGKKKKGGLYSQEQAAKAVLADWVSGKISFYIPPPATHTLPTHLSAEIVKEMTEVFDIEDTEQANEDTMECLATGESDELLGDTDPLEMEIKLLHSPMTKIADAIENKTTVYKIGDLTGYCTNPNRHQMGWAKRNVDHRPKSNSMVDVCSVDRRSVLQRIMETDPLQQGQALASALKNKKKMQKRADKIASKLSDSMMSALDLSGNADDGVGD

SEQ ID NO: 913394 - protein, 582 aa, Homo sapiens; identical to SEQ ID NO: 913393

SEQ ID NO: 913395 - protein, 582 aa, Homo sapiens; identical to SEQ ID NO: 913393

SEQ ID NO: 913396 - protein, 582 aa, Homo sapiens; identical to SEQ ID NO: 913393

SEQ ID NO: 913397 - protein, 582 aa, Homo sapiens; identical to SEQ ID NO: 913393

SEQ ID NO: 913398 - protein, 582 aa, Homo sapiens; identical to SEQ ID NO: 913393

SEQ ID NO: 913399 - protein, 582 aa, Homo sapiens; identical to SEQ ID NO: 913393

SEQ ID NO: 913400 - protein, 563 aa, Homo sapiens
MGRRCAHQPAKQNGKKATSKVPSAPHFVHPNDHANREAELKKKWVEEMREKQQAAREQERQKRRTIESYCQDVLRRQEEFEHKEEVLQELNMFPQLDDEATRKAYYKEFRKVVEYSDVILEVLDARDPLGCRCFQMEEAVLRAQGNKKLVLVLNKIDLVPKEVVEKWLDYLRNELPTVAFKASTQHQVKNLNRCSVPVDQASESLLKSKACFGAENLMRVLGNYCRLGEVRTHIRVGVVGLPNVGKSSLINSLKRSRACSVGAVPGITKFMQEVYLDKFIRLLDAPGIVPGPNSEVGTILRNCVHVQKLADPVTPVETILQRCNLEEISNYYGVSGFQTTEHFLTAVAHRLGKKKKGGLYSQEQAAKAVLADWVSGKISFYIPPPATHTLPTHLSAEIVKEMTEVFDIEDTEQANEDTMECLATGESDELLGDTDPLEMEIKLLHSPMTKIADAIENKTTVYKIGDLTGYCTNPNRHQMGWAKRNVDHRPKSNSMVDVCSVDRRSVLQRIMETDPLQQGQALASALKNKKKMQKRADKIASKLSDSMMSALDLSGNADDGVGD

SEQ ID NO: 913401 - protein, 466 aa, Homo sapiens
YPFPALISWSSALQVVEYSDVILEVLDARDPLGCRCFQMEEAVLRAQGNKKLVLVLNKIDLVPKEVVEKWLDYLRNELPTVAFKASTQHQVKNLNRCSVPVDQASESLLKSKACFGAENLMRVLGNYCRLGEVRTHIRVGVVGLPNVGKSSLINSLKRSRACSVGAVPGITKFMQEVYLDKFIRLLDAPGIVPGPNSEVGTILRNCVHVQKLADPVTPVETILQRCNLEEISNYYGVSGFQTTEHFLTAVAHRLGKKKKGGLYSQEQAAKAVLADWVSGKISFYIPPPATHTLPTHLSAEIVKEMTEVFDIEDTEQANEDTMECLATGESDELLGDTDPLEMEIKLLHSPMTKIADAIENKTTVYKIGDLTGYCTNPNRHQMGWAKRNVDHRPKSNSMVDVCSVDRRSVLQRIMETDPLQQGQALASALKNKKKMQKRADKIASKLSDSMMSALDLSGNADDGVGD

SEQ ID NO: 913402 - protein, 582 aa, Homo sapiens; identical to SEQ ID NO: 913393

SEQ ID NO: 913403 - protein, 153 aa, Homo sapiens
SSPILTGREQADLNLSAFKLVIMMKLRHKNKKPGEGSKGHKKISWPYPQPAKQNGKKATSKVPSAPHFVHPNDHANREAELKKKWVEEMREKQQAAREQERQKRRTIESYCQDVLRRQEEFEHKEEVLQELNMFPQAGIIGMNHRVRPYIFVF

SEQ ID NO: 913404 - protein, 582 aa, Homo sapiens; identical to SEQ ID NO: 913393

SEQ ID NO: 913405 - protein, 582 aa, Homo sapiens; identical to SEQ ID NO: 913393

SEQ ID NO: 913406 - protein, 582 aa, Homo sapiens; identical to SEQ ID NO: 913393

SEQ ID NO: 913407 - protein, 582 aa, Homo sapiens; identical to SEQ ID NO: 913393

SEQ ID NO: 913408 - protein, 582 aa, Homo sapiens; identical to SEQ ID NO: 913393

SEQ ID NO: 913409 - protein, 604 aa, Homo sapiens
SSPILTGREQADLNLSAFKLVIMMKLRHKNKKPGEGSKGHKKISWPYPQPAKQNGKKATSKVPSAPHFVHPNDHANREAELKKKWVEEMREKQQAAREQERQKRRTIESYCQDVLRRQEEFEHKEEVLQELNMFPQLDDEATRKAYYKEFRKVVEYSDVILEVLDARDPLGCRCFQMEEAVLRAQGNKKLVLVLNKIDLVPKEVVEKWLDYLRNELPTVAFKASTQHQVKNLNRCSVPVDQASESLLKSKACFGAENLMRVLGNYCRLGEVRTHIRVGVVGLPNVGKSSLINSLKRSRACSVGAVPGITKFMQEVYLDKFIRLLDAPGIVPGPNSEVGTILRNCVHVQKLADPVTPVETILQRCNLEEISNYYGVSGFQTTEHFLTAVAHRLGKKKKGGLYSQEQAAKAVLADWVSGKISFYIPPPATHTLPTHLSAEIVKEMTEVFDIEDTEQANEDTMECLATGESDELLGDTDPLEMEIKLLHSPMTKIADAIENKTTVYKIGDLTGYCTNPNRHQMGWAKRNVDHRPKSNSMVDVCSVDRRSVLQRIMETDPLQQGQALASALKNKKKMQKRADKIASKLSDSMMSALDLSGNADDGVGD

SEQ ID NO: 913410 - protein, 582 aa, Homo sapiens; identical to SEQ ID NO: 913393

SEQ ID NO: 913411 - protein, 565 aa, Homo sapiens
MMKLRHKNKKPGEGSKGHKKISWPYPQPAKQNGKKATSKVPSAPHFVHPNDHANREAELKKKWVEEMREKQQAAREQERQKRRTIESYCQDVLRRQEEFEHKEEVLQELNMFPQLDDEATRKAYYKEFRKVVEYSDVILEVLDARDPLGCRCFQMEEAVLRAQGNKKLVLVLNKIDLVPKEVVEKWLDYLRNELPTVAFKASTQHQVKNLNRCSVPVDQASESLLKSKACFGAENLMRVLGNYCRLGEVRTHIRVGVVGLPNVGKSSLINSLKRSRACSVGAVPGITKFMQEVYLDKFIRLLDAPGIVPGPNSEVGTILRNCVHVQKLADPVTPVETILQRCNLEEISNYYGVSGFQTTEHFLTAVAHRLGKKKKGGLYSQEQAAKAVLADWVSGKISFYIPPPATHTLPTHLSAEIVKEMTEVFDIEDTEQANEDTMECLATGESDELLGDTDPLEMEIKLLHSPMTKIADAIENKTTVYKIGDLTGYCTNPNRHQMGWAKRNVDHRPKSNSMVDVCSVDRRSVLQRIMETDPLQQGQALASALKNKKKMQKRAEKSQQAVVQK

SEQ ID NO: 913412 - protein, 1214 aa, Homo sapiens
MKCFFPVLSCLAVLGVVSAQRQVTVQEGPLYRTEGSHITIWCNVSGYQGPSEQNFQWSIYLPSSPEREVQIVSTMDSSFPYAIYTQRVRGGKIFIERVQGNSTLLHITDLQARDAGEYECHTPSTDKQYFGSYSAKMNLVVIPDSLQTTAMPQTLHRVEQDPLELTCEVASETIQHSHLSVAWLRQKVGEKPVEVISLSRDFMLHSSSEYAQRQSLGEVRLDKLGRTTFRLTIFHLQPSDQGEFYCEAAEWIQDPDGSWYAMTRKRSEGAVVNVQPTDKEFTVRLETEKRLHTVGEPVEFRCILEAQNVPDRYFAVSWAFNSSLIATMGPNAVPVLNSEFAHREARGQLKVAKESDSVFVLKIYHLRQEDSGKYNCRVTEREKTVTGEFIDKESKRPKNIPIIVLPLTDNWVVKVPQHHQLLSQGHLESSISVEVASNASVILEGEDLRFSCSVRTAGRPQGRFSVIWQLVDRQNRRSNIMWLDRDGTVQPGSSYWERSSFGGVQMEQVQPNSFSLGIFNSRKEDEGQYECHVTEWVRAVDGEWQIVGERRASTPISITALEMGFAVTAISRTPGVTYSDSFDLQCIIKPHYPAWVPVSVTWRFQPVGTVEFHDLVTFTRDGGVQWGDRSSSFRTRTAIEKAESSNNVRLSISRASDTEAGKYQCVAELWRKNYNNTWTRLAERTSNLLEIRVLQPVTKLQVSKSKRTLTLVENKPIQLNCSVKSQTSQNSHFAVLWYVHKPSDADGKLILKTTHNSAFEYGTYAEEEGLRARLQFERHVSGGLFSLTVQRAEVSDSGSYYCHVEEWLLSPNYAWYKLAEEVSGRTEVTVKQPDSRLRLSQAQGNLSVLETRQVQLECVVLNRTSITSQLMVEWFVWKPNHPERETVARLSRDATFHYGEQAAKNNLKGRLHLESPSPGVYRLFIQNVAVQDSGTYSCHVEEWLPSPSGMWYKRAEDTAGQTALTVMRPDASLQVDTVVPNATVSEKAAFQLDCSIVSRSSQDSRFAVAWYSLRTKAGGKRSSPGLEEQEEEREEEEEEDDDDDDDPTERTALLSVGPDAVFGPEGSPWEGRLRFQRLSPVLYRLTVLQASPQDTGNYSCHVEEWLPSPQKEWYRLTEEESAPIGIRVLDTSPTLQSIICSNDALFYFVFFYPFPIFGILIITILLVRFKSRNSSKNSDGKNGVPLLWIKEPHLNYSPTCLEPPVLSIHPGAID

SEQ ID NO: 913413 - protein, 1194 aa, Homo sapiens
MKCFFPVLSCLAVLGVVSAQRQVTVQEGPLYRTEGSHITIWCNVSGYQGPSEQNFQWSIYLPSSPEREVQIVSTMDSSFPYAIYTQRVRGGKIFIERVQGNSTLLHITDLQARDAGEYECHTPSTDKQYFGSYSAKMNLVVIPDSLQTTAMPQTLHRVEQDPLELTCEVASETIQHSHLSVAWLRQKVGEKPVEVISLSRDFMLHSSSEYAQRQSLGEVRLDKLGRTTFRLTIFHLQPSDQGEFYCEAAEWIQDPDGSWYAMTRKRSEGAVVNVQPTDKEFTVRLETEKRLHTVGEPVEFRCILEAQNVPDRYFAVSWAFNSSLIATMGPNAVPVLNSEFAHREARGQLKVAKESDSVFVLKIYHLRQEDSGKYNCRVTEREKTVTGEFIDKESKRPKNIPIIVLPLKSSISVEVASNASVILEGEDLRFSCSVRTAGRPQGRFSVIWQLVDRQNRRSNIMWLDRDGTVQPGSSYWERSSFGGVQMEQVQPNSFSLGIFNSRKEDEGQYECHVTEWVRAVDGEWQIVGERRASTPISITALEMGFAVTAISRTPGVTYSDSFDLQCIIKPHYPAWVPVSVTWRFQPVGTVEFHDLVTFTRDGGVQWGDRSSSFRTRTAIEKAESSNNVRLSISRASDTEAGKYQCVAELWRKNYNNTWTRLAERTSNLLEIRVLQPVTKLQVSKSKRTLTLVENKPIQLNCSVKSQTSQNSHFAVLWYVHKPSDADGKLILKTTHNSAFEYGTYAEEEGLRARLQFERHVSGGLFSLTVQRAEVSDSGSYYCHVEEWLLSPNYAWYKLAEEVSGRTEVTVKQPDSRLRLSQAQGNLSVLETRQVQLECVVLNRTSITSQLMVEWFVWKPNHPERETVARLSRDATFHYGEQAAKNNLKGRLHLESPSPGVYRLFIQNVAVQDSGTYSCHVEEWLPSPSGMWYKRAEDTAGQTALTVMRPDASLQVDTVVPNATVSEKAAFQLDCSIVSRSSQDSRFAVAWYSLRTKAGGKRSSPGLEEQEEEREEEEEEDDDDDDDPTERTALLSVGPDAVFGPEGSPWEGRLRFQRLSPVLYRLTVLQASPQDTGNYSCHVEEWLPSPQKEWYRLTEEESAPIGIRVLDTSPTLQSIICSNDALFYFVFFYPFPIFGILIITILLVRFKSRNSSKNSDGKNGVPLLWIKEPHLNYSPTCLEPPVLSIHPGAID

SEQ ID NO: 913414 - protein, 1047 aa, Homo sapiens
SLGHGSGLHRVEQDPLELTCEVASETIQHSHLSVAWLRQKVGEKPVEVISLSRDFMLHSSSEYAQRQSLGEVRLDKLGRTTFRLTIFHLQPSDQGEFYCEAAEWIQDPDGSWYAMTRKRSEGAVVNVQPTDKEFTVRLETEKRLHTVGEPVEFRCILEAQNVPDRYFAVSWAFNSSLIATMGPNAVPVLNSEFAHREARGQLKVAKESDSVFVLKIYHLRQEDSGKYNCRVTEREKTVTGEFIDKESKRPKNIPIIVLPLKSSISVEVASNASVILEGEDLRFSCSVRTAGRPQGRFSVIWQLVDRQNRRSNIMWLDRDGTVQPGSSYWERSSFGGVQMEQVQPNSFSLGIFNSRKEDEGQYECHVTEWVRAVDGEWQIVGERRASTPISITALEMGFAVTAISRTPGVTYSDSFDLQCIIKPHYPAWVPVSVTWRFQPVGTVEFHDLVTFTRDGGVQWGDRSSSFRTRTAIEKAESSNNVRLSISRASDTEAGKYQCVAELWRKNYNNTWTRLAERTSNLLEIRVLQPVTKLQVSKSKRTLTLVENKPIQLNCSVKSQTSQNSHFAVLWYVHKPSDADGKLILKTTHNSAFEYGTYAEEEGLRARLQFERHVSGGLFSLTVQRAEVSDSGSYYCHVEEWLLSPNYAWYKLAEEVSGRTEVTVKQPDSRLRLSQAQGNLSVLETRQVQLECVVLNRTSITSQLMVEWFVWKPNHPERETVARLSRDATFHYGEQAAKNNLKGRLHLESPSPGVYRLFIQNVAVQDSGTYSCHVEEWLPSPSGMWYKRAEDTAGQTALTVMRPDASLQVDTVVPNATVSEKAAFQLDCSIVSRSSQDSRFAVAWYSLRTKAGGKRSSPGLEEQEEEREEEEEEDDDDDDDPTERTALLSVGPDAVFGPEGSPWEGRLRFQRLSPVLYRLTVLQASPQDTGNYSCHVEEWLPSPQKEWYRLTEEESAPIGIRVLDTSPTLQSIICSNDALFYFVFFYPFPIFGILIITILLVRFKSRNSSKNSDGKNGVPLLWIKEPHLNYSPTCLEPPVLSIHPGAID

SEQ ID NO: 913415 - protein, 1214 aa, Homo sapiens; identical to SEQ ID NO: 913412

SEQ ID NO: 913416 - protein, 1214 aa, Homo sapiens; identical to SEQ ID NO: 913412

SEQ ID NO: 913417 - protein, 1214 aa, Homo sapiens; identical to SEQ ID NO: 913412

SEQ ID NO: 913418 - protein, 1093 aa, Homo sapiens
MCYIRPPELDNNHIMNNHIMNNHIMNNHIMVIVAKMNLVVIPDSLQTTAMPQTLHRVEQDPLELTCEVASETIQHSHLSVAWLRQKVGEKPVEVISLSRDFMLHSSSEYAQRQSLGEVRLDKLGRTTFRLTIFHLQPSDQGEFYCEAAEWIQDPDGSWYAMTRKRSEGAVVNVQPTDKEFTVRLETEKRLHTVGEPVEFRCILEAQNVPDRYFAVSWAFNSSLIATMGPNAVPVLNSEFAHREARGQLKVAKESDSVFVLKIYHLRQEDSGKYNCRVTEREKTVTGEFIDKESKRPKNIPIIVLPLKSSISVEVASNASVILEGEDLRFSCSVRTAGRPQGRFSVIWQLVDRQNRRSNIMWLDRDGTVQPGSSYWERSSFGGVQMEQVQPNSFSLGIFNSRKEDEGQYECHVTEWVRAVDGEWQIVGERRASTPISITALEMGFAVTAISRTPGVTYSDSFDLQCIIKPHYPAWVPVSVTWRFQPVGTVEFHDLVTFTRDGGVQWGDRSSSFRTRTAIEKAESSNNVRLSISRASDTEAGKYQCVAELWRKNYNNTWTRLAERTSNLLEIRVLQPVTKLQVSKSKRTLTLVENKPIQLNCSVKSQTSQNSHFAVLWYVHKPSDADGKLILKTTHNSAFEYGTYAEEEGLRARLQFERHVSGGLFSLTVQRAEVSDSGSYYCHVEEWLLSPNYAWYKLAEEVSGRTEVTVKQPDSRLRLSQAQGNLSVLETRQVQLECVVLNRTSITSQLMVEWFVWKPNHPERETVARLSRDATFHYGEQAAKNNLKGRLHLESPSPGVYRLFIQNVAVQDSGTYSCHVEEWLPSPSGMWYKRAEDTAGQTALTVMRPDASLQVDTVVPNATVSEKAAFQLDCSIVSRSSQDSRFAVAWYSLRTKAGGKRSSPGLEEQEEEREEEEEEDDDDDDDPTERTALLSVGPDAVFGPEGSPWEGRLRFQRLSPVLYRLTVLQASPQDTGNYSCHVEEWLPSPQKEWYRLTEEESAPIGIRVLDTSPTLQSIICSNDALFYFVFFYPFPIFGILIITILLVRFKSRNSSKNSDGKNGVPLLWIKEPHLNYSPTCLEPPVLSIHPGAID

SEQ ID NO: 913419 - protein, 988 aa, Homo sapiens
MKCFFPVLSCLAVLGVVSAQRQVTVQEGPLYRTEGSHITIWCNVSGYQGPSEQNFQWSIYLPSSPEREVQIVSTMDSSFPYAIYTQRVRGGKIFIERVQGNSTLLHITDLQARDAGEYECHTPSTDKQYFGSYSAKMNLVVIPDSLQTTAMPQTLHRVEQDPLELTCEVASETIQHSHLSVAWLRQKVGEKPVEVISLSRDFMLHSSSEYAQRQSLGEVRLDKLGRTTFRLTIFHLQPSDQGEFYCEAAEWIQDPDGSWYAMTRKRSEGAVVNVQPTDKEFTVRLETEKRLHTVGEPVEFRCILEAQNVPDRYFAVSWAFNSSLIATMGPNAVPVLNSEFAHREARGQLKVAKESDSVFVLKIYHLRQEDSGKYNCRVTEREKTVTGEFIDKESKRPKNIPIIVLPLKSSISVEVASNASVILEGEDLRFSCSVRTAGRPQGRFSVIWQLVDRQNRRSNIMWLDRDGTVQPGSSYWERSSFGGVQMEQVQPNSFSLGIFNSRKEDEGQYECHVTEWVRAVDGEWQIVGERRASTPISITALEMGFAVTAISRTPGVTYSDSFDLQCIIKPHYPAWVPVSVTWRFQPVGTVEFHDLVTFTRDGGVQWGDRSSSFRTRTAIEKAESSNNVRLSISRASDTEAGKYQCVAELWRKNYNNTWTRLAERTSNLLEIRVLQPVTKLQVSKSKRTLTLVENKPIQLNCSVKSQTSQNSHFAVLWYVHKPSDADGKLILKTTHNSAFEYGTYAEEEGLRARLQFERHVSGGLFSLTVQRAEVSDSGSYYCHVEEWLLSPNYAWYKLAEEVSGRTEVTVKQPDSRLRLSQAQGNLSVLETRQVQLECVVLNRTSITSQLMVEWFVWKPNHPERETVARLSRDATFHYGEQAAKNNLKGRLHLESPSPGVYRLFIQNVAVQDSGTYSCHVEEWLPSPSGMWYKRAEDTAGQTALTVMRPGEGPRPQASTPSGVSHLSILFYALDKISLLINYLQLNKK

SEQ ID NO: 913420 - protein, 188 aa, Homo sapiens
MKVASGSTATAAAGPSCALKAGKTASGAGEVVRCLSEQSVAISRCAGGAGARLPALLDEQQVNVLLYDMNGCYSRLKELVPTLPQNRKVSKVEILQHVIDYIRDLQLELNSESEVGTPGGRGLPVRAPLSTLNGEISALTAEGGMRSCGRSHLVSLKRLPQGPADPSHPGGKRNYVLCGSPPNAPRRI

SEQ ID NO: 913421 - protein, 66 aa, Homo sapiens
PVPGPAQHPLNGREPRAAGEITHYSDLEGKEEEQDRSAATAPLTAFQPGAEAEALARRGRSSLHTY

SEQ ID NO: 913422 - protein, 149 aa, Homo sapiens
MKVASGSTATAAAGPSCALKAGKTASGAGEVVRCLSEQSVAISRCAGGAGARLPALLDEQQVNVLLYDMNGCYSRLKELVPTLPQNRKVSKVEILQHVIDYIRDLQLELNSESEVGTPGGRGLPVRAPLSTLNGEISALTAEVRSRSDH

SEQ ID NO: 913423 - protein, 188 aa, Homo sapiens; identical to SEQ ID NO: 913420

SEQ ID NO: 913424 - protein, 138 aa, Homo sapiens
MKVASGSTATAAAGPSCALKAGKTASGAGEVVRCLSEQSVAISRCAGGAGARLPALLDEQQVNVLLYDMNGCYSRLKELVPTLPQNRKVSKVEILQHVIDYIRDEQDRSAATAPLTAFQPGAEAEALARRGRSSLHTY

SEQ ID NO: 913425 - protein, 188 aa, Homo sapiens; identical to SEQ ID NO: 913420

SEQ ID NO: 913426 - protein, 149 aa, Homo sapiens; identical to SEQ ID NO: 913422

SEQ ID NO: 913427 - protein, 175 aa, Homo sapiens
MKVASGSTATAAAGPSCALKAGKTASGAGEVVRCLSEQSVAISRCAGGAGARLPALLDEQQVNVLLYDMNGCYSRLKELVPTLPQNRKVSKVEILQHVIDYIRDLQLELNSESEVGTPGGRGLPVRAPLSTLNGEISALTAEGGMRSCGRSHLVSLRHWRGEGAPLCTPTSHQRL

SEQ ID NO: 913428 - protein, 1353 aa, Homo sapiens
VTPRAAWLGLGFRGSAVLGLCWQPRSPPSRAAGMMNRTTPDQELVPASEPVWERPWSVEEIRRSSQSWSLAADAGLLQFLQEFSQQTISRTHEIKKQVDGLIRETKATDCRLHNVFNDFLMLSNTQFIENRVYDEEVEEPVLKAEAEKTEQEKTREQKEVDLIPKVQEAVNYGLQVLDSAFEQLDIKAGNSDSEEDDANGRVELILEPKDLYIDRPLPYLIGSKLFMEQEDVGLGELSSEEGSVGSDRGSIVDTEEEKEEEESDEDFAHHSDNEQNQHTTQMSDEEEDDDGCDLFADSEKEEEDIEDIEENTRPKRSRPTSFADELAARIKGDAMGRVDEEPTTLPSGEAKPRKTLKEKKERRTPSDDEEDNLFAPPKLTDEDFSPFGSGGGLFSGGKGLFDDEDEESDLFTEASQDRQAGASVKEESSSSKPGKKIPAGAVSVFLGDTDVFGAASVPSLKEPQKPEQPTPRKSPYGPPPTGLFDDDDGDDDDDFFSAPHSKPSKTRKVQSTADIFGDEEGDLFKEKAVASPEATVSQTDENKARAEKKVTLSSSKNLKPSSETKTQKGLFSDEEDSEDLFSSQSASNLKGASLLPGKLPTSVSLFDDEDEEDNLFGGTAAKKQTLSLQAQREEKAKASELSKKKASALLFSSDEEDQWNIPASQTHLASDSRSKGEPRDSGTLQSQEAKAVKKTSLFEEDKEDDLFAIAKDSQKKTQRVSLLFEDDVDSGGSLFGSPPTSVPPATKKKETVSEAPPLLFSDEEEKEAQLGVKSVDKKVESAKESLKFGRTDVAESEKEGLLTRSAQETVKHSDLFSSSSPWDKGTKPRTKTVLSLFDEEEDKMEDQNIIQAPQKEVGKGCDPDAHPKSTGVFQDEELLFSHKLQKDNDPDVDLFAGTKKTKLLEPSVGSLFGDDEDDDLFSSAKSQPLVQEKKRVVKKDHSVNSFKNQKHPESIQGSKEKGIWKPETPQANLAINPAALLPTAASQISEVKPVLPELAFPSSEHRRSHGLESVPVLPGSGEAGVSFDLPAQADTLHSANKSRVKMRGKRRPQTRAARRLAAQESSEAEDMSVPRGPIAQWADGAISPNGHRPQLRAASGEDSTEEALAAAAAPWEGGPVPGVDTSPFAKSLGHSRGEADLFDSGDIFSTGTGSQSVERTKPKAKIAENPANPPVGGKAKSPMFPALGEASSDDDLFQSAKPKPAKKTNPFPLLEDEDDLFTDQKVKKNETKSSSQQDVILTTQDIFEDDIFATEAIKPSQKTREKEKTLESNLFDDNIDIFADLTVKPKEKSKKKVEAKSIFDDDMDDIFSTGIQAKTTKPKSRSAQAAPEPRFEHKVSNIFDDPLNAFGGQ

SEQ ID NO: 913429 - protein, 1374 aa, Homo sapiens
VTPRAAWLGLGFRGSAVLGLCWQPRSPPSRAAGMMNRTTPDQELVPASEPVWERPWSVEEIRRSSQSWSLAADAGLLQFLQEFSQQTISRTHEIKKQVDGLIRETKATDCRLHNVFNDFLMLSNTQFIENRVYDEEVEEPVLKAEAEKTEQEKTREQKEVDLIPKVQEAVNYGLQVLDSAFEQLDIKAGNSDSEEDDANGRVELILEPKDLYIDRPLPYLIGSKLFMEQEDVGLGELSSEEGSVGSDRGSIVDTEEEKEEEESDEDFAHHSDNEQNQHTTQMSDEEEDDDGCDLFADSEKEEEDIEDIEENTRPKRSRPTSFADELAARIKGDAMGRVDEEPTTLPSGEAKPRKTLKEKKERRTPSDDEEDNLFAPPKLTDEDFSPFGSGGGLFSGGKGLFDDEDEESDLFTEASQDRQAGASVKEESSSSKPGKKIPAGAVSVFLGDTDVFGAASVPSLKEPQKPEQPTPRKSPYGPPPTGLFDDDDGDDDDDFFSAPHSKPSKTRKVQSTADIFGDEEGDLFKEKAVASPEATVSQTDENKARAEKKVTLSSSKNLKPSSETKTQKGLFSDEEDSEDLFSSQSASNLKGASLLPGKLPTSVSLFDDEDEEDNLFGGTAAKKQTLSLQAQREEKAKASELSKKKASALLFSSDEEDQWNIPASQTHLASDSRSKGEPRDSGTLQSQEAKAVKKTSLFEEDKEDDLFAIAKDSQKKTQRVSLLFEDDVDSGGSLFGSPPTSVPPATKKKETVSEAPPLLFSDEEEKEAQLGVKSVDKKVESAKESLKFGRTDVAESEKEGLLTRSAQETVKHSDLFSSSSPWDKGTKPRTKTVLSLFDEEEDKMEDQNIIQAPQKEVGKGCDPDAHPKSTGVFQDEELLFSHKLQKDNDPDVDLFAGTKKTKLLEPSVGSLFGDDEDDDLFSSAKSQPLVQEKKRVVKKDHSVNSFKNQKHPESIQGSKEKGIWKPETPQDSSGLAPFKTKEPSTRIGKIQANLAINPAALLPTAASQISEVKPVLPELAFPSSEHRRSHGLESVPVLPGSGEAGVSFDLPAQADTLHSANKSRVKMRGKRRPQTRAARRLAAQESSEAEDMSVPRGPIAQWADGAISPNGHRPQLRAASGEDSTEEALAAAAAPWEGGPVPGVDTSPFAKSLGHSRGEADLFDSGDIFSTGTGSQSVERTKPKAKIAENPANPPVGGKAKSPMFPALGEASSDDDLFQSAKPKPAKKTNPFPLLEDEDDLFTDQKVKKNETKSSSQQDVILTTQDIFEDDIFATEAIKPSQKTREKEKTLESNLFDDNIDIFADLTVKPKEKSKKKVEAKSIFDDDMDDIFSTGIQAKTTKPKSRSAQAAPEPRFEHKVSNIFDDPLNAFGGQ

SEQ ID NO: 913430 - protein, 1024 aa, Homo sapiens
MSRGSPSSSIWGCMGRVDEEPTTLPSGEAKPRKTLKEKKERRTPSDDEEDNLFAPPKLTDEDFSPFGSGGGLFSGGKGLFDDEDEESDLFTEASQDRQAGASVKEESSSSKPGKKIPAGAVSVFLGDTDVFGAASVPSLKEPQKPEQPTPRKSPYGPPPTGLFDDDDGDDDDDFFSAPHSKPSKTRKVQSTADIFGDEEGDLFKEKAVASPEATVSQTDENKARAEKKDLFSSQSASNLKGASLLPGKLPTSVSLFDDEDEEDNLFGGTAAKKQTLSLQAQREEKAKASELSKKKASALLFSSDEEDQWNIPASQTHLASDSRSKGEPRDSGTLQSQEAKAVKKTSLFEEDKEDDLFAIAKDSQKKTQRVSLLFEDDVDSGGSLFGSPPTSVPPATKKKETVSEAPPLLFSDEEEKEAQLGVKSVDKKVESAKESLKFGRTDVAESEKEGLLTRSAQETVKHSDLFSSSSPWDKGTKPRTKTVLSLFDEEEDKMEDQNIIQAPQKEVGKGCDPDAHPKSTGVFQDEELLFSHKLQKDNDPDVDLFAGTKKTKLLEPSVGSLFGDDEDDDLFSSAKSQPLVQEKKRVVKKDHSVNSFKNQKHPESIQGSKEKGIWKPETPQDSSGLAPFKTKEPSTRIGKIQANLAINPAALLPTAASQISEVKPVLPELAFPSSEHRRSHGLESVPVLPGSGEAGVSFDLPAQADTLHSANKSRVKMRGKRRPQTRAARRLAAQESSEAEDMSVPRGPIAQWADGAISPNGHRPQLRAASGEDSTEEALAAAAAPWEGGPVPGVDTSPFAKSLGHSRGEADLFDSGDIFSTGTGSQSVERTKPKAKIAENPANPPVGGKAKSPMFPALGEASSDDDLFQSAKPKPAKKTNPFPLLEDEDDLFTDQKVKKNETKSSSQQDVILTTQDIFEDDIFATEAIKPSQKTREKEKTLESNLFDDNIDIFADLTVKPKEKSKKKVEAKSIFDDDMDDIFSTGIQAKTTKPKSRSAQAAPEPRFEHKVSNIFDDPLNAFGGQ

SEQ ID NO: 913431 - protein, 1374 aa, Homo sapiens; identical to SEQ ID NO: 913429

SEQ ID NO: 913432 - protein, 1256 aa, Homo sapiens
VTPRAAWLGLGFRGSAVLGLCWQPRSPPSRAAGMMNRTTPDQELVPASEPVWERPWSVEEIRRSSQSWSLAADAGLLQFLQEFSQQTISRTHEIKKQVDGLIRETKATDCRLHNVFNDFLMLSNTQFIENRVYDEEVEEPVLKAEAEKTEQEKTREQKEVDLIPKVQEAVNYGLQVLDSAFEQLDIKAGNSDSEEDDANGRVELILEPKDLYIDRPLPYLIGSKLFMEQEDVGLGELSSEEGSVGSDRGSIVDTEEEKEEEESDEDFAHHSDNEQNQHTTQMSDEEEDDDGCDLFADSEKEEEDIEDIEENTRPKRSRPTSFADELAARIKGDAMGRVDEEPTTLPSGEAKPRKTLKEKKERRTPSDDEEDNLFAPPKLTDEDFSPFGSGGGLFSGGKGLFDDEDEESDLFTEASQDRQAGASVKEESSSSKPGKKIPAGAVSVFLGDTDVFGAASVPSLKEPQKPEQPTPRKSPYGPPPTGLFDDDDGDDDDDFFSAPHSKPSKTRKVQSTADIFGDEEGDLFKEKAVASPEATVSQTDENKARAEKKVTLSSSKNLKPSSETKTQKGLFSDEEDSEDLFSSQSASNLKGASLLPGKLPTSVSLFDDEDEEDNLFGGTAAKKQTLSLQAQREEKAKASELSKKKASALLFSSDEEDQWNIPASQTHLASDSRSKGEPRDSGTLQSQEAKAVKKTSLFEEDKEDDLFAIAKDSQKKTQRVSLLFEDDVDSGGSLFGSPPTSVPPATKKKETVSEAPPLLFSDEEEKEAQLGVKSVDKKVESAKESLKFGRTDVAESEKEGLLTRSAQETVKHSDLFSSSSPWDKGTKPRTKTVLSLFDEEEDKMEDQNIIQAPQKEVGKGCDPDAHPKSTGVFQDEELLFSHKLQKDNDPDVDLFAGTKKTKLLEPSVGSLFGDDEDDDLFSSAKSQPLVQEKKRVVKKDHSVNSFKNQKHPESIQGSKEKGIWKPETPQDSSGLAPFKTKEPSTRIGKIQANLAINPAALLPTAASQISEVKPVLPELAFPSSEHRRSHGLESVPVLPGSGEAGVSFDLPAQADTLHSANKSRVKMRGKRRPQTRAARRLAAQESSEAEDMSVPRGPIAQWADGAISPNGHRPQLRAASGEDSTEEALAAAAAPWEGGPVPGVDTSPFAKSLGHSRGEADLFDSGDIFSTGTGSQSVERTKPKAKIAENPANPPVGGKAKSPMFPALGEASSDDDLFQSAKPKPAKKTNPFPLLEDEDDLFTDQKVKKNETKSSR

SEQ ID NO: 913433 - protein, 134 aa, Homo sapiens
MHMLLSSLSVAYTAVFDSPFEGGASSFLQPLPPPFSPPPSSCTCFSMACIWYICILLSSHSNVSPLWLVSDTCRFPALPPGGLLTTEQIMPLLLALPHYSKESIRAPGFGMKPLCNRCQPMCAASSLVTSHFPA

SEQ ID NO: 913434 - protein, 308 aa, Homo sapiens
MRGKRRPQTRAARRLAAQESSEAEDMSVPRGPIAQWADGAISPNGHRPQLRAASGEDSTEEALAAAAAPWEGGPVPGVDTSPFAKSLGHSRGEADLFDSGDIFSTGTGSQSVERTKPKAKIAENPANPPVGGKAKSPMFPALGEASSDDDLFQSAKPKPAKKTNPFPLLEDEDDLFTDQKVKKNETKSSSQQDVILTTQDIFEDDIFATEAIKPSQKTREKEKTLESNLFDDNIDIFADLTVKPKEKSKKKVEAKSIFDDDMDDIFSTGIQAKTTKPKSRSAQAAPEPRFEHKVSNIFDDPLNAFGGQ

SEQ ID NO: 913435 - protein, 1308 aa, Homo sapiens
VTPRAAWLGLGFRGSAVLGLCWQPRSPPSRAAGMMNRTTPDQELVPASEPVWERPWSVEEIRRSSQSWSLAADAGLLQFLQEFSQQTISRTHEIKKQVDGLIRETKATDCRLHNVFNDFLMLSNTQFIENRVYDEEVEEPVLKAEAEKTEQEKTREQKEVDLIPKVQEAVNYGLQVLDSAFEQLDIKAGNSDSEEDDANGRVELILEPKDLYIDRPLPYLIGSKLFMEQEDVGLGELSSEEGSVGSDRGSIVDTEEEKEEEESDEDFAHHSDNEQNQKRSRPTSFADELAARIKGDAMGRVDEEPTTLPSGEAKPRKTLKEKKERRTPSDDEEDNLFAPPKLTDEDFSPFGSGGGLFSGGKGLFDDEDEESDLFTEASQDRQAGASVKEESSSSKPGKKIPAGAVSVFLGDTDVFGAASVPSLKEPQKPEQPTPRKSPYGPPPTGLFDDDDGDDDDDFFSAPHSKPSKTRKVQSTADIFGDEEGDLFKEKAVASPEATVSQTDENKARAEKKDLFSSQSASNLKGASLLPGKLPTSVSLFDDEDEEDNLFGGTAAKKQTLSLQAQREEKAKASELSKKKASALLFSSDEEDQWNIPASQTHLASDSRSKGEPRDSGTLQSQEAKAVKKTSLFEEDKEDDLFAIAKDSQKKTQRVSLLFEDDVDSGGSLFGSPPTSVPPATKKKETVSEAPPLLFSDEEEKEAQLGVKSVDKKVESAKESLKFGRTDVAESEKEGLLTRSAQETVKHSDLFSSSSPWDKGTKPRTKTVLSLFDEEEDKMEDQNIIQAPQKEVGKGCDPDAHPKSTGVFQDEELLFSHKLQKDNDPDVDLFAGTKKTKLLEPSVGSLFGDDEDDDLFSSAKSQPLVQEKKRVVKKDHSVNSFKNQKHPESIQGSKEKGIWKPETPQDSSGLAPFKTKEPSTRIGKIQANLAINPAALLPTAASQISEVKPVLPELAFPSSEHRRSHGLESVPVLPGSGEAGVSFDLPAQADTLHSANKSRVKMRGKRRPQTRAARRLAAQESSEAEDMSVPRGPIAQWADGAISPNGHRPQLRAASGEDSTEEALAAAAAPWEGGPVPGVDTSPFAKSLGHSRGEADLFDSGDIFSTGTGSQSVERTKPKAKIAENPANPPVGGKAKSPMFPALGEASSDDDLFQSAKPKPAKKTNPFPLLEDEDDLFTDQKVKKNETKSSSQQDVILTTQDIFEDDIFATEAIKPSQKTREKEKTLESNLFDDNIDIFADLTVKPKEKSKKKVEAKSIFDDDMDDIFSTGIQAKTTKPKSRSAQAAPEPRFEHKVSNIFDDPLNAFGGQ

SEQ ID NO: 913436 - protein, 997 aa, Homo sapiens
MSSGPIFNTPCKTLLSVCYDEEDNLFAPPKLTDEDFSPFGSGGGLFSGGKGLFDDEDEESDLFTEASQDRQAGASVKEESSSSKPGKKIPAGAVSVFLGDTDVFGAASVPSLKEPQKPEQPTPRKSPYGPPPTGLFDDDDGDDDDDFFSAPHSKPSKTRKVQSTADIFGDEEGDLFKEKAVASPEATVSQTDENKARAEKKDLFSSQSASNLKGASLLPGKLPTSVSLFDDEDEEDNLFGGTAAKKQTLSLQAQREEKAKASELSKKKASALLFSSDEEDQWNIPASQTHLASDSRSKGEPRDSGTLQSQEAKAVKKTSLFEEDKEDDLFAIAKDSQKKTQRVSLLFEDDVDSGGSLFGSPPTSVPPATKKKETVSEAPPLLFSDEEEKEAQLGVKSVDKKVESAKESLKFGRTDVAESEKEGLLTRSAQETVKHSDLFSSSSPWDKGTKPRTKTVLSLFDEEEDKMEDQNIIQAPQKEVGKGCDPDAHPKSTGVFQDEELLFSHKLQKDNDPDVDLFAGTKKTKLLEPSVGSLFGDDEDDDLFSSAKSQPLVQEKKRVVKKDHSVNSFKNQKHPESIQGSKEKGIWKPETPQDSSGLAPFKTKEPSTRIGKIQANLAINPAALLPTAASQISEVKPVLPELAFPSSEHRRSHGLESVPVLPGSGEAGVSFDLPAQADTLHSANKSRVKMRGKRRPQTRAARRLAAQESSEAEDMSVPRGPIAQWADGAISPNGHRPQLRAASGEDSTEEALAAAAAPWEGGPVPGVDTSPFAKSLGHSRGEADLFDSGDIFSTGTGSQSVERTKPKAKIAENPANPPVGGKAKSPMFPALGEASSDDDLFQSAKPKPAKKTNPFPLLEDEDDLFTDQKVKKNETKSSSQQDVILTTQDIFEDDIFATEAIKPSQKTREKEKTLESNLFDDNIDIFADLTVKPKEKSKKKVEAKSIFDDDMDDIFSTGIQAKTTKPKSRSAQAAPEPRFEHKVSNIFDDPLNAFGGQ

SEQ ID NO: 913437 - protein, 458 aa, Homo sapiens
IIFIIPKQAPNTWLYLFGDDEDDDLFSSAKSQPLVQEKKRVVKKDHSVNSFKNQKHPESIQGSKEKGIWKPETPQANLAINPAALLPTAASQISEVKPVLPELAFPSSEHRRSHGLESVPVLPGSGEAGVSFDLPAQADTLHSANKSRVKMRGKRRPQTRAARRLAAQESSEAEDMSVPRGPIAQWADGAISPNGHRPQLRAASGEDSTEEALAAAAAPWEGGPVPGVDTSPFAKSLGHSRGEADLFDSGDIFSTGTGSQSVERTKPKAKIAENPANPPVGGKAKSPMFPALGEASSDDDLFQSAKPKPAKKTNPFPLLEDEDDLFTDQKVKKNETKSSSQQDVILTTQDIFEDDIFATEAIKPSQKTREKEKTLESNLFDDNIDIFADLTVKPKEKSKKKVEAKSIFDDDMDDIFSTGIQAKTTKPKSRSAQAAPEPRFEHKVSNIFDDPLNAFGGQ

SEQ ID NO: 913438 - protein, 292 aa, Homo sapiens
MQKYEKLEKIGEGTYGTVFKAKNRETHEIVALKRVRLDDDDEGVPSSALREICLLKELKHKNIVRLHDVLHSDKKLTLVFEFCDQDLKKYFDSCNGDLDPEIVKSFLFQLLKGLGFCHSRNVLHRDLKPQNLLINRNGELKLADFGLARAFGIPVRCYSAEVVTLWYRPPDVLFGAKLYSTSIDMWSAGCIFAELANAGRPLFPGNDVDDQLKRIFRLLGTPTEEQWPSMTKLPDYKPYPMYPATTSLVNVVPKLNATGRDLLQNLLKCNPVQRISAEEALQHPYFSDFCPP

SEQ ID NO: 913439 - protein, 292 aa, Homo sapiens; identical to SEQ ID NO: 913438

SEQ ID NO: 913440 - protein, 131 aa, Homo sapiens
MQKYEKLEKIGEGTYGTVFKAKNRETHEIVALKRVRLDDDDEGVPSSALREICLLKELKHKNIVRLHDVLHSDKKLTLVFEFCDQDLKKYFDSCNGDLDPEIVTSLQNLKFLPLPPLQWSPRCQTQKLFLQ

SEQ ID NO: 913441 - protein, 284 aa, Homo sapiens
MQKYEKLEKIGEGTYGTVFKAKNRETHEIVALKRGVPSSALREICLLKELKHKNIVRLHDVLHSDKKLTLVFEFCDQDLKKYFDSCNGDLDPEIVKSFLFQLLKGLGFCHSRNVLHRDLKPQNLLINRNGELKLADFGLARAFGIPVRCYSAEVVTLWYRPPDVLFGAKLYSTSIDMWSAGCIFAELANAGRPLFPGNDVDDQLKRIFRLLGTPTEEQWPSMTKLPDYKPYPMYPATTSLVNVVPKLNATGRDLLQNLLKCNPVQRISAEEALQHPYFSDFCPP

SEQ ID NO: 913442 - protein, 575 aa, Homo sapiens
MPGSPVEVKIQSRSSPPTMPPLPPINPGGPRPVSFTPTALSNGINHSPPTLNGAPSPPQRFSNGPASSTSSALTNQQLPATCGARQLSKLKRFLTTLQQFGNDISPEIGEKVRTLVLALVNSTVTIEEFHCKLQEATNFPLRPFVIPFLKANLPLLQRELLHCARAAKQTPSQYLAQHEHLLLNTSIASPADSSELLMEVHGNGKRPSPERREENSFDRDTIAPEPPAKRVCTISPAPRHSPALTVPLMNPGGQFHPTPPPLQHYTLEDIATSHLYREPNKMLEHREVRDRHHSLGLNGGYQDELVDHRLTEREWADEWKHLDHALNCIMEMVEKTRRSMAVLRRCQESDREELNYWKRRYNENTELRKTGTELVSRQHSPGSADSLSNDSQREFNSRPGTGYVPVEFWKKTEEAVNKVKIQAMSEVQKAVAEAEQKAFEVIATERARMEQTIADVKRQAAEDAFLVINEQEESTENCWNCGRKASETCSGCNIARYCGSFCQHKDWERHHRLCGQNLHGQSPHGQGRPLLPVGRGSSARSADCSVPSPALDKTSATTSRSSTPASVTAIDTNGL

SEQ ID NO: 913443 - protein, 604 aa, Homo sapiens
MAKESGISLKEIQVLARQWKVGPEKRVPAMPGSPVEVKIQSRSSPPTMPPLPPINPGGPRPVSFTPTALSNGINHSPPTLNGAPSPPQRFSNGPASSTSSALTNQQLPATCGARQLSKLKRFLTTLQQFGNDISPEIGEKVRTLVLALVNSTVTIEEFHCKLQEATNFPLRPFVIPFLKANLPLLQRELLHCARAAKQTPSQYLAQHEHLLLNTSIASPADSSELLMEVHGNGKRPSPERREENSFDRDTIAPEPPAKRVCTISPAPRHSPALTVPLMNPGGQFHPTPPPLQHYTLEDIATSHLYREPNKMLEHREVRDRHHSLGLNGGYQDELVDHRLTEREWADEWKHLDHALNCIMEMVEKTRRSMAVLRRCQESDREELNYWKRRYNENTELRKTGTELVSRQHSPGSADSLSNDSQREFNSRPGTGYVPVEFWKKTEEAVNKVKIQAMSEVQKAVAEAEQKAFEVIATERARMEQTIADVKRQAAEDAFLVINEQEESTENCWNCGRKASETCSGCNIARYCGSFCQHKDWERHHRLCGQNLHGQSPHGQGRPLLPVGRGSSARSADCSVPSPALDKTSATTSRSSTPASVTAIDTNGL

SEQ ID NO: 913444 - protein, 832 aa, Homo sapiens
MSSCSVSFYLSDHTHLERCGHLLPMGSIWHLLSHSCPAGCAVQVGRTCPHCQGLVSSEKPSWTSKNSSDLIVTGHYIYYVDLSSGTQLLFPSLVLSDSVPPGAHQKGFMKCEPFWEKLINFSSYLPIFKWDITHIPFRMLGTASHILPCLFGFCFLLLLWFFNTKLTLLPRLECSGMILAHCNLCLPGSSNSPASASRVAEITGAHHHAQLDFCIFSRDSGFTMLARLISNSCPQVTCLGLPKCRDYKREPPCPACLFGFDGSLRTPTPPALHLGASGILSHPEISWSKFNWPCSSWPLKHKFKSPPSVHCPESKIKVVSTIKEKGSTQVAFSLDTGTSYCKNFKSWLGAVAHSCNPSTLRDRGRQITVRSGIQDQPGQHGETLSLIKKKRKISRVWWHTPVILATQEAEARESLEPVSQRLQWAEIPPLHSSLGNRAKLCLKKKKKKAKLKNFKSLIYSNQAFSVLQRNLVHDTFKMPRFPLPKVRCDQLKQQQRIMFLCCGTHKPHSFPVSLIHGYPPTPSASLSHSPWWGTLRGTESVPRTGPHLHETWLSHRSQSHYNSLLVFHGFVGLNLKQVFYCYFVCLFVLRREFLSCLPGWSAIAQSRLTVTSASQVRRVSCLSLLSSWDCRHAPPRPTDFVFLVETGFLLVGQAGLKPRTSGDPPTLASQSARITGMSHCVLVLSRFLKSPVAIKLARVAHAFTGWNKEAKTNKIIFIRARCPFLWLRLRFGVQSLACSCGLWLLWTVSFSEIFVMLFHPARAAQRLICKPGQYSTLKLSLQTFCCVNSGQFHTEVTRASAQDLLFTFQESLSEILQLSGQEEEHHWGGVGS

SEQ ID NO: 913445 - protein, 808 aa, Homo sapiens
MGSIWHLLSHSCPAGCAVQVGRTCPHCQGLVSSEKPSWTSKNSSDLIVTGHYIYYVDLSSGTQLLFPSLVLSDSVPPGAHQKGFMKCEPFWEKLIKFFFLASHFQMGHHSYPFQNVRNCLPHSSLSFWVLFFVVVVVFYTKLTLLPRLECSGMILAHCNLCLPGSSNSPASASRVAEITGAHHHAQLIFVFFSRDSGFTMLARLISNSCPQVTCLGLPKCRDYKREPPCPACLFGFDGSLRTPTPPALHLGASGILSHPEISWSKFNWPCSSWPLKHKFKSPPSVHCPESKIKVVSTIKEKGSTQVAFSLDTGTSYCKNFKSWLGAVAHSCNPSTLRDRGRQITVRSGIQDQPGQHGETLSLIKKKRKISRVWWHTPVILATQEAEARESLEPVSQRLQWAEIPPLHSSLGNRAKLCLKKKKKKAKLKNFKSLIYSNQAFSVLQRNLVHDTFKMPRFPLPKVRCDQLKQQQRIMFLCCGTHKPHSFPVSLIHGYPPTPSASLSHSPWWGTLRGTESVPRTGPHLHETWLSHRSQSHYNSLLVFHGFVGLNLKQVFYCYFVCLFVLRREFLSCLPGWSAIAQSRLTVTSASQVRRVSCLSLLSSWDCRHAPPRPTDFVFLVETGFLLVGQAGLKPRTSGDPPTLASQSARITGMSHCVLVLSRFLKSPVAIKLARVAHAFTGWNKEAKTNKIIFIRARCPFLWLRLRFGVQSLACSCGLWLLWTVSFSEIFVMLFHPARAAQRLICKPGQYSTLKLSLQTFCCVNSGQFHTEVTRASAQDLLFTFQESLSEILQLSGQEEEHHWGGVGS

SEQ ID NO: 913446 - protein, 832 aa, Homo sapiens; identical to SEQ ID NO: 913444

SEQ ID NO: 913447 - protein, 832 aa, Homo sapiens; identical to SEQ ID NO: 913444

SEQ ID NO: 913448 - protein, 325 aa, Homo sapiens
MPGSPVEVKIQSRSSPPTMPPLPPINPGGPRPVSFTPTALSNGINHSPPTLNGAPSPPQRFSNGPASSTSSALTNQQLPATCGARQLSKLKRFLTTLQQFGNDISPEIGEKVRTLVLALVNSTVTIEEFHCKLQEATNFPLRPFVIPFLKANLPLLQRELLHCARAAKQTPSQYLAQHEHLLLNTSIASPADSSELLMEVHGNGKRPSPERREENSFDRDTIAPEPPAKRVCTISPAPRHSPALTVPLMNPGGQFHPTPPPLQHYTLEDIATSHLYREPNKMLEHREVRDRHHSLGLNGGYQDELVDHRLTEREWADEWKHLDHA

SEQ ID NO: 913449 - protein, 67 aa, Homo sapiens
HASDEHVDARGKRQVVNVLVSKNYRHSRVGRALGGPCVPSSPSTAPEVELPSQTPSGRAYGCPVYTQ

SEQ ID NO: 913450 - protein, 263 aa, Homo sapiens
MPGSPVEVKIQSRSSPPTMPPLPPINPGGPRPVSFTPTALSNGINHSPPTLNGAPSPPQRFSNGPASSTSSALTNQQLPATCGARQLSKLKRFLTTLQQFGNDISPEIGEKVRTLVLALVNSTVTIEEFHCKLQEATNFPLRPFVIPFLKANLPLLQRELLHCARAAKQTPSQYLAQHEHLLLNTSIASPADSSELLMEVHGNGKRPSPESCIIHLKSMGVASRHEYFSGTLQMPAHPVRNSTLENLWVDCSRSLRSTVLPFP

SEQ ID NO: 913451 - protein, 808 aa, Homo sapiens
MGSIWHLLSHSCPAGCAVQVGRTCPHCQGLVSSEKPSWTSKNSSDLIVTGHYIYYVDLSSGTQLLFPSLVLSDSVPPSAHQKGFMKCEPFWEKLINFSSQLPIFKWDITHIPFRMLGTASHILPCLFGFCFLLLLWFFNTKLTLLPRLECSGMILAHCNLCLPGSSNSPASASRVAEITGAHHHAQLIFVFFSRDSGFTMLARLISNSCPQVTCLGLPKCRDYKREPPCPACLFGFDGSLRTPTPPALHLWASGILSHPEISWSKFNWPCSSWPLKHKFKSPPSVHCPESKIKVVSTIKEKGSTQVAFSLDTGTSYCKNFKSWLGAVAHSCNPSTLRDRGRQITVRSGIQDQPGQHGETLSLIKKNRKISRVWWHTPVILATQEAEARESLEPVSQRLQWAEIPPLHSSLGNRAKLCLKKKKKMAKLKNFKSLIYSNQAFSVLQRNLVHDTFKMPRFPLPKVRCDQLKQQQRIMFLCCGTHKPHSFPVSLIHGYPPTPSASLSHSPWWGTLRGTESVPRTGPHLHETWLSHRSQSHYNSLLVFHGFVGLNLKQVFYCYFVCLFVLRREFLSCLPGWSAIAQSRLTVTSASQVRRVSCLSLLSSWDCRHAPPRPTDFVFLVETGFLLVGQAGLKPRTSGDPPTLASQSARITGMSHCVLVLSRFLKSPVAIKLARVAHAFTGWNKEAKTNKIIFIRARCPFLWLRLRFGVQSLACSCGLWLLWTVSFSEIFVMLFHPARAAQRLICKPGQYSTLKLSLQTFCCVNSGQFHTEVTRASAQDLLFTFQESLSEILQLSGQEEEHHWGGVGS

SEQ ID NO: 913452 - protein, 808 aa, Homo sapiens
MGSIWHLLSHSCPAGCAVQVGRTCPHCQGLVSSEKPSWTSKNSSDLIVTGHYIYYVDLSSGTQLLFPSLVLSDSVPPCAHQKGFMKCEPFWEKLINFSSQLPIFKWDITHIPFRMLGTASHILPCLFGFCFLLLLWFFNTKLTLLPRLECSGMILAHCNLCLPGSSNSPASSLPSSWDYRRPPPRPARFLYFLVETGFHHVGQADLELLTSGTCLGLPKCRDYKREPPCPACLFGFDGSLRTPTLLLSIFEPLASSHTQKSVGVSLIGPAPAGLLKHKFKSPPSVHCPESKIKVVSTIKEKGSTQVAFSLDTGTSYCKNFKSWLGAVAHSCNPSTLRDRGRQITCRSGIQDQPGQHGETLSLIKKNRKISRVWWHTPVILATQEAEARESLEPVSQRLQWAEIPPLHSSLGNRAKLCLKKKKKKAKLKNFKSLIYSNQAFSVLQRNLVHDTFKMPRFPLPKVRCDQLKQQQRIMFLCCGTHKPHSFPVSLIHGYPPTPSASLSHSPWWGTLRGTESVPRTGPHLHETWLSHRSQSHYNSLLVFHGFVGLTPKQVFYCYFVCLFVLRREFLSCLPGWSAIAQSRLTVTSASQVRRVSCLSLLSSWDCRHAPPRPTDFVFLVETGFLLVGQAGLKPRTSGDPPTLASQSARITGMSHCVRSVSRFLKSPVAIKLARVAHAFTGWNKEAKTNKIIFIRARCPFLWLRLRFGVQSLACSCGLWLLWTVSFSEIFVMLFHPARAAQRLICKPGQYSTLKLSLQTFCCVNSGQFHTEVTRASAQDLLFTFQESLSEILQLSGQEEEHHWGGVGS

SEQ ID NO: 913453 - protein, 557 aa, Homo sapiens [sequence omitted]

SEQ ID NO: 913454 - protein, 143 aa, Homo sapiens
MVGVPGAAAFQLGPEKRVPAMPGSPVEVKIQSRSSPPTMPPLPPINPGGPRPVSFTPTALSNGINHSPPTLNGAPSPPQRFSNGPASSTSSALTNQQLPATCGARQLSKLKRFLTTLQQFGNDISPEIGEKVRTLVLALVQSC

SEQ ID NO: 913455 - protein, 327 aa, Homo sapiens
RSDAGPGATVSAAAAAATERARRGATMGAQLSTLGHMVLFPVWFLYSLLMKLFQRSTPAITLESPDIKYPLRLIDREIISHDTRRFRFALPSPQHILGLPVGQHIYLSARIDGNLVVRPYTPISSDDDKGFVDLVIKVYFKDTHPKFPAGGKMSQYLESMQIGDTIEFRGPSGLLVYQGKGKFAIRPDKKSNPIIRTVKSVGMIAGGTGITPMLQVIRAIMKDPDDHTVCHLLFANQTEKDILLRPELEELRNKHSARFKLWYTLDRAPEAWDYGQGFVNEEMIRDHLPPPEEEPLVLMCGPPPMIQYACLPNLDHVGHPTERCFVF

SEQ ID NO: 913456 - protein, 291 aa, Homo sapiens
MVLFPVWFLYSLLMKLFQRSTPAITLESPDIKYPLRLIDREIISHDTRRFRFALPSPQHILGLPVGQHIYLSARIDGNLVVRPYTPISSDDDKGFVDLVIKVYFKDTHPKFPAGGKMSQYLESMQIGDTIEFRGPSGLLVYQGKGKFAIRPDKKSNPIIRTVKSVGMIAGGTGITPMLQVIRAIMKDPDDHTVCHLLFANQTEKDILLRPELEELRNKHSARFKLWYTLDRAPEAWDYGQGFVNEEMIRDHLPPPEEEPLVLMCGPPPMIQYACLPNLDHVGHPTERCFVF

SEQ ID NO: 913457 - protein, 237 aa, Homo sapiens
PPPRGRPGSRGRLDKLGHMVLFPVWFLYSLLMKLFQRSTPAITLESPDIKYPLRLIDREIISHDTRRFRFALPSPQHILGLPVGQHIYLSARIDGNLVVRPYTPISSDDDKGFVDLVIKVYFKDTHPKFPAGGKMSQYLESMQIGDTIEFRGPSGLLVYQGKGKFAIRPDKKSNPIIRTVKSVGMIAGGTGITPMLQVIRAIMKDPDDHTVCHLLFANQNRTRRTSCWELNWGTPGP

SEQ ID NO: 913458 - protein, 327 aa, Homo sapiens; identical to SEQ ID NO: 913455

SEQ ID NO: 913459 - protein, 327 aa, Homo sapiens; identical to SEQ ID NO: 913455

SEQ ID NO: 913460 - protein, 362 aa, Homo sapiens
MLTLRPRSQLCVHLFLLLGSLPPQFPAKPEPPTAELPPLPPTSSRLEQDQEGGAAQILAGPLAGSRGQLGHMVLFPVWFLYSLLMKLFQRSTPAITLESPDIKYPLRLIDREIISHDTRRFRFALPSPQHILGLPVGQHIYLSARIDGNLVVRPYTPISSDDDKGFVDLVIKVYFKDTHPKFPAGGKMSQYLESMQIGDTIEFRGPSGLLVYQGKGKFAIRPDKKSNPIIRTVKSVGMIAGGTGITPMLQVIRAIMKDPDDHTVCHLLFANQTEKDILLRPELEELRNKHSARFKLWYTLDRAPEAWDYGQGFVNEEMIRDHLPPPEEEPLVLMCGPPPMIQYACLPNLDHVGHPTERCFVF

SEQ ID NO: 913461 - protein, 327 aa, Homo sapiens; identical to SEQ ID NO: 913455

SEQ ID NO: 913462 - protein, 327 aa, Homo sapiens; identical to SEQ ID NO: 913455

SEQ ID NO: 913463 - protein, 251 aa, Homo sapiens
MIISHDTRRFRFALPSPQHILGLPVGQHIYLSARIDGNLVVRPYTPISSDDDKGFVDLVIKVYFKDTHPKFPAGGKMSQYLESMQIGDTIEFRGPSGLLVYQGKGKFAIRPDKKSNPIIRTVKSVGMIAGGTGITPMLQVIRAIMKDPDDHTVCHLLFANQTEKDILLRPELEELRNKHSARFKLWYTLDRAPEAWDYGQGFVNEEMIRDHLPPPEEEPLVLMCGPPPMIQYACLPNLDHVGHPTERCFVF

SEQ ID NO: 913464 - protein, 115 aa, Homo sapiens [sequence omitted]

SEQ ID NO: 913465 - protein, 89 aa, Homo sapiens
PPPRGRPGSRGRLDKLGHMVLFPVWFLYSLLMKLFQRSTPAITLASHLPTSHTGAPGSAWPARALVNHLAEQFPWSPFGSRAVSQMGHG

SEQ ID NO: 913466 - protein, 197 aa, Homo sapiens
RSDAGPGATVSAAAAAATERARRGATMGAQLSTLGHMVLFPVWFLYSLLMKLFQRSTPAITLESPDIKYPLRLIDREIISHDTRRFRFALPSPQHILGLPVGQHIYLSARIDGNLVVRPYTPISSDDDKGFVDLVIKVYFKDTHPKFPAGGKMSQYLESMQIGDTIEFRGPSGLLVYQGKASLMAELPQPHVFIPLS

SEQ ID NO: 913467 - protein, 204 aa, Homo sapiens
MNRSLLVGCMQSKDIWGREESICERLKQDGLDVERAESWELGHMVLFPVWFLYSLLMKLFQRSTPAITLESPDIKYPLRLIDREIISHDTRRFRFALPSPQHILGLPVGQHIYLSARIDGNLVVRPYTPISSDDDKGFVDLVIKVYFKDTHPKFPAGGKMSQYLESMQIGDTIEFRGPSGLLVYQGKASLMAELPQPHVFIPLS

SEQ ID NO: 913468 - protein, 264 aa, Homo sapiens
RSDAGPGATVSAAAAAATERARRGATMGAQLSTLGHMVLFPVWFLYSLLMKLFQRSTPAITLESPDIKYPLRLIDREIISHDTRRFRFALPSPQHILGLPVGQHIYLSARIDGNLVVRPYTPISSDDDKGFVDLVIKVYFKDTHPKFPAGGKMSQYLESMQIGDTIEFRGPSGLLVYQGKVIRVGIPWLHGRLRELESLGVLGAGCRPLALCGWVTLVRPAVPLWELSLPGCRGGKLLAQGLQTGHSWGPRLTHCQPLFGFLSI

SEQ ID NO: 913469 - protein, 95 aa, Homo sapiens
WLEWEEGAGHGALPEPQHFLSAVLMTPRPPPTHTIRLRAASSPVCPPFPAVDHSRDVSRHTWAAQSCRCQGPPQPRLSPPLPPQGQAQASPPDAA

SEQ ID NO: 913470 - protein, 327 aa, Homo sapiens; identical to SEQ ID NO: 913455

SEQ ID NO: 913471 - protein, 327 aa, Homo sapiens; identical to SEQ ID NO: 913455

SEQ ID NO: 913472 - protein, 327 aa, Homo sapiens; identical to SEQ ID NO: 913455

SEQ ID NO: 913473 - protein, 336 aa, Homo sapiens
MGAQLSTLGHMVLVRQIVGSVVACLASVEVRRSMLLSNELAYSALRTRPRTIQSTSHAGFIGTRGTNLIHGPISSSAGAGFFPGLYVARLCPVSKPPLRGNHFLGGPPLSGQHIYLSARIDGNLVVRPYTPISSDDDKGFVDLVIKVYFKDTHPKFPAGGKMSQYLESMQIGDTIEFRGPSGLLVYQGKGKFAIRPDKKSNPIIRTVKSVGMIAGGTGITPMLQVIRAIMKDPDDHTVCHLLFANQTEKDILLRPELEELRNKHSARFKLWYTLDRAPEAWDYGQGFVNEEMIRDHLPPPEEEPLVLMCGPPPMIQYACLPNLDHVGHPTERCFVF

SEQ ID NO: 913474 - protein, 227 aa, Homo sapiens
RSDAGPGATVSAAAAAATERARRGATMGAQLSTLGHMVLFPVWFLYSLLMKLFQRSTPAITLESPDIKYPLRLIDREIISHDTRRFRFALPSPQHILGLPVGQHIYLSARIDGNLVVRPYTPISSDDDKGFVDLVIKTEKDILLRPELEELRNKHSARFKLWYTLDRAPEAWDYGQGFVNEEMIRDHLPPPEEEPLVLMCGPPPMIQYACLPNLDHVGHPTERCFVF

SEQ ID NO: 913475 - protein, 79 aa, Homo sapiens
SAASRQTRIQRAPGQVGPYGALPSLVPVQSAHEAVPALHASHHPRPGSAWPARALVNHLAEQFPWSPFGSRAVSQMGHG

SEQ ID NO: 913476 - protein, 82 aa, Homo sapiens
RSDAGPGATVSAAAAAATERARRGATMGAQLSTLGHMVLFPVWFLYSLLMKLFQRSTPAITLESPDIKYPLRLIDREMEKAR

SEQ ID NO: 913477 - protein, 64 aa, Homo sapiens
MRVLYLLFSFLFIFLMPLPGVFGGIGDPVTCLKSGAICHPVFCPRRYKQIGTCGLPGTKCCKKP

SEQ ID NO: 913478 - protein, 409 aa, Homo sapiens [sequence omitted]

SEQ ID NO: 913479 - protein, 1270 aa, Homo sapiens
RRRRRALPPRGPRPGASGSAMWLSPEEVLVANALWVTERANPFFVLQRRRGHGRGGGLTGLLVGTLDVVLDSSARVAPYRILHQTQDSQVYWTVACGSSRKEITKHWEWLENNLLQTLSIFDSEEDITTFVKGKIHGIIAEENKNLQPQGDEDPGKFKEAELKMRKQFGMPEGEKLVNYYSCSYWKGRVPRQGWLYLTVNHLCFYSFLLGKEVSLVVQWVDITRLEKNATLLFPESIRVDTRDQELFFSMFLNIGETFKLMEQLANLAMRQLLDSEGFLEDKALPRPIRPHRNISALKRDLDARAKNECYRATFRLPRDERLDGHTSCTLWTPFNKLHIPGQMFISNNYICFASKEEDACHLIIPLREVTIVEKADSSSVLPSPLSISTKSKMTFLFANLKDRDFLVQRISDFLQKTPSKQPGSIGSRKASVVDPSTESSPAPQEGSEQPASPASPLSSRQSFCAQEAPTASQGLLKLFQKNSPMEDLGAKGAKEKMKEESWHIHFFEYGRGVCMYRTAKTRALVLKGIPESLRGELWLLFSGAWNEMVTHPGYYAELVEKSTGKYSLATEEIERDLHRSMPEHPAFQNELGIAALRRVLTAYAFRNPTIGYCQAMNIVTSVLLLYGSEEEAFWLLVALCERMLPDYYNTRVVGALVDQGIFEELTRDFLPQLSEKMQDLGVISSISLSWFLTLFLSVMPFESAVVIVDCFFYEGIKVILQVALAVLDANMEQLLGCSDEGEAMTMLGRYLDNVVNKQSVSPPIPHLRALLSSSDDPPAEVDIFELLKVSYEKFSSLRAEDIEQMRFKQRLKVIQSLEDTAKRSVVRAIPVDIGFSIEELEDLYMVFKAKHLASQYWGCSRTMAGRRDPSLPYLEQYRIDASQFRELFASLTPWACGSHTPLLAGRMFRLLDENKDSLINFKEFVTGMSGMYHGDLTEKLKVLYKLHLPPALSPEEAESALEAAHYFTEDSSSEASPLASDLDLFLPWEAQEALPQEEQEGSGSEERGEEKGTSSPDYRHYLRMWAKEKEAQKETIKDLPKMNQEQFIELCKTLYNMFSEDPMEQDLYHAIATVASLLLRIGEVGKKFSARTGRKPRDCATEEDEPPAPELHQDAARELQPPAAGDPQAKAGGDTHLGTAPQESQVVVEGGSGEGQGSPSQLLSDDETKDDMSMSSYSVVSTGSLQCEDLADDTVLVGGEACSPTARIGGTVDTDWCISFEQILASILTESVLVNFFEKRVDIGLKIKDQKKVERQFSTASDHEQPGVSG

SEQ ID NO: 913480 - protein, 409 aa, Homo sapiens [sequence omitted]

SEQ ID NO: 913481 - protein, 1270 aa, Homo sapiens; identical to SEQ ID NO: 913479

SEQ ID NO: 913482 - protein, 1270 aa, Homo sapiens; identical to SEQ ID NO: 913479

SEQ ID NO: 913483 - protein, 1270 aa, Homo sapiens; identical to SEQ ID NO: 913479

SEQ ID NO: 913484 - protein, 584 aa, Homo sapiens
RRRRRALPPRGPRPGASGSAMWLSPEEVLVANALWVTERANPFFVLQRRRGHGRGGGLTGLLVGTLDVVLDSSARVAPYRILHQTQDSQVYWTVACGSSRKEITKHWEWLENNLLQTLSIFDSEEDITTFVKGKIHGIIAEENKNLQPQGDEDPGKFKEAELKMRKQFGMPEGEKLVNYYSCSYWKGRVPRQGWLYLTVNHLCFYSFLLGKEVSLVVQWVDITRLEKNATLLFPESIRVDTRDQELFFSMFLNIGETFKLMEQLANLAMRQLLDSEGFLEDKALPRPIRPHRNISALKRDLDARAKNECYRATFRLPRDERLDGHTSCTLWTPFNKLHIPGQMFISNNYICFASKEEEEQFIELCKTLYNMFSEDPMEQDLYHAIATVASLLLRIGEVGKKFSARTGRKPRDCATEEDEPPAPELHQDAARELQPPAAGDPQAKAGGDTHLGTAPQESQVVVEGGSGEGQGSPSQLLSDDETKDDMSMSSYSVVSTGSLQCEDLADDTVLVGGEACSPTARIGGTVDTDWCISFEQILASILTESVLVNFFEKRVDIGLKIKDQKKVERQFSTASDHEQPGVSG

SEQ ID NO: 913485 - protein, 1253 aa, Homo sapiens
RRRRRALPPRGPRPGASGSAMWLSPEEVLVANALWVTERANPFFVLQRRRGHGRGGGLTGLLVGTLDVVLDSSARVAPYRILHQTQDSQVYWTVACGSSRKEITKHWEWLENNLLQTLSIFDSEEDITTFVKGKIHGIIAEENKNLQPQGDEDPGKFKEAELKMRKQFGMPEGEKLVNYYSCSYWKGRVPRQGWLYLTVNHLCFYSFLLGKEVSLVVQWVDITRLEKNATLLFPESIRVDTRDQELFFSMFLNIGETFKLMEQLANLAMRQLLDSEGFLEDKALPRPIRPHRNISALKRDLDARAKNECYRATFRLPRDERLDGHTSCTLWTPFNKLHIPGQMFISNNYICFASKEEDACHLIIPLREVTIVEKADSSSVLPSPLSISTKSKMTFLFANLKDRDFLVQRISDFLQKTPSKQPGSIGSRKASVVDPSTESSPAPQEGSEQPASPASPLSSRQSFCAQEAPTASQGLLKLFQKNSPMEDLGAKGAKEKMKEESWHIHFFEYGRGVCMYRTAKTRALVLKGIPESLRGELWLLFSGAWNEMVTHPGYYAELVEKSTGKYSLATEEIERDLHRSMPEHPAFQNELGIAALRRVLTAYAFRNPTIGYCQAMNIVTSVLLLYGSEEEAFWLLVALCERMLPDYYNTRVVGALVDQGIFEELTRDFLPQLSEKMQDLGVISSISLSWFLTLFLSVMPFESAVVIVDCFFYEGIKVILQVALAVLDANMEQLLGCSDEGEAMTMLGRYLDNVVNKQSVSPPIPHLRALLSSSDDPPAEVDIFELLKVSYEKFSSLRAEDIEQMRFKQRLKVIQSLEDTAKRSVVRAIPVDIGFSIEELEDLYMVFKAKHLASQYWGCSRTMAGRRDPSLPYLEQYRIDASQFRELFASLTPWACGSHTPLLAGRMFRLLDENKDSLINFKEFVTGMSGMYHGDLTEKLKVLYKLHLPPALSPEEAESALEAAHYFTEDSSSEEALPQEEQEGSGSEERGEEKGTSSPDYRHYLRMWAKEKEAQKETIKDLPKMNQEQFIELCKTLYNMFSEDPMEQDLYHAIATVASLLLRIGEVGKKFSARTGRKPRDCATEEDEPPAPELHQDAARELQPPAAGDPQAKAGGDTHLGTAPQESQVVVEGGSGEGQGSPSQLLSDDETKDDMSMSSYSVVSTGSLQCEDLADDTVLVGGEACSPTARIGGTVDTDWCISFEQILASILTESVLVNFFEKRVDIGLKIKDQKKVERQFSTASDHEQPGVSG

SEQ ID NO: 913486 - protein, 1235 aa, Homo sapiens
RRRRRALPPRGPRPGASGSAMWLSPEEVLVANALWVTERANPFFVLQRRRGHGRGGGLTGLLVGTLDVVLDSSARVAPYRILHQTQDSQVYWTVACGSSRKEITKHWEWLENNLLQTLSIFDSEEDITTFVKGKIHGIIAEENKNLQPQGDEDPGKFKEAELKMRKQFGMPEGEKLVNYYSCSYWKGRVPRQGWLYLTVNHLCFYSFLLGKEVSLVVQWVDITRLEKNATLLFPESIRVDTRDQELFFSMFLNIGETFKLMEQLANLAMRQLLDSEGFLEDKALPRPIRPHRNISALKRDLDARAKNECYRATFRLPRDERLDGHTSCTLWTPFNKLHIPGQMFISNNYICFASKEEDACHLIIPLREVTIVEKADSSSVLPSPLSISTKSKMTFLFANLKDRDFLVQRISDFLQKTPSKQPGSIGSRKASVVDPSTESSPAPQEGSEQPASPASPLSSRQSFCAQEAPTASQGLLKLFQKNSPMEDLGAKGAKEKMKEESWHIHFFEYGRGVCMYRTAKTRALVLKGIPESLRGELWLLFSGAWNEMVTHPGYYAELVEKSTGKYSLATEEIERDLHRSMPEHPAFQNELGIAALRRVLTAYAFRNPTIGYCQAMNIVTSVLLLYGSEEEAFWLLVALCERMLPDYYNTRVVGALVDQGIFEELTRDFLPQLSEKMQDLGVISSISLSWFLTLFLSVMPFESAVVIVDCFFYEGIKVILQVALAVLDANMEQLLGCSDEGEAMTMLGRYLDNVVNKQSVSPPIPHLRALLSSSDDPPAEVDIFELLKVSYEKFSSLRAEDIEQMRFKQRLKVIQSLEDTAKRSVVRAIPVDIGFSIEELEDLYMVFKAKHLASQYWGCSRTMAGRRDPSLPYLEQYRIDASQFRELFASLTPWACGSHTPLLAGRMFRLLDENKDSLINFKEFVTGMSGMYHGDLTEKLKVLYKLHLPPALSPEEAESALEAAHYFTEDSSSEEALPQEEQEGSGSEERGEEKGTSSPDYRHYLRMWAKEKEAQKETIKDLPKMNQEQFIELCKTLYNMFSEDPMEQDLYHAIATVASLLLRIGEVGKKFSARTGRKPRDCATEEDEPPAPELHQDAARELQPPAAGDPQAKAGGDTHLGTAPQESQVVVEGGSGEGQGSPSQLLSDDETKDDMSMSSYSVVSTGSLQCEDLADDTVLVGGEACSPTARIGGTVDTDWCISFEQILASILTESVLVNFFEKRVDIGLKIKDLSG

SEQ ID NO: 913487 - protein, 1158 aa, Homo sapiens
RRRRRALPPRGPRPGASGSAMWLSPEEVLVANALWVTERANPFFVLQRRRGHGRGGGLTGLLVGTLDVVLDSSARVAPYRILHQTQDSQVYWTVACGSSRKEITKHWEWLENNLLQTLSIFDSEEDITTFVKGKIHGIIAEENKNLQPQGDEDPGKFKEAELKMRKQFGMPEGEKLVNYYSCSYWKGRVPRQGWLYLTVNHLCFYSFLLGKEVSLVVQWVDITRLEKNATLLFPESIRVDTRDQELFFSMFLNIGETFKLMEQLANLAMRQLLDSEGFLEDKALPRPIRPHRNISALKRDLDARAKNECYRATFRLPRDERLDGHTSCTLWTPFNKLHIPGQMFISNNYICFASKEEDACHLIIPLREVTIVEKADSSSVLPSPLSISTKSKMTFLFANLKDRDFLVQRISDFLQKTPSKQPGSIGSRKASVVDPSTESSPAPQEGSEQPASPASPLSSRQSFCAQEAPTASQGLLKLFQKNSPMEDLGAKGAKEKMKEESWHIHFFEYGRGVCMYRTAKTRALVLKGIPESLRGELWLLFSGAWNEMVTHPGYYAELVEKSTGKYSLATEEIERDLHRSMPEHPAFQNELGIAALRRVLTAYAFRNPTIGYCQAMNIVTSVLLLYGSEEEAFWLLVALCERMLPDYYNTRVVGALVDQGIFEELTRDFLPQLSEKMQDLGVISSISLSWFLTLFLSVMPFESAVVIVDCFFYEGIKVILQVALAVLDANMEQLLGCSDEGEAMTMLGRYLDNVVNKQSVSPPIPHLRALLSSSDDPPAEVDIFELLKVSYEKFSSLRAEDIEQMRFKQRLKVIQSLEDTAKRSVVRAIPVDIGFSIEELEDLYMVFKAKHLASQYWGCSRTMAGRRDPSLPYLEQYRIDASQFRELFASLTPWACGSHTPLLAGRMFRLLDENKDSLINFKEFVTGMSGMYHGDLTEKLKVLYKLHLPPALSPEEAESALEAAHYFTEDSSSEEALPQEEQEGSGSEERGEEKGTSSPDYRHYLRMWAKEKEAQKETIKDLPKMNQEQFIELCKTLYNMFSEDPMEQDLYHAIATVASLLLRIGEVGKKFSARTGRKPRDCATEEDEPPAPELHQDAARELQPPAAGDPQAKAGGDTHLGTAPQESQVVVEGGSGEGQGSPSQLLSDDETKDDIPCW

SEQ ID NO: 913488 - protein, 1113 aa, Homo sapiens
RRRRRALPPRGPRPGASGSAMWLSPEEVLVANALWVTERANPFFVLQRRRGHGRGGGLTGLLVGTLDVVLDSSARVAPYRILHQTQDSQVYWTVACGSSRKEITKHWEWLENNLLQTLSIFDSEEDITTFVKGKIHGIIAEENKNLQPQGDEDPGKFKEAELKMRKQFGMPEGEKLVNYYSCSYWKGRVPRQGWLYLTVNHLCFYSFLLGKEVSLVVQWVDITRLEKNATLLFPESIRVDTRDQELFFSMFLNIGETFKLMEQLANLAMRQLLDSEGFLEDKALPRPIRPHRNISALKRDLDARAKNECYRATFRLPRDERLDGHTSCTLWTPFNKLHIPGQMFISNNYICFASKEEDACHLIIPLREVTIVEKADSSSVLPSPLSISTKSKMTFLFANLKDRDFLVQRISDFLQKTPSKQPGSIGSRKASVVDPSTESSPAPQEGSEQPASPASPLSSRQSFCAQEAPTASQGLLKLFQKNSPMEDLGAKGAKEKMKEESWHIHFFEYGRGVCMYRTAKTRALVLKGIPESLRGELWLLFSGAWNEMVTHPGYYAELVEKSTGKYSLATEEIERDLHRSMPEHPAFQNELGIAALRRVLTAYAFRNPTIGYCQAMNIVTSVLLLYGSEEEAFWLLVALCERMLPDYYNTRVVGALVDQGIFEELTRDFLPQLSEKMQDLGVISSISLSWFLTLFLSVMPFESAVVIVDCFFYEGIKVILQVALAVLDANMEQLLGCSDEGEAMTMLGRYLDNVVNKQSVSPPIPHLRALLSSSDDPPAEVDIFELLKVSYEKFSSLRAEDIEQMRFKQRLKVIQSLEDTAKRSVVRAIPVDIGFSIEELEDLYMVFKAKHLASQYWGCSRTMAGRRDPSLPYLEQYRIDASQFRELFASLTPWACGSHTPLLAGRMFRLLDENKDSLINFKEFVTGMSGMYHGDLTEKLKVLYKLHLPPALSPEEAESALEAAHYFTEDSSSEEALPQEEQEGSGSEERGEEKGTSSPDYRHYLRMWAKEKEAQKETIKDLPKMNQEQFIELCKTLYNMFSEDPMEQDLYHAIATVASLLLRIGESPSNSSTETLTKFQGPLGERGIRRARKGFYQSINTTSPTIGPHLGIW

SEQ ID NO: 913489 - protein, 517 aa, Homo sapiens
RRRRRALPPRGPRPGASGSAMWLSPEEVLVANALWVTERANPFFVLQRRRGHGRGGGLTGLLVGTLDVVLDSSARVAPYRILHQTQDSQVYWTVACGSSRKEITKHWEWLENNLLQTLSIFDSEEDITTFVKGKIHGIIAEENKNLQPQGDEDPGKFKEAELKMRKQFGMPEGEKLVNYYSCSYWKGRVPRQGWLYLTVNHLCFYSFLLGKEVSLVVQWVDITRLEKNATLLFPESIRVDTRDQELFFSMFLNIGETFKLMEQLANLAMRQLLDSEGFLEDKALPRPIRPHRNISALKRDLDARAKNECYRATFRLPRDERLDGHTSCTLWTPFNKLHIPGQMFISNNYICFASKEEDACHLIIPLREVTIVEKADSSSVLPSPLSISTKSKMTFLFANLKDRDFLVQRISDFLQKTPSKQPGSIGSRKASVVDPSTESSPAPQEGSEQPASPASPLSSRQSFCAQEAPTASQGLLKLFQKNSPMEDLGAKGEVHPQAWAVASCLPLGSRTRLWSQR

SEQ ID NO: 913490 - protein, 492 aa, Homo sapiens
RRRRRALPPRGPRPGASGSAMWLSPEEVLVANALWVTERANPFFVLQRRRGHGRGGGLTGLLVGTLDVVLDSSARVAPYRILHQTQDSQVYWTVACGSSRKEITKHWEWLENNLLQTLSIFDSEEDITTFVKGKIHGIIAEENKNLQPQGDEDPGKFKEAELKMRKQFGMPEGEKLVNYYSCSYWKGRVPRQGWLYLTVNHLCFYSFLLGKEVSLVVQWVDITRLEKNATLLFPESIRVDTRDQELFFSMFLNIGETFKLMEQLANLAMRQLLDSEGFLEDKALPRPIRPHRNISALKRDLDARAKNECYRATFRLPRDERLDGHTSCTLWTPFNKLHIPGQMFISNNYICFASKEEDACHLIIPLREVTIVEKADSSSVLPSPLSISTKSKMTFLFANLKDRDFLVQRISDFLQKTPSKQPGSIGSRKASVVDPSTEPHTRYSSLLLGPLPMRNLLWLSFLHCCCTQSKATLWRPVHFGFVPMTFPARRSG

SEQ ID NO: 913491 - protein, 131 aa, Homo sapiens [sequence omitted]

SEQ ID NO: 913492 - protein, 1253 aa, Homo sapiens; identical to SEQ ID NO: 913485

SEQ ID NO: 913493 - protein, 1005 aa, Homo sapiens
RRRRRALPPRGPRPGASGSAMWLSPEEVLVANALWVTERANPFFVLQRRRGHGRGGGLTGLLVGTLDVVLDSSARVAPYRILHQTQDSQVYWTVACGSSRKEITKHWEWLENNLLQTLSIFDSEEDITTFVKGKIHGIIAEENKNLQPQGDEDPGKFKEAELKMRKQFGMPEGEKLVNYYSCSYWKGRVPRQGWLYLTVNHLCFYSFLLGKEVSLVVQWVDITRLEKNATLLFPESIRVDTRDQELFFSMFLNIGETFKLMEQLANLAMRQLLDSEGFLEDKALPRPIRPHRNISALKRDLDARAKNECYRATFRLPRDERLDGHTSCTLWTPFNKLHIPGQMFISNNYICFASKEEDACHLIIPLREVTIVEKADSSSVLPSPLSISTKSKMTFLFANLKDRDFLVQRISDFLQKTPSKQPGSIGSRKASVVDPSTESSPAPQEGSEQPASPASPLSSRQSFCAQEAPTASQGLLKLFQKNSPMEDLGAKGAKEKMKEESWHIHFFEYGRGVCMYRTAKTRALVLKGIPESLRGELWLLFSGAWNEMVTHPGYYAELVEKSTGKYSLATEEIERDLHRSMPEHPAFQNELGIAALRRVLTAYAFRNPTIGYCQAMNIVTSVLLLYGSEEEAFWLLVALCERMLPELCGSHTPLLAGRMFRLLDENKDSLINFKEFVTGMSGMYHGDLTEKLKVLYKLHLPPALSPEEAESALEAAHYFTEDSSSEEALPQEEQEGSGSEERGEEKGTSSPDYRHYLRMWAKEKEAQKETIKDLPKMNQEQFIELCKTLYNMFSEDPMEQDLYHAIATVASLLLRIGEVGKKFSARTGRKPRDCATEEDEPPAPELHQDAARELQPPAAGDPQAKAGGDTHLGTAPQESQVVVEGGSGEGQGSPSQLLSDDETKDDMSMSSYSVVSTGSLQCEDLADDTVLVGGEACSPTARIGGTVDTDWCISFEQILASILTESVLVNFFEKRVDIGLKIKDQKKVERQFSTASDHEQPGVSG

SEQ ID NO: 913494 - protein, 360 aa, Homo sapiens
GGRTNYRLGYEARVVGLLDENKDSLINFKEFVTGMSGMYHGDLTEKLKVLYKLHLPPALSPEEAESALEAAHYFTEDSSSEEALPQEEQEGSGSEERGEEKGTSSPDYRHYLRMWAKEKEAQKETIKDLPKMNQEQFIELCKTLYNMFSEDPMEQDLYHAIATVASLLLRIGEVGKKFSARTGRKPRDCATEEDEPPAPELHQDAARELQPPAAGDPQAKAGGDTHLGTAPQESQVVVEGGSGEGQGSPSQLLSDDETKDDMSMSSYSVVSTGSLQCEDLADDTVLVGGEACSPTARIGGTVDTDWCISFEQILASILTESVLVNFFEKRVDIGLKIKDQKKVERQFSTASDHEQPGVSG

SEQ ID NO: 913495 - protein, 324 aa, Homo sapiens [sequence omitted]

SEQ ID NO: 913496 - protein, 1270 aa, Homo sapiens; identical to SEQ ID NO: 913479

SEQ ID NO: 913497 - protein, 247 aa, Homo sapiens [sequence omitted]

SEQ ID NO: 913498 - protein, 1253 aa, Homo sapiens; identical to SEQ ID NO: 913485

SEQ ID NO: 913499 - protein, 1235 aa, Homo sapiens; identical to SEQ ID NO: 913486

SEQ ID NO: 913500 - protein, 487 aa, Homo sapiens
RRRRRALPPRGPRPGASGSAMWLSPEEVLVANALWVTERANPFFVLQRRRGHGRGGGLTGLLVGTLDVVLDSSARVAPYRILHQTQDSQVYWTVACGSSRKEITKHWEWLENNLLQTLSIFDSEEDITTFVKGKIHGIIAEENKNLQPQGDEDPGKFKEAELKMRKQFGMPEGEKLVNYYSCSYWKGRVPRQGWLYLTVNHLCFYSFLLGKEVSLVVQWVDITRLEKNATLLFPESIRVDTRDQELFFSMFLNIGETFKLMEQLANLAMRQLLDSEGFLEDKALPRPIRPHRNISALKRDLDARAKNECYRATFRLPRDERLDGHTSCTLWTPFNKLHIPGQMFISNNYICFASKEEDACHLIIPLREVTIVEKADSSSVLPSPLSISTKSKMTFLFANLKDRDFLVQRISDFLQKTPSKQPGSIGSRKASVVDPSTEVRSPLGAAGSSWAQEEPGHPSASPLEPDPMVPAVGLRLGVDVSELARDP

SEQ ID NO: 913501 - protein, 394 aa, Homo sapiens
RRRRRALPPRGPRPGASGSAMWLSPEEVLVANALWVTERANPFFVLQRRRGHGRGGGLTGLLVGTLDVVLDSSARVAPYRILHQTQDSQVYWTVACGSSRKEITKHWEWLENNLLQTLSIFDSEEDITTFVKGKIHGIIAEENKNLQPQGDEDPGKFKEAELKMRKQFGMPEGEKLVNYYSCSYWKGRVPRQGWLYLTVNHLCFYSFLLGKEVSLVVQWVDITRLEKNATLLFPESIRVDTRDQELFFSMFLNIGETFKLMEQLANLAMRQLLDSEGFLEDKALPRPIRPHRNISALKRDLDARAKNECYRATFRLPRDERLDGHTSCTLWTPFNKLHIPGQMFISNNYICFASKEEDACHLIIPLREVTIVEKADYPACCPSPVVIRDRLDHP

SEQ ID NO: 913502 - protein, 124 aa, Homo sapiens
PCYCPQSTRRRTETAGTRVSPGAWNEMVTHPGYYAELVEKSTGKYSLATEEIERDLHRSMPEHPAFQNELGIAALRRVLTAYAFRNPTIGYCQVRGLTGAQRQHLPPEVHRSRSLWSQACVVTL

SEQ ID NO: 913503 - protein, 327 aa, Homo sapiens
MPGPTQTLSPNGENNNDIIQDNNGTIIPFRKHTVRGERSYSWGMAVNVYSTSITQETMSRHDIIAWVNDIVSLNYTKVEQLCSGAAYCQFMDMLFPGCISLKKVKFQAKLEHEYIHNFKLLQASFKRMNVDKVIPVEKLVKGRFQDNLDFIQWFKKFYDANYDGKEYDPVEARQGQDAIPPPDPGEQIFNLPKKSHHANSPTAGAAKSSPAAKPGSTPSRPSSAKRASSSGSASKSDKDLETQVIQLNEQVHSLKLALEGVEKERDFYFGKLREIELLCQEHGQENDDLVQRLMDILYASEEHEGHTEEPEAEEQAHEQQPPQQEEY

SEQ ID NO: 913504 - protein, 327 aa, Homo sapiens; identical to SEQ ID NO: 913503

SEQ ID NO: 913505 - protein, 327 aa, Homo sapiens; identical to SEQ ID NO: 913503

SEQ ID NO: 913506 - protein, 327 aa, Homo sapiens
SGENKAPSCQQRKEATAPEQCPVSQRNSSFQQPGRKPGCSSWGMAVNVYSTSITQETMSRHDIIAWVNDIVSLNYTKVEQLCSGAAYCQFMDMLFPGCISLKKVKFQAKLEHEYIHNFKLLQASFKRMNVDKVIPVEKLVKGRFQDNLDFIQWFKKFYDANYDGKEYDPVEARQGQDAIPPPDPGEQIFNLPKKSHHANSPTAGAAKSSPAAKPGSTPSRPSSAKRASSSGSASKSDKDLETQVIQLNEQVHSLKLALEGVEKERDFYFGKLREIELLCQEHGQENDDLVQRLMDILYASEEHEGHTEEPEAEEQAHEQQPPQQEEY

SEQ ID NO: 913507 - protein, 306 aa, Homo sapiens
AEKTKPPAVSRGRRRQRRSSWGMAVNVYSTSITQETMSRHDIIAWVNDIVSLNYTKVEQLCSGAAYCQFMDMLFPGCISLKKVKFQAKLEHEYIHNFKLLQASFKRMNVDKVIPVEKLVKGRFQDNLDFIQWFKKFYDANYDGKEYDPVEARQGQDAIPPPDPGEQIFNLPKKSHHANSPTAGAAKSSPAAKPGSTPSRPSSAKRASSSGSASKSDKDLETQVIQLNEQVHSLKLALEGVEKERDFYFGKLREIELLCQEHGQENDDLVQRLMDILYASEEHEGHTEEPEAEEQAHEQQPPQQEEY

SEQ ID NO: 913508 - protein, 327 aa, Homo sapiens; identical to SEQ ID NO: 913503

SEQ ID NO: 913509 - protein, 327 aa, Homo sapiens; identical to SEQ ID NO: 913503

SEQ ID NO: 913510 - protein, 105 aa, Homo sapiens
MPGPTQTLSPNGENNNDIIQDNNGTIIPFRKHTVRGERSYSWGMAVNVYSTSITQETMSRHDIIAWVNDIVSLNYTKVEQLCSGKTYSFKCLPKYLQSVMWNVIL

SEQ ID NO: 913511 - protein, 259 aa, Homo sapiens
SGENKAPSCQQRKEATAPEQCPVSQRNSSFQQPGRKPGCSSWGMAVNVYSTSITQETMSRHDIIAWVNDIVSLNYTKVEQLCSGAAYCQFMDMLFPGCISLKKVKFQAKLEHEYIHNFKLLQASFKRMNVDKVIPVEKLVKGRFQDNLDFIQWFKKFYDANYDGKEYDPVEARQGQDAIPPPDPGEQIFNLPKKSHHANSPTAGAAKSSPAAKPGSTPSRPSSAKRASSSGSASKSDKDLETQVIQLNEQVMHQLWPRL

SEQ ID NO: 913512 - protein, 327 aa, Homo sapiens; identical to SEQ ID NO: 913503

SEQ ID NO: 913513 - protein, 315 aa, Homo sapiens
MKQNRDQKCPVSQRNSSFQQPGRKPGCSSWGMAVNVYSTSITQETMSRHDIIAWVNDIVSLNYTKVEQLCSGAAYCQFMDMLFPGCISLKKVKFQAKLEHEYIHNFKLLQASFKRMNVDKVIPVEKLVKGRFQDNLDFIQWFKKFYDANYDGKEYDPVEARQGQDAIPPPDPGEQIFNLPKKSHHANSPTAGAAKSSPAAKPGSTPSRPSSAKRASSSGSASKSDKDLETQVIQLNEQVHSLKLALEGVEKERDFYFGKLREIELLCQEHGQENDDLVQRLMDILYASEEHEGHTEEPEAEEQAHEQQPPQQEEY

SEQ ID NO: 913514 - protein, 200 aa, Homo sapiens [sequence omitted]

SEQ ID NO: 913515 - protein, 259 aa, Homo sapiens
MPGPTQTLSPNGENNNDIIQDNNGTIIPFRKHTVRGERSYSWGMAVNVYSTSITQETMSRHDIIAWVNDIVSLNYTKVEQLCSGAAYCQFMDMLFPGCISLKKVKFQAKLEHEYIHNFKLLQASFKRMNVDKVIPVEKLVKGRFQDNLDFIQWFKKFYDANYDGKEYDPVEARQGQDAIPPPDPGEQIFNLPKKSHHANSPTAGAAKSSPAAKPGSTPSRPSSAKRASSSGSASKSDKDLETQVIQLNEQVMHQLWPRL

SEQ ID NO: 913516 - protein, 149 aa, Homo sapiens
SGENKAPSCQQRKEATAPEQCPVSQRNSSFQQPGRKPGCSSWGMAVNVYSTSITQETMSRHDIIAWVNDIVSLNYTKVEQLCSGAAYCQFMDMLFPGCISLKKVKFQAKLEHEYIHNFKLLQASFKRMNVDKGFQWKAWKGPFKTTWIY

SEQ ID NO: 913517 - protein, 551 aa, Homo sapiens
MPSETPQAEVGPTGCPHRSGPHSAKGSLEKGSPEDKEAKEPLWIRPDAPSRCTWQLGRPASESPHHHTAPAKSPKILPDILKKIGDTPMVRINKIGKKFGLKCELLAKCEFFNAGGSVKDRISLRMIEDAERDGTLKPGDTIIEPTSGNTGIGLALAAAVRGYRCIIVMPEKMSSEKVDVLRALGAEIVRTPTNARFDSPESHVGVAWRLKNEIPNSHILDQYRNASNPLAHYDTTADEILQQCDGKLDMLVASVGTGGTITGIARKLKEKCPGCRIIGVDPEGSILAEPEELNQTEQTTYEVEGIGYDFIPTVLDRTVVDKWFKSNDEEAFTFARMLIAQEGLLCGGSAGSTVAVAVKAAQELQEGQRCVVILPDSVRNYMTKFLSDRWMLQKGFLKEEDLTEKKPWWWHLRVQELGLSAPLTVLPTITCGHTIEILREKGFDQAPVVDEAGVILGMVTLGNMLSSLLAGKVQPSDQVGKVIYKQFKQIRLTDTLGRLSHILEMDHFALVVHEQIQYHSTGKSSQRQMVFGVVTAIDLLNFVAAQERDQK

SEQ ID NO: 913518 - protein, 551 aa, Homo sapiens; identical to SEQ ID NO: 913517

SEQ ID NO: 913519 - protein, 551 aa, Homo sapiens; identical to SEQ ID NO: 913517

SEQ ID NO: 913520 - protein, 258 aa, Homo sapiens
MVRINKIGKKFGLKCELLAKCEFFNAGGSVKDRISLRMIEDAERDGTLKPGDTIIEPTSGNTGIGLALAAAVRGYRCIIVMPEKMSSEKVDVLRALGAEIVRTPTNARFDSPESHVGVAWRLKNEIPNSHILDQYRNASNPLAHYDTTADEILQQCDGKLDMLVASVGTGGTITGIARKLKEKCPGCRIIGVDPEGSILAEPEELNQTEQTTYEVEGIGYDFIPTVLDRTPAVVARGPEHAVGASLAVVSAKVLRCSV

SEQ ID NO: 913521 - protein, 59 aa, Homo sapiens
MFGKRPRPRPPGPGEGAPRGAPATTLRGVGPVPESARQPLAVGRTGAAQGDCSAPRLGV

SEQ ID NO: 913522 - protein, 551 aa, Homo sapiens; identical to SEQ ID NO: 913517

SEQ ID NO: 913523 - protein, 506 aa, Homo sapiens
MPSETPQAEVGPTGCPHRSGPHSAKGSLEKGSPEDKEAKEPLWIRPDAPSRCTWQLGRPASESPHHHTAPAKSPKILPDILKKIGDTPMVRINKIGKKFGLKCELLAKCEFFNAGGSVKDRISLRMIEDAERDGTLKPGDTIIEPTSGNTGIGLALAAAVRGYRCIIVMPEKMSSEKVDVLRALGAEIVRTPTNARFDSPESHVGVAWRLKNEIPNSHILDQYRNASNPLAHYDTTADEILQQCDGKLDMLVASVGTGGTITGIARKLKEKCPGCRIIGVDPEGSILAEPEELNQTEQTTYEVEGIGYDFIPTVLDRTVVDKWFKSNDEEAFTFARMLIAQEGLLCGGSAGSTVAVAVKAAQELQEGQRCVVILPDSVRNYMTKFLSDRWMLQKGFLKEEDLTEKKPWVILGMVTLGNMLSSLLAGKVQPSDQVGKVIYKQFKQIRLTDTLGRLSHILEMDHFALVVHEQIQYHSTGKSSQRQMVFGVVTAIDLLNFVAAQERDQK

SEQ ID NO: 913524 - protein, 463 aa, Homo sapiens [sequence omitted]

SEQ ID NO: 913525 - protein, 551 aa, Homo sapiens; identical to SEQ ID NO: 913517

SEQ ID NO: 913526 - protein, 566 aa, Homo sapiens
MPSETPQAEVGPTGCPHRSGPHSAKGSLEKGSPEDKEAKEPLWIRPDAPSRCTWQLGRPASESPHHHTAPAKSPKILPDILKKIGDTPMVRINKIGKKFGLKCELLAKCEFFNAGGSVKDRISLRMIEDAERDGTLKPGDTIIEPTSGNTGIGLALAAAVRGYRCIIVMPEKMSSEKVDVLRALGAEIVRTPTNARFDSPESHVGVAWRLKNEIPNSHILDQYRNASNPLAHYDTTADEILQQCDGKLDMLVASVGTGGTITGIARKLKEKCPGCRIIGVDPEGSILAEPEELNQTEQTTYEVEGIGYDFIPTVLDRTVVDKWFKSNDEEAFTFARMLIAQEGLLCGGSAGSTVAVAVKAAQELQEGQRCVVILPDSVRNYMTKFLSDRWMLQKGFLKEEDLTEKKPWWWHLRVQELGLSAPLTVLPTITCGHTIEILREKGFDQAPVVDEAGVILGMVTLGNMLSSLLAGKVQPSDQVGKVIYKQFKQIRLTDTLGRLSHILEMDHFALVVHEQIQYHSTGKSSQRQMVFGVVTAIDLLNFVAAQERDQKMFHQGNIEREVGQVG

SEQ ID NO: 913527 - protein, 326 aa, Homo sapiens
TTLEIPRSDYAARSDYAADLRKLDMLVASVGTGGTITGIARKLKEKCPGCRIIGVDPEGSILAEPEELNQTEQTTYEVEGIGYDFIPTVLDRTVVDKWFKSNDEEAFTFARMLIAQEGLLCGGSAGSTVAVAVKAAQELQEGQRCVVILPDSVRNYMTKFLSDRWMLQKGFLKEEDLTEKKPWWWHLRVQELGLSAPLTVLPTITCGHTIEILREKGFDQAPVVDEAGVILGMVTLGNMLSSLLAGKVQPSDQVGKVIYKQFKQIRLTDTLGRLSHILEMDHFALVVHEQIQYHSTGKSSQRQMVFGVVTAIDLLNFVAAQERDQK

SEQ ID NO: 913528 - protein, 566 aa, Homo sapiens
MPSETPQAEVGPTGCPHRSGPHSAKGSLEKGSPEDKEAKEPLWIRPDAPSRCTWQLGRPASESPHHHTAPAKSPKILPDILKKIGDTPMVRINKIGKKFGLKCELLAKCEFFNAGGSVKDRISLRMIEDAERDGTLKPGDTIIEPTSGNTGIGLALAAAVRGYRCIIVMPEKMSSEKVDVLRALGAEIVRTPTNARFDSPESHVGVAWRLKNEIPNSHILDQYRNASNPLAHYDTTADEILQQCDGKLDMLVASVGTGGTITGIARKLKEKCPGCRIIGVDPEGSILAEPEELNQTEQTTYEVEGIGYDFIPTVLDRTVVDKWFKSNDEEAFTFARMLIAQEGLLCGGSAGSTVAVAVKAAQELQEGQRCVVILPDSVRNYMTKFLSDRWMLQKGFLKEEDLTEKKPWWWHLRVQELGLSAPLTVLPTITCGHTIEILREKGFDQAPVVDEAGVILGMVTLGNMLSSLLAGKVQPSDQVGKVIYKQFKQIRLTDTLGRLSHILEMDHFALVVHEQIQSQDQAWAGVVGGPAGRYHPPLRMALRLRFTASPWQMEAFQGPGPTPKLG

SEQ ID NO: 913529 - protein, 538 aa, Homo sapiens
MPSETPQAEVGPTGCPHRSGPHSAKGSLEKGSPEDKEAKEPLWIRPDAPSRCTWQLGRPASESPHHHTAPAKSPKILPDILKKIGDTPMVRINKIGKKFGLKCELLAKCEFFNAGGSVKDRISLRMIEDAERDGTLKPGDTIIEPTSGNTGIGLALAAAVRGYRCIIVMPEKMSSEKVDVLRALGAEIVRTPTNARFDSPESHVGVAWRLKNEIPNSHILDQYRNASNPLAHYDTTADEILQQCDGKLDMLVASVGTGGTITGIARKLKEKCPGCRIIGVDPEGSILAEPEELNQTEQTTYEVEGIGYDFIPTVLDRTVVDKWFKSNDEEAFTFARMLIAQEGLLCGGSAGSTVAVAVKAAQELQEGQRCVVILPDSVRNYMTKFLSDRWMLQKGFLKEEDLTEKKPWWWHLRVQELGLSAPLTVLPTITCGHTIEILREKGFDQAPVVDEAGVILGMVTLGNMLSSLLAGKVQPSDQVGKVIYKQFKQIRLTDTLGRLSHILEMDHFALVVHEQIQYHSTGKFSKSMAVTTPNTICR

SEQ ID NO: 913530 - protein, 409 aa, Homo sapiens
MPSETPQAEVGPTGCPHRSGPHSAKGSLEKGSPEDKEAKEPLWIRPDAPSRCTWQLGRPASESPHHHTAPAKSPKILPDILKKIGDTPMVRINKIGKKFGLKCELLAKCEFFNAGGSVKDRISLRMIEDAERDGTLKPGDTIIEPTSGNTGIGLALAAAVRGYRCIIVMPEKMSSEKVDVLRALGAEIVRTPTNARFDSPESHVGVAWRLKNEIPNSHILDQYRNASNPLAHYDTTADEILQQCDGKLDMLVASVGTGGTITGIARKLKEKCPGCRIIGVDPEGSILAEPEELNQTEQTTYEVEGIGYDFIPTVLDRTVVDKWFKSNDEEAFTFARMLIAQEGLLCGEWVAGTGVWGRQRWLGGTGDGWGRTLSQPPTCMCKTAVLRSVTAAATSLRCCLPAQCGHLLR

SEQ ID NO: 913531 - protein, 255 aa, Homo sapiens
DGCVHAHTRLLAMGAGSPAPRLPPGASSQHLGVSAAPVRSRRGAGQAVRATQQGRGPGGALRGLGDSPIPRTKFLSDRWMLQKGFLKEEDLTEKKPWWWHLRVQELGLSAPLTVLPTITCGHTIEILREKGFDQAPVVDEAGVILGMVTLGNMLSSLLAGKVQPSDQVGKVIYKQFKQIRLTDTLGRLSHILEMDHFALVVHEQIQYHSTGKSSQRQMVFGVVTAIDLLNFVAAQERDQKMFHQGNIEREVGQVG

SEQ ID NO: 913532 - protein, 551 aa, Homo sapiens; identical to SEQ ID NO: 913517

SEQ ID NO: 913533 - protein, 446 aa, Homo sapiens
MAKCEFFNAGGSVKDRISLRMIEDAERDGTLKPGDTIIEPTSGNTGIGLALAAAVRGYRCIIVMPEKMSSEKVDVLRALGAEIVRTPTNARFDSPESHVGVAWRLKNEIPNSHILDQYRNASNPLAHYDTTADEILQQCDGKLDMLVASVGTGGTITGIARKLKEKCPGCRIIGVDPEGSILAEPEELNQTEQTTYEVEGIGYDFIPTVLDRTVVDKWFKSNDEEAFTFARMLIAQEGLLCGGSAGSTVAVAVKAAQELQEGQRCVVILPDSVRNYMTKFLSDRWMLQKGFLKEEDLTEKKPWWWHLRVQELGLSAPLTVLPTITCGHTIEILREKGFDQAPVVDEAGVILGMVTLGNMLSSLLAGKVQPSDQVGKVIYKQFKQIRLTDTLGRLSHILEMDHFALVVHEQIQYHSTGKSSQRQMVFGVVTAIDLLNFVAAQERDQK

SEQ ID NO: 913534 - protein, 153 aa, Homo sapiens [sequence omitted]

SEQ ID NO: 913535 - protein, 52 aa, Homo sapiens
MDEAGVILGMVTLGNMLSSLLAGKVQPSDQVGKVIYKQFKQVPSHLQAAQTD

SEQ ID NO: 913536 - protein, 551 aa, Homo sapiens; identical to SEQ ID NO: 913517

SEQ ID NO: 913537 - protein, 408 aa, Homo sapiens
MLRAGAPGIGLALAAAVRGYRCIIVMPEKMSSEKVDVLRALGAEIVRTPTNARFDSPESHVGVAWRLKNEIPNSHILDQYRNASNPLAHYDTTADEILQQCDGKLDMLVASVGTGGTITGIARKLKEKCPGCRIIGVDPEGSILAEPEELNQTEQTTYEVEGIGYDFIPTVLDRTVVDKWFKSNDEEAFTFARMLIAQEGLLCGGSAGSTVAVAVKAAQELQEGQRCVVILPDSVRNYMTKFLSDRWMLQKGFLKEEDLTEKKPWWWHLRVQELGLSAPLTVLPTITCGHTIEILREKGFDQAPVVDEAGVILGMVTLGNMLSSLLAGKVQPSDQVGKVIYKQFKQIRLTDTLGRLSHILEMDHFALVVHEQIQYHSTGKSSQRQMVFGVVTAIDLLNFVAAQERDQK

SEQ ID NO: 913538 - protein, 551 aa, Homo sapiens; identical to SEQ ID NO: 913517

SEQ ID NO: 913539 - protein, 360 aa, Homo sapiens
QTKGSNEGCSNWRRSFSFELFGYPPWFGLSVFSMIITMSDGLARQGPKNVIRPPGKLDMLVASVGTGGTITGIARKLKEKCPGCRIIGVDPEGSILAEPEELNQTEQTTYEVEGIGYDFIPTVLDRTVVDKWFKSNDEEAFTFARMLIAQEGLLCGGSAGSTVAVAVKAAQELQEGQRCVVILPDSVRNYMTKFLSDRWMLQKGFLKEEDLTEKKPWWWHLRVQELGLSAPLTVLPTITCGHTIEILREKGFDQAPVVDEAGVILGMVTLGNMLSSLLAGKVQPSDQVGKVIYKQFKQIRLTDTLGRLSHILEMDHFALVVHEQIQYHSTGKSSQRQMVFGVVTAIDLLNFVAAQERDQK

SEQ ID NO: 913540 - protein, 269 aa, Homo sapiens
MPSETPQAEVGPTGCPHRSGPHSAKGSLEKGSPEDKVVDKWFKSNDEEAFTFARMLIAQEGLLCGGSAGSTVAVAVKAAQELQEGQRCVVILPDSVRNYMTKFLSDRWMLQKGFLKEEDLTEKKPWWWHLRVQELGLSAPLTVLPTITCGHTIEILREKGFDQAPVVDEAGVILGMVTLGNMLSSLLAGKVQPSDQVGKVIYKQFKQIRLTDTLGRLSHILEMDHFALVVHEQIQYHSTGKSSQRQMVFGVVTAIDLLNFVAAQERDQK

SEQ ID NO: 913541 - protein, 506 aa, Homo sapiens; identical to SEQ ID NO: 913523

SEQ ID NO: 913542 - protein, 360 aa, Homo sapiens
MPSETPQAEVGPTGCPHRSGPHSAKGSLEKGSPEDKEAKEPLWIRPDAPSRCTWQLGRPASESPHHHTAPAKSPKILPDILKKIGDTPMVRINKIGKKFGLKCELLAKCEFFNAGGSVKDRISLRMIEDAERDGTLKPGDTIIEPTSGNTGIGLALAAAVRGYRCIIVMPEKMSSEKVDVLRALGAEIVRTPTNARFDSPESHVGVAWRLKNEIPNSHILDQYRNASNPLAHYDTTADEILQQCDGKLDMLVASVGTGGTITGIARKLKEKCPGCRIIGVDSPKGSHSFAGGPEGGWNQTGATNYGGGGVRYDFLPPGGSGPAGVGQGSPDRVGGSLSPFVAKGGCAGLLRGPRAGLSAL

SEQ ID NO: 913543 - protein, 279 aa, Homo sapiens
GGAAAPAASTSSSAGFCAPGPPLLPPVPRRLMEAPEGGGGGPAARGPEGQPAPEARVHFRVARFIMEAGVKLGMRSIPIATACTIYHKFFCETNLDAYDPYLIAMSSIYLAGKVEEQHLRTRDIINVSNRYFNPSGEPLELDSRFWELRDSIVQCELLMLRVLRFQVSFQHPHKYLLHYLVSLQNWLNRHSWQRTPVAVTAWALLRDSYHGALCLRFQAQHIAVAVLYLALQVYGVEVPAEVEAEKPWWQVFNDDLTKPIIDNIVSDLIQIYTMDTEIP

SEQ ID NO: 913544 - protein, 279 aa, Homo sapiens; identical to SEQ ID NO: 913543

SEQ ID NO: 913545 - protein, 259 aa, Homo sapiens
GGAAAPAASTSSSAGFCAPGPPLLPPVPRRLMEAPEGGGGGPAARGPEGQPAPEARVHFRVARFIMEAGVKLGMRSIPIATACTIYHKFFCETNLDAYDPYLIAMSSIYLAGKVEEQHLRTRDIINVSNRYFNPSGEPLELDSRFWELRDSIVQCELLMLRVLRFQVSFQHPHKYLLHYLVSLQNWLNRHSWQRTPVAVTAWALLRDSYHGALCLRFQAQHIAVAVLYLALQVYGVEVPAEVEAEKPWWQIYTMDTEIP

SEQ ID NO: 913546 - protein, 264 aa, Homo sapiens
GWGGSARREHLQFCRLLRAGAASPSAGAAAPHGSPGGRRRGACSAGPGGAAGARSQGALPSGEVHHGGSIYHKFFCETNLDAYDPYLIAMSSIYLAGKVEEQHLRTRDIINVSNRYFNPSGEPLELDSRFWELRDSIVQCELLMLRVLRFQVSFQHPHKYLLHYLVSLQNWLNRHSWQRTPVAVTAWALLRDSYHGALCLRFQAQHIAVAVLYLALQVYGVEVPAEVEAEKPWWQVFNDDLTKPIIDNIVSDLIQIYTMDTEIP

SEQ ID NO: 913547 - protein, 272 aa, Homo sapiens
ETQTDGGERDETERNSKILDGLHDAPGGPDSPSAGAAAPHGSPGGRRRGACSAGPGGAAGARSQGALPSGEVHHGGSIYHKFFCETNLDAYDPYLIAMSSIYLAGKVEEQHLRTRDIINVSNRYFNPSGEPLELDSRFWELRDSIVQCELLMLRVLRFQVSFQHPHKYLLHYLVSLQNWLNRHSWQRTPVAVTAWALLRDSYHGALCLRFQAQHIAVAVLYLALQVYGVEVPAEVEAEKPWWQVFNDDLTKPIIDNIVSDLIQIYTMDTEIP

SEQ ID NO: 913548 - protein, 127 aa, Homo sapiens
SIAISLRRYFNPSGEPLELDSRFWELRDSIVQCELLMLRVLRFQVSFQHPHKNWLNRHSWQRTPVAVTAWALLRDSYHGALCLRFQAQHIAVAVLYLALQVYGVEVPAEVEAEKPWWQIYTMDTEIP

SEQ ID NO: 913549 - protein, 279 aa, Homo sapiens; identical to SEQ ID NO: 913543

SEQ ID NO: 913550 - protein, 259 aa, Homo sapiens; identical to SEQ ID NO: 913545

SEQ ID NO: 913551 - protein, 279 aa, Homo sapiens; identical to SEQ ID NO: 913543

SEQ ID NO: 913552 - protein, 259 aa, Homo sapiens; identical to SEQ ID NO: 913545

SEQ ID NO: 913553 - protein, 203 aa, Homo sapiens
GGAAAPAASTSSSAGFCAPGPPLLPPVPRRLMEAPEGGGGGPAARGPEGQPAPEARVHFRVARFIMEAGVKLGMRSIPIATACTIYHKFFCETNLDAYDPYLIAMSSIYLAGKVEEQHLRTRDIINVSNRYFNPSGEPLELDSRFWELRDSIVQCELLMLRVLRFQVSFQHPHKVFNDDLTKPIIDNIVSDLIQIYTMDTEIP

SEQ ID NO: 913554 - protein, 292 aa, Homo sapiens
MASSMRSLFSDHGKYVESFRRFLNHSTEHQCMQEFMDKKLPGIIGRIGDTKSEIKILSIGGGAGEIDLQILSKVQAQYPGVCINNEVVEPSAEQIAKYKELVAKTSNLENVKFAWHKETSSEYQSRMLEKKELQKWDFIHMIQMLYYVKDIPATLKFFHSLLGTNAKMLIIVVSGSSGWDKLWKKYGSRFPQDDLCQYITSDDLTQMLDNLGLKYECYDLLSTMDISDCFIDGNENGDLLWDFLTETCNFNATAPPDLRAELGKDLQEPEFSAKKEGKVLFNNTLSFIVIEA

SEQ ID NO: 913555 - protein, 292 aa, Homo sapiens; identical to SEQ ID NO: 913554

SEQ ID NO: 913556 - protein, 307 aa, Homo sapiens
GVPVDRPFWPGRKPNMASSMRSLFSDHGKYVESFRRFLNHSTEHQCMQEFMDKKLPGIIGRIGDTKSEIKILSIGGGAGEIDLQILSKVQAQYPGVCINNEVVEPSAEQIAKYKELVAKTSNLENVKFAWHKETSSEYQSRMLEKKELQKWDFIHMIQMLYYVKDIPATLKFFHSLLGTNAKMLIIVVSGSSGWDKLWKKYGSRFPQDDLCQYITSDDLTQMLDNLGLKYECYDLLSTMDISDCFIDGNENGDLLWDFLTETCNFNATAPPDLRAELGKDLQEPEFSAKKEGKVLFNNTLSFIVIEA

SEQ ID NO: 913557 - protein, 198 aa, Homo sapiens
GVPVDRPFWPGRKPNMASSMRSLFSDHGKYVESFRRFLNHSTEHQCMQEFMDKKLPGIIGRIGDTKSEIKILSIGGGAGEIDLQILSKVQAQYPGVCINNEVVEPSAEQIAKYKELVAKTSNLENVKFAWHKETSSEYQSRMLEKKELQKWDFIHMIQMLYYVKDIPATLKFFHSLLGTNAKMLIIVVSGSSGWDKLW

SEQ ID NO: 913558 - protein, 66 aa, Homo sapiens
GVPVDRPFWPGRKPNMASSMRSLFSDHGKYVESFRRFLNHSTEHQCMQEFMDKKLPGIIGRYQNCC

SEQ ID NO: 913559 - protein, 66 aa, Homo sapiens; identical to SEQ ID NO: 913558

SEQ ID NO: 913560 - protein, 292 aa, Homo sapiens; identical to SEQ ID NO: 913554

SEQ ID NO: 913561 - protein, 238 aa, Homo sapiens
MASSMRSLFSDHGKYVESFRRFLNHSTEHQCMQEFMDKKLPGIIGRIGDTKSEIKILSIGGGAGEIDLQILSKVQAQYPGVCINNEVVEPSAEQIAKYKELVAKTSNLENVKFAWHKETSSEYQSRMLEKKELQKWDFIHMIQMLYYVKDIPATLKFFHSLLGTNAKMLIIVVSGSSGWDKLWKKYGSRFPQDDLCQYITSDDLTQMLDNLGLKYECYDLLSTMDISDCFIDGNESTT

SEQ ID NO: 913562 - protein, 274 aa, Homo sapiens
MASSMRSLFSDHGKYVESFRRFLNHSTEHQCMQEFMDKKLPGIIGRIGDTKSEIKILSIGGGAGEIDLQILSKVQAQYPGVCINNEVVEPSAEQIAKYKELVAKTSNLENVKFAWHKETSSEYQSRMLEKKELQKWDFIHMIQMLYYVKDIPATLKFFHSLLGTNAKMLIIVVSGSSGWDKLWKKYGSRFPQDDLCQYITSDDLTQMLDNLGLKYECYDLLSTMDISDCFIDGNELGTGWVFGGTEIYVRRFKQVGKFKGFVKGGVKRVGGVKF

SEQ ID NO: 913563 - protein, 96 aa, Homo sapiens
GVPVDRPFWPGRKPNMASSMRSLFSDHGKYVESFRRFLNHSTEHQCMQEFMDKKLPGIIGRIGDTKSEIKILSIGGGAGKRIIYIFLLAGRGYSRL

SEQ ID NO: 913564 - protein, 293 aa, Homo sapiens
MAMEMRLPVARKPLSERLGRDTKKHLVVPGDTITTDTGFMRGHGTYMGEEKLIASVAGSVERVNKLICVKALKTRYIGEVGDIVVGRITEVQQKRWKVETNSRLDSVLLLSSMNLPGGELRRRSAEDELAMRGFLQEGDLISAEVQAVFSDGAVSLHTRSLKYGKLGQGVLVQVSPSLVKRQKTHFHDLPCGASVILGNNGFIWIYPTPEHKEEEAGGFIANLEPVSLADREVISRLRNCIISLVTQRMMLYDTSILYCYEASLPHQIKDILKPEIMEEIVMETRQRLLEQEG

SEQ ID NO: 913565 - protein, 293 aa, Homo sapiens; identical to SEQ ID NO: 913564

SEQ ID NO: 913566 - protein, 293 aa, Homo sapiens; identical to SEQ ID NO: 913564

SEQ ID NO: 913567 - protein, 293 aa, Homo sapiens; identical to SEQ ID NO: 913564

SEQ ID NO: 913568 - protein, 293 aa, Homo sapiens; identical to SEQ ID NO: 913564

SEQ ID NO: 913569 - protein, 129 aa, Homo sapiens
MAMEMRLPVARKPLSERLGRDTKKHLVVPGDTITTDTGFMRGHGTYMGEEKLIASVAGSVERVNKLICVKALKTRYIGEVGDIVVGRITEVQQKRWKVETNSRLDSVLLLSSMNLPGGELVRATAGAMD

SEQ ID NO: 913570 - protein, 181 aa, Homo sapiens
MNLPGGELRRRSAEDELAMRGFLQEGDLISAEVQAVFSDGAVSLHTRSLKYGKLGQGVLVQVSPSLVKRQKTHFHDLPCGASVILGNNGFIWIYPTPEHKEEEAGGFIANLEPVSLADREVISRLRNCIISLVTQRMMLYDTSILYCYEASLPHQIKDILKPEIMEEIVMETRQRLLEQEG

SEQ ID NO: 913571 - protein, 275 aa, Homo sapiens
MAMEMRLPVARKPLSERLGRDTKKHLVVPGDTITTDTGFMRGHGTYMGEEKLIASVAGSVERVNKLICVKALKTRYIGEVGDIVVGRITEVQQKRWKVETNSRLDSVLLLSSMNLPGGELRRRSAEDELAMRGFLQEGDLISAEVQAVFSDGAVSLHTRSLKYGKTHFHDLPCGASVILGNNGFIWIYPTPEHKEEEAGGFIANLEPVSLADREVISRLRNCIISLVTQRMMLYDTSILYCYEASLPHQIKDILKPEIMEEIVMETRQRLLEQEG

SEQ ID NO: 913572 - protein, 160 aa, Homo sapiens
MRGFLQEGDLISLGQGVLVQVSPSLVKRQKTHFHDLPCGASVILGNNGFIWIYPTPEHKEEEAGGFIANLEPVSLADREVISRLRNCIISLVTQRMMLYDTSILYCYEASLPHQIKASLKQNIGGDCGGEPGEACDKAVRGVPNRDVGLRSAMVCVHGKN

SEQ ID NO: 913573 - protein, 293 aa, Homo sapiens; identical to SEQ ID NO: 913564

SEQ ID NO: 913574 - protein, 293 aa, Homo sapiens; identical to SEQ ID NO: 913564

SEQ ID NO: 913575 - protein, 263 aa, Homo sapiens
MAMEMRLPVARKPLSERLGRDTKKHLVVPGDTITTDTGFMRGHGTYMGEEKLIASVAGSVERVNKLICVKALKTRYIGEVGDIVVGRITERRRSAEDELAMRGFLQEGDLISAEVQAVFSDGAVSLHTRSLKYGKLGQGVLVQVSPSLVKRQKTHFHDLPCGASVILGNNGFIWIYPTPEHKEEEAGGFIANLEPVSLADREVISRLRNCIISLVTQRMMLYDTSILYCYEASLPHQIKDILKPEIMEEIVMETRQRLLEQEG

SEQ ID NO: 913576 - protein, 270 aa, Homo sapiens
MAMEMRLPVARKPLSERLGRDTKKHLVVPGDTITTDTGFMRGHGTYMGEEKLIASVAGSVERVNKLICVKALKTRYIGEVGDIVVGRITEVQQKRWKVETNSRLDSVLLLSSMNLPGGELRRRSAEDELAMRGFLQEGDLISLGQGVLVQVSPSLVKRQKTHFHDLPCGASVILGNNGFIWIYPTPEHKEEEAGGFIANLEPVSLADREVISRLRNCIISLVTQRMMLYDTSILYCYEASLPHQIKDILKPEIMEEIVMETRQRLLEQEG

SEQ ID NO: 913577 - protein, 195 aa, Homo sapiens
MAMEMRLPVARKPLSERLGRDTKKHLVVPGDTITTDTGFMRGHGTYMGEEKLIASVAGSVERVNKLICVKALKTRYIGEVGDIVVGRITEVQQKRWKVETNSRLDSVLLLSSMNLPGGELRRRSAEDELAMRGFLQEGDLISVSCALHSSLLMLFCGTGKWAFHCMSLTEEPCHPCRDPSLRPSVGLCCILSQSP

SEQ ID NO: 913578 - protein, 2114 aa, Homo sapiens
LTSDSQTRAVLRGSSAGHTVGALADSTEAPSKKPMSSSPSRSAADIYIREYFHSHVSGGHPEATPLRVMYTDRPLSQTDPVTLQYCCLTDDRQAFRPPTRAELARHRVVVTTTSQARELRVPVGFFSHILIDEAAQMLECEALTPLAYASHGTRLVLAGDHMQVTPRLFSVARARAAEHTLLHRLFLCYQQETHEVARQSRLVFHENYRCTDAIVSFISRHFYVAKGNPIHARGKVPPHPRHYPLMFCHVAGNPDRDMSMASWLNLAEIAQVVEKVQEAYNTWPSCWGGREQRCICVVSHGAQVSALRQELRRRDLGQVSVGSFEILPGRQFRVVVLSTVHTCQSLLSPGALAPEFFTDARVLNTVLTRAQSQLVVVGDAVALCSFGACGKLWESFIRECVERHSVCPEGLSMEQVEQGVAQRRRWPPRGTQAGAAGNWEAAPEPVGDLAEEQAAVVTAMVKAEPGDEALSPASRDITATTAQTEAAAAPAGDAVKEDVVPGACAAGAAAAAGVESTEAEDAEADFWPWDGELNADDAILRELLDESQKVMVTVGEDGLLDTVARPESLQQARLYENLPPAALRKLLHAEPERYRHCSFVPETFERASAIPLDDASSGPIQVRGRLDCGMAFAGDEVLVQLLSGDKAPEGRLRGRVLGVLKRKRHELAFVCRMDTWDPRIMVPINGSVTKIFVAELKDPSQVPIYSLRKGRLQRVGLERLTAEARHSRLFWVQIVLWRQGFYYPLGIVREVLPEASTWEQGLRILGLEYSLRVPPSDQATITKVLQKYHTELGRVAGRREDCRAFLTFTVDPQGACNLDDALSVRDLGPRCEVAVHITDVASFVPRDGVLDVEARRQGAAFYAPGREPVPMLPASLCQDVLSLLPGRDRLAISLFLTMEKASGQLKSLRFAPSVVQSDRQLSYEEAEEVIRQHPGAGRELPARLDSVDACVVAACYFSRLLRRHRLRSDCFYEQPDEDGTLGFRAAHIMVKEYMIQFNRLVAEFLVGSECTRTVTPLRWQPAPRSQQLKALCEKHGDRVPLSLHLGHHLHGGGGSPPDTRLHLLASLWKQVQFAARTQDYEQMVDLVTTDDMHPFLAPAGRDLRKALERSAFGRCARGHQQQGGHYSLQVDWYTWATSPIRRYLDVVLQRQILLALGHGGSAYSARDIDGLCQAFSLQHALAQSYQRRARSLHLAVQLKAQPLDKLGFVVDVEAGSRCFRLLFPSNRETLPDPCPVPYGSLQLAEHPHALAGRPGLRLLWRRRVYSAQGSSPPLPLPGTVPDPHTLAVETALWKQLLELVELQRWPEAAALIQEKGEASQRRELVQVQRSHCGHFLEVARELGSGDTLQVQLGTSLQHGFLVPSPQLWTVAPGFSLCLEHVERPGDCFSGRVYRAPRDRYRDVDEYACVWEPFCALESATGAVAENDSVTLQHLSVSWEASRTPQGQLQGAFRLEAAFLEENCADINFSCCYLCIRLEGLLAPTASPRPGPSSLGPGLNVDPGTYTWVAHGQTEDWDQERRADRQEAPRRVHLFVHHMGMEKVPEEVLRPGTLFTVELLPKQLPDLRKEEAVRGLEEASPLVTSIALGRPVPQPLCRVIPSRFLERQTYNIPGGRHKLNPSQNVAVREALEKPFTVIQGPPGTGKTIVGLHIVFWFHKSNQEQVQPGGPPRGEKRLGGPCILYCGPSNKSVDVLAGLLLRRMELKPLRVYSEQAEASEFPVPRVGSRKLLRKSPREGRPNQSLRSITLHHRIRQAPNPYSSEIKAFDTRLQRGELFSREDLVWYKKVLWEARKFELDRHEVILCTCSCAASASLKILDVRQILVDEAGMATEPETLIPLVQFPQAEKVVLLGDHKQLRPVVKNERLQNLGLDRSLFERYHEDAHMLDTQYRMHEGICAFPSVAFYKSKLKTWQGLRRPPSVLGHAGKESCPVIFGHVQGHERSLLVSTDEGNENSKANLEEVAEVVRITKQLTLGRTVEPQDIAVLTPYNAQASEISKALRREGIAGVAVSSITKSQGSEWRYVLVSTVRTCAKSDLDQRPTKSWLKKFLGFVVDPNQVNVAVTRAQEGLCLIGDHLLLRCCPLWRSLLDFCEAQQTLVPAGQVRVCRRPTMPS

SEQ ID NO: 913579 - protein, 356 aa, Homo sapiens
SLEKSSSPGPPWRRAPLSAGEDLVWYKKVLWEARKFELDRHEVILCTCSCAASASLKILDVRQILVDEAGMATEPETLIPLVQFPQAEKVVLLGDHKQLRPVVKNERLQNLGLDRSLFERYHEDAHMLDTQYRMHEGICAFPSVAFYKSKLKTWQGLRRPPSVLGHAGKESCPVIFGHVQGHERSLLVSTDEGNENSKANLEEVAEVVRITKQLTLGRTVEPQDIAVLTPYNAQASEISKALRREGIAGVAVSSITKSQGSEWRYVLVSTVRTCAKSDLDQRPTKSWLKKFLGFVVDPNQVNVAVTRAQEGLCLIGDHLLLRCCPLWRSLLDFCEAQQTLVPAGQVRVCRRPTMPS

SEQ ID NO: 913580 - protein, 75 aa, Homo sapiens
RRQAGPGRLMAEGGGEGGGALDFPCLLASGSPWGRKWVDLEEERQGPVPTLLLLLGIWGQEHLSGWPRGASLGPV

SEQ ID NO: 913581 - protein, 107 aa, Homo sapiens
RQQGLTSHPAGSEWRYVLVSTVRTCAKSDLDQRPTKSWLKKFLGFVVDPNQVNVAVTRAQEGLCLIGDHLLLRCCPLWRSLLDFCEAQQTLVPAGQVRVCRRPTMPS

SEQ ID NO: 913582 - protein, 421 aa, Homo sapiens [sequence omitted]

SEQ ID NO: 913583 - protein, 376 aa, Homo sapiens [sequence omitted]

SEQ ID NO: 913584 - protein, 421 aa, Homo sapiens [sequence omitted]

SEQ ID NO: 913585 - protein, 403 aa, Homo sapiens
MAGEAEAQLDPSLQGLVMFEDVTVYFSREEWGLLNVTQKGLYRDVMLENFALVSSLGLAPSRSPVFTQLEDDEQSWVPSWVDVTPVSRAEARRGFGLDGLCRVEDERAHPEHLKSYRVIQHQDTHSEGKPRRHTEHGAAFPPGSSCGQQQEVHVAEKLFKCSDCGKVFLKAFALLDHLITHSEERPFRCPTGRSAFKKSAHINPRKIHTGETAHVCNECGKAFSYPSKLRKHQKVHTGIKPFKCSDCGKTFNRKDALVLHQRIHTGERPYECSKCGKTPYECAECGKFFKYNNSFILHQRVHTGERPFECKQCGKGYVTRSGLYQHWKVHTGERPYECSLCGKTFTTRSYRNRHQQFHTEERSYECTECGKAFKHSSTLLQHKKVHTPERRQEDRAHGKVVSC

SEQ ID NO: 913586 - protein, 148 aa, Homo sapiens
MAGEAEAQLDPSLQGLVMFEDVTVYFSREEWGLLNVTQKGLYRDVMLENFALVSSLGLAPSRSPVFTQLEDDEQSWVPSWVDVTPVSRAEARRGFGLEVGDGERSHGSKGKRRTDRGDKGAGGPGLGQNRRTTRAGEAPMTHTADSKN

SEQ ID NO: 913587 - protein, 324 aa, Homo sapiens
MVCVEWRMREPILSIYKSYRVIQHQDTHSEGKPRRHTEHGAAFPPGSSCGQQQEVHVAEKLFKCSDCGKVFLKAFALLDHLITHSEERPFRCPTGRSAFKKSAHINPRKIHTGETAHVCNECGKAFSYPSKLRKHQKVHTGIKPFKCSDCGKTFNRKDALVLHQRIHTGERPYECSKCGKTFSVLSTLIRHRKVHIGERPYECAECGKFFKYNNSFILHQRVHTGERPFECKQCGKGYVTRSGLYQHWKVHTGERPYECSLCGKTFTTRSYRNRHQQFHTEERSYECTECGKAFKHSSTLLQHKKVHTPERRQEDRAHGKVVSC

SEQ ID NO: 913588 - protein, 413 aa, Homo sapiens
MAGEAEGLVMFEDVTVYFSREEWGLLNVTQKGLYRDVMLENFALVSSLGLAPSRSPVFTQLEDDEQSWVPSWVDVTPVSRAEARRGFGLDGLCRVEDERAHPEHLKSYRVIQHQDTHSEGKPRRHTEHGAAFPPGSSCGQQQEVHVAEKLFKCSDCGKVFLKAFALLDHLITHSEERPFRCPTGRSAFKKSAHINPRKIHTGETAHVCNECGKAFSYPSKLRKHQKVHTGIKPFKCSDCGKTFNRKDALVLHQRIHTGERPYECSKCGKTFSVLSTLIRHRKVHIGERPYECAECGKFFKYNNSFILHQRVHTGERPFECKQCGKGYVTRSGLYQHWKVHTGERPYECSLCGKTFTTRSYRNRHQQFHTEERSYECTECGKAFKHSSTLLQHKKVHTPERRQEDRAHGKVVSC

SEQ ID NO: 913589 - protein, 421 aa, Homo sapiens [sequence omitted]

SEQ ID NO: 913590 - protein, 274 aa, Homo sapiens
MAGNKGRGRAAYTFNIEAVGFSKGEKLPDVVLKPPPLFPDTDYKPVPLKTGEGEEYMLALKQELRETMKRMPYFIETPEERQDIERYRKKQYMKGIHRDRNGYQIGEELPREMMPRQIPVKKAKRKKGKGQPAKATTSLITDDVLDHQLGALGNNGGDGDKIRVLDIEEQRRTRPTHVHERWTTDETMPSRHTAALEQTRQRKRPYASRTRDDWAHRCHGRDPMTDVTHPIQQPLTDHHQTGDVGRPPHQTPPHTKRELKAFADYDGPPDARAE

SEQ ID NO: 913591 - protein, 233 aa, Homo sapiens
MAGNKGRGRAAYTFNIEAVGFSKGEKLPDVVLKPPPLFPDTDYKPVPLKTGEGEEYMLALKQELRETMKRMPYFIETPEERQDIERYSKRYMKVYKEEWIPDWRRLPREMMPRNKCKKAGPKPKKAKDAGKGTPLTNTEDVLKKMVELEKRGDGEKSDEENEEKEGSKEKSKEGDDDDDDDAAEQEEYDEEEQEEENDYINSYFEDGDDFGADVMTTWMRQPIRHEIFQKIFL

SEQ ID NO: 913592 - protein, 233 aa, Homo sapiens; identical to SEQ ID NO: 913591

SEQ ID NO: 913593 - protein, 161 aa, Homo sapiens
MDGHMFMCNGGREEGLTPAKMIQVSQSQNAVKIGALEGYRGQRVKVFGWVHRLRRQGKNLMFLVLRDGTGYLQCVLADELCQCYNGVLLSTESSVAVYGMLNLTPKGKQAPGGHELSCDFWELIGLAPAGGADNLINEESDVDVQLNNRHMMIQVSQSQNV

SEQ ID NO: 913594 - protein, 600 aa, Homo sapiens
NRNDRASVKPALTRQYYTARYEGWVCAGARWSHKTASVLQSVSLEVTRATAGMVLAELYVSDREGSDATGDGTKEKPFKTGLKALMTVGKEPFPTIYVDSQKENERWNVISKSQLKNIKKMWHREQMKSESREKKEAEDSLRREKNLEEAKKITIKNDPSLPEPKCVKIGALEGYRGQRVKVFGWVHRLRRQGKNLMFLVLRDGTGYLQCVLADELCQCYNGVLLSTESSVAVYGMLNLTPKGKQAPGGHELSCDFWELIGLAPAGGADNLINEESDVDVQLNNRHMMIRGENMSKILKARSMVTRCFRDHFFDRGYYEVTPPTLVQTQVEGGATLFKLDYFGEEAFLTQSSQLYLETCLPALGDVFCIAQSYRAEQSRTRRHLAEYTHVEAECPFLTFDDLLNRLEDLVCDVVDRILKSPAGSIVHELNPNFQPPKRPFKRMNYSDAIVWLKEHDVKKEDGTFYEFGEDIPEAPERLMTDTINEPILLCRFPVEIKSFYMQRCPEDSRLTESVDVLMPNVGEIVGGSMRIFDSEEILAGYKREGIDPTPYYWYTDQRKYGTCPHGGYGLGLERFLTWILNRYHIRDVCLYPRFVQRCTP

SEQ ID NO: 913595 - protein, 335 aa, Homo sapiens
MVLAELYVSDREGSDATGDGTKEKPFKTGLKALMTVGKEPFPTIYVDSQKENERWNVISKSQLKNIKKMWHREQMKSESREKKEAEDSLRREKNLEEAKKITIKNDPSLPEPKCVKIGALEGYRGQRVKVFGWVHRLRRQGKNLMFLVLRDGTGYLQCVLADELCQCYNGVLLSTESSVAVYGMLNLTPKGKQAPGGHELSCDFWELIGLAPAGGADNLINEESDVDVQLNNRHMMIRGENMSKILKARSMVTRCFRDHFFDRGYYEVTPPTLVQTQVEGGATLFKLDYFGEEAFLTQSSQLYLETCLPALGDVFCIAQSYRAEQSRTRRHLAEV

SEQ ID NO: 913596 - protein, 548 aa, Homo sapiens
MVLAELYVSDREGSDATGDGTKEKPFKTGLKALMTVGKEPFPTIYVDSQKENERWNVISKSQLKNIKKMWHREQMKSESREKKEAEDSLRREKNLEEAKKITIKNDPSLPEPKCVKIGALEGYRGQRVKVFGWVHRLRRQGKNLMFLVLRDGTGYLQCVLADELCQCYNGVLLSTESSVAVYGMLNLTPKGKQAPGGHELSCDFWELIGLAPAGGADNLINEESDVDVQLNNRHMMIRGENMSKILKARSMVTRCFRDHFFDRGYYEVTPPTLVQTQVEGGATLFKLDYFGEEAFLTQSSQLYLETCLPALGDVFCIAQSYRAEQSRTRRHLAEYTHVEAECPFLTFDDLLNRLEDLVCDVVDRILKSPAGSIVHELNPNFQPPKRPFKRMNYSDAIVWLKEHDVKKEDGTFYEFGEDIPEAPERLMTDTINEPILLCRFPVEIKSFYMQRCPEDSRLTESVDVLMPNVGEIVGGSMRIFDSEEILAGYKREGIDPTPYYWYTDQRKYGTCPHGGYGLGLERFLTWILNRYHIRDVCLYPRFVQRCTP

SEQ ID NO: 913597 - protein, 469 aa, Homo sapiens
MVLAELYVSDREGSDATGDGTKEKPFKTGLKALMTVGKEPFPTIYVDSQKENERWNVISKSQLKNIKKMWHREQMKSESREKKEAEDSLRREKNLEEAKKITIKNDPSLPEPKCVKIGALEGYRGQRVKVFGWVHRLRRQGKNLMFLVLRDGTGYLQCVLADELCQCYNGVLLSTESSVAVYGMLNLTPKGKQAPGGHELSCDFWELIGLAPAGGADNLINEESDVDVQLNNRHMMIRGENMSKILKARSMVTRCFRDHFFDRGYYEVTPPTLVQTQVEGGATLFKLDYFGEEAFLTQSSQLYLETCLPALGDVFCIAQSYRAEQSRTRRHLAEYTHVEAECPFLTFDDLLNRLEDLVCDVVDRILKSPAGSIVHELNPNFQPPKRPFKRMNYSDAIVWLKEHDVKKEDGTFYEFGEDIPEAPERLMTDTINEPILLCRFPVEIKSFYMQRCPEDSRLTESVSFCFKEY

SEQ ID NO: 913598 - protein, 410 aa, Homo sapiens
MVLAELYVSDREGSDATGDGTKEKPFKTGLKALMTVGKEPFPTIYVDSQKENERWNVISKSQLKNIKKMWHREQMKSESREKKEAEDSLRREKNLEEAKKITIKNDPSLPEPKCVKIGALEGYRGQRVKVFGWVHRLRRQGKNLMFLVLRDGTGYLQCVLADELCQCYNGVLLSTESSVAVYGMLNLTPKGKQAPGGHELSCDFWELIGLAPAGGADNLINEESDVDVQLNNRHMMIRGENMSKILKARSMVTRCFRDHFFDRGYYEVTPPTLVQTQVEGGATLFKLDYFGEEAFLTQSSQLYLETCLPALGDVFCIAQSYRAEQSRTRRHLAEYTHVEAECPFLTFDDLLNRLEDLVCDVVDRILKSPAGSIVHELNPNFQPPKRPFKRMNYSDAIVWLKEISQKLLRD

SEQ ID NO: 913599 - protein, 404 aa, Homo sapiens [sequence omitted]

SEQ ID NO: 913600 - protein, 548 aa, Homo sapiens; identical to SEQ ID NO: 913596

SEQ ID NO: 913601 - protein, 282 aa, Homo sapiens
NRNDRASVKPALTRQYYTARYEAGCEEAFLTQSSQLYLETCLPALGDVFCIAQSYRAEQSRTRRHLAEYTHVEAECPFLTFDDLLNRLEDLVCDVVDRILKSPAGSIVHELNPNFQPPKRPFKRMNYSDAIVWLKEHDVKKEDGTFYEFGEDIPEAPERLMTDTINEPILLCRFPVEIKSFYMQRCPEDSRLTESVDVLMPNVGEIVGGSMRIFDSEEILAGYKREGIDPTPYYWYTDQRKYGTCPHGGYGLGLERFLTWILNRYHIRDVCLYPRFVQRCTP

SEQ ID NO: 913602 - protein, 548 aa, Homo sapiens; identical to SEQ ID NO: 913596

SEQ ID NO: 913603 - protein, 422 aa, Homo sapiens
MVLAELYVSDREGSDATGDGTKEKPFKTGLKALMTVGKEPFPTIYVDSQKENERWNVISKSQLKNIKKMWHREQMKSESREKKEAEDSLRREKNLEEAKKITIKNDPSLPEPKCVKIGALEGYRGQRVKVFGWVHRLRRQGKNLMFLVLRDGTGYLQCVLADELCQCYNGVLLSTESSVAVYGMLNLTPKGKQAPGGHELSCDFWELIGLAPAGGADNLINEESDVDVQLNNRHMMIRGENMSKILKARSMVTRCFRDHFFDRGYYEVTPPTLVQTQVEGGATLFKLDYFGEEAFLTQSSQLYLETCLPALGDVFCIAQSYRAEQSRTRRHLAEYTHVEAECPFLTFDDLLNRLEDLVCDVVDRILKSPAGSIVHELNPNFQPPKRPFKRMNYSDAIVWLKEHDVKKEDGTFYEFGEISRRS

SEQ ID NO: 913604 - protein, 425 aa, Homo sapiens
MVLAELYVSDREGSDATGDGTKEKPFKTGLKALMTVGKEPFPTIYVDSQKENERWNVISKSQLKNIKKMWHREQMKSESREKKEAEDSLRREKNLEEAKKITIKNDPSLPEPKCVKIGALEGYRGQRVKVFGWVHRLRRQGKNLMFLVLRDGTGYLQCVLADELCQCYNGVLLSTESSVAVYGMLNLTPKGKQAPGGHELSCDFWELIGLAPAGGADNLINEESDVDVQLNNRHMMIRGENMSKILKARSMVTRCFRDHFFDRGYYEVTPPNECKHQVDAGVPTLKAGHIGAKARQEQKPQGPGERGPNTVRKSRKKHTPPGERQQKRRGDNHPAERRAPKRMKNTPNAPQTNNQARQQQKPHSKKEQMTTQNNPRGEDKKHEGPEKERNTNDTETTTRNEEATCVAITHVCLIALNPSTPRDPR

SEQ ID NO: 913605 - protein, 548 aa, Homo sapiens; identical to SEQ ID NO: 913596

SEQ ID NO: 913606 - protein, 548 aa, Homo sapiens; identical to SEQ ID NO: 913596

SEQ ID NO: 913607 - protein, 515 aa, Homo sapiens [sequence omitted]

SEQ ID NO: 913608 - protein, 428 aa, Homo sapiens
MIQVSQSQNVFGWVHRLRRQGKNLMFLVLRDGTGYLQCVLADELCQCYNGVLLSTESSVAVYGMLNLTPKGKQAPGGHELSCDFWELIGLAPAGGADNLINEESDVDVQLNNRHMMIRGENMSKILKARSMVTRCFRDHFFDRGYYEVTPPTLVQTQVEGGATLFKLDYFGEEAFLTQSSQLYLETCLPALGDVFCIAQSYRAEQSRTRRHLAEYTHVEAECPFLTFDDLLNRLEDLVCDVVDRILKSPAGSIVHELNPNFQPPKRPFKRMNYSDAIVWLKEHDVKKEDGTFYEFGEDIPEAPERLMTDTINEPILLCRFPVEIKSFYMQRCPEDSRLTESVDVLMPNVGEIVGGSMRIFDSEEILAGYKREGIDPTPYYWYTDQRKYGTCPHGGYGLGLERFLTWILNRYHIRDVCLYPRFVQRCTP

SEQ ID NO: 913609 - protein, 510 aa, Homo sapiens
MVLAELYVSDREGSDATGDGTKEKPFKTGLKALMTVGKEPFPTIYVDSQKENERWNVISKSQLKNIKKMWHREQMKSESREKKEAEDSLRREKNLEEAKKITIKNDPSLPEPKCVKIGALEGYRGQRVKVFGWVHRLRRQGKNLMFLVLRDGTGYLQCVLADELCQCYNGVLLSTESSVAVYGMLNLTPKGKQAPGGHELSCDFWELIGLAPAGGADNLINEESDVDVQLNNRHMMIRGENMSKILKARSMVTRCFRDHFFDRGYYEVTPPTLVQTQVEGGATLFKLDYFGEEAFLTQSSQLYLETCLPALGDVFCIAQSYRAEQSRTRRHLAEYTHVEAECPFLTFDDLLNRLEDLVCDVVDRILKSPAGSIVHELNPNFQPPKRPFKRMNYSDAIVWLKEHDVKKEDGTFYEFGEDIPEAPERLMTDTINEPILLCRFPVEIKSFYMQRCPEDSRLTESVDVLMPNVGEIVGGSMRIFDSEEILAGYKREGIDPTPYYWYTDQVKPIF

SEQ ID NO: 913610 - protein, 510 aa, Homo sapiens; identical to SEQ ID NO: 913609

SEQ ID NO: 913611 - protein, 387 aa, Homo sapiens
MVLAELYVSDREGSDATGDGTKEKPFKTGLKALMTVGKEPFPTIYVDSQKENERWNVISKSQLKNIKKMWHREQMKSESREKKEAEDSLRREKNLEEAKKITIKNDPSLPEPKCVKIGALEGYRGQRVKVFGWVHRLRRQGKNLMFLVLRDGTGYLQCVLADELCQCYNGVLLYTHVEAECPFLTFDDLLNRLEDLVCDVVDRILKSPAGSIVHELNPNFQPPKRPFKRMNYSDAIVWLKEHDVKKEDGTFYEFGEDIPEAPERLMTDTINEPILLCRFPVEIKSFYMQRCPEDSRLTESVDVLMPNVGEIVGGSMRIFDSEEILAGYKREGIDPTPYYWYTDQRKYGTCPHGGYGLGLERFLTWILNRYHIRDVCLYPRFVQRCTP

SEQ ID NO: 913612 - protein, 572 aa, Homo sapiens
MVLAELYVSDREGSDATGDGTKEKPFKTGLKALMTVGKEPFPTIYVDSQKENERWNVISKSQLKNIKKMWHREQMKSESREKKEAEDSLRREKNLEEAKKITIKNDPSLPEPKCVKIGALEGYRGQRVKVFGWVHRLRRQGKNLMFLVLRDGTGYLQCVLADELCQCYNGVLLSTESSVAVYGMLNLTPKGKQAPGGHELSCDFWELIGLAPAGGADNLINEESDVDVQLNNRHMMIRGENMSKILKARSMVTRCFRDHFFDRGYYEVTPPTLVQTQVEGGATLFKLDYFGEEAFLTQSSQLYLETCLPALGDVFCIAQSYRAEQSRTRRHLAEYTHVEAECPFLTFDDLLNRLEDLVCDVVDRILKSPAGSIVHELNPNFQPPKRPFKRMNYSDAIVWLKEHDVKKEDGTFYEFGEDIPEAPERLMTDTINEPILLEMEEKYYRFGIKPEWMTVHRIINHSVDKKGNYHYLVKWRDLPYDQSTWKEDEMNIPEYEEHKQSYWRHRELIMGEDPAQPRKYKKKKKELQGDGPPSSPTNDPTVKYETQPGLSQPLEHLHMYQWKELTGYASPA

SEQ ID NO: 913613 - protein, 404 aa, Homo sapiens
MVLAELYVSDREGSDATGDGTKEKPFKTGLKALMTVGKEPFPTIYVDSQKENERWNVISKSQLKNIKKMWHREQMKSESREKKEAEDSLRREKNLEEAKKITIKNDPSLPEPKCVKIGALEGYRGQRVKVFGWVHRLRRQGKNLMFLVLRDGTGYLQCVLADELCQCYNGVLLSTESSVAVYGMLNLTPKGKQAPGGHELSCDFWELIGLAPAGGADNLINEESDVDVQLNNRHMMIRGENMSKILKARSMVTRCFRDHFFDRGYYEVTPPTLVQTQVEGGATLFKLDYFGEEAFLTQSSQLYLETCLPALGDVFCIAQSYRAEQSRTRRHLAEYTHVEAECPFLTFDDLLNRLEDLVCDVVDRILKSPAGSIVHELNPNFQPPKRPFKRMNYSDAIVWLKEYL

SEQ ID NO: 913614 - protein, 125 aa, Homo sapiens
MVLAELYVSDREGSDATGDGTKEKPFKTGLKALMTVGKEPFPTIYVDSQKENERWNVISKSQLKNIKKMWHREQMKSESREKKEAEDSLRREKNLEEAKKITIKNDPSLPEPKCIFPWKMHQPIG

SEQ ID NO: 913615 - protein, 476 aa, Homo sapiens
MADSKEGVLPLTAASTAPISFGFTRTSARRRLADSGDGAGPSPEEKDFLKTVEGRELQSVKPQEAPKELVIPLIQNGHRRQPPARPPGPSTDTGALADGVVSQAVKELIAESKKSLEERENAGVDPTLAIPMIQKGCTPSGEGADSEPRAETVPEEANYEAVPVEAYGLAMLRGMGWKPGEGIGRTFNQVVKPRVNSLRPKGLGLGANLTEAQALTPTGPSRMPRPDEEQEKDKEDQPQGLVPGGAVVVLSGPHRGLYGKVEGLDPDNVRAMVRLAVGSRVVTVSEYYLRPVSQQEFDKNTLDLRQQNGTASSRKTLWNQELYIQQDNSERKRKHLPDRQDGPAAKSEKAAPRSQHWLHRDLRVRFVDNMYKGGQYYNTKMIIEDVLSPDTCVCRTDEGRVLEGLREDMLETLVPKAEGDRVMVVLGPQTGRVGHLLSRDRARSRALVQLPRENQVVELHYDAICQYMGPSDTDDD

SEQ ID NO: 913616 - protein, 476 aa, Homo sapiens; identical to SEQ ID NO: 913615

SEQ ID NO: 913617 - protein, 227 aa, Homo sapiens
MADSKEGVLPLTAASTAPISFGFTRTSARRRLADSGDGAGPSPEEKDFLKTVEGRELQSVKPQEAPKELVIPLIQNGHRRQPPARPPGPSTDTGALADGVVSQAVKELIAESKKSLEERENAGVDPTLAIPMIQKGCTPSGEGADSEPRAETVPEEANYEAVPVEAYGLAMLRGMGWKPGEGIGRTFNQVVKPRVNSLRPKGLGLGANLTEAQALTPTGPSRMPRHR

SEQ ID NO: 913618 - protein, 476 aa, Homo sapiens; identical to SEQ ID NO: 913615

SEQ ID NO: 913619 - protein, 382 aa, Homo sapiens
MADSKEGVLPLTAASTAPISFGFTRTSARRRLADSGDGAGPSPEEKDFLKTVEGRELQSVKPQEAPKELVIPLIQNGHRRQPPARPPGPSTDTGALADGVVSQAVKELIAESKKSLEERENAGVDPTLAIPMIQKGCTPSGEGADSEPRAETVPEEANYEAVPVEAYGLAMLRGMGWKPGEGIGRTFNQVVKPRVNSLRPKGLGLGANLTEAQALTPTGPSRMPRPDEEQEKDKEDQPQGLVPGGAVVVLSGPHRGLYGKVEGLDPDNVRAMVRLAVGSRVVTVSEYYLRPVSQQEFDKNTLDLRQQNGTASSRKTLWNQELYIQQDNSERKRKHLPDRQDGPAAKSEKAAPRSQHWLHRDLRVRFVDNMYKGGQYLPKFRV

SEQ ID NO: 913620 - protein, 81 aa, Homo sapiens
RYPTFPRVSLREDMLETLVPKAEGDRVMVVLGPQTGRVGHLLSRDRARSRALVQLPRENQVVELHYDAICQYMGPSDTDDD

SEQ ID NO: 913621 - protein, 145 aa, Homo sapiens
VIHKIQSCWHASLVQDVVIQQVTIPDDDNERLSKVEKARQLREQVNDLFSRKFGEAIGMGFPVKVPYRKITINPGCVVVDGMPPGVSFKAPSYLEISSMRRILDSAEFIKFTVIRPFPGLVINNQLVDQSESEGPVIQNQLNQAS

SEQ ID NO: 913622 - protein, 708 aa, Homo sapiens
MLGIDQEVTVTVRWSSSNDHFLFQDDDYSPPSKRPKANELPQPPVPEPANAGKRKVREFNFEKWNARITDLRKQVEELFERKYAQAIKAKGPVTIPYPLFQSHVEDLYVEGLPEGIPFRRPSTYGIPRLERILLAKERIRFVIKKHELLNSTREDLQLDKPASGVKEEWYARITKLRKMVDQLFCKKFAEALGSTEAKAVPYQKFEAHPNDLYVEGLPENIPFRSPSWYGIPRLEKIIQVGNRIKFVIKRPELLTHSTTEVTQPRTNTPVKEDWNVRITKLRKQVEEIFNLKFAQALGLTEAVKVPYPVFESNPEFLYVEGLPEGIPFRSPTWFGIPRLERIVRGSNKIKFVVKKPELVISYLPPGMASKINTKALQSPKRPRSPGSNSKVPEIEVTVEGPNNNNPQTSAVRTPTQTNGSNVPFKPRGREFSFEAWNAKITDLKQKVENLFNEKCGEALGLKQAVKVPFALFESFPEDFYVEGLPEGVPFRRPSTFGIPRLEKILRNKAKIKFIIKKPEMFETAIKESTSSKSPPRKINSSPNVNTTASGVEDLNIIQVTIPDDDNERLSKVEKARQLREQVNDLFSRKFGEAIGMGFPVKVPYRKITINPGCVVVDGMPPGVSFKAPSYLEISSMRRILDSAEFIKFTVIRPFPGLVINNQLVDQSESEGPVIQESAEPSQLEVPATEEIKETDGSSQIKQEPDPTW

SEQ ID NO: 913623 - protein, 553 aa, Homo sapiens
LLPAEPASGVKEEWYARITKLRKMVDQLFCKKFAEALGSTEAKAVPYQKFEAHPNDLYVEGLPENIPFRSPSWYGIPRLEKIIQVGNRIKFVIKRPELLTHSTTEVTQPRTNTPVKEDWNVRITKLRKQVEEIFNLKFAQALGLTEAVKVPYPVFESNPEFLYVEGLPEGIPFRSPTWFGIPRLERIVRGSNKIKFVVKKPELVISYLPPGMASKINTKALQSPKRPRSPGSNSKVPEIEVTVEGPNNNNPQTSAVRTPTQTNGSNVPFKPRGREFSFEAWNAKITDLKQKVENLFNEKCGEALGLKQAVKVPFALFESFPEDFYVEGLPEGVPFRRPSTFGIPRLEKILRNKAKIKFIIKKPEMFETAIKESTSSKSPPRKINSSPNVNTTASGVEDLNIIQVTIPDDDNERLSKVEKARQLREQVNDLFSRKFGEAIGMGFPVKVPYRKITINPGCVVVDGMPPGVSFKAPSYLEISSMRRILDSAEFIKFTVIRPFPGLVINNQLVDQSESEGPVIQESAEPSQLEVPATEEIKETDGSSQIKQEPDPTW

SEQ ID NO: 913624 - protein, 652 aa, Homo sapiens
MLGIDQEVTVTVRWSSSNDHFLFQDDDYSPPSKRPKANELPQPPVPEPANAGKRKVREFNFEKWNARITDLRKQVEELFERKYAQAIKAKGPVTIPYPLFQSHVEDLYVEGLPEGIPFRRPSTYGIPRLERILLAKERIRFVIKKHELLNSTREDLQLDKPASGVKEEWYARITKLRKMVDQLFCKKFAEALGSTEAKAVPYQKFEAHPNDLYVEGLPENIPFRSPSWYGIPRLEKIIQVGNRIKFVIKRPELLTHSTTEVTQPRTNTPVKEDWNVRITKLRKQVEEIFNLKFAQALGLTEAVKVPYPVFESNPEFLYVEGLPEGIPFRSPTWFGIPRLERIVRGSNKIKFVVKKPELVISYLPPGMASKINTKALQSPKRPRSPGSNSKVPEIEVTVEGPNNNNPQTSAVRTPTQTNGSNVPFKPRGREFSFEAWNAKITDLKQKVENLFNEKCGEALGLKQAVKVPFALFESFPEDFYVEGLPEGVPFRRPSTFGIPRLEKILRNKAKIKFIIKKPEMFETAIKESTSSKSPPRKINSSPNVNTTASGVEDLNIIQVTIPDDDNERLSKVEKARQLREQVNDLFSRKFGEAIGMGFPVKVPYRKITINPGCVVVDGMPPGVSFKAPSYLEISSMRRILDSAEFIKFTVIR

SEQ ID NO: 913625 - protein, 342 aa, Homo sapiens
MASKINTKALQSPKRPRSPGSNSKVPEIEVTVEGPNNNNPQTSAVRTPTQTNGSNVPFKPRGREFSFEAWNAKITDLKQKVENLFNEKCGEALGLKQAVKVPFALFESFPEDFYVEGLPEGVPFRRPSTFGIPRLEKILRNKAKIKFIIKKPEMFETAIKESTSSKSPPRKINSSPNVNTTASGVEDLNIIQVTIPDDDNERLSKVEKARQLREQVNDLFSRKFGEAIGMGFPVKVPYRKITINPGCVVVDGMPPGVSFKAPSYLEISSMRRILDSAEFIKFTVIRPFPGLVINNQLVDQSESEGPVIQESAEPSQLEVPATEEIKETDGSSQIKQEPDPTW

SEQ ID NO: 913626 - protein, 306 aa, Homo sapiens
RGEPGAKPFVDDTQTNGSNVPFKPRGREFSFEAWNAKITDLKQKVENLFNEKCGEALGLKQAVKVPFALFESFPEDFYVEGLPEGVPFRRPSTFGIPRLEKILRNKAKIKFIIKKPEMFETAIKESTSSKSPPRKINSSPNVNTTASGVEDLNIIQVTIPDDDNERLSKVEKARQLREQVNDLFSRKFGEAIGMGFPVKVPYRKITINPGCVVVDGMPPGVSFKAPSYLEISSMRRILDSAEFIKFTVIRPFPGLVINNQLVDQSESEGPVIQESAEPSQLEVPATEEIKETDGSSQIKQEPDPTW

SEQ ID NO: 913627 - protein, 303 aa, Homo sapiens
DENNAKANDTQTNGSNVPFKPRGREFSFEAWNAKITDLKQKVENLFNEKCGEALGLKQAVKVPFALFESFPEDFYVEGLPEGVPFRRPSTFGIPRLEKILRNKAKIKFIIKKPEMFETAIKESTSSKSPPRKINSSPNVNTTASGVEDLNIIQVTIPDDDNERLSKVEKARQLREQVNDLFSRKFGEAIGMGFPVKVPYRKITINPGCVVVDGMPPGVSFKAPSYLEISSMRRILDSAEFIKFTVIRPFPGLVINNQLVDQSESEGPVIQESAEPSQLEVPATEEIKETDGSSQIKQEPDPTW

SEQ ID NO: 913628 - protein, 708 aa, Homo sapiens; identical to SEQ ID NO: 913622

SEQ ID NO: 913629 - protein, 68 aa, Homo sapiens
VASSIHSFTVIRPFPGLVINNQLVDQSESEGPVIQESAEPSQLEVPATEEIKETDGSSQIKQEPDPTW

SEQ ID NO: 913630 - protein, 708 aa, Homo sapiens; identical to SEQ ID NO: 913622

SEQ ID NO: 913631 - protein, 708 aa, Homo sapiens; identical to SEQ ID NO: 913622

SEQ ID NO: 913632 - protein, 652 aa, Homo sapiens; identical to SEQ ID NO: 913624

SEQ ID NO: 913633 - protein, 652 aa, Homo sapiens; identical to SEQ ID NO: 913624

SEQ ID NO: 913634 - protein, 652 aa, Homo sapiens; identical to SEQ ID NO: 913624

SEQ ID NO: 913635 - protein, 599 aa, Homo sapiens
MLGIDQEVTVTVRWSSSNDHFLFQDDDYSPPSKRPKANELPQPPVPEPANAGKRKVREFNFEKWNARITDLRKQVEELFERKYAQAIKAKGPVTIPYPLFQSHVEDLYVEGLPEGIPFRRPSTYGIPRLERILLAKERIRFVIKKHELLNSTREDLQLDKPASGVKEEWYARITKLRKMVDQLFCKKFAEALGSTEAKAVPYQKFEAHPNDLYVEGLPENIPFRSPSWYGIPRLEKIIQVGNRIKFVIKRPELLTHSTTEVTQPRTNTPVKEDWNVRITKLRKQVEEIFNLKFAQALGLTEAVKVPYPVFESNPEFLYVEGLPEGIPFRSPTWFGIPRLERIVRGSNKIKFVVKKPELVISYLPPGMASKINTKALQSPKRPRSPGSNSKVPEIEVTVEGPNNNNPQTSAVRTPTQTNGSNVPFKPRGREFSFEAWNAKITDLKQKVENLFNEKCGEALGLKQAVKVPFALFESFPEDFYVEGLPEGVPFRRPSTFGIPRLEKILRNKAKIKFIIKKPEMFETAIKESTSSKSPPRKINSSPNVNTTASGVEDLNIIQVTIPDDDNERLSKVEKARQLREQVNDLFSRKFAWDPLESPH

SEQ ID NO: 913636 - protein, 576 aa, Homo sapiens
MLGIDQEVTVTVRWSSSNDHFLFQDDDYSPPSKRPKANELPQPPVPEPANAGKRKVREFNFEKWNARITDLRKQVEELFERKYAQAIKAKGPVTIPYPLFQSHVEDLYVEGLPEGIPFRRPSTYGIPRLERILLAKERIRFVIKKHELLNSTREDLQLDKPASGVKEEWYARITKLRKMVDQLFCKKFAEALGSTEAKAVPYQKFEAHPNDLYVEGLPENIPFRSPSWYGIPRLEKIIQVGNRIKFVIKRPELLTHSTTEVTQPRTNTPVKEDWNVRITKLRKQVEEIFNLKFAQALGLTEAVKVPYPVFESNPEFLYVEGLPEGIPFRSPTWFGIPRLERIVRGSNKIKFVVKKPELVISYLPPGMASKINTKALQSPKRPRSPGSNSKVPEIEVTVEGPNNNNPQTSAVRTPTQTNGSNVPFKPRGREFSFEAWNAKITDLKQKVENLFNEKCGKSILKPSYCHAGCLHGSRREQSGILSVGVSLSLATCGFFGIEWRHFAHVLFRVRGCFAGEALGLKQAVKVPFALFESFPEDFYVEGLPEGVPFRRPSTFGIPRLEKILRNKAKIKFIIKK

SEQ ID NO: 913637 - protein, 530 aa, Homo sapiens
MVDQLFCKKFAEALGSTEAKAVPYQKFEAHPNDLYVEGLPENIPFRSPSWYGIPRLEKIIQVGNRIKFVIKRPELLTHSTTEVTQPRTNTPVKEDWNVRITKLRKQVEEIFNLKFAQALGLTEAVKVPYPVFESNPEFLYVEGLPEGIPFRSPTWFGIPRLERIVRGSNKIKFVVKKPELVISYLPPGMASKINTKALQSPKRPRSPGSNSKVPEIEVTVEGPNNNNPQTSAVRTPTQTNGSNVPFKPRGREFSFEAWNAKITDLKQKVENLFNEKCGEALGLKQAVKVPFALFESFPEDFYVEGLPEGVPFRRPSTFGIPRLEKILRNKAKIKFIIKKPEMFETAIKESTSSKSPPRKINSSPNVNTTASGVEDLNIIQVTIPDDDNERLSKVEKARQLREQVNDLFSRKFGEAIGMGFPVKVPYRKITINPGCVVVDGMPPGVSFKAPSYLEISSMRRILDSAEFIKFTVIRPFPGLVINNQLVDQSESEGPVIQESAEPSQLEVPATEEIKETDGSSQIKQEPDPTW

SEQ ID NO: 913638 - protein, 708 aa, Homo sapiens; identical to SEQ ID NO: 913622

SEQ ID NO: 913639 - protein, 342 aa, Homo sapiens; identical to SEQ ID NO: 913625

SEQ ID NO: 913640 - protein, 306 aa, Homo sapiens
LAGSRGSTKAKATQTNGSNVPFKPRGREFSFEAWNAKITDLKQKVENLFNEKCGEALGLKQAVKVPFALFESFPEDFYVEGLPEGVPFRRPSTFGIPRLEKILRNKAKIKFIIKKPEMFETAIKESTSSKSPPRKINSSPNVNTTASGVEDLNIIQVTIPDDDNERLSKVEKARQLREQVNDLFSRKFGEAIGMGFPVKVPYRKITINPGCVVVDGMPPGVSFKAPSYLEISSMRRILDSAEFIKFTVIRPFPGLVINNQLVDQSESEGPVIQESAEPSQLEVPATEEIKETDGSSQIKQEPDPTW

SEQ ID NO: 913641 - protein, 708 aa, Homo sapiens; identical to SEQ ID NO: 913622

SEQ ID NO: 913642 - protein, 708 aa, Homo sapiens; identical to SEQ ID NO: 913622

SEQ ID NO: 913643 - protein, 708 aa, Homo sapiens; identical to SEQ ID NO: 913622

SEQ ID NO: 913644 - protein, 109 aa, Homo sapiens
GRSLQTGEWSMTVFEYRTRKVGRLPIRYAPYDMVVLIKNVWTLALFAFYKPNSICNPNKKKFNSICVPLVLISVNQCGQCGERLNLFLSYLSWFLCFFIIIKSKTIWIT

SEQ ID NO: 913645 - protein, 652 aa, Homo sapiens; identical to SEQ ID NO: 913624

SEQ ID NO: 913646 - protein, 682 aa, Homo sapiens
MLGIDQEVTVTVRWSSSNDHFLFQDDDYSPPSKRPKANELPQPPVPEPANAGKRKVREFNFEKWNARITDLRKQVEELFERKYAQAIKAKGPVTIPYPLFQSHVEDLYVEGLPEGIPFRRPSTYGIPRLERILLAKERIRFVIKKHELLNSTREDLQLDKPASGVKEEWYARITKLRKMVDQLFCKKFAEALGSTEAKAVPYQKFEAHPNDLYVEGLPENIPFRSPSWYGIPRLEKIIQVGNRIKFVIKRPELLTHSTTEVTQPRTNTPVKEDWNVRITKLRKQVEEIFNLKFAQALGLTEAVKVPYPVFESNPEFLYVEGLPEGIPFRSPTWFGIPRLERIVRGSNKIKFVVKKPELVISYLPPGMASKINTKALQSPKRPRSPGSNSKVPEIEVTVEGPNNNNPQTSAVRTPTQTNGSNVPFKPRGREFSFEAWNAKITDLKQKVENLFNEKCGEALGLKQAVKVPFALFESFPEDFYVEGLPEGVPFRRPSTFGIPRLEKILRNKAKIKFIIKKPEMFETAIKESTSSKSPPRKINSSPNVNTTASGVEDLNIIQVTIPDDDNERLSKVEKARQLREQVNDLFSRKFGEAIGMGFPVKVPYRKITINPGCVVVDGMPPGVSFKAPSYLEISSMRRILDSAEFIKFTVIRPFPGLVINNQLVDQSESEGPVIQNQLNQAS

SEQ ID NO: 913647 - protein, 517 aa, Homo sapiens
MLGIDQEVTVTVRWSSSNDHFLFQDDDYSPPSKRPKANELPQPPVPEPANAGKRKVREFNFEKWNARITDLRKQVEELFERKYAQAIKAKGPVTIPYPLFQSHVEDLYVEGLPEGIPFRRPSTYGIPRLERILLAKERIRFVIKKHELLNSTREDLQLDKPASGVKEEWYARITKLRKMVDQLFCKKFAEALGSTEAKAVPYQKFEAHPNDLYVEGLPENIPFRSPSWYGIPRLEKIIQVGNRIKFVIKRPELLTHSTTEVTQPRTNTPVKEDWNVRITKLRKQVEEIFNLKFAQALGLTEAVKVPYPVFESNPEFLYVEGLPEGIPFRSPTWFGIPRLERIVRGSNKIKFVVKKPELVISYLPPGMASKINTKALQSPKRPRSPGSNSKVPEIEVTVEGPNNNNPQTSAVRTPTQTNGSNVPFKPRGREFSFEAWNAKITDLKQKVENLFNEKCGEALGLKQAVKVPFALFESFPEDFYVEGLPEGVPFRRPSTFGIPRLEKILRNKAKIKFIIKK

SEQ ID NO: 913648 - protein, 377 aa, Homo sapiens
MGTTEATLRMENVDVKEEWQDEDLPRPLPEETGVELLGSPVEDTSSPPNTLNFNGAHRKRKTLVAPEINISLDQSEGSLLSDDFLDTPDDLDINVDDIETPDETDSLEFLGNGNELEWEDDTPVATAKNMPGDSADLFGDGTTEDGSAANGRLWRTVIIGEQEHRIDLHMIRPYMKVVTHGGYYGEGLNAIIVFAACFLPDSSLPDYHYIMENLFLYVISSLELLVAEDYMIVYLNGATPRRRMPGIGWLKKCYQMIDRRLRKNLKSLIIVHPSWFIRTVLAISRPFISVKFINKIQYVHSLEDLEQLIPMEHVQIPDCVLQYEEERLKARRESARPQPEFVLPRSEEKPEVAPVENRSALVSEDQETSLQPLHRSS

SEQ ID NO: 913649 - protein, 371 aa, Homo sapiens
MGTTEATLRMENVDVKEEWQDEDLPRPLPEETGVELLGSPVEDTSSPPNTLNFNGAHRKRKTLVAPEINISLDQSEGSLLSDDFLDTPDDLDINVDDIETPDETDSLEFLGNGNELEWEDDTPVATAKNMPGDSADLFGDGTTEDGSAANGRLWRTVIIGEQEHRIDLHMIRPYMKVVTHGGYYGEGLNAIIVFAACFLPDSSLPDYHYIMENLFLYVISSLELLVAEDYMIVYLNGATPRRRMPGIGWLKKCYQMIDRRLRKNLKSLIIVHPSWFIRTVLAISRPFISVKFINKIQYVHSLEDLEQLIPMEHVQIPDCVLQYEEERLKARRESARPQPEFVLPRSEEKPEVAPVENRSALVSEDQETSMS

SEQ ID NO: 913650 - protein, 371 aa, Homo sapiens; identical to SEQ ID NO: 913649

SEQ ID NO: 913651 - protein, 371 aa, Homo sapiens; identical to SEQ ID NO: 913649

SEQ ID NO: 913652 - protein, 371 aa, Homo sapiens; identical to SEQ ID NO: 913649

SEQ ID NO: 913653 - protein, 358 aa, Homo sapiens
MGTTEATLRMENVDVKEEWQDEDLPRPLPEETGVELLGSPVEDTSSPPNTLNFNGAHRKRKTLVAPEINISLDQSEGSLLSDDFLDTPDDLDINVDDIETPDETDSLEFLGNGNELEWEDDTPVATAKNMPGDSADLFGDGTTEDGSAANGRLWRTVIIGEQEHRIDLHMIRPYMKVVTHGGYYGEGLNAIIVFAACFLPDSSLPDYHYIMENLFLYVISSLELLVAEDYMIVYLNGATPRRRMPGIGWLKKCYQMIDRRLRKNLKSLIIVHPSWFIRTVLAISRPFISVKFINKIQYVHSLEDLEQLIPMEHVQIPDCVLQYEEERLKARRESARPQPEFVLPRSEEKPEVAPVENR

SEQ ID NO: 913654 - protein, 114 aa, Homo sapiens [sequence omitted]

SEQ ID NO: 913655 - protein, 371 aa, Homo sapiens; identical to SEQ ID NO: 913649

SEQ ID NO: 913656 - protein, 125 aa, Homo sapiens
MAVADLALIPDVDIDSDGVFKYVLIRVHSAPRSGAPAAESKEIVRGYKWAEYHADIYDKVSGDMQKQGCDCECLGGGRISHQSQDKKIHVYGYSMAYGPAQHAISTEKIKAKYPDYEVTWANDGY

SEQ ID NO: 913657 - protein, 125 aa, Homo sapiens; identical to SEQ ID NO: 913656

SEQ ID NO: 913658 - protein, 125 aa, Homo sapiens; identical to SEQ ID NO: 913656

SEQ ID NO: 913659 - protein, 1082 aa, Homo sapiens
MAVGTHRGKEASTAALRSPTLREAASSCKLRLWYQRPLEVHPGPPRLVGGAQGEGGWAAGDKQGRSCPGTPDIADVAELRVELTHGAETLTLWQSTGPWGPGWQELAVTTGRIRGDFRVTFSATRNATHRGAVALDDLEFWDCGLPTPQANCPPGHHHCQNKVCVEPQQLCDGEDNCGDLSDENPLTCGRHIATDFETGLGPWNRSEGWSRNHRLVVLSAPPGHAVTTAGTVHRLVFYQYLSGSEAGCLQLFLQTLGPGAPRAPVLLRRRRGELGTAWVRDRVDIQSAYPFQILLAGQTGPGGVVGLDDLILSDHCRPVSEVSTLQPLPPGPRAPAPQPLPPSSRLQDSCKQGHLACGDLCVPPEQLCDFEEQCAGGEDEQACGTTDFESPEAGGWEDASVGRLQWRRVSAQESQGSSAAAAGHFLSLQRAWGQLGAEARVLTPLLGPSGPSCELHLAYYLQSQPRAEFVGLVDLDGPDQQGAGVDNVTLRDCSPTVTTERDRGSCCPSSLPPGCSPYTPPGTPELPPSQGSGGGGEKVCDSHLAPPPEVSCNFERDTCSWYPGHLSDTHWRWVESRGPDHDHTTGQGHFVLLDPTDPLAWGHSAHLLSRPQVPAAPTECLSFWYHLHGPQIGTLRLAMRREGEETHLWSRSGTQGNRWHEAWATLSHQPGSHAQYQLLFEGLRDGYHGTMALDDVAVRPGPCWAPNYCSFEDSDCGFSPGGQGLWRRQANASGHAAWGPPTDHTTETAQGHYMVVDTSPDALPRGQTASLTSKEHRPLAQPACLTFWYHGSLRSPGTLRVYLEERGRHQVLSLSAHGGLAWRLGSMDVQAELSLEGSCDFESGLCGWSHLAWPGLGGYSWDWGGGATPSRYPQPPVDHTLGTEAGHFAFFETGVLGPGGRAAWLRSEPLPATPASCLRFWYHMGFPEHFYKGELKVLLHSAQGQLAVWGAGGHRRHQWLEAQVEVASAKEFQIVFEATLGGQPALGPIALDDVEYLAGQHCQQPAPSPGNTAAPGSVPAVVGSALLLLMLLVLLGLGGRRWLQKKGSCPFQSNTEATAPGFDNILFNADGVTLPASVTSDP

SEQ ID NO: 913660 - protein, 1106 aa, Homo sapiens
MAVGTHRGKEASTAALRSPTLREAASSCKLRLWYQRPLEVHPGPPRLVGGAQGEGGWAAGDKQGRSCPGTPDIADVAELRVELTHGAETLTLWQSTGPWGPGWQELAVTTGRIRGDFRVTFSATRNATHRGAVALDDLEFWDCGLPTPQANCPPGHHHCQNKVCVEPQQLCDGEDNCGDLSDENPLTCGRHIATDFETGLGPWNRSEGWSRNHRLVVLSAPPGHAVTTAGTVHRLVFYQYLSGSEAGCLQLFLQTLGPGAPRAPVLLRRRRGELGTAWVRDRVDIQSAYPFQILLAGQTGPGGVVGLDDLILSDHCRPVSEVSTLQPLPPGPRAPAPQPLPPSSRLQDSCKQGHLACGDLCVPPEQLCDFEEQCAGGEDEQACGTTDFESPEAGGWEDASVGRLQWRRVSAQESQGSSAAAAGHFLSLQRAWGQLGAEARVLTPLLGPSGPSCELHLAYYLQSQPRAEFVGLVDLDGPDQQGAGVDNVTLRDCSPTVTTERDRGSCCPSSLPPGCSPYTPPGTPELPPSQGSGGGGEKVCDSHLAPPPEVSCNFERDTCSWYPGHLSDTHWRWVESRGPDHDHTTGQGHFVLLDPTDPLAWGHSAHLLSRPQVPAAPTECLSFWYHLHGPQIGTLRLAMRREGEETHLWSRSGTQGNRWHEAWATLSHQPGSHAQYQLLFEGLRDGYHGTMALDDVAVRPGPCWAPNYCSFEDSDCGFSPGGQGLWRRQANASGHAAWGPPTDHTTETAQGMGAWQGQGLRGWPGAGRLMLAPPGHYMVVDTSPDALPRGQTASLTSKEHRPLAQPACLTFWYHGSLRSPGTLRVYLEERGRHQVLSLSAHGGLAWRLGSMDVQAELSLEGSCDFESGLCGWSHLAWPGLGGYSWDWGGGATPSRYPQPPVDHTLGTEAGHFAFFETGVLGPGGRAAWLRSEPLPATPASCLRFWYHMGFPEHFYKGELKVLLHSAQGQLAVWGAGGHRRHQWLEAQVEVASAKEFQIVFEATLGGQPALGPIALDDVEYLAGQHCQQPAPSPGNTAAPGSVPAVVGSALLLLMLLVLLGLGGRRWLQKKGSCPFQSNTEATAPGFDNILFNADGVTLPASVTSDP

SEQ ID NO: 913661 - protein, 490 aa, Homo sapiens
MAVGTHRGKEASTAALRSPTLREAASSCKLRLWYQRPLEVHPGPPRLVGGAQGEGGWAAGDKQGRSCPGTPDIADVAELRVELTHGAETLTLWQSTGPWGPGWQELAVTTGRIRGDFRVTFSATRNATHRGAVALDDLEFWDCGLPTPQANCPPGHHHCQNKVCVEPQQLCDGEDNCGDLSDENPLTCGRHIATDFETGLGPWNRSEGWSRNHRLVVLSAPPGHAVTTAGTVHRLVFYQYLSGSEAGCLQLFLQTLGPGAPRAPVLLRRRRGELGTAWVRDRVDIQSAYPFQILLAGQTGPGGVVGLDDLILSDHCRPVSEVSTLQPLPPGPRAPAPQPLPPSSRLQDSCKQGHLACGDLCVPPEQLCDFEEQCAGGEDEQACGTTDFESPEAGGWEDASVGRLQWRRVSAQESQGSSAAAAGHFLSLQRAWGQLGAEARVLTPLLGPSGPSCELHLAYYLQSQPRGTATLRKFPGQPLGAPCTVGGVWG

SEQ ID NO: 913662 - protein, 1209 aa, Homo sapiens
MPLSSHLLPALVLFLGALARPCATSCVTAGTAQMRPSVVTTGPRPPWAPPSPVTSSRTPAAGGTLVPQATAGSETGQGPHWRVLGLTQTTHWAPTWVRPGQVSVRPCPNTLLAPAPSPDLSPAPGWYMAVGTHRGKEASTAALRSPTLREAASSCKLRLWYHAALEVHPGPPRLVGGAQGEGGWAAGDKQGRSCPGTPDIADVAELRVELTHGAETLTLWQSTGPWGPGWQELAVTTGRIRGDFRVTFSATRNATHRGAVALDDLEFWDCGLPTPQANCPPGHHHCQNKVCVEPQQLCDGEDNCGDLSDENPLTCGRHIATDFETGLGPWNRSEGWSRNHRLVVLSAPPGHAVTTAGTVHRLVFYQYLSGSEAGCLQLFLQTLGPGAPRAPVLLRRRRGELGTAWVRDRVDIQSAYPFQILLAGQTGPGGVVGLDDLILSDHCRPVSEVSTLQPLPPGPRAPAPQPLPPSSRLQDSCKQGHLACGDLCVPPEQLCDFEEQCAGGEDEQACGTTDFESPEAGGWEDASVGRLQWRRVSAQESQGSSAAAAGHFLSLQRAWGQLGAEARVLTPLLGPSGPSCELHLAYYLQSQPRVEFVGLVDLDGPDQQGAGVDNVTLRDCSPTVTTERDRGSCCPSSLPPGCSPYTPPGTPELPPSQGSGGGGEKVCDSHLAPPPEVSCNFERDTCSWYPGHLSDTHWRWVESRGPDHDHTTGQGHFVLLDPTDPLAWGHSAHLLSRPQVPAAPTECLSFWYHLHGPQIGTLRLAMRREGEETHLWSRSGTQGNRWHEAWATLSHQPGSHAQYQLLFEGLRDGYHGTMALDDVAVRPGPCWAPNYCSFEDSDCGFSPGGQGLWRRQANASGHAAWGPPTDHTTETAQGHYMVVDTSPDALPRGQTASLTSKEHRPLAQPACLTFWYHGSLRSPGTLRVYLEERGRHQVLSLSAHGGLAWRLGSMDVQAELSLEGSCDFESGLCGWSHLAWPGLGGYSWDWGGGATPSRYPQPPVDHTLGTEAGHFAFFETGVLGPGGRAAWLRSEPLPATPASCLRFWYHMGFPEHFYKGELKVLLHSAQGQLAVWGAGGHRRHQWLEAQVEVASAKEFQIVFEATLGGQPALGPIALDDVEYLAGQHCQQPAPSPGNTAAPGSVPAVVGSALLLLMLLVLLGLGGRRWLQKKGSCPFQSNTEATAPGFDNILFNADGVTLPASVTSDP

SEQ ID NO: 913663 - protein, 1209 aa, Homo sapiens
MPLSSHLLPALVLFLGALARPCATSCVTAGTAQMRPSVVTTGPRPPWAPPSPVTSSRTPAAGGTLVPQATAGSETGQGPHWRVLGLTQTTHWAPTWVRPGQVSVRPCPNTLLAPAPSPDLSPAPGWYMAVGTHRGKEASTAALRSPTLREAASSCKLRLWYQRPLEVHPGPPRLVGGAQGEGGWAAGDKQGRSCPGTPDIADVAELRVELTHGAETLTLWQSTGPWGPGWQELAVTTGRIRGDFRVTFSATRNATHRGAVALDDLEFWDCGLPTPQANCPPGHHHCQNKVCVEPQQLCDGEDNCGDLSDENPLTCGRHIATDFETGLGPWNRSEGWSRNHRLVVLSAPPGHAVTTAGTVHRLVFYQYLSGSEAGCLQLFLQTLGPGAPRAPVLLRRRRGELGTAWVRDRVDIQSAYPFQILLAGQTGPGGVVGLDDLILSDHCRPVSEVSTLQPLPPGPRAPAPQPLPPSSRLQDSCKQGHLACGDLCVPPEQLCDFEEQCAGGEDEQACGTTDFESPEAGGWEDASVGRLQWRRVSAQESQGSSAAAAGHFLSLQRAWGQLGAEARVLTPLLGPSGPSCELHLAYYLQSQPRAEFVGLVDLDGPDQQGAGVDNVTLRDCSPTVTTERDRGSCCPSSLPPGCSPYTPPGTPELPPSQGSGGGGEKVCDSHLAPPPEVSCNFERDTCSWYPGHLSDTHWRWVESRGPDHDHTTGQGHFVLLDPTDPLAWGHSAHLLSRPQVPAAPTECLSFWYHLHGPQIGTLRLAMRREGEETHLWSRSGTQGNRWHEAWATLSHQPGSHAQYQLLFEGLRDGYHGTMALDDVAVRPGPCWAPNYCSFEDSDCGFSPGGQGLWRRQANASGHAAWGPPTDHTTETAQGHYMVVDTSPDALPRGQTASLTSKEHRPLAQPACLTFWYHGSLRSPGTLRVYLEERGRHQVLSLSAHGGLAWRLGSMDVQAELSLEGSCDFESGLCGWSHLAWPGLGGYSWDWGGGATPSRYPQPPVDHTLGTEAGHFAFFETGVLGPGGRAAWLRSEPLPATPASCLRFWYHMGFPEHFYKGELKVLLHSAQGQLAVWGAGGHRRHQWLEAQVEVASAKEFQIVFEATLGGQPALGPIALDDVEYLAGQHCQQPAPSPGNTAAPGSVPAVVGSALLLLMLLVLLGLGGRRWLQKKGSCPFQSNTEATAPGFDNILFNADGVTLPASVTSDP

SEQ ID NO: 913664 - protein, 1209 aa, Homo sapiens; identical to SEQ ID NO: 913662

SEQ ID NO: 913665 - protein, 1209 aa, Homo sapiens
MPLSSHLLPALVLFLGALARPCATSCVTAGTAQMRPSVVTTGPRPPWAPPSPVTSSRTPAAGGTLVPQATAGSETGQGPHWRVLGLTQTTHWAPTWVRPGQVSVRPCPNTLLAPAPSPDLSPAPGWYMAVGTHRGKEASTAALRSPTLREAASSCKLRLWYHAASGGAPWTPKARGGSQGEGGWAAGDKQGRSCPGTPDIADVAELRVELTHGAETLTLWQSTGPWGPGWQELAVTTGRIRGDFRVTFSATRNATHRGAVALDDLEFWDCGLPTPQANCPPGHHHCQNKVCVEPQQLCDGEDNCGDLSDENPLTCGRHIATDFETGLGPWNRSEGWSRNHRLVVLSAPPGHAVTTAGTVHRLVFYQYLSGSEAGCLQLFLQTLGPGAPRAPVLLRRRRGELGTAWVRDRVDIQSAYPFQILLAGQTGPGGVVGLDDLILSDHCRPVSEVSTLQPLPPGPRAPAPQPLPPSSRLQDSCKQGHLACGDLCVPPEQLCDFEEQCAGGEDEQACGTTDFESPEAGGWEDASVGRLQWRRVSAQESQGSSAAAAGHFLSLQRAWGQLGAEARVLTPLLGPSGPSCELHLAYYLQSQPRAEFVGLVDLDGPDQQGAGVDNVTLRDCSPTVTTERDRGSCCPSSLPPGCSPYTPPGTPELPPSQGSGGGGEKVCDSHLAPPPEVSCNFERDTCSWYPGHLSDTHWRWVESRGPDHDHTTGQGHFVLLDPTDPLAWGHSAHLLSRPQVPAAPTECLSFWYHLHGPQIGTLRLAMRREGEETHLWSRSGTQGNRWHEAWATLSHQPGSHAQYQLLFEGLRDGYHGTMALDDVAVRPGPCWAPNYCSFEDSDCGFSPGGQGLWRRQANASGHAAWGPPTDHTTETAQGHYMVVDTSPDALPRGQTASLTSKEHRPLAQPACLTFWYHGSLRSPGTLRVYLEERGRHQVLSLSAHGGLAWRLGSMDVQAELSLEGSCDFESGLCGWSHLAWPGLGGYSWDWGGGATPSRYPQPPVDHTLGTEAGHFAFFETGVLGPGGRAAWLRSEPLPATPASCLRFWYHMGFPEHFYKGELKVLLHSAQGQLAVWGAGGHRRHQWLEAQVEVASAKEFQIVFEATLGGQPALGPIALDDVEYLAGQHCQQPAPSPGNTAAPGSVPAVVGSALLLLMLLVLLGLGGRRWLQKKGSCPFQSNTEATAPGFDNILFNADGVTLPASVTSDP

SEQ ID NO: 913666 - protein, 1209 aa, Homo sapiens; identical to SEQ ID NO: 913663

SEQ ID NO: 913667 - protein, 125 aa, Homo sapiens
MAVADLALIPDVDIDSDGVFKYVLIRVHSAPRSGAPAAESKEIVRGYKWAEYHADIYDKVSGDMQKQGCDCECLGGGRISHQSQDKKIHVYGYSMVSRSPVPPCRRPQYQLRGPPEPAALTRGPS

SEQ ID NO: 913668 - protein, 125 aa, Homo sapiens; identical to SEQ ID NO: 913667

SEQ ID NO: 913669 - protein, 69 aa, Homo sapiens
MAVADLALIPDVDIDSDGVFKYVLIRVHSAPRSGAPAAESKEIVRGYKWAEYHADIYDHVLAKWGDPSR

SEQ ID NO: 913670 - protein, 84 aa, Homo sapiens
LWRAHMSLWPTGNTAAPGSVPAVVGSALLLLMLLVLLGLGGRRWLQKKGSCPFQSNTEATAPGFDNILFNADGVTLPASVTSDP

SEQ ID NO: 913671 - protein, 125 aa, Homo sapiens; identical to SEQ ID NO: 913656

SEQ ID NO: 913672 - protein, 1106 aa, Homo sapiens; identical to SEQ ID NO: 913660

SEQ ID NO: 913673 - protein, 345 aa, Homo sapiens
MAVGTHRGKEASTAALRSPTLREAASSCKLRLWYQRPLEVHPGPPRLVGGAQGEGGWAAGDKQGRSCPGTPDIADVAELRVELTHGAETLTLWQSTGPWGPGWQELAVTTGRIRGDFRVTFSATRNATHRGAVALDDLEFWDCGLPTPQANCPPGHHHCQNKVCVEPQQLCDGEDNCGDLSDENPLTCGRHIATDFETGLGPWNRSEGWSRNHRLVVLSAPPGHAVTTAGTVHRLVFYQYLSGSEAGCLQLFLQTLGPGAPRAPVLLRRRRGELGTAWVRDRVDIQSAYPFQILLAGQTGPGGVVGLDDLILSDHCRPVSEVSTLQPLPPGPRAPAPQPPNRPYH

SEQ ID NO: 913674 - protein, 125 aa, Homo sapiens; identical to SEQ ID NO: 913656

SEQ ID NO: 913675 - protein, 1209 aa, Homo sapiens
MPLSSHLLPALVLFLGALARPCATSCVTAGTAQMRPSVVTTGPRPPWAPPSPVTSSRTPAAGGTLVPQATAGSETGQGPHWRVLGLTQTTHWAPTWVRPGQVSVRPCPNTLLAPAPSPDLSPAPGWYMAVGTHRGKEASTAALRSPTLREAASSCKLRLWYHAALEVHPGPPRLVGGAQGEGGWAAGDKQGRSCPGTPDIADVAELRVELTHGAETLTLWQSTGPWGPGWQELAVTTGRIRGDFRVTFSATRNATHRGAVALDDLEFWDCGLPTPQANCPPGHHHCQNKVCVEPQQLCDGEDNCGDLSDENPLTCGRHIATDFETGLGPWNRSEGWSRNHRLVVLSAPPGHAVTTAGTVHRLVFYQYLSGSEAGCLQLFLQTLGPGAPRAPVLLRRRRGELGTAWVRDRVDIQSAYPFQILLAGQTGPGGVVGLDDLILSDHCRPVSEVSTLQPLPPGPRAPAPQPLPPSSRLQDSCKQGHLACGDLCVPPEQLCDFEEQCAGGEDEQACGTTDFESPEAGGWEDASVGRLQWRRVSAQESQGSSAAAAGHFLSLQRAWGQLGAEARVLTPLLGPSGPSCELHLAYYLQSQPRAEFVGLVDLDGPDQQGAGVDNVTLRDCSPTVTTERDRGSCCPSSLPPGCSPYTPPGTPELPPSQGSGGGGEKVCDSHLAPPPEVSCNFERDTCSWYPGHLSDTHWRWVESRGPDHDHTTGQGHFVLLDPTDPLAWGHSAHLLSRPQVPAAPTECLSFWYHLHGPQIGTLRLAMRREGEETHLWSRSGTQGNRWHEAWATLSHQPGSHAQYQLLFEGLRDGYHGTMALDDVAVRPGPCWAPNYCSFEDSDCGFSPGGQGLWRRQANASGHAAWGPPTDHTTETAQGHYMVVDTSPDALPRGQTASLTSKEHRPLAQPACLTFWYHGSLRSPGTLRVYLEERGRHQVLSLSAHGGLAWRLGSMDVQAELSLEGSCDFESGLCGWSHLAWPGLGGYSWDWGGGATPSRYPQPPVDHTLGTEAGHFAFFETGVLGPGGRAAWLRSEPLPATPASCLRFWYHMGFPEHFYKGELKVLLHSAQGQLAVWGAGGHRRHQWLEAQVEVASAKEFQIVFEATLGGQPALGPIALDDVEYLAGQHCQQPAPSPGNTAAPGSVPAVVGSALLLLMLLVLLGLGGRRWLQKKGSCPFQSNTEATAPGFDNILFNADGVTLPASVTSDP

SEQ ID NO: 913676 - protein, 1209 aa, Homo sapiens; identical to SEQ ID NO: 913662

SEQ ID NO: 913677 - protein, 125 aa, Homo sapiens; identical to SEQ ID NO: 913656

SEQ ID NO: 913678 - protein, 181 aa, Homo sapiens
MAVADLALIPDVDIDSDGVFKYVLIRVHSAPRSGAPAAESKEIVRGYKWAEYHADIYDKVSGDMQKQGCDCECLGGGRISHQSQDKKIHVYGYSMDETHVRPSGRLRPQDPPSRPMVLPSTPFQLRKSKPSTPTTRSPGLTTATEHSQPGACCLQQPLQSPRLCLHSSCRAGPACSCGSLW

SEQ ID NO: 913679 - protein, 282 aa, Homo sapiens
LPCTRQVVFEAVAAGVAHSYVALDDLLLQDGPCPQPGSCDFESGLCGWSHLAWPGLGGYSWDWGGGATPSRYPQPPVDHTLGTEAGHFAFFETGVLGPGGRAAWLRSEPLPATPASCLRFWYHMGFPEHFYKGELKVLLHSAQGQLAVWGAGGHRRHQWLEAQVEVASAKEFQIVFEATLGGQPALGPIALDDVEYLAGQHCQQPAPSPGNTAAPGSVPAVVGSALLLLMLLVLLGLGGRRWLQKKGSCPFQSNTEATAPGFDNILFNADGVTLPASVTSDP

SEQ ID NO: 913680 - protein, 741 aa, Homo sapiens
MDIEDEENMSSSSTDVKENRNLDNVSPKDGSTPGPGEGSQLSNGGGGGPGRKRPLEEGSNGHSKYRLKKRRKTPGPVLPKNALMQLNEIKPGLQYTLLSQTGPVHAPLFVMSVEVNGQVFEGSGPTKKKAKLHAAEKALRSFVQFPNASEAHLAMGRTLSVNTDFTSDQADFPDTLFNGFETPDKAEPPFYVGSNGDDSFSSSGDLSLSASPVPASLAQPPLPVLPPFPPPSGKNPVMILNELRPGLKYDFLSESGESHAKSFVMSVVVDGQFFEGSGRNKKLAKARAAQSALAAIFNLHLDQTPSRQPIPSEGLQLHLPQVLADAVSRLVLGKFGDLTDNFSSPHARRKVLAGVVMTTGTDVKDAKVISVSTGTKCINGEYMSDRGLALNDCHAEIISRRSLLRFLYTQLELYLNNKDDQKRSIFQKSERGGFRLKENVQFHLYISTSPCGDARIFSPHEPILEGSRSYTQAGVQWCNHGSLQPRPPGLLSDPSTSTFQGAGTTEPADRHPNRKARGQLRTKIESGEGTIPVRSNASIQTWDGVLQGERLLTMSCSDKIARWNVVGIQGSLLSIFVEPIYFSSIILGSLYHGDHLSRAMYQRISNIEDLPPLYTLNKPLLSGISNAEARQPGKAPNFSVNWTVGDSAIEVINATTGKDELGRASRLCKHALYCRWMRVHGKVPSHLLRSKITKPNVYHESKLAAKEYQAAKARLFTAFIKAGLGAWVEKPTEQDQFSLTP

SEQ ID NO: 913681 - protein, 701 aa, Homo sapiens
MDIEDEENMSSSSTDVKENRNLDNVSPKDGSTPGPGEGSQLSNGGGGGPGRKRPLEEGSNGHSKYRLKKRRKTPGPVLPKNALMQLNEIKPGLQYTLLSQTGPVHAPLFVMSVEVNGQVFEGSGPTKKKAKLHAAEKALRSFVQFPNASEAHLAMGRTLSVNTDFTSDQADFPDTLFNGFETPDKAEPPFYVGSNGDDSFSSSGDLSLSASPVPASLAQPPLPVLPPFPPPSGKNPVMILNELRPGLKYDFLSESGESHAKSFVMSVVVDGQFFEGSGRNKKLAKARAAQSALAAIFNLHLDQTPSRQPIPSEGLQLHLPQVLADAVSRLVLGKFGDLTDNFSSPHARRKVLAGVVMTTGTDVKDAKVISVSTGTKCINGEYMSDRGLALNDCHAEIISRRSLLRFLYTQLELYLNNKDDQKRSIFQKSERGGFRLKENVQFHLYISTSPCGDARIFSPHEPILEEPADRHPNRKARGQLRTKIESGEGTIPVRSNASIQTWDGVLQGERLLTMSCSDKIARWNVVGIQGSLLSIFVEPIYFSSIILGSLYHGDHLSRAMYQRISNIEDLPPLYTLNKPLLSGISNAEARQPGKAPNFSVNWTVGDSAIEVINATTGKDELGRASRLCKHALYCRWMRVHGKVPSHLLRSKITKPNVYHESKLAAKEYQAAKARLFTAFIKAGLGAWVEKPTEQDQFSLTP

SEQ ID NO: 913682 - protein, 70 aa, Homo sapiens
EPWAGWLSGGTGFREPWAGAGGGCRKELVSGSPGRGGCGEEGDVQGTRGSALLLGQLICNQKKNKQNTER

SEQ ID NO: 913683 - protein, 359 aa, Homo sapiens
MSDRGLALNDCHAEIISRRSLLRFLYTQLELYLNNKDDQKRSIFQKSERGGFRLKENVQFHLYISTSPCGDARIFSPHEPILEGSRSYTQAGVQWCNHGSLQPRPPGLLSDPSTSTFQGAGTTEPADRHPNRKARGQLRTKIESGEGTIPVRSNASIQTWDGVLQGERLLTMSCSDKIARWNVVGIQGSLLSIFVEPIYFSSIILGSLYHGDHLSRAMYQRISNIEDLPPLYTLNKPLLSGISNAEARQPGKAPNFSVNWTVGDSAIEVINATTGKDELGRASRLCKHALYCRWMRVHGKVPSHLLRSKITKPNVYHESKLAAKEYQAAKARLFTAFIKAGLGAWVEKPTEQDQFSLTP

SEQ ID NO: 913684 - protein, 74 aa, Homo sapiens
GGGAEALRRPWRRRRRRRQRRPSGQVGGRGSGPREATATPRRCAQPTRQSAARRETAAEAWGARAEDQARRGCG

SEQ ID NO: 913685 - protein, 714 aa, Homo sapiens
MDIEDEENMSSSSTDVKENRNLDNVSPKDGSTPGPGEGSQLSNGGGGGPGRKRPLEEGSNGHSKYRLKKRRKTPGPVLPKNALMQLNEIKPGLQYTLLSQTGPVHAPLFVMSVEVNGQVFEGSGPTKKKAKLHAAEKALRSFVQFPNASEAHLAMGRTLSVNTDFTSDQADFPDTLFNGFETPDKAEPPFYVGSNGDDSFSSSGDLSLSASPVPASLAQPPLPVLPPFPPPSGKNPVMILNELRPGLKYDFLSESGESHAKSFVMSVVVDGQFFEGSGRNKKLAKARAAQSALAAIFNLHLDQTPSRQPIPSEGLQLHLPQVLADAVSRLVLGKFGDLTDNFSSPHARRKVLAGVVMTTGTDVKDAKVISVSTGTKCINGEYMSDRGLALNDCHAEIISRRSLLRFLYTQLELYLNNKDDQKRSIFQKSERGGFRLKENVQFHLYISTSPCGDARIFSPHEPILEGSRSYTQAGVQWCNHGSLQPRPPGLLSDPSTSTFQGAGTTEPADRHPNRKARGQLRTKIESGEGTIPVRSNASIQTWDGVLQGERLLTMSCSDKIARWNVVGIQGSLLSIFVEPIYFSSIILGSLYHGDHLSRAMYQRISNIEDLPPLYTLNKPLLSGISNAEARQPGKAPNFSVNWTVGDSAIEVINATTGKDELGRASRLCKHALYCRWMRVHGKVPSHLLRSKITKPNVYHESKLAAKEYQAAKVH

SEQ ID NO: 913686 - protein, 741 aa, Homo sapiens; identical to SEQ ID NO: 913680

SEQ ID NO: 913687 - protein, 682 aa, Homo sapiens
MDIEDEENMSSSSTDVKENRNLDNVSPKDGSTPGPGEGSQLSNGGGGGPGRKRPLEEGSNGHSKYRLKKRRKTPGPVLPKNALMQLNEIKPGLQYTLLSQTGPVHAPLFVMSVEVNGQVFEGSGPTKKKAKLHAAEKALRSFVQFPNASEAHLAMGRTLSVNTDFTSDQADFPDTLFNGFETPDKAEPPFYVGSNGDDSFSSSGDLSLSASPVPASLAQPPLPVLPPFPPPSGKNPVMILNELRPGLKYDFLSESGESHAKSFVMSVVVDGQFFEGSGRNKKLAKARAAQSALAAIFNLHLDQTPSRQPIPSEGLQLHLPQVLADAVSRLVLGKFGDLTDNFSSPHARRKVLAGVVMTTGTDVKDAKVISVSTGTKCINGEYMSDRGLALNDCHAEIISRRSLLRFLYTQLELYLNNKDDQKRSIFQKSERGGFRLKENVQFHLYISTSPCGDARIFSPHEPILEGSRSYTQAGVQWCNHGSLQPRPPGLLSDPSTSTFQGAGTTEPADRHPNRKARGQLRTKIESGEGTIPVRSNASIQTWDGVLQGERLLTMSCSDKIARWNVVGIQGSLLSIFVEPIYFSSIILGSLYHGDHLSRAMYQRISNIEDLPPLYTLNKPLLSGISNAEARQPGKAPNFSVNWTVGDSAIEVINATTGKDELGRASRLCKHALYCRWMRVHGK

SEQ ID NO: 913688 - protein, 484 aa, Homo sapiens
LGWSRPGCQRLGSRARSGRRAASAPAGPCVPRLAPLTPSRPGRAMISLPGPLVTNLLRFLFLGLSALAPPSRAQLQLHLPANRLQAVEGGEVVLPAWYTLHGEVSSSQPWEVPFVMWFFKQKEKEDQVLSYINGVTTSKPGVSLVYSMPSRNLSLRLEGLQEKDSGPYSCSVNVQDKQGKSRGHSIKTLELNVLVPPAPPSCRLQGVPHVGANVTLSCQSPRSKPAVQYQWDRQLPSFQTFFAPALDVIRGSLSLTNLSSSMAGVYVCKAHNEVGTAQCNVTLEVSTGPGAAVVAGAVVGTLVGLGLLAGLVLLYHRRGKALEEPANDIKEDALLPGPAWPKSSEKSPRLGPFSVTPHEPTGDHMASQAGVLNPTPRSQQALLHQQLATETMEANHQKKKPVLGGSPYTGPERNGITGPSDEADKNNRHTENRHPNHSTQEGEEQHKEPTKADSEGKDNARPKDAHTNEKATTMLQKHEQTDNT

SEQ ID NO: 913689 - protein, 434 aa, Homo sapiens
LGWSRPGCQRLGSRARSGRRAASAPAGPCVPRLAPLTPSRPGRAMISLPGPLVTNLLRFLFLGLSALAPPSRAQLQLHLPANRLQAVEGGEVVLPAWYTLHGEVSSSQPWEVPFVMWFFKQKEKEDQVLSYINGVTTSKPGVSLVYSMPSRNLSLRLEGLQEKDSGPYSCSVNVQDKQGKSRGHSIKTLELNVLVPPAPPSCRLQGVPHVGANVTLSCQSPRSKPAVQYQWDRQLPSFQTFFAPALDVIRGSLSLTNLSSSMAGVYVCKAHNEVGTAQCNVTLEVSTGPGAAVVAGAVVGTLVGLGLLAGLVLLYHRRGKALEEPANDIKEDAIAPRTLPWPKSSDTISKNGTLSSVTSARALRPPHGPPRPGALTPTPSLSSQALPSPRLPTTDGAHPQPISPIPGGVSSSGLSRMGAVPVMVPAQSQAGSLV

SEQ ID NO: 913690 - protein, 337 aa, Homo sapiens
LGWSRPGCQRLGSRARSGRRAASAPAGPCVPRLAPLTPSRPGRAMISLPGPLVTNLLRFLFLGLSALAPPSRAQLQLHLPANRLQAVEGGEVVLPAWYTLHGEVSSSQPWEVPFVMWFFKQKEKEDQVLSYINGVTTSKPGVSLVYSMPSRNLSLRLEGLQEKDSGPYSCSVNVQDKQGKSRGHSIKTLELNVLVPPAPPSCRLQGVPHVGANVTLSCQSPRSKPAVQYQWDRQLPSFQTFFAPALDVIRGSLSLTNLSSSMAGVYVCKAHNEVGTAQCNVTLEVSTGPGAAVVAGAVVGTLVGLGLLAGLVLLYPRQMGPTLNQYPPSLVGFLPLA

SEQ ID NO: 913691 - protein, 280 aa, Homo sapiens
MRLAGLQEKDSGPYSCSVNVQDKQGKSRGHSIKTLELNVLVPPAPPSCRLQGVPHVGANVTLSCQSPRSKPAVQYQWDRQLPSFQTFFAPALDVIRGSLSLTNLSSSMAGVYVCKAHNEVGTAQCNVTLEVSTGPGAAVVAGAVVGTLVGLGLLAGLVLLYHRRGKALEEPANDIKEDAIAPRTLPWPKSSDTISKNGTLSSVTSARALRPPHGPPRPGALTPTPSLSSQALPSPRLPTTDGAHPQPISPIPGGVSSSGLSRMGAVPVMVPAQSQAGSLV

SEQ ID NO: 913692 - protein, 366 aa, Homo sapiens
LGWSRPGCQRLGSRARSGRRAASAPAGPCVPRLAPLTPSRPGRAMISLPGPLVTNLLRFLFLGLSALAPPSRAQLQLHLPANRLQAVEGGEVVLPAWYTLHGEVSSSQPWEVPFVMWFFKQKEKEDQVLSYINGVTTSKPGVSLVYSMPSRNLSLRLEGLQEKDSGPYSCSVNVQDKQGKSRGHSIKTLELNVLVPPAPPSCRLQGVPHVGANVTLSCQSPRSKPAVQYQWDRQLPSFQTFFAPALDVIRGSLSLTNLSSSMAGVYVCKAHNEVGTAQCNVTLEVSTGPGAAVVAGAVVGTLVGLGLLAGLVLLYHRRGKALEEPANDIKEDAIAPRTLPWPKSSDTLLTLSTLPPPLFTVGKPSQ

SEQ ID NO: 913693 - protein, 349 aa, Homo sapiens
LGWSRPGCQRLGSRARSGRRAASAPAGPCVPRLAPLTPSRPGRAMISLPGPLVTNLLRFLFLGLSALAPPSRAQLQLHLPANRLQAVEGGEVVLPAWYTLHGEVSSSQPWEVPFVMWFFKQKEKEDQVLSYINGVTTSKPGVSLVYSMPSRNLSLRLEGLQEKDSGPYSCSVNVQDKQGKSRGHSIKTLELNVLVPPAPPSCRLQGVPHVGANVTLSCQSPRSKPAVQYQWDRQLPSFQTFFAPALDVIRGSLSLTNLSSSMAGVYVCKAHNEVGTAQCNVTLEVSTGPGAAVVAGAVVGTLVGLGLLAGLVLLYHRRGKALEEPANDIKEDAIAPRTLPWPKSSDTSY

SEQ ID NO: 913694 - protein, 434 aa, Homo sapiens; identical to SEQ ID NO: 913689

SEQ ID NO: 913695 - protein, 434 aa, Homo sapiens; identical to SEQ ID NO: 913689

SEQ ID NO: 913696 - protein, 307 aa, Homo sapiens
LGWSRPGCQRLGSRARSGRRAASAPAGPCVPRLAPLTPSRPGRAMISLPGPLVTNLLRFLFLGLSALVPPAPPSCRLQGVPHVGANVTLSCQSPRSKPAVQYQWDRQLPSFQTFFAPALDVIRGSLSLTNLSSSMAGVYVCKAHNEVGTAQCNVTLEVSTGPGAAVVAGAVVGTLVGLGLLAGLVLLYHRRGKALEEPANDIKEDAIAPRTLPWPKSSDTISKNGTLSSVTSARALRPPHGPPRPGALTPTPSLSSQALPSPRLPTTDGAHPQPISPIPGGVSSSGLSRMGAVPVMVPAQSQAGSLV

SEQ ID NO: 913697 - protein, 173 aa, Homo sapiens [sequence omitted]

SEQ ID NO: 913698 - protein, 836 aa, Homo sapiens
RAAARLPDLSPAQPSAGERKRNPFRGLLVTLLHASRRPPGRFGLAVVARTPPEPRPSPEGDPSPPPPPMSALVPDTPPDTPPAMKNATSSKQLPLEPESPSGQVGPRPAPPQEESPSSEAKSRGPTPPAMGPRDARPPRRSSQPSPTAVPASDSPPTKQEVKKAGERHKLAKERREERAKYLAAKKAVWLEKEEKAKALREKQLQERRRRLEEQRLKAEQRRAALEERQRQKLEKNKERYEAAIQRSVKKTWAEIRQQRWSWAGALHHSSPGHKTSGSRCSVSAVNLPKHVDSIINKRLSKSSATLWNSPSRNRSLQLSAWESSIVDRLMTPTLSFLARSRSAVTLPRNGRDHRAGVPALGLRQPPDAVQRHPKRAPLRPRGERGERRKPNAGGSPAPVRRRPEASPVQKKEKKDKERENEKEKSALARERSLKKRQSLPASPRARLSASTASELSPKSKARPSSPSTSWHRPASPCPSPGPGHTLPPKPPSPRGTTASPKGRVRRKEEAKESPSAAGPEDKSQSKRRASNEKESAAPASPAPSPAPSPTPAPPQKEQPPAETPTDAAVLTSPPAPAPPVTPSKPMAGTTDREEATRLLAEKRRQAREQREREEQERRLQAERDKRMREEQLAREAEARAEREAEARRREEQEAREKAQAEQEEQERLQKQKEEAEARSREEAERQRLEREKHFQQQEQERQERRKRLEEIMKRTRKSEVSETKKQDSKEANANGSSPEPVKAVEARSPGLQKEAVQKEEPIPQEPQWSLPSKELPASLVNGLQPLPAHQENGFSTNGPSGDKSLSRTPETLLPFAEAEAFLKKAVVQSPQVTEVL

SEQ ID NO: 913699 - protein, 832 aa, Homo sapiens
MESGPRAELGAGAPPAVVARTPPEPRPSPEGDPSPPPPPMSALVPDTPPDTPPAMKNATSSKQLPLEPESPSGQVGPRPAPPQEESPSSEAKSRGPTPPAMGPRDARPPRRSSQPSPTAVPASDSPPTKQEVKKAGERHKLAKERREERAKYLAAKKAVWLEKEEKAKALREKQLQERRRRLEEQRLKAEQRRAALEERQRQKLEKNKERYEAAIQRSVKKTWAEIRQQRWSWAGALHHSSPGHKTSGSRCSVSAVNLPKHVDSIINKRLSKSSATLWNSPSRNRSLQLSAWESSIVDRLMTPTLSFLARSRSAVTLPRNGRDQGPTWGRAGASLARGPQPDRTHPSAAVPVCPRSASASPLTPCSVTRSVHRCAPAGERGERRKPNAGGSPAPVRRRPEASPVQKKEKKDKERENEKEKSALARERSLKKRQSLPASPRARLSASTASELSPKSKARPSSPSTSWHRPASPCPSPGPGHTLPPKPPSPRGTTASPKGRVRRKEEAKESPSAAGPEDKSQSKRRASNEKESAAPASPAPSPAPSPTPAPPQKEQPPAETPTDAAVLTSPPAPAPPVTPSKPMAGTTDREEATRLLAEKRRQAREQREREEQERRLQAERDKRMREEQLAREAEARAEREAEARRREEQEAREKAQAEQEEQERLQKQKEEAEARSREEAERQRLEREKHFQQQEQERQERRKRLEEIMKRTRKSEVSETKKQDSKEANANGSSPEPVKAVEARSPGLQKEAVQKEEPIPQEPQWSLPSKELPASLVNGLQPLPAHQENGFSTNGPSGDKSLSRTPETLLPFAEAEAFLKKAVVQSPQVTEVL

SEQ ID NO: 913700 - protein, 770 aa, Homo sapiens
MESGPRAELGAGAPPAVVARTPPEPRPSPEGDPSPPPPPMSALVPDTPPDTPPAMKNATSSKQLPLEPESPSGQVGPRPAPPQEESPSSEAKSRGPTPPAMGPRDARPPRRSSQPSPTAVPASDSPPTKQEVKKAGERHKLAKERREERAKYLAAKKAVWLEKEEKAKALREKQLQERRRRLEEQRLKAEQRRAALEERQRQKLEKNKERYEAAIQRSVKKTWAEIRQQRWSWAGALHHSSPGHKTNRSLQLSAWESSIVDRLMTPTLSFLARSRSAVTLPRNGRDHRAGVPALGLRQPPDAVQRHPKRAPLRPRGERGERRKPNAGGSPAPVRRRPEASPVQKKEKKDKERENEKEKSALARERSLKKRQSLPASPRARLSASTASELSPKSKARPSSPSTSWHRPASPCPSPGPGHTLPPKPPSPRGTTASPKGRVRRKEEAKESPSAAGPEDKSQSKRRASNEKESAAPASPAPSPAPSPTPAPPQKEQPPAETPTDAAVLTSPPAPAPPVTPSKPMAGTTDREEATRLLAEKRRQAREQREREEQERRLQAERDKRMREEQLAREAEARAEREAEARRREEQEAREKAQAEQEEQERLQKQKEEAEARSREEAERQRLEREKHFQQQEQERQERRKRLEEIMKRTRKSEVSETKKQDSKEANANGSSPEPVKAVEARSPGLQKEAVQKEEPIPQEPQWSLPSKELPASLVNGLQPLPAHQENGFSTNGPSGDKSLSRTPETLLPFAEAEAFLKKAVVQSPQVTEVL

SEQ ID NO: 913701 - protein, 540 aa, Homo sapiens [sequence omitted]

SEQ ID NO: 913702 - protein, 831 aa, Homo sapiens
MESGPRAELGAGAPPAVVARTPPEPRPSPEGDPSPPPPPMSALVPDTPPDTPPAMKNATSSKQLPLEPESPSGQVGPRPAPPQEESPSSEAKSRGPTPPAMGPRDARPPRRSSQPSPTAVPASDSPPTKQEVKKAGERHKLAKERREERAKYLAAKKAVWLEKEEKAKALREKQLQERRRRLEEQRLKAEQRRAALEERQRQKLEKNKERYEAAIQRSVKKTWAEIRQQRWSWAGALHHSSPGHKTSGSRCSVSAVNLPKHVDSIINKRLSKSSATLWNSPSRNRSLQLSAWESSIVDRLMTPTLSFLARSRSAVTLPRNGRDQGRGCDPGRGPTWGRAGASLARGPQPDRTHPSAAVPVCPRSASASPLTPCSVTRSVHRCAPAGERGERRKPNAGGSPAPVRRRPEASPVQKKEKKDKERENEKEKSALARERSLKKRQSLPASPRARLSASTASELSPKSKARPSSPSTSWHRPASPCPSPGPGHTLPPKPPSPRGTTASPKGRVRRKEEAKESPSAAGPEDKSQSKRRASNEKESAAPASPAPSPAPSPTPAPPQKEQPPAETPTAPAPPVTPSKPMAGTTDREEATRLLAEKRRQAREQREREEQERRLQAERDKRMREEQLAREAEARAEREAEARRREEQEAREKAQAEQEEQERLQKQKEEAEARSREEAERQRLEREKHFQQQEQERQERRKRLEEIMKRTRKSEVSETKKQDSKEANANGSSPEPVKAVEARSPGLQKEAVQKEEPIPQEPQWSLPSKELPASLVNGLQPLPAHQENGFSTNGPSGDKSLSRTPETLLPFAEAEAFLKKAVVQSPQVTEVL

SEQ ID NO: 913703 - protein, 985 aa, Homo sapiens
MESGPRAELGAGAPPAVVARTPPEPRPSPEGDPSPPPPPMSALVPDTPPDTPPAMKNATSSKQLPLEPESPSGQVGPRPAPPQEESPSSEAKSRGPTPPAMGPRDARPPRRSSQPSPTAVPASDSPPTKQEVKKAGERHKLAKERREERAKYLAAKKAVWLEKEEKAKALREKQLQERRRRLEEQRLKAEQRRAALEERQRQKLEKNKERYEAAIQRSVKKTWAEIRQQRWSWAGALHHSSPGHKTSGSRCSVSAVNLPKHVDSIINKRLSKSSATLWNSPSRNRSLQLSAWESSIVDRLMTPTLSFLARSRSAVTLPRNGRDQGRGCDPGRGPTWGRAGASLARGPQPDRTHPSAAVPVCPRSASASPLTPCSVTRSVHRCAPAGERGERRKPNAGGSPAPVRRRPEASPVQKKEKKDKERENEKEKSALARERSLKKRQSLPASPRARLSASTASELSPKSKARPSSPSTSWHRPASPCPSPGPGHTLPPKPPSPRGTTASPKGRVRRKEEAKESPSAAGPEDKSQSKRRASNEKESAAPASPAPSPAPSPTPAPPQKEQPPAETPTDAAVLTSPPAPAPPVTPSKPMAGTTDREEATRLLAEKRRQAREQREREEQERRLQAERDKRMREEQLAREAEARAEREAEARRREEQEAREKAQAEQEEQERLQKQKEEAEARSREEAERQRLEREKHFQQQEQERQERRKVCGPGRGFVGGAWAGRARWAGPGLRADRTGKRWGKFQFLLLERAAMSWEALRLRGRVWLVGGLGLGAGLEPNCSAASKQRLEEIMKRTRKSEVSETKVRIPPKGSAGRGGQGVKRRLRKGILATESEAVREAAAARARGGPNSVRSGWGRLSLEPDCSSSSKQKQDSKEANANGSSPEPVKAVEARSPGLQKEAVQKEEPIPQEPQWSLPSKELPASLVNGLQPLPAHQENGFSTNGPSGDKSLSRTPETLLPFAEAEAFLKKAVVQSPQVTEVL

SEQ ID NO: 913704 - protein, 187 aa, Homo sapiens
GHLEDPHFAQAEQEEQERLQKQKEEAEARSREEAERQRLEREKHFQQQEQERQERRKRLEEIMKRTRKSEVSETKKQDSKEANANGSSPEPVKAVEARSPGLQKEAVQKEEPIPQEPQWSLPSKELPASLVNGLQPLPAHQENGFSTNGPSGDKSLSRTPETLLPFAEAEAFLKKAVVQSPQVTEVL

SEQ ID NO: 913705 - protein, 840 aa, Homo sapiens
MESGPRAELGAGAPPAVVARTPPEPRPSPEGDPSPPPPPMSALVPDTPPDTPPAMKNATSSKQLPLEPESPSGQVGPRPAPPQEESPSSEAKSRGPTPPAMGPRDARPPRRSSQPSPTAVPASDSPPTKQEVKKAGERHKLAKERREERAKYLAAKKAVWLEKEEKAKALREKQLQERRRRLEEQRLKAEQRRAALEERQRQKLEKNKERYEAAIQRSVKKTWAEIRQQRWSWAGALHHSSPGHKTSGSRCSVSAVNLPKHVDSIINKRLSKSSATLWNSPSRNRSLQLSAWESSIVDRLMTPTLSFLARSRSAVTLPRNGRDQGRGCDPGRGPTWGRAGASLARGPQPDRTHPSAAVPVCPRSASASPLTPCSVTRSVHRCAPAGERGERRKPNAGGSPAPVRRRPEASPVQKKEKKDKERENEKEKSALARERSLKKRQSLPASPRARLSASTASELSPKSKARPSSPSTSWHRPASPCPSPGPGHTLPPKPPSPRGTTASPKGRVRRKEEAKESPSAAGPEDKSQSKRRASNEKESAAPASPAPSPAPSPTPAPPQKEQPPAETPTDAAVLTSPPAPAPPVTPSKPMAGTTDREEATRLLAEKRRQAREQREREEQERRLQAERDKRMREEQLAREAEARAEREAEARRREEQEAREKAQAEQEEQERLQKQKEEAEARSREEAERQRLEREKHFQQQEQERQERRKRLEEIMKRTRKSEVSETKKQDSKEANANGSSPEPVKAVEARSPGLQKEAVQKEEPIPQEPQWSLPSKELPASLVNGLQPLPAHQENGFSTNGPSGDKSLSRTPETLLPFAEAEAFLKKAVVQSPQVTEVL

SEQ ID NO: 913706 - protein, 840 aa, Homo sapiens; identical to SEQ ID NO: 913705

SEQ ID NO: 913707 - protein, 840 aa, Homo sapiens; identical to SEQ ID NO: 913705

SEQ ID NO: 913708 - protein, 840 aa, Homo sapiens; identical to SEQ ID NO: 913705

SEQ ID NO: 913709 - protein, 155 aa, Homo sapiens
MESGPRAELGAGAPPAVVARTPPEPRPSPEGDPSPPPPPMSALVPDTPPDTPPAMKNATSSKQLPLEPESPSGQVGPRPAPPQEESPSSEAKSRGPTPPAMGPRDARPPRRSSQPSPTAVPASDSPPTKQEVKKAGERHKLAKERREERAKYLGE

SEQ ID NO: 913710 - protein, 807 aa, Homo sapiens
MESGPRAELGAGAPPAVVARTPPEPRPSPEGDPSPPPPPMSALVPDTPPDTPPAMKNATSSKQLPLEPESPSGQVGPRPAPPQEESPSSEAKSRGPTPPAMGPRDARPPRRSSQPSPTAVPASDSPPTKQEVKKAGERHKLAKERREERAKYLAAKKAVWLEKEEKAKALREKQLQERRRRLEEQRLKAEQRRAALEERQRQKLEKNKERYEAAIQRSVKKTWAEIRQQRWSWAGALHHSSPGHKTSGSRCSVSAVNLPKHVDSIINKRLSKSSATLWNSPSRNRSLQLSAWESSIVDRLMTPTLSFLARSRSAVTLPRNGRDHRAGVPALGLRQPPDAVQRHPKRAPLRPRGERGERRKPNAGGSPAPVRRRPEASPVQKKEKKDKERENEKEKSALARERSLKKRQSLPASPRARLSASTASELSPKSKARPSSPSTSWHRPASPCPSPGPGHTLPPKPPSPRGTTASPKGRVRRKEEAKESPSAAGPEDKSQSKRRASNEKESAAPASPAPSPAPSPTPAPPQKEQPPAETPTDAAVLTSPPAPAPPVTPSKPMAGTTDREEATRLLAEKRRQAREQREREEQERRLQAERDKRMREEQLAREAEARAEREAEARRREEQEAREKAQAEQEEQERLQKQKEEAEARSREEAERQRLEREKHFQQQEQERQERRKRLEEIMKRTRKSEVSETKKQDSKEANANGSSPEPVKAVEARSPGLQKEAVQKEEPIPQEPQWSLPSKELPASLVNGLQPLPAHQENGFSTNGPSGDKSLSRTPETLLPFAEAEAFLKKAVVQSPQVTEVL

SEQ ID NO: 913711 - protein, 840 aa, Homo sapiens; identical to SEQ ID NO: 913705

SEQ ID NO: 913712 - protein, 718 aa, Homo sapiens
MGSRAGHLEEMSLAQAFCRTLHTRHWAPLSTAAKKAVWLEKEEKAKALREKQLQERRRRLEEQRLKAEQRRAALEERQRQKLEKNKERYEAAIQRSVKKTWAEIRQQRWSWAGALHHSSPGHKTSGSRCSVSAVNLPKHVDSIINKRLSKSSATLWNSPSRNRSLQLSAWESSIVDRLMTPTLSFLARSRSAVTLPRNGRDQGRGCDPGRGPTWGRAGASLARGPQPDRTHPSAAVPVCPRSASASPLTPCSVTRSVHRCAPAGERGERRKPNAGGSPAPVRRRPEASPVQKKEKKDKERENEKEKSALARERSLKKRQSLPASPRARLSASTASELSPKSKARPSSPSTSWHRPASPCPSPGPGHTLPPKPPSPRGTTASPKGRVRRKEEAKESPSAAGPEDKSQSKRRASNEKESAAPASPAPSPAPSPTPAPPQKEQPPAETPTDAAVLTSPPAPAPPVTPSKPMAGTTDREEATRLLAEKRRQAREQREREEQERRLQAERDKRMREEQLAREAEARAEREAEARRREEQEAREKAQAEQEEQERLQKQKEEAEARSREEAERQRLEREKHFQQQEQERQERRKRLEEIMKRTRKSEVSETKKQDSKEANANGSSPEPVKAVEARSPGLQKEAVQKEEPIPQEPQWSLPSKELPASLVNGLQPLPAHQENGFSTNGPSGDKSLSRTPETLLPFAEAEAFLKKAVVQSPQVTEVL

SEQ ID NO: 913713 - protein, 810 aa, Homo sapiens
MESGPRAELGAGAPPAVVARTPPEPRPSPEGDPSPPPPPMSALVPDTPPDTPPAMKNATSSKQLPLEPESPSGQVGPRPAPPQEESPSSEAKSRGPTPPAMGPRDARPPRRSSQPSPTAVPASDSPPTKQEVKKAGERHKLAKERREERAKYLAAKKAVWLEKEEKAKALREKQLQERRRRLEEQRLKAEQRRAALEERQRQKLEKNKERYEAAIQRSVKKTWAEIRQQRWSWAGALHHSSPGHKTSGSRCSVSAVNLPKHVDSIINKRLSKSSATLWNSPSRNRSLQLSAWESSIVDRLMTPTLSFLARSRSAVTLPRNGRDQGRGCDPGRGPTWGRAGASLARGPQPDRTHPSAAVPVCPRSASASPLTPCSVTRSVHRCAPAGERGERRKPNAGGSPAPVRRRPEASPVQKKEKKDKERENEKEKSALARERSLKKRQSLPASPRARLSASTASELSPKSKARPSSPSTSWHRPASPCPSPGPGHTLPPKPPSPRGTTASPKGRVRRKEEAKESPSAAGPEDKSQSKRRASNEKESAAPASPAPSPAPSPTPAPPQKEQPPAETPTDAAVLTSPPAPAPPVTPSKPMAGTTDREEATRLLAEKRRQAREQREREAEARRREEQEAREKAQAEQEEQERLQKQKEEAEARSREEAERQRLEREKHFQQQEQERQERRKRLEEIMKRTRKSEVSETKKQDSKEANANGSSPEPVKAVEARSPGLQKEAVQKEEPIPQEPQWSLPSKELPASLVNGLQPLPAHQENGFSTNGPSGDKSLSRTPETLLPFAEAEAFLKKAVVQSPQVTEVL

SEQ ID NO: 913714 - protein, 919 aa, Homo sapiens
MESGPRAELGAGAPPAVVARTPPEPRPSPEGDPSPPPPPMSALVPDTPPDTPPAMKNATSSKQLPLEPESPSGQVGPRPAPPQEESPSSEAKSRGPTPPAMGPRDARPPRRSSQPSPTAVPASDSPPTKQEVKKAGERHKLAKERREERAKYLAAKKAVWLEKEEKAKALREKQLQERRRRLEEQRLKAEQRRAALEERQRQKLEKNKERYEAAIQRSVKKTWAEIRQQRWSWAGALHHSSPGHKTSGSRCSVSAVNLPKHVDSIINKRLSKSSATLWNSPSRNRSLQLSAWESSIVDRLMTPTLSFLARSRSAVTLPRNGRDQGRGCDPGRGPTWGRAGASLARGPQPDRTHPSAAVPVCPRSASASPLTPCSVTRSVHRCAPAGERGERRKPNAGGSPAPVRRRPEASPVQKKEKKDKERENEKEKSALARERSLKKRQSLPASPRARLSASTASELSPKSKARPSSPSTSWHRPASPCPSPGPGHTLPPKPPSPRGTTASPKGRVRRKEEAKESPSAAGPEDKSQSKRRASNEKESAAPASPAPSPAPSPTPAPPQKEQPPAETPTDAAVLTSPPAPAPPVTPSKPMAGTTDREEATRLLAEKRRQAREQREREEQERRLQAERDKRMREEQLAREAEARAEREAEARRREEQEAREKAQAEQEEQERLQKQKEEAEARSREEAERQRLEREKHFQQQEQERQERRKVCGPGRGFVGGAWAGRARWAGPGLRADRTGKRWGKFQFLLLERAAMSWEALRLRGRVWLVGGLGLGAGLEPNCSAASKQRLEEIMKRTRKSEVSETKKQDSKEANANGSSPEPVKAVEARSPGLQKEAVQKEEPIPQEPQWSLPSKELPASLVNGLQPLPAHQENGFSTNGPSGDKSLSRTPETLLPFAEAEAFLKKAVVQSPQVTEVL

SEQ ID NO: 913715 - protein, 840 aa, Homo sapiens; identical to SEQ ID NO: 913705

SEQ ID NO: 913716 - protein, 840 aa, Homo sapiens; identical to SEQ ID NO: 913705

SEQ ID NO: 913717 - protein, 124 aa, Homo sapiens
TLLSKETGLLRAQPAVSAPGGHQRVEQGHRTHSGRGLQEALLHDTADAGLGQQYLLHGARAPAGPLVRVQGPAGHRSPLRGFALDPGTVVRAPLHHLPGCLEEKKTEQRWKWPGPLGVGPLCCF

SEQ ID NO: 913718 - protein, 676 aa, Homo sapiens
MESGPRAELGAGAPPAVVARTPPEPRPSPEGDPSPPPPPMSALVPDTPPDTPPAMKNATSSKQLPLEPESPSGQVGPRPAPPQEESPSSEAKSRGPTPPAMGPRDARPPRRSSQPSPTAVPASDSPPTKQEVKKAGERHKLAKERREERAKYLAAKKAVWLEKEEKAKALREKQLQERRRRLEEQRLKAEQRRAALEERQRQKLEKNKERYEAAIQRSVKKTWAEIRQQRWSWAGALHHSSPGHKTSGSRCSVSAVNLPKHVDSIINKRLSKSSATLWNSPSRNRSLQLSAWESSIVDRLMTPTLSFLARSRSAVTLPRNGRDQGRGCDPGRGPTWGRAGASLARGPQPDRTHPSAAVPVCPRSASASPLTPCSVTRSVHRCAPAGERGERRKPNAGGSPAPVRRRPEASPVQKKEKKDKERENEKEKSALARERSLKKRQSLPASPRARLSASTASELSPKSKARPSSPSTSWHRPASPCPSPGPGHTLPPKPPSPRGTTASPKGRVRRKEEAKESPSAAGPEDKSQSKRRASNEKESAAPASPAPSPAPSPTPAPPQKEQPPAETPTDAAVLTSPPAPAPPVTPSKPMAGTTDREEATRLLAEKRRQAREQREREEQERRLQAERDKRMREEQLAREAEARAEREAEARRREEQEAREKAQAEQEEQERLQKQA

SEQ ID NO: 913719 - protein, 505 aa, Homo sapiens
MSSVQQQPPPPRRVTNVGSLLLTPQENESLFTFLGKKCVTMSSAVVQLYAADRNCMWSKKCSGVACLVKDNPQRSYFLRIFDIKDGKLLWEQELYNNFVYNSPRGYFHTFAGDTCQVALNFANEEEAKKFRKAVTDLLGRRQRKSEKRRDPPNGPNLPMATVDIKNPEITTNRFYGPQVNNISHTKEKKKGKAKKKRLTKADIGTPSNFQHIGHVGWDPNTGFDLNNLDPELKNLFDMCGISEAQLKDRETSKVIYDFIEKTGGVEAVKNELRRQAPPPPPPSRGGPPPPPPPPHSSGPPPPPARGRGAPPPPPSRAPTAAPPPPPPSRPSVEVPPPPPNRMYPPPPPALPSSAPSGPPPPPPSVLGVGPVAPPPPPPPPPPPGPPPPPGLPSDGDHQVPTTAGNKAALLDQIREGAQLKKVEQNSRPVSCSGRDALLDQIRQGIQLKSVADGQESTPPTPAPTSGIVGALMEVMQKRSKAIHSSDEDEDEDDEEDFEDDDEWED

SEQ ID NO: 913720 - protein, 505 aa, Homo sapiens; identical to SEQ ID NO: 913719

SEQ ID NO: 913721 - protein, 458 aa, Homo sapiens
MSSVQQQPPPPRRVTNVGSLLLTPQENESLFTFLGKKCVTMSSAVVQLYAADRNCMWSKKCSGVACLVKDNPQRSYFLRIFDIKDGKLLWEQELYNNFVYNSPRGYFHTFAGDTCQVALNFANEEEAKKFRKAVTDLLGRRQRKSEKRRDPPNGPNLPMATVDIKNPEITTNRFYGPQVNNISHTKEKKKGKAKKKRLTKADIGTPSNFQHIGHVGWDPNTGFDLNNLDPELKNLFDMCGISEAQLKDRETSKVIYDFIEKTGGVEAVKNELRRQAPPPPPPSRGGPPPPPPPPHSSGPPPPPARGRGAPPPPPSRAPTAAPPPPPPSRPSVEVPPPPPNRMYPPPPPALPSSAPSGPPPPPPSVLGVGPVAPPPPPPPPPPPGPPPPPGLPSDGDHQVPTTAGNKAALLDQIREGAQLKKVEQNSRPVSCSGRDALLDQIRQGIQLKSVSKLFFFSF

SEQ ID NO: 913722 - protein, 505 aa, Homo sapiens; identical to SEQ ID NO: 913719

SEQ ID NO: 913723 - protein, 505 aa, Homo sapiens; identical to SEQ ID NO: 913719

SEQ ID NO: 913724 - protein, 347 aa, Homo sapiens
MATVDIKNPEITTNRFYGPQVNNISHTKEKKKGKAKKKRLTKADIGTPSNFQHIGHVGWDPNTGFDLNNLDPELKNLFDMCGISEAQLKDRETSKVIYDFIEKTGGVEAVKNELRRQAPPPPPPSRGGPPPPPPPPHSSGPPPPPARGRGAPPPPPSRAPTAAPPPPPPSRPSVEVPPPPPNRMYPPPPPALPSSAPSGPPPPPPSVLGVGPVAPPPPPPPPPPPGPPPPPGLPSDGDHQVPTTAGNKAALLDQIREGAQLKKVEQNSRPVSCSGRDALLDQIRQGIQLKSVADGQESTPPTPAPTSGIVGALMEVMQKRSKAIHSSDEDEDEDDEEDFEDDDEWED

SEQ ID NO: 913725 - protein, 454 aa, Homo sapiens
MWPLTVPPPLLLLLCSGLAGQTLFQNPEEGWQLYTSAQAPDGKCICTAVIPAQSTCSRDGRSRELRQLMEKVQNVSQSMEVLELRTYRDLQYVRGMETLMRSLDARLRAADGSLSAKSFQELKDRMTELLPLSSVLEQYKADTRTIVRLREEVRNLSGSLAAIQEEMGAYGYEDLQQRVMALEARLHACAQKLGCGKLTGVSNPITVRAMGSRFGSWMTDTMAPSADSRVWYMDGYYKGRRVLEFRTLGDFIKGQNFIQHLLPQPWAGTGHVVYNGSLFYNKYQSNVVVKYHFRSRSVLVQRSLPGAGYNNTFPYSWGGFSDMDFMVDESGLWAVYTTNQNAGNIVVSRLDPHTLEVMRSWDTGYPKRSAGEAFMICGVLYVTNSHLAGAKVYFAYFTNTSSYEYTDVPFHNQYSHISMLDYNPRERALYTWNNGHQVLYNVTLFHVISTSGDP

SEQ ID NO: 913726 - protein, 478 aa, Homo sapiens
MSVPLLKIGAVLSTMAMVTNWMSQTLPSLVGLNGTVSRAGASEKITLFQNPEEGWQLYTSAQAPDGKCICTAVIPAQSTCSRDGRSRELRQLMEKVQNVSQSMEVLELRTYRDLQYVRGMETLMRSLDARLRAADGSLSAKSFQELKDRMTELLPLSSVLEQYKADTRTIVRLREEVRNLSGSLAAIQEEMGAYGYEDLQQRVMALEARLHACAQKLGCGKLTGVSNPITVRAMGSRFGSWMTDTMAPSADSRVWYMDGYYKGRRVLEFRTLGDFIKGQNFIQHLLPQPWAGTGHVVYNGSLFYNKYQSNVVVKYHFRSRSVLVQRSLPGAGYNNTFPYSWGGFSDMDFMVDESGLWAVYTTNQNAGNIVVSRLDPHTLEVMRSWDTGYPKRSAGEAFMICGVLYVTNSHLAGAKVYFAYFTNTSSYEYTDVPFHNQYSHISMLDYNPRERALYTWNNGHQVLYNVTLFHVISTSGDP

SEQ ID NO: 913727 - protein, 399 aa, Homo sapiens
IRHNSRTSMDWETFWTVQNVSQSMEVLELRTYRDLQYVRGMETLMRSLDARLRAADGSLSAKSFQELKDRMTELLPLSSVLEQYKADTRTIVRLREEVRNLSGSLAAIQEEMGAYGYEDLQQRVMALEARLHACAQKLGCGKLTGVSNPITVRAMGSRFGSWMTDTMAPSADSRVWYMDGYYKGRRVLEFRTLGDFIKGQNFIQHLLPQPWAGTGHVVYNGSLFYNKYQSNVVVKYHFRSRSVLVQRSLPGAGYNNTFPYSWGGFSDMDFMVDESGLWAVYTTNQNAGNIVVSRLDPHTLEVMRSWDTGYPKRSAGEAFMICGVLYVTNSHLAGAKVYFAYFTNTSSYEYTDVPFHNQYSHISMLDYNPRERALYTWNNGHQVLYNVTLFHVISTSGDP

SEQ ID NO: 913728 - protein, 84 aa, Homo sapiens
LPLPPPIYSFSKEISSSYSPHSPVPSLTNTSSYEYTDVPFHNQYSHISMLDYNPRERALYTWNNGHQVLYNVTLFHVISTSGDP

SEQ ID NO: 913729 - protein, 454 aa, Homo sapiens; identical to SEQ ID NO: 913725

SEQ ID NO: 913730 - protein, 376 aa, Homo sapiens
MEVLELRTYRDLQYVRGMETLMRSLDARLRAADGSLSAKSFQELKDRMTELLPLSSVLEQYKADTRTIVRLREEVRNLSGSLAAIQEEMGAYGYEDLQQRVMALEARLHACAQKLGCGKLTGVSNPITVRAMGSRFGSWMTDTMAPSADSRVWYMDGYYKGRRVLEFRTLGDFIKGQNFIQHLLPQPWAGTGHVVYNGSLFYNKYQSNVVVKYHFRSRSVLVQRSLPGAGYNNTFPYSWGGFSDMDFMVDESGLWAVYTTNQNAGNIVVSRLDPHTLEVMRSWDTGYPKRSAGEAFMICGVLYVTNSHLAGAKVYFAYFTNTSSYEYTDVPFHNQYSHISMLDYNPRERALYTWNNGHQVLYNVTLFHVISTSGDP

SEQ ID NO: 913731 - protein, 245 aa, Homo sapiens
MGSRFGSWMTDTMAPSADSRVWYMDGYYKGRRVLEFRTLGDFIKGQNFIQHLLPQPWAGTGHVVYNGSLFYNKYQSNVVVKYHFRSRSVLVQRSLPGAGYNNTFPYSWGGFSDMDFMVDESGLWAVYTTNQNAGNIVVSRLDPHTLEVMRSWDTGYPKRSAGEAFMICGVLYVTNSHLAGAKVYFAYFTNTSSYEYTDVPFHNQYSHISMLDYNPRERALYTWNNGHQVLYNVTLFHVISTSGDP

SEQ ID NO: 913732 - protein, 98 aa, Homo sapiens
PRPQQPQQEEVTSPVVPPSVKTPARELLFHPALFEVPSLKLLAAHCIVGHQHMIPENALEEITKNMDTSAVLAEIPAGPGREPVQTLPSLCGKEAHGH

SEQ ID NO: 913733 - protein, 581 aa, Homo sapiens
GPQFGCAAERSCEGVAVIRGPGTRAGAEAQAAGRGVGSAGLSVPSSMSEGESQTVLSSGSDPKVESSSSAPGLTSVSPPVTSTTSAASPEEEEESEDESEILEESPCGRWQKRREEVNQRNVPGIDSAYLAMDTEEGVEVVWNEVQFSERKNYKLQEEKVRAVFDNLIQLEHLNIVKFHKYWADIKENKARVIFITEYMSSGSLKQFLKKTKKNHKTMNEKAWKRWCTQILSALSYLHSCDPPIIHGNLTCDTIFIQHNGLIKIGSVAPDTINNHVKTCREEQKNLHFFAPEYGEVTNVTTAVDIYSFGMCALEMAVLEIQGNGESSYVPQEAISSAIQLLEDPLQREFIQKCLQSEPARRPTARELLFHPALFEVPSLKLLAAHCIVGHQHMIPENALEEITKNMDTSAVLAEIPAGPGREPVQTLYSQSPALELDKFLEDVRNGIYPLTAFGLPRPQQPQQEEVTSPVVPPSVKTPTPEPAEVETRKVVLMQCNIESVEEGVKHHLTLLLKLEDKLNRHLSCDLMPNENIPELAAELVQLGFISEADQSRLTSLLEETLNKFNFARNSTLNSAAVTVSS

SEQ ID NO: 913734 - protein, 581 aa, Homo sapiens; identical to SEQ ID NO: 913733

SEQ ID NO: 913735 - protein, 581 aa, Homo sapiens; identical to SEQ ID NO: 913733

SEQ ID NO: 913736 - protein, 581 aa, Homo sapiens; identical to SEQ ID NO: 913733

SEQ ID NO: 913737 - protein, 581 aa, Homo sapiens; identical to SEQ ID NO: 913733

SEQ ID NO: 913738 - protein, 508 aa, Homo sapiens
MSEGESQTVLSSGSDPKEEEESEDESEILEESPCGRWQKRREEVNQRNVPGIDSAYLAMDTEEGVEVVWNEVQFSERKNYKLQEEKVRAVFDNLIQLEHLNIVKFHKYWADIKENKARVIFITEYMSSGSLKQFLKKTKKNHKTMNEKAWKRWCTQILSALSYLHSCDPPIIHGNLTCDTIFIQHNGLIKIGSVAPDTINNHVKTCREEQKNLHFFAPEYGEVTNVTTAVDIYSFGMCALEMAVLEIQGNGESSYVPQEAISSAIQLLEDPLQREFIQKCLQSEPARRPTARELLFHPALFEVPSLKLLAAHCIVGHQHMIPENALEEITKNMDTSAVLAEIPAGPGREPVQTLYSQSPALELDKFLEDVRNGIYPLTAFGLPRPQQPQQEEVTSPVVPPSVKTPTPEPAEVETRKVVLMQCNIESVEEGVKHHLTLLLKLEDKLNRHLSCDLMPNENIPELAAELVQLGFISEADQSRLTSLLEETLNKFNFARNSTLNSAAVTVSS

SEQ ID NO: 913739 - protein, 576 aa, Homo sapiens
GPQFGCAAERSCEGVAVIRGPGTRAGAEAQAAGRGVGSAGLSVPSSMSEGESQTVLSSGSDPKVESSSSAPGLTSVSPPVTSTTSAASPEEEEESEDESEILEESPCGRWQKRREEVNQRNVPGIDSAYLAMDTEEGVEVVWNEVQFSERKNYKLQEEKVRAVFDNLIQLEHLNIVKFHKYWADIKENKARVIFITEYMSSGSLKQFLKKTKKNHKTMNEKAWKRWCTQILSALSYLHSCDPPIIHGNLTCDTIFIQHNGLIKIGSVAPDTINNHVKTCREEQKNLHFFAPEYGEVTNVTTAVDIYSFGMCALEMAVLEIQGNGESSYVPQEAISSAIQLLEDPLQREFIQKCLQSEPARRPTARELLFHPALFEVPSLKLLAAHCIVGHQHMIPENALEEITKNMDTSAVLAEIPAGPGREPVQTLYSQSPALELDKFLEDVRNGIYPLTAFGLPRPQQPQQEEVTSPVVPPSVKTPTPEPAEVETRKVVLMQCNIESVEEGVKHHLTLLLKLEDKLNRHLSCDLMPNENIPELAAELVQLGFISEVRFLPSSALAAPMPSLLSAPILLSSSPPG

SEQ ID NO: 913740 - protein, 272 aa, Homo sapiens
MCALEMAVLEIQGNGESSYVPQEAISSAIQLLEDPLQREFIQKCLQSEPARRPTARELLFHPALFEVPSLKLLAAHCIVGHQHMIPENALEEITKNMDTSAVLAEIPAGPGREPVQTLYSQSPALELDKFLEDVRNGIYPLTAFGLPRPQQPQQEEVTSPVVPPSVKTPTPEPAEVETRKVVLMQCNIESVEEGVKHHLTLLLKLEDKLNRHLSCDLMPNENIPELAAELVQLGFISEADQSRLTSLLEETLNKFNFARNSTLNSAAVTVSS

SEQ ID NO: 913741 - protein, 481 aa, Homo sapiens
GPQFGCAAERSCEGVAVIRGPGTRAGAEAQAAGRGVGSAGLSVPSSMSEGESQTVLSSGSDPKVESSSSAPGLTSVSPPVTSTTSAASPEEEEESEDESEILEESPCGRWQKRREEVNQRNVPGIDSAYLAMDTEEGVEVVWNEVQFSERKNYKLQEHNGLIKIGSVAPDTINNHVKTCREEQKNLHFFAPEYGEVTNVTTAVDIYSFGMCALEMAVLEIQGNGESSYVPQEAISSAIQLLEDPLQREFIQKCLQSEPARRPTARELLFHPALFEVPSLKLLAAHCIVGHQHMIPENALEEITKNMDTSAVLAEIPAGPGREPVQTLYSQSPALELDKFLEDVRNGIYPLTAFGLPRPQQPQQEEVTSPVVPPSVKTPTPEPAEVETRKVVLMQCNIESVEEGVKHHLTLLLKLEDKLNRHLSCDLMPNENIPELAAELVQLGFISEADQSRLTSLLEETLNKFNFARNSTLNSAAVTVSS

SEQ ID NO: 913742 - protein, 326 aa, Homo sapiens
MVRLWVSPLLPVAPDTINNHVKTCREEQKNLHFFAPEYGEVTNVTTAVDIYSFGMCALEMAVLEIQGNGESSYVPQEAISSAIQLLEDPLQREFIQKCLQSEPARRPTARELLFHPALFEVPSLKLLAAHCIVGHQHMIPENALEEITKNMDTSAVLAEIPAGPGREPVQTLYSQSPALELDKFLEDVRNGIYPLTAFGLPRPQQPQQEEVTSPVVPPSVKTPTPEPAEVETRKVVLMQCNIESVEEGVKHHLTLLLKLEDKLNRHLSCDLMPNENIPELAAELVQLGFISEADQSRLTSLLEETLNKFNFARNSTLNSAAVTVSS

SEQ ID NO: 913743 - protein, 189 aa, Homo sapiens
MIPENALEEITKNMDTSAVLAEIPAGPGREPVQTLYSQSPALELDKFLEDVRNGIYPLTAFGLPRPQQPQQEEVTSPVVPPSVKTPTPEPAEVETRKVVLMQCNIESVEEGVKHHLTLLLKLEDKLNRHLSCDLMPNENIPELAAELVQLGFISEADQSRLTSLLEETLNKFNFARNSTLNSAAVTVSS

SEQ ID NO: 913744 - protein, 197 aa, Homo sapiens
PTPSCPPDMIPENALEEITKNMDTSAVLAEIPAGPGREPVQTLYSQSPALELDKFLEDVRNGIYPLTAFGLPRPQQPQQEEVTSPVVPPSVKTPTPEPAEVETRKVVLMQCNIESVEEGVKHHLTLLLKLEDKLNRHLSCDLMPNENIPELAAELVQLGFISEADQSRLTSLLEETLNKFNFARNSTLNSAAVTVSS

SEQ ID NO: 913745 - protein, 331 aa, Homo sapiens
GPQFGCAAERSCEGVAVIRGPGTRAGAEAQAAGRGVGSAGLSVPSSMSEGESQTVLSSGSDPKVESSSSAPGLTSVSPPVTSTTSAASPEEEEESEDESEILEESPCGRWQKRREEVNQRNVPGIDSAYLAMDTEEGVEVVWNEVQFSERKNYKLQEEKVRAVFDNLIQLEHLNIVKFHKYWADIKENKARVIFITEYMSSGSLKQFLKKTKKNHKTMNEKAWKRWCTQILSALSYLHSCDPPIIHGNLTCDTIFIQHNGLIKIGSVAPDTINNHVKTCREEQKNLHFFAPEYGEVTNVTTAVDIYSFGMCALEMAVLMSSCAHMRKSSRL

SEQ ID NO: 913746 - protein, 89 aa, Homo sapiens
ISSVPHRSQEGVNTHLTLLLKLEDKLNRHLSCDLMPNENIPELAAELVQLGFISEADQSRLTSLLEETLNKFNFARNSTLNSAAVTVSS

SEQ ID NO: 913747 - protein, 85 aa, Homo sapiens
FVIQRSPAGLFLTLLLKLEDKLNRHLSCDLMPNENIPELAAELVQLGFISEADQSRLTSLLEETLNKFNFARNSTLNSAAVTVSS

SEQ ID NO: 913748 - protein, 201 aa, Homo sapiens
GPQFGCAAERSCEGVAVIRGPGTRAGAEAQAAGRGVGSAGLSVPSSMSEGESQTVLSSGSDPKVESSSSAPGLTSVSPPVTSTTSAASPEEEEESEDESEILEESPCGRWQKRREEVNQRNVPGIDSAYLAMDTEEGVEVVWNEVQFSERKNYKLQEEKVRAVFDNLIQLEHLNIVKFHKYWADISVNSCPLHNLSCFPKG

SEQ ID NO: 913749 - protein, 99 aa, Homo sapiens
SVQRIPSIICASGHLSFGMCALEMAVLEIQGNGESSYVPQEAISSAIQLLEDPLQRVRIFRITPSSTDLQMSSGFSSFVPTGYMLLRAREHNRKDTKNL

SEQ ID NO: 913750 - protein, 535 aa, Homo sapiens
MSEGESQTVLSSGSDPKVESSSSAPGLTSVSPPVTSTTSAASPEEEEESEDESEILEESPCGRWQKRREEVNQRNVPGIDSAYLAMDTEEGVEVVWNEVQFSERKNYKLQEEKVRAVFDNLIQLEHLNIVKFHKYWADIKENKARVIFITEYMSSGSLKQFLKKTKKNHKTMNEKAWKRWCTQILSALSYLHSCDPPIIHGNLTCDTIFIQHNGLIKIGSVAPDTINNHVKTCREEQKNLHFFAPEYGEVTNVTTAVDIYSFGMCALEMAVLEIQGNGESSYVPQEAISSAIQLLEDPLQREFIQKCLQSEPARRPTARELLFHPALFEVPSLKLLAAHCIVGHQHMIPENALEEITKNMDTSAVLAEIPAGPGREPVQTLYSQSPALELDKFLEDVRNGIYPLTAFGLPRPQQPQQEEVTSPVVPPSVKTPTPEPAEVETRKVVLMQCNIESVEEGVKHHLTLLLKLEDKLNRHLSCDLMPNENIPELAAELVQLGFISEADQSRLTSLLEETLNKFNFARNSTLNSAAVTVSS

SEQ ID NO: 913751 - protein, 576 aa, Homo sapiens; identical to SEQ ID NO: 913739

SEQ ID NO: 913752 - protein, 581 aa, Homo sapiens; identical to SEQ ID NO: 913733

SEQ ID NO: 913753 - protein, 484 aa, Homo sapiens
GPQFGCAAERSCEGVAVIRGPGTRAGAEAQAAGRGVGSAGLSVPSSMSEGESQTVLSSGSDPKVESSSSAPGLTSVSPPVTSTTSAASPEEEEESEDESEILEESPCGRWQKRREEVNQRNVPGIDSAYLAMDTEEGVEVVWNEVQFSERKNYKLQEEKVRAVFDNLIQLEHLNIVKFHKYWADIKENKARVIFITEYMSSGSLKQFLKKTKKNHKTMNEKAWKRWCTQILSALSYLHSCDPPIIHGNLTCDTIFIQHNGLIKIGSVAPDTINNHVKTCREEQKNLHFFAPEYGDMIPENALEEITKNMDTSAVLAEIPAGPGREPVQTLYSQSPALELDKFLEDVRNGIYPLTAFGLPRPQQPQQEEVTSPVVPPSVKTPTPEPAEVETRKVVLMQCNIESVEEGVKHHLTLLLKLEDKLNRHLSCDLMPNENIPELAAELVQLGFISEADQSRLTSLLEETLNKFNFARNSTLNSAAVTVSS

SEQ ID NO: 913754 - protein, 591 aa, Homo sapiens
GPQFGCAAERSCEGVAVIRGPGTRAGAEAQAAGRGVGSAGLSVPSSMSEGESQTVLSSGSDPKVESSSSAPGLTSVSPPVTSTTSAASPEEEEESEDESEILEESPCGRWQKRREEVNQRNVPGIDSAYLAMDTEEGVEVVWNEVQFSERKNYKLQEEKVRAVFDNLIQLEHLNIVKFHKYWADIKENKARVIFITEYMSSGSLKQFLKKTKKNHKTMNEKAWKRWCTQILSALSGPSNSPVPPSYLHSCDPPIIHGNLTCDTIFIQHNGLIKIGSVAPDTINNHVKTCREEQKNLHFFAPEYGEVTNVTTAVDIYSFGMCALEMAVLEIQGNGESSYVPQEAISSAIQLLEDPLQREFIQKCLQSEPARRPTARELLFHPALFEVPSLKLLAAHCIVGHQHMIPENALEEITKNMDTSAVLAEIPAGPGREPVQTLYSQSPALELDKFLEDVRNGIYPLTAFGLPRPQQPQQEEVTSPVVPPSVKTPTPEPAEVETRKVVLMQCNIESVEEGVKHHLTLLLKLEDKLNRHLSCDLMPNENIPELAAELVQLGFISEADQSRLTSLLEETLNKFNFARNSTLNSAAVTVSS

SEQ ID NO: 913755 - protein, 397 aa, Homo sapiens
IKENKAKVIFITEYMSSGSLKQFLKKTKKNHKTMNEKAWKRWCTQILSALSYLHSCDPPIIHGNLTCDTIFIQHNGLIKIGSVAPDTINNHVKTCREEQKNLHFFAPEYGEVTNVTTAVDIYSFGMCALEMAVLEIQGNGESSYVPQEAISSAIQLLEDPLQREFIQKCLQSEPARRPTARELLFHPALFEVPSLKLLAAHCIVGHQHMIPENALEEITKNMDTSAVLAEIPAGPGREPVQTLYSQSPALELDKFLEDVRNGIYPLTAFGLPRPQQPQQEEVTSPVVPPSVKTPTPEPAEVETRKVVLMQCNIESVEEGVKHHLTLLLKLEDKLNRHLSCDLMPNENIPELAAELVQLGFISEADQSRLTSLLEETLNKFNFARNSTLNSAAVTVSS

SEQ ID NO: 913756 - protein, 421 aa, Homo sapiens
EIHAFSGIPRNDQQLVSALRYPYFQVGHPLASYNLGPGTTWDVLVPGFLVRRRTTETMNEKAWKRWCTQILSALSYLHSCDPPIIHGNLTCDTIFIQHNGLIKIGSVAPDTINNHVKTCREEQKNLHFFAPEYGEVTNVTTAVDIYSFGMCALEMAVLEIQGNGESSYVPQEAISSAIQLLEDPLQREFIQKCLQSEPARRPTARELLFHPALFEVPSLKLLAAHCIVGHQHMIPENALEEITKNMDTSAVLAEIPAGPGREPVQTLYSQSPALELDKFLEDVRNGIYPLTAFGLPRPQQPQQEEVTSPVVPPSVKTPTPEPAEVETRKVVLMQCNIESVEEGVKHHLTLLLKLEDKLNRHLSCDLMPNENIPELAAELVQLGFISEADQSRLTSLLEETLNKFNFARNSTLNSAAVTVSS

SEQ ID NO: 913757 - protein, 225 aa, Homo sapiens
PVIIRRSARELLFHPALFEVPSLKLLAAHCIVGHQHMIPENALEEITKNMDTSAVLAEIPAGPGREPVQTLYSQSPALELDKFLEDVRNGIYPLTAFGLPRPQQPQQEEVTSPVVPPSVKTPTPEPAEVETRKVVLMQCNIESVEEGVKHHLTLLLKLEDKLNRHLSCDLMPNENIPELAAELVQLGFISEADQSRLTSLLEETLNKFNFARNSTLNSAAVTVSS

SEQ ID NO: 913758 - protein, 176 aa, Homo sapiens [sequence omitted]

SEQ ID NO: 913759 - protein, 259 aa, Homo sapiens
YYKDPSHEGSSIPLSRYELLTRKAQRLPMEALQVTCLDSAVGVIGPSHSPCRLMYHEDVSELCRKPQCSLPRIEQQGIGSLRLVLVARKSMTRVHVTHKTNSRLMYSQSPALELDKFLEDVRNGIYPLTAFGLPRPQQPQQEEVTSPVVPPSVKTPTPEPAEVETRKVVLMQCNIESVEEGVKHHLTLLLKLEDKLNRHLSCDLMPNENIPELAAELVQLGFISEADQSRLTSLLEETLNKFNFARNSTLNSAAVTVSS

SEQ ID NO: 913760 - protein, 287 aa, Homo sapiens
GPQFGCAAERSCEGVAVIRGPGTRAGAEAQAAGRGVGSAGLSVPSSMSEGESQTVLSSGSDPKVESSSSAPGLTSVSPPVTSTTSAASPEEEEESEDESEILEESPCGRWQKRREEVNQRNVPGIDSAYLAMDTEEGVEVVWNEVQFSERKNYKLQEEKVRAVFDNLIQLEHLNIVKFHKYWADIKENKARVIFITEYMSSGSLKQFLKKTKKNHKTMNEKAWRWVHTNPLCPYSYLHSLWTPPSIQWGNLDPVDNQSSIQATNGTHQRIGVLLGSLNQFKQINGVR

SEQ ID NO: 913761 - protein, 135 aa, Homo sapiens
TPPSASRLDASTLGSAAAAAAAGRCGRPAPAPAAARQSVSQSVSQSVSQSVTERAARELLAVAASLARERRAWGGGGGSGWRSASGGFLARGRGKADRLPRWSSYQMKKLIMVLKKTVTRKIRTWTKCLEPGLEN

SEQ ID NO: 913762 - protein, 556 aa, Homo sapiens
MEQLSDEEIDHGAEEDSDKEDQDLDKMFGAWLGELDKLTQSLDSDKPMEPVKRSPLRQETNMANFSYRFSIYNLNEALNQGETVDLDALMADLCSIEQELSSIGSGNSKRQITETKATQKLPVSRHTLKHGTLKGLSSSSNRIAKPSHASYSLDDVTAQLEQASLSMDEAAQQSVLEDTKPLVTNQHRRTASAGTVSDAEVHSISNSSHSSITSAASSMDSLDIDKVTRPQELDLTHQGQPITEEEQAAKLKAEKIRVALEKIKEAQVKKLVIRVHMSDDSSKTMMVDERQTVRQVLDNLMDKSHCGYSLDWSLVETVSELQMERIFEDHENLVENLLNWTRDSQNKLIFMERIEKYALFKNPQNYLLGKKETAEMADRNKEVLLEECFCGSSVTVPEIEGVLWLKDDGKKSWKKRYFLLRASGIYYVPKGKAKVSRDLVCFLQLDHVNVYYGQDYRNKYKAPTDYCLVLKHPQIQKKSQYIKYLCCDDVRTLHQWVNGIRIAKYGKQLYMNYQEALKRTESAYDWTSLSSSSIKSGSSSSSIPGSSKCFKALFCD

SEQ ID NO: 913763 - protein, 649 aa, Homo sapiens
MEQLSDEEIDHGAEEDSDKEDQDLDKMFGAWLGELDKLTQSLDSDKPMEPVKRSPLRQETNMANFSYRFSIYNLNEALNQGETVDLDALMADLCSIEQELSSIGSGNSKRQITETKATQKLPVSRHTLKHGTLKGLSSSSNRIAKPSHASYSLDDVTAQLEQASLSMDEAAQQSVLEDTKPLVTNQHRRTASAGTVSDAEVHSISNSSHSSITSAASSMDSLDIDKVTRPQELDLTHQGQPITEHAISLRCSSKQAKRHIDFTEEQAELTPHSYLDRETSLLLRNIAGKPSHLLTKEEQAAKLKAEKIRVALEKIKEAQVKKLVIRVHMSDDSSKTMMVDERQTVRQVLDNLMDKSHCGYSLDWSLVETVSELQMERIFEDHENLVENLLNWTRDSQNKLIFMERIEKYALFKNPQNYLLGKKETAEMADRNKEVLLEECFCGSSVTVPEIEGVLWLKDDGKKSWKKRYFLLRASGIYYVPKGKAKVSRDLVCFLQLDHVNVYYGQDYRNKYKAPTDYCLVLKHPQIQKKSQYIKYLCCDDVRTLHQWVNGIRIAKYGKQLYMNYQEALKRTESAYDWTSLSSSSIKSGSSSSSIPESQSNHSNQSDSGVSDTQPAGHVRSQSIVSSVFSEAWKRGTQLEESSKVTASF

SEQ ID NO: 913764 - protein, 592 aa, Homo sapiens
MEQLSDEEIDHGAEEDSDKEDQDLDKMFGAWLGELDKLTQSLDSDKPMEPVKRSPLRQETNMANFSYRFSIYNLNEALNQGETVDLDALMADLCSIEQELSSIGSGNSKRQITETKATQKLPVSRHTLKHGTLKGLSSSSNRIAKPSHASYSLDDVTAQLEQASLSMDEAAQQSVLEDTKPLVTNQHRRTASAGTVSDAEVHSISNSSHSSITSAASSMDSLDIDKVTRPQELDLTHQGQPITEEEQAAKLKAEKIRVALEKIKEAQVKKLVIRVHMSDDSSKTMMVDERQTVRQVLDNLMDKSHCGYSLDWSLVETVSELQMERIFEDHENLVENLLNWTRDSQNKLIFMERIEKYALFKNPQNYLLGKKETAEMADRNKEVLLEECFCGSSVTVPEIEGVLWLKDDGKKSWKKRYFLLRASGIYYVPKGKAKVSRDLVCFLQLDHVNVYYGQDYRNKYKAPTDYCLVLKHPQIQKKSQYIKYLCCDDVRTLHQWVNGIRIAKYGKQLYMNYQEALKRTESAYDWTSLSSSSIKSGSSSSSIPESQSNHSNQSDSGVSDTQPAGHVRSQSIVSSVFSEAWKRGTQLEESSK

SEQ ID NO: 913765 - protein, 375 aa, Homo sapiens
MSSHKGSVVAQGNGAPASNREADTVELAELGPLLEEKGKRVIANPPKAEEEQTCPVPQEEEEEVRVLTLPLQAHHAMEKMEEFVYKVWEGRWRVIPYDVLPDWLKDNDYLLHGHRPPMPSFRACFKSIFRIHTETGNIWTHLLGFVLFLFLGILTMLRPNMYFMAPLQEKVVFGMFFLGAVLCLSFSWLFHTVYCHSEKVSRTFSKLDYSGIALLIMGSFVPWLYYSFYCSPQPRLIYLSIVCVLGISAIIVAQWDRFATPKHRQTRAGVFLGLGLSGVVPTMHFTIAEGFVKATTVGQMGWFFLMAVMYITGAGLYAARIPERFFPGKFDIWFQSHQIFHVLVVAAAFVHFYGVSNLQEFRYGLEGGCTDDTLL

SEQ ID NO: 913766 - protein, 375 aa, Homo sapiens; identical to SEQ ID NO: 913765

SEQ ID NO: 913767 - protein, 375 aa, Homo sapiens; identical to SEQ ID NO: 913765

SEQ ID NO: 913768 - protein, 375 aa, Homo sapiens; identical to SEQ ID NO: 913765

SEQ ID NO: 913769 - protein, 375 aa, Homo sapiens; identical to SEQ ID NO: 913765

SEQ ID NO: 913770 - protein, 120 aa, Homo sapiens
PSTVPEIPRQTRAGVFLGLGLSGVVPTMHFTIAEGFVKATTVGQMGWFFLMAVMYITGAGLYAARIPERFFPGKFDIWFQSHQIFHVLVVAAAFVHFYGVSNLQEFRYGLEGGCTDDTLL

SEQ ID NO: 913771 - protein, 112 aa, Homo sapiens
HHCGAVHETRAGVFLGLGRATCYIAEGFVKATTVGQMGWFFLMAVMYITGAGLYAARIPERFFPGKFDIWFQSHQIFHVLVVAAAFVHFYGVSNLQEFRYGLEGGCTDDTLL

SEQ ID NO: 913772 - protein, 206 aa, Homo sapiens [sequence omitted]

SEQ ID NO: 913773 - protein, 375 aa, Homo sapiens; identical to SEQ ID NO: 913765

SEQ ID NO: 913774 - protein, 375 aa, Homo sapiens; identical to SEQ ID NO: 913765

SEQ ID NO: 913775 - protein, 375 aa, Homo sapiens; identical to SEQ ID NO: 913765

SEQ ID NO: 913776 - protein, 130 aa, Homo sapiens
MSSHKGSVVAQGNGAPASNREADTVELAELGPLLEEKGKRVIANPPKAEEEQTCPVPQEEEEEVRVLTLPLQAHHAMEKMEEFVYKGELCPLALLFLLLLPTATAHLPLHRLCPGHFCHHCGAVGPVCHS

SEQ ID NO: 913777 - protein, 133 aa, Homo sapiens
RLVPGVWISSTTRSGFATPKHRQTRAGVFLGLGLSGVVPTMHFTIAEGFVKATTVGQMGWFFLMAVMYITGAGLYAARIPERFFPGKFDIWFQSHQIFHVLVVAAAFVHFYGVSNLQEFRYGLEGGCTDDTLL

SEQ ID NO: 913778 - protein, 328 aa, Homo sapiens
MSSHKGSVVAQGNGAPASNREADTVELAELGPLLEEKGKRVIANPPKAEEEQTCPVPQEEEEEVRVLTLPLQAHHAMEKMEEFVYKVWEGRWRVIPYDVLPDWLKDNDYLLHGHRPPMPSFRACFKSIFRIHTETGNIWTHLLGFVLFLFLGILTMLRPNMYFMAPLQEKVVFGMFFLGAVLCLSFSWLFHTVYCHSEKVSRTFSKLDYSGIALLIMGSFVPWLYYSFYCSPQPRLIYLSIVCVLGISAIIVAQWDRFATPKHRQTRAGVFLGLGLSGKFVGWRPPKRYGIKYCLVARGQERLHGGDDKEEKPERWEYIGVVTKRVEM

SEQ ID NO: 913779 - protein, 217 aa, Homo sapiens
LSRGSLVLPQSMPTDIKKSSYKKLSKFLQQMQQEQIIQVKELSKGVESIVAVDWKHPRITSFVIPEPSPTSQTIQEGSREQPYHPPDIKPLYCVPASMTLLFQESGHKKGSFLEGSEVRTIVINYAKKNDLVDADNKNLVRLDPILCDCILEKNEQHTVMKLPWDSLLTRCLEKLQPAYQVTLPGQEPIVKKGRICPIDITLAQRASNKKVILERHN

SEQ ID NO: 913780 - protein, 584 aa, Homo sapiens
MFAKAFRVKSNTAIKGSDRRKLRADVTTAFPTLGTDQVSELVPGKEELNIVKLYAHKGDAVTVYVSGGNPILFELEKNLYPTVYTLWSYPDLLPTFTTWPLVLEKLVGGADLMLPGLVMPPAGLPQVQKGDLCAISLVGNRAPVAIGVAAMSTAEMLTSGLKGRGFSVLHTYQDHLWRSGNKSSPPSIAPLALDSADLSEEKGSVQMDSTLQGDMRHMTLEGEEENGEVHQAREDKSLSEAPEDTSTRGLNQDSTDSKTLQEQMDELLQQCFLHALKCRVKKADLPLLTSTFLGSHMFSCCPEGRQLDIKKSSYKKLSKFLQQMQQEQIIQVKELSKGVESIVAVDWKHPRITSFVIPEPSPTSQTIQEGSREQPYHPPDIKPLYCVPASMTLLFQESGHKKGSFLEGSEVRTIVINYAKKNDLVDADNKNLVRLDPILCDCILEKNEQHTVMKLPWDSLLTRCLEKLQPAYQVTLPGQEPIVKKGRICPIDITLAQRASNKKVTVVRNLEAYGLDPYSVAAILQQRCQASTTVNPAPGAKDSLQVQIQGNQVHHLGWLLLEEYQLPRKHIQGLEKALKPGKKK

SEQ ID NO: 913781 - protein, 434 aa, Homo sapiens
MSTAEMLTSGLKGRGFSVLHTYQDHLWRSGNKSSPPSIAPLALDSADLSEEKGSVQMDSTLQGDMRHMTLEGEEENGEVHQAREDKSLSEAPEDTSTRGLNQDSTDSKTLQEQMDELLQQCFLHALKCRVKKADLPLLTSTFLGSHMFSCCPEGRQLDIKKSSYKKLSKFLQQMQQEQIIQVKELSKGVESIVAVDWKHPRITSFVIPEPSPTSQTIQEGSREQPYHPPDIKPLYCVPASMTLLFQESGHKKGSFLEGSEVRTIVINYAKKNDLVDADNKNLVRLDPILCDCILEKNEQHTVMKLPWDSLLTRCLEKLQPAYQVTLPGQEPIVKKGRICPIDITLAQRASNKKVTVVRNLEAYGLDPYSVAAILQQRCQASTTVNPAPGAKDSLQVQIQGNQVHHLGWLLLEEYQLPRKHIQGLEKALKPGKKK

SEQ ID NO: 913782 - protein, 584 aa, Homo sapiens; identical to SEQ ID NO: 913780

SEQ ID NO: 913783 - protein, 519 aa, Homo sapiens
MFAKAFRVKSNTAIKGSDRRKLRADVTTAFPTLGTDQVSELVPGKEELNIVKLYAHKGDAVTVYVSGGNPILFELEKNLYPTVYTLWSYPDLLPTFTTWPLVLEKLVGGADLMLPGLVMPPAGLPQVQKGDLCAISLVGNRAPVAIGVAAMSTAEMLTSGLKGRGFSVLHTYQDHLWRSGNKSSPPSIAPLALDSADLSEEKGSVQMDSTLQGDMRHMTLEGEEENGEVHQAREDKSLSEAPEDTSTRGLNQDSTDSKTLQEQMDELLQQCFLHALKCRVKKADLPLLTSTFLGSHMFSCCPEGRQLDIKKSSYKKLSKFLQQMQQEQIIQVKELSKGVESIVAVDWKHPRITSFVIPEPSPTSQTIQEGSREQPYHPPDIKPLYCVPASMTLLFQESGHKKGSFLEGSEVRTIVINYAKKNDLVDADNKNLVRLDPILCDCILEKNEQHTVMKLPWDSLLTRCLEKLQPAYQVTLPGQEPIVKKGRICPIDITLAQRASNKKITKLRLSLRNMPVVPC

SEQ ID NO: 913784 - protein, 510 aa, Homo sapiens
MFAKAFRVKSNTAIKGSDRRKLRADVTTAFPTLGTDQVSELVPGKEELNIVKLYAHKGDAVTVYVSGGNPILFELEKNLYPTVYTLWSYPDLLPTFTTWPLVLEKLVGGADLMLPGLVMPPAGLPQVQKGDLCAISLVGNRAPVAIGVAAMSTAEMLTSGLKGRGFSVLHTYQDHLWRSGNKSSPPSIAPLALDSADLSEEKGSVQMDSTLQGDMRHMTLEGEEENGEVHQAREDKSLSEAPEDTSTRGLNQDSTDSKTLQEQMDELLQQCFLHALKCRVKKADLPLLTSTFLGSHMFSCCPEGRQLDIKKSSYKKLSKFLQQMQQEQIIQVKELSKGVESIVAVDWKHPRITSFVIPEPSPTSQTIQEGSREQPYHPPDIKPLYCVPASMTLLFQESGHKKGSFLEGSEVRTIVINYAKKNDLVDADNKNLVRLDPILCDCILEKNEQHTVMKLPWDSLLTRCLEKLQPAYQVTLPGQEPIVKKGRICPIDITLAQRASNKKVILERHN

SEQ ID NO: 913785 - protein, 401 aa, Homo sapiens
MFAKAFRVKSNTAIKGSDRRKLRADVTTAFPTLGTDQVSELVPGKEELNIVKLYAHKGDAVTVYVSGGNPILFELEKNLYPTVYTLWSYPDLLPTFTTWPLVLEKLVGGADLMLPGLVMPPAGLPQVQKGDLCAISLVGNRAPVAIGVAAMSTAEMLTSGLKGRGFSVLHTYQDHLWRSGNKSSPPSIAPLALDSADLSEEKGSVQMDSTLQGDMRHMTLEGEEENGEVHQAREDKSLSEAPEDTSTRGLNQDSTDSKTLQEQMDELLQQCFLHALKCRVKKADLPLLTSTFLGSHMFSCCPEGRQLDIKKSSYKKLSKFLQQMQQEQIIQVKELSKGVESIVAVDWKHPRITSFVIPEPSPTSQTIQEGSREQPYHPPDIKPLYCVPASMTLLFQESGHK

SEQ ID NO: 913786 - protein, 333 aa, Homo sapiens
MFAKAFRVKSNTAIKGSDRRKLRADVTTAFPTLGTDQVSELVPGKEELNIVKLYAHKGDAVTVYVSGGNPILFELEKNLYPTVYTLWSYPDLLPTFTTWPLVLEKLVGGADLMLPGLVMPPAGLPQVQKGDLCAISLVGNRAPVAIGVAAMSTAEMLTSGLKGRGFSVLHTYQDHLWRSGNKSSPPSIAPLALDSADLSEEKGSVQMDSTLQGDMRHMTLEGEEENGEVHQAREDKSLSEAPEDTSTRGLNQDSTDSKTLQEQMDELLQQCFLHALKCRVKKADLPLLTSTFLGSHMFSCCPEGRQTGHNRSHSYKKSLSPGSQLQTGARLYR

SEQ ID NO: 913787 - protein, 202 aa, Homo sapiens
MFAKAFRVKSNTAIKGSDRRKLRADVTTAFPTLGTDQVSELVPGKEELNIVKLYAHKGDAVTVYVSGGNPILFELEKNLYPTVYTLWSYPDLLPTFTTWPLVLEKLVGGADLMLPGLVMPPAGLPQVQKGDLCAISLVGNRAPVAIGVAAMSTAEMLTSGLKGRGFSVLHTYQDHLWEETRFILPISEMKKLRHGTFRGPEL

SEQ ID NO: 913788 - protein, 584 aa, Homo sapiens; identical to SEQ ID NO: 913780

SEQ ID NO: 913789 - protein, 556 aa, Homo sapiens
MFAKAFRVKSNTAIKGSDRRKLRADVTTAFPTLGTDQVSELVPGKEELNIVKLYAHKGDAVTVYVSGGNPILFELEKNLYPTDLMLPGLVMPPAGLPQVQKGDLCAISLVGNRAPVAIGVAAMSTAEMLTSGLKGRGFSVLHTYQDHLWRSGNKSSPPSIAPLALDSADLSEEKGSVQMDSTLQGDMRHMTLEGEEENGEVHQAREDKSLSEAPEDTSTRGLNQDSTDSKTLQEQMDELLQQCFLHALKCRVKKADLPLLTSTFLGSHMFSCCPEGRQLDIKKSSYKKLSKFLQQMQQEQIIQVKELSKGVESIVAVDWKHPRITSFVIPEPSPTSQTIQEGSREQPYHPPDIKPLYCVPASMTLLFQESGHKKGSFLEGSEVRTIVINYAKKNDLVDADNKNLVRLDPILCDCILEKNEQHTVMKLPWDSLLTRCLEKLQPAYQVTLPGQEPIVKKGRICPIDITLAQRASNKKVTVVRNLEAYGLDPYSVAAILQQRCQASTTVNPAPGAKDSLQVQIQGNQVHHLGWLLLEEYQLPRKHIQGLEKALKPGKKK

SEQ ID NO: 913790 - protein, 460 aa, Homo sapiens
MFAKAFRVKSNTAIKGSDRRKLRADVTTAFPTLGTDQVSELVPGKEELNIVKLYAHKGDAVTVYVSGGNPILFELEKNLYPTVYTLWSYPDLLPTFTTWPLVLEKLVGGADLMLPGLVMPPAGLPQVQKGDLCAISLVGNRAPVAIGVAAMSTAEMLTSGLKGRGFSVLHTYQDHLCPEGRQLDIKKSSYKKLSKFLQQMQQEQIIQVKELSKGVESIVAVDWKHPRITSFVIPEPSPTSQTIQEGSREQPYHPPDIKPLYCVPASMTLLFQESGHKKGSFLEGSEVRTIVINYAKKNDLVDADNKNLVRLDPILCDCILEKNEQHTVMKLPWDSLLTRCLEKLQPAYQVTLPGQEPIVKKGRICPIDITLAQRASNKKVTVVRNLEAYGLDPYSVAAILQQRCQASTTVNPAPGAKDSLQVQIQGNQVHHLGWLLLEEYQLPRKHIQGLEKALKPGKKK

SEQ ID NO: 913791 - protein, 455 aa, Homo sapiens
MFAKAFRVKSNTAIKGSDRRKLRADVTTAFPTLGTDQVSELVPGKEELNIVKLYAHKGDAVTVYVSGGNPILFELEKNLYPTVYTLWSYPDLLPTFTTWPLVLEKLVGGADLMLPGLVMPPAGLPQVQKGDLCAISLVGNRAPVAIGVAAMSTAEMLTSGLKGRGFSVLHTYQDHLWRSGNKSSPPSIAPLALDSADLSEEKGSVQMDSTLQGDMRHMTLEGEEENGEVHQAREDKSLSEAPEDTSTRGLNQDSTDSKTLQEQMDELLQQCFLHALKCRVKKADLPLLTSTFLGSHMFSCCPEGRQLDIKKSSYKKLSKFLQQMQQEQIIQVKELSKGVESIVAVDWKHPRITSFVIPEPSPTSQTIQEGSREQPYHPPDIKPLYCVPASMTLLFQESGHKKGSFLEGSEVRTIVINYAKKNDLVDADNKNLVRLDPILCDCMRVHFSLRCSQST

SEQ ID NO: 913792 - protein, 324 aa, Homo sapiens
MFAKAFRVKSNTAIKGSDRRKLRADVTTAFPTLGTDQVSELVPGKEELNIVKLYAHKGDAVTVYVSGGNPILFELEKNLYPTVYTLWSYPDLLPTFTTWPLVLEKLVGGADLMLPGLVMPPAGLPQVQKGDLCAISLVGNRAPVAIGVAAMSTAEMLTSGLKGRGFSVLHTYQDHLWRSGNKSSPPSIAPLALDSADLSEEKGSVQMDSTLQGDMRHMTLEGEEENGEVHQAREDKSLSEAPEDTSTRGLNQDSTDSKTLQEQMDELLQQCFLHALKCRVKKADLPLLTSTFLGSHMFSCCPEGRQLDIKKSSYKKEGELSGGQ

SEQ ID NO: 913793 - protein, 118 aa, Homo sapiens
EPSENTGAQKAAEALEGPLEGRECSHHRQSLSPLSPQVTVVRNLEAYGLDPYSVAAILQQRCQASTTVNPAPGAKDSLQVQIQGNQVHHLGWLLLEEYQLPRKHIQGLEKALKPGKKK

SEQ ID NO: 913794 - protein, 233 aa, Homo sapiens
MRRGAPQDQELVGPGPPGRGSRGAPPPLGPVVPVLVFPPDLVFRADQRSGPRQLLTLYNPTGTALRFRVLCTAPAKYTVFDAEGYVKPQSCIDIVIRHVAPIPSHYDVQDRFRIELSEEGAEGRVVGRKDITSILRAPAYPLELQGQPDPAPRPGPPAGTPPPTARHFQEHPRQQLATSSFLLFLLTGIVSVAFLLLPLPDELGSQLPQVLHVSLGQKLVAAYVLASHMVSSD

SEQ ID NO: 913795 - protein, 235 aa, Homo sapiens
MRRGAPQDQELVGPGPPGRGSRGAPPPLGPVVPVLVFPPDLVFRADQRSGPRQLLTLYNPTGTALRFRVLCTAPAKYTVFDAEGYVKPQSCIDIVIRHVAPIPSHYDVQDRFRIELSEEGAEGRVVGRKDITSILRAPAYPLELQGQPDPAPRPGPPAGTPPPTARHFQEHPRQQLATSSFLLFLLTGIVSVAFLLLPLPDELGSQLPQVLHVSLGQKLVAAYVLGLLTMVFLRT

SEQ ID NO: 913796 - protein, 225 aa, Homo sapiens
MRRGAPQDQELVGPGPPGRGSRGAPPPLGPVVPVLVFPPDLVFRADQRSGPRQLLTLYNPTGTALRFRVLCTAPAKYTVFDAEGYVKPQSCIDIHYDVQDRFRIELSEEGAEGRVVGRKDITSILRAPAYPLELQGQPDPAPRPGPPAGTPPPTARHFQEHPRQQLATSSFLLFLLTGIVSVAFLLLPLPDELGSQLPQVLHVSLGQKLVAAYVLGLLTMVFLRT

SEQ ID NO: 913797 - protein, 221 aa, Homo sapiens
MSDRPEPACAPPPLGPVVPVLVFPPDLVFRADQRSGPRQLLTLYNPTGTALRFRVLCTAPAKYTVFDAEGYVKPQSCIDIVIRHVAPIPSHYDVQDRFRIELSEEGAEGRVVGRKDITSILRAPAYPLELQGQPDPAPRPGPPAGTPPPTARHFQEHPRQQLATSSFLLFLLTGIVSVAFLLLPLPDELGSQLPQVLHVSLGQKLVAAYVLGLLTMVFLRT

SEQ ID NO: 913798 - protein, 235 aa, Homo sapiens; identical to SEQ ID NO: 913795

SEQ ID NO: 913799 - protein, 233 aa, Homo sapiens
MRRGAPQDQELVGPGPPGRGSRGAPPPLGPVVPVLVFPPDLVFRADQRSGPRQLLTLYNPTGTALRFRVLCTAPAKYTVFDAEGYVKPQSCIDIVIRHVAPIPSHYDVQDRFRIELSEEGAEGRVVGRKDITSILRAPAYPLELQGQPDPAPRPGPPAGTPPPTARHFQEHPRQQLATSSFLLFLLTGIVSVAFLLLPLPDELGSQLPQVLHVSLGQKLVAAYVLGRVLRQPL

SEQ ID NO: 913800 - protein, 193 aa, Homo sapiens [sequence omitted]

SEQ ID NO: 913801 - protein, 129 aa, Homo sapiens
MRRGAPQDQELVGPGPPGRGSRGAPPPLGPVVPVLVFPPDLVFRADQRSGPRQLLTLYNPTGTALRFRVLCTAPAKYTVFDAEGYVKPQSCIDIVMLIPYLASYPLLFPAYSPLLPDKKHPGICTHFPS

SEQ ID NO: 913802 - protein, 235 aa, Homo sapiens; identical to SEQ ID NO: 913795

SEQ ID NO: 913803 - protein, 235 aa, Homo sapiens; identical to SEQ ID NO: 913795

SEQ ID NO: 913804 - protein, 235 aa, Homo sapiens; identical to SEQ ID NO: 913795

SEQ ID NO: 913805 - protein, 182 aa, Homo sapiens
MTHMAGLVCVCLYPPVLCTAPAKYTVFDAEGYVKPQSCIDIVIRHVAPIPSHYDVQDRFRIELSEEGAEGRVVGRKDITSILRAPAYPLELQGQPDPAPRPGPPAGTPPPTARHFQEHPRQQLATSSFLLFLLTGIVSVAFLLLPLPDELGSQLPQVLHVSLGQKLVAAYVLGLLTMVFLRT

SEQ ID NO: 913806 - protein, 235 aa, Homo sapiens; identical to SEQ ID NO: 913795

SEQ ID NO: 913807 - protein, 233 aa, Homo sapiens
MRRGAPQDQELVGPGPPGRGSRGAPPPLGPVVPVLVFPPDLVFRADQRSGPRQLLTLYNPTGTALRFRVLCTAPAKYTVFDAEGYVKPQSCIDIVIRHVAPIPSHYDVQDRFRIELSEEGAEGRVVGRKDITSILRAPAYPLELQGQPPPATGHQLLPPLLADGDCVCGLPAAPTPGRTRQPAASSPARLPGTKVGGRLRLGPPHHGVPPDLSSVLNPQPTPPSLGRVLRQPL

SEQ ID NO: 913808 - protein, 124 aa, Homo sapiens
WGEAQISLDYCLIHPNGLLSYLGTSVIRHVAPIPSHYDVQDRFRIELSEEGAEGRVVGRKDITSILRAPAYPLELQGQPDPAPRPGPPAGTPPPTARHFQERELGDWDLEFCREGGTSISLEMR

SEQ ID NO: 913809 - protein, 137 aa, Homo sapiens
CSGLRVGVKSPLCFRFLAVGFICLTILSCCFLQQTKERVKLLIQLADGFCEKGHAHAAEIKKCVTAVDKRYRDFSLRMEKYRTSLEKALGISSDSNKSSKSLQLDIIPASIPGSEVKLRDAAHELNEEKRKSARRKE

SEQ ID NO: 913810 - protein, 2928 aa, Homo sapiens
AAAGAAAAMSGSSGGAAAPAASSGPAAAASAAGSGCGGGAGEGAEEAAKDLADIAAFFRSGFRKNDEMKAMDVLPILKEKVAYLSGGRDKRGGPILTFPARSNHDRIRQEDLRRLISYLACIPSEEVCKRGFTVIVDMRGSKWDSIKPLLKILQESFPCCIHVALIIKPDNFWQKQRTNFGSSKFEFETNMVSLEGLTKVVDPSQLTPEFDGCLEYNHEEWIEIRVAFEDYISNATHMLSRLEELQDILAKKELPQDLEGARNMIEEHSQLKKKVIKAPIEDLDLEGQKLLQRIQSSESFPKKNSGSGNADLQNLLPKVSTMLDRLHSTRQHLHQMWHVRKLKLDQCFQLRLFEQDAEKMFDWITHNKGLFLNSYTEIGTSHPHAMELQTQHNHFAMNCMNVYVNINRIMSVANRLVESGHYASQQIRQIASQLEQEWKAFAAALDERSTLLDMSSIFHQKAEKYMSNVDSWCKACGEVDLPSELQDLEDAIHHHQGIYEHITLAYSEVSQDGKSLLDKLQRPLTPGSSDSLTASANYSKAVHHVLDVIHEVLHHQRQRENIWQHRKVRLHQRLQLCVFQQDVQQVLDWIENHGEAFLSKHTGVGKSLHRARALQKRHEDFEEVAQNTYTNADKLLEAAEQLAQTGECDPEEIYQAAHQLEDRIQDFVRRVEQRKILLDMSVSFHTHVKELWTWLEELQKELLDDVYAESVEAVQDLIKRFGQQQQTTLQVTVNVIKEGEDLIQQLRDSAISSNKTPHNSSINHIETVLQQLDEAQSQMEELFQERKIKLELFLHVRIFERDAIDIISDLESWNDELSQQMNDFDTEDLTIAEQRLQHHADKALTMNNLTFDVIHQGQDLLQYVNEVQASGVELLCDRDVDMATRVQDLLEFLHEKQQELDLAAEQHRKHLEQCVQLRHLQAEVKQVLGWIRNGESMLNAGLITASSLQEAEQLQREHEQFQHAIEKTHQSALQVQQKAEAMLQANHYDMDMIRDCAEKVASHWQQLMLKMEDRLKLVNASVAFYKTSEQVCSVLESLEQEYKREEDWCGGADKLGPNSETDHVTPMISKHLEQKEAFLKACTLARRNADVFLKYLHRNSVNMPGMVTHIKAPEQQVKNILNELFQRENRVLHYWTMRKRRLDQCQQYVVFERSAKQALEWIHDNGEFYLSTHTSTGSSIQHTQELLKEHEEFQITAKQTKERVKLLIQLADGFCEKGHAHAAEIKKCVTAVDKRYRDFSLRMEKYRTSLEKALGISSDSNKSSKSLQLDIIPASIPGSEVKLRDAAHELNEEKRKSARRKEFIMAELIQTEKAYVRDLRECMDTYLWEMTSGVEEIPPGIVNKELIIFGNMQEIYEFHNNIFLKELEKYEQLPEDVGHCFVTWADKFQMYVTYCKNKPDSTQLILEHAGSYFDEIQQRHGLANSISSYLIKPVQRITKYQLLLKELLTCCEEGKGEIKDGLEVMLSVPKRANDAMHLSMLEGFDENIESQGELILQESFQVWDPKTLIRKGRERHLFLFEMSLVFSKEVKDSSGRSKYLYKSKLFTSELGVTEHVEGDPCKFALWVGRTPTSDNKIVLKASSIENKQDWIKHIREVIQERTIHLKGALKEPIHIPKTAPATRQKGRRDGEDLDSQGDGSSQPDTISIASRTSQNTLDSDKLSGGCELTVVIHDFTACNSNELTIRRGQTVEVLERPHDKPDWCLVRTTDRSPAAEGLVPCGSLCIAHSRSSMEMEGIFNHKDSLSVSSNDASPPASVASLQPHMIGAQSSPGPKRPGNTLRKWLTSPVRRLSSGKADGHVKKLAHKHKKSREVRKSADAGSQKDSDDSAATPQDETVEERGRNEGLSSGTLSKSSSSGMQSCGEEEGEEGADAVPLPPPMAIQQHSLLQPDSQDDKASSRLLVRPTSSETPSAAELVSAIEELVKSKMALEDRPSSLLVDQGDSSSPSFNPSDNSLLSSSSPIDEMEERKSSSLKRRHYVLQELVETERDYVRDLGYVVEGYMALMKEDGVPDDMKGKDKIVFGNIHQIYDWHRDFFLGELEKCLEDPEKLGSLFVKHERRLHMYIAYCQNKPKSEHIVSEYIDTFFEDLKQRLGHRLQLTDLLIKPVQRIMKYQLLLKDFLKYSKKASLDTSELERAVEVMCIVPRRCNDMMNVGRLQGFDGKIVAQGKLLLQDTFLVTDQDAGLLPRCRERRIFLFEQIVIFSEPLDKKKGFSMPGFLFKNSIKVSCLCLEENVENDPCKFALTSRTGDVVETFILHSSSPSVRQTWIHEINQILENQRNFLNALTSPIEYQRNHSGGGGGGGSGAAAGVGAAAAAGPPVAAAATVAAPAAAAAPPARAGAGPPGSPSLSDTTPPCWSPLQPRARQRQTRCQSESSSSSNISTMLVTHDYTAVKEDEINVYQGEVVQILASNQQNMFLVFRAATDQCPAAEGWIPGFVLGHTSAVIVENPDGTLKKSTSWHTALRLRKKSEKKDKDGKREGKLENGYRKSREGLSNKVSVKLLNPNYIYDVPPEFVIPLSEVTCETGETVVLRCRVCGRPKASITWKGPEHNTLNNDGHYSISYSDLGEATLKIVGVTTEDDGIYTCIAVNDMGSASSSASLRVLGPGMDGIMVTWKDNFDSFYSEVAELGRGRFSVVKKCDQKGTKRAVATKFVNKKLMKRDQVTHELGILQSLQHPLLVGLLDTFETPTSYILVLEMADQGRLLDCVVRWGSLTEGKIRAHLGEVLEAVRYLHNCRIAHLDLKPENILVDESLAKPTIKLADFGDAVQLNTTYYIHQLLGNPEFAAPEIILGNPVSLTSDTWSVGVLTYVLLSGVSPFLDDSVEETCLNICRLDFSFPDDYFKGVSQKAKEFVCFLLQEDPAKRPSAALALQEQWLQAGNGRSTGVLDTSRLTSFIERRKHQNDVRPIRSIKNFLQSRLLPRV

SEQ ID NO: 913811 - protein, 2928 aa, Homo sapiens; identical to SEQ ID NO: 913810

SEQ ID NO: 913812 - protein, 1009 aa, Homo sapiens
MLARILFEIIILFRAKNSKRKKKLNSINYKRKIHYSIGGNLKKTASDNLEGNVFFSPSFSPFISCFEGKIVAQGKLLLQDTFLVTDQDAGLLPRCRERRIFLFEQIVIFSEPLDKKKGFSMPGFLFKNSIKVSCLCLEENVENDPCKFALTSRTGDVVETFILHSSSPSVRQTWIHEINQILENQRNFLNALTSPIEYQRNHSGGGGGGGSGGSGGGGGSGGGGAPSGGSGHSGGPSSCGGAPSTSRSRPSRIPQPVRHHPPVLVSSAASSQAEADKMSGTSTPGPSLPPPGAAPEAGPSAPSRRPPGADAEGSEREAEPIPKMKVLESPRKGAANASGSSPDAPAKDARASLGTLPLGKPRAGAASPLNSPLSSAVPSLGKEPFPPSSPLQKGGSFWSSIPASPASRPGSFTFPGDSDSLQRQTPRHAAPGKDTDRMSTCSSASEQSVQSTQSNGSESSSSSNISTMLVTHDYTAVKEDEINVYQGEVVQILASNQQNMFLVFRAATDQCPAAEGWIPGFVLGHTSAVIVENPDGTLKKSTSWHTALRLRKKSEKKDKDGKREGKLENGYRKSREGLSNKVSVKLLNPNYIYDVPPEFVIPLSEVTCETGETVVLRCRVCGRPKASITWKGPEHNTLNNDGHYSISYSDLGEATLKIVGVTTEDDGIYTCIAVNDMGSASSSASLRVLGPGMDGIMVTWKDNFDSFYSEVAELGRGRFSVVKKCDQKGTKRAVATKFVNKKLMKRDQVTHELGILQSLQHPLLVGLLDTFETPTSYILVLEMADQGRLLDCVVRWGSLTEGKIRAHLGEVLEAVRYLHNCRIAHLDLKPENILVDESLAKPTIKLADFGDAVQLNTTYYIHQLLGNPEFAAPEIILGNPVSLTSDTWSVGVLTYVLLSGVSPFLDDSVEETCLNICRLDFSFPDDYFKGVSQKAKEFVCFLLQEDPAKRPSAALALQEQWLQAGNGRSTGVLDTSRLTSFIERRKHQNDVRPIRSIKNFLQSRLLPRV

SEQ ID NO: 913813 - protein, 889 aa, Homo sapiens
MPGFLFKNSIKVSCLCLEENVENDPCKFALTSRTGDVVETFILHSSSPSVRQTWIHEINQILENQRNFLNALTSPIEYQRNHSGGGGGGGSGGSGGGGGSGGGGAPSGGSGHSGGPSSCGGAPSTSRSRPSRIPQPVRHHPPVLVSSAASSQAEADKMSGTSTPGPSLPPPGAAPEAGPSAPSRRPPGADAEGSEREAEPIPKMKVLESPRKGAANASGSSPDAPAKDARASLGTLPLGKPRAGAASPLNSPLSSAVPSLGKEPFPPSSPLQKGGSFWSSIPASPASRPGSFTFPGDSDSLQRQTPRHAAPGKDTDRMSTCSSASEQSVQSTQSNGSESSSSSNISTMLVTHDYTAVKEDEINVYQGEVVQILASNQQNMFLVFRAATDQCPAAEGWIPGFVLGHTSAVIVENPDGTLKKSTSWHTALRLRKKSEKKDKDGKREGKLENGYRKSREGLSNKVSVKLLNPNYIYDVPPEFVIPLSEVTCETGETVVLRCRVCGRPKASITWKGPEHNTLNNDGHYSISYSDLGEATLKIVGVTTEDDGIYTCIAVNDMGSASSSASLRVLGPGMDGIMVTWKDNFDSFYSEVAELGRGRFSVVKKCDQKGTKRAVATKFVNKKLMKRDQVTHELGILQSLQHPLLVGLLDTFETPTSYILVLEMADQGRLLDCVVRWGSLTEGKIRAHLGEVLEAVRYLHNCRIAHLDLKPENILVDESLAKPTIKLADFGDAVQLNTTYYIHQLLGNPEFAAPEIILGNPVSLTSDTWSVGVLTYVLLSGVSPFLDDSVEETCLNICRLDFSFPDDYFKGVSQKAKEFVCFLLQEDPAKRPSAALALQEQWLQAGNGRSTGVLDTSRLTSFIERRKHQNDVRPIRSIKNFLQSRLLPRV

SEQ ID NO: 913814 - protein, 619 aa, Homo sapiens
MKKWGERICPLGTLYVTVLLWKTETALGTWRGGSAVQAGAGPCGLLGSGLVWPITHAAVSSTRVAVSESSSSSNISTMLVTHDYTAVKEDEINVYQGEVVQILASNQQNMFLVFRAATDQCPAAEGWIPGFVLGHTSAVIVENPDGTLKKSTSWHTALRLRKKSEKKDKDGKREGKLENGYRKSREGLSNKVSVKLLNPNYIYDVPPEFVIPLSEVTCETGETVVLRCRVCGRPKASITWKGPEHNTLNNDGHYSISYSDLGEATLKIVGVTTEDDGIYTCIAVNDMGSASSSASLRVLGPGMDGIMVTWKDNFDSFYSEVAELGRGRFSVVKKCDQKGTKRAVATKFVNKKLMKRDQVTHELGILQSLQHPLLVGLLDTFETPTSYILVLEMADQGRLLDCVVRWGSLTEGKIRAHLGEVLEAVRYLHNCRIAHLDLKPENILVDESLAKPTIKLADFGDAVQLNTTYYIHQLLGNPEFAAPEIILGNPVSLTSDTWSVGVLTYVLLSGVSPFLDDSVEETCLNICRLDFSFPDDYFKGVSQKAKEFVCFLLQEDPAKRPSAALALQEQWLQAGNGRSTGVLDTSRLTSFIERRKHQNDVRPIRSIKNFLQSRLLPRV

SEQ ID NO: 913815 - protein, 2132 aa, Homo sapiens
AAAGAAAAMSGSSGGAAAPAASSGPAAAASAAGSGCGGGAGEGAEEAAKDLADIAAFFRSGFRKNDEMKAMDVLPILKEKVAYLSGGRDKRGGPILTFPARSNHDRIRQEDLRRLISYLACIPSEEVCKRGFTVIVDMRGSKWDSIKPLLKILQESFPCCIHVALIIKPDNFWQKQRTNFGSSKFEFETNMVSLEGLTKVVDPSQLTPEFDGCLEYNHEEWIEIRVAFEDYISNATHMLSRLEELQDILAKKELPQDLEGARNMIEEHSQLKKKVIKAPIEDLDLEGQKLLQRIQSSESFPKKNSGSGNADLQNLLPKVSTMLDRLHSTRQHLHQMWHVRKLKLDQCFQLRLFEQDAEKMFDWITHNKGLFLNSYTEIGTSHPHAMELQTQHNHFAMNCMNVYVNINRIMSVANRLVESGHYASQQIRQIASQLEQEWKAFAAALDERSTLLDMSSIFHQKAEKYMSNVDSWCKACGEVDLPSELQDLEDAIHHHQGIYEHITLAYSEVSQDGKSLLDKLQRPLTPGSSDSLTASANYSKAVHHVLDVIHEVLHHQRQRENIWQHRKVRLHQRLQLCVFQQDVQQVLDWIENHGEAFLSKHTGVGKSLHRARALQKRHEDFEEVAQNTYTNADKLLEAAEQLAQTGECDPEEIYQAAHQLEDRIQDFVRRVEQRKILLDMSVSFHTHVKELWTWLEELQKELLDDVYAESVEAVQDLIKRFGQQQQTTLQVTVNVIKEGEDLIQQLRDSAISSNKTPHNSSINHIETVLQQLDEAQSQMEELFQERKIKLELFLHVRIFERDAIDIISDLESWNDELSQQMNDFDTEDLTIAEQRLQHHADKALTMNNLTFDVIHQGQDLLQYVNEVQASGVELLCDRDVDMATRVQDLLEFLHEKQQELDLAAEQHRKHLEQCVQLRHLQAEVKQVLGWIRNGESMLNAGLITASSLQEAEQLQREHEQFQHAIEKTHQSALQVQQKAEAMLQANHYDMDMIRDCAEKVASHWQQLMLKMEDRLKLVNASVAFYKTSEQVCSVLESLEQEYKREEDWCGGADKLGPNSETDHVTPMISKHLEQKEAFLKACTLARRNADVFLKYLHRNSVNMPGMVTHIKAPEQQVKNILNELFQRENRVLHYWTMRKRRLDQCQQYVVFERSAKQALEWIHDNGEFYLSTHTSTGSSIQHTQELLKEHEEFQITAKQTKERVKLLIQLADGFCEKGHAHAAEIKKCVTAVDKRYRDFSLRMEKYRTSLEKALGISSDSNKSSKSLQLDIIPASIPGSEVKLRDAAHELNEEKRKSARRKEFIMAELIQTEKAYVRDLRECMDTYLWEMTSGVEEIPPGIVNKELIIFGNMQEIYEFHNNIFLKELEKYEQLPEDVGHCFVTWADKFQMYVTYCKNKPDSTQLILEHAGSYFDEIQQRHGLANSISSYLIKPVQRITKYQLLLKELLTCCEEGKGEIKDGLEVMLSVPKRANDAMHLSMLEGFDENIESQGELILQESFQVWDPKTLIRKGRERHLFLFEMSLVFSKEVKDSSGRSKYLYKSKLFTSELGVTEHVEGDPCKFALWVGRTPTSDNKIVLKASSIENKQDWIKHIREVIQERTIHLKGALKEPIHIPKTAPATRQKGRRDGEDLDSQGDGSSQPDTISIASRTSQNTLDSDKLSGGCELTVVIHDFTACNSNELTIRRGQTVEVLERPHDKPDWCLVRTTDRSPAAEGLVPCGSLCIAHSRSSMEMEGIFNHKDSLSVSSNDASPPASVASLQPHMIGAQSSPGPKRPGNTLRKWLTSPVRRLSSGKADGHVKKLAHKHKKSREVRKSADAGSQKDSDDSAATPQDETVEERGRNEGLSSGTLSKSSSSGMQSCGEEEGEEGADAVPLPPPMAIQQHSLLQPDSQDDKASSRLLVRPTSSETPSAAELVSAIEELVKSKMALEDRPSSLLVDQGDSSSPSFNPSDNSLLSSSSPIDEMEERKSSSLKRRHYVLQELVETERDYVRDLGYVVEGYMALMKEDGVPDDMKGKDKIVFGNIHQIYDWHRDFFLGELEKCLEDPEKLGSLFVKHERRLHMYIAYCQNKPKSEHIVSEYIDTFFEDLKQRLGHRLQLTDLLIKPVQRIMKYQLLLKVRRWRDKLWCQE

SEQ ID NO: 913816 - protein, 2132 aa, Homo sapiens; identical to SEQ ID NO: 913815

SEQ ID NO: 913817 - protein, 1761 aa, Homo sapiens
AAAGAAAAMSGSSGGAAAPAASSGPAAAASAAGSGCGGGAGEGAEEAAKDLADIAAFFRSGFRKNDEMKAMDVLPILKEKVAYLSGGRDKRGGPILTFPARSNHDRIRQEDLRRLISYLACIPSEEVCKRGFTVIVDMRGSKWDSIKPLLKILQESFPCCIHVALIIKPDNFWQKQRTNFGSSKFEFETNMVSLEGLTKVVDPSQLTPEFDGCLEYNHEEWIEIRVAFEDYISNATHMLSRLEELQDILAKKELPQDLEGARNMIEEHSQLKKKVIKAPIEDLDLEGQKLLQRIQSSESFPKKNSGSGNADLQNLLPKVSTMLDRLHSTRQHLHQMWHVRKLKLDQCFQLRLFEQDAEKMFDWITHNKGLFLNSYTEIGTSHPHAMELQTQHNHFAMNCMNVYVNINRIMSVANRLVESGHYASQQIRQIASQLEQEWKAFAAALDERSTLLDMSSIFHQKAEKYMSNVDSWCKACGEVDLPSELQDLEDAIHHHQGIYEHITLAYSEVSQDGKSLLDKLQRPLTPGSSDSLTASANYSKAVHHVLDVIHEVLHHQRQRENIWQHRKVRLHQRLQLCVFQQDVQQVLDWIENHGEAFLSKHTGVGKSLHRARALQKRHEDFEEVAQNTYTNADKLLEAAEQLAQTGECDPEEIYQAAHQLEDRIQDFVRRVEQRKILLDMSVSFHTHVKELWTWLEELQKELLDDVYAESVEAVQDLIKRFGQQQQTTLQVTVNVIKEGEDLIQQLRDSAISSNKTPHNSSINHIETVLQQLDEAQSQMEELFQERKIKLELFLHVRIFERDAIDIISDLESWNDELSQQMNDFDTEDLTIAEQRLQHHADKALTMNNLTFDVIHQGQDLLQYVNEVQASGVELLCDRDVDMATRVQDLLEFLHEKQQELDLAAEQHRKHLEQCVQLRHLQAEVKQVLGWIRNGESMLNAGLITASSLQEAEQLQREHEQFQHAIEKTHQSALQVQQKAEAMLQANHYDMDMIRDCAEKVASHWQQLMLKMEDRLKLVNASVAFYKTSEQVCSVLESLEQEYKREEDWCGGADKLGPNSETDHVTPMISKHLEQKEAFLKACTLARRNADVFLKYLHRNSVNMPGMVTHIKAPEQQVKNILNELFQRENRVLHYWTMRKRRLDQCQQYVVFERSAKQALEWIHDNGEFYLSTHTSTGSSIQHTQELLKEHEEFQITAKQTKERVKLLIQLADGFCEKGHAHAAEIKKCVTAVDKRYRDFSLRMEKYRTSLEKALGISSDSNKSSKSLQLDIIPASIPGSEVKLRDAAHELNEEKRKSARRKEFIMAELIQTEKAYVRDLRECMDTYLWEMTSGVEEIPPGIVNKELIIFGNMQEIYEFHNNIFLKELEKYEQLPEDVGHCFVTWADKFQMYVTYCKNKPDSTQLILEHAGSYFDEIQQRHGLANSISSYLIKPVQRITKYQLLLKELLTCCEEGKGEIKDGLEVMLSVPKRANDAMHLSMLEGFDENIESQGELILQESFQVWDPKTLIRKGRERHLFLFEMSLVFSKEVKDSSGRSKYLYKSKLFTSELGVTEHVEGDPCKFALWVGRTPTSDNKIVLKASSIENKQDWIKHIREVIQERTIHLKGALKEPIHIPKTAPATRQKGRRDGEDLDSQGDGSSQPDTISIASRTSQNTLDSDKLSGGCELTVVIHDFTACNSNELTIRRGQTVEVLERPHDKPDWCLVRTTDRSPAAEGLVPCGSLCIAHSRSSMEMEGIFNHKGQAMFRISQDLNVSLLSLR

SEQ ID NO: 913818 - protein, 1565 aa, Homo sapiens
AAAGAAAAMSGSSGGAAAPAASSGPAAAASAAGSGCGGGAGEGAEEAAKDLADIAAFFRSGFRKNDEMKAMDVLPILKEKVAYLSGGRDKRGGPILTFPARSNHDRIRQEDLRRLISYLACIPSEEVCKRGFTVIVDMRGSKWDSIKPLLKILQESFPCCIHVALIIKPDNFWQKQRTNFGSSKFEFETNMVSLEGLTKVVDPSQLTPEFDGCLEYNHEEWIEIRVAFEDYISNATHMLSRLEELQDILAKKELPQDLEGARNMIEEHSQLKKKVIKAPIEDLDLEGQKLLQRIQSSESFPKKNSGSGNADLQNLLPKVSTMLDRLHSTRQHLHQMWHVRKLKLDQCFQLRLFEQDAEKMFDWITHNKGLFLNSYTEIGTSHPHAMELQTQHNHFAMNCMNVYVNINRIMSVANRLVESGHYASQQIRQIASQLEQEWKAFAAALDERSTLLDMSSIFHQKAEKYMSNVDSWCKACGEVDLPSELQDLEDAIHHHQGIYEHITLAYSEVSQDGKSLLDKLQRPLTPGSSDSLTASANYSKAVHHVLDVIHEVLHHQRQRENIWQHRKVRLHQRLQLCVFQQDVQQVLDWIENHGEAFLSKHTGVGKSLHRARALQKRHEDFEEVAQNTYTNADKLLEAAEQLAQTGECDPEEIYQAAHQLEDRIQDFVRRVEQRKILLDMSVSFHTHVKELWTWLEELQKELLDDVYAESVEAVQDLIKRFGQQQQTTLQVTVNVIKEGEDLIQQLRDSAISSNKTPHNSSINHIETVLQQLDEAQSQMEELFQERKIKLELFLHVRIFERDAIDIISDLESWNDELSQQMNDFDTEDLTIAEQRLQHHADKALTMNNLTFDVIHQGQDLLQYVNEVQASGVELLCDRDVDMATRVQDLLEFLHEKQQELDLAAEQHRKHLEQCVQLRHLQAEVKQVLGWIRNGESMLNAGLITASSLQEAEQLQREHEQFQHAIEKTHQSALQVQQKAEAMLQANHYDMDMIRDCAEKVASHWQQLMLKMEDRLKLVNASVAFYKTSEQVCSVLESLEQEYKREEDWCGGADKLGPNSETDHVTPMISKHLEQKEAFLKACTLARRNADVFLKYLHRNSVNMPGMVTHIKAPEQQVKNILNELFQRENRVLHYWTMRKRRLDQCQQYVVFERSAKQALEWIHDNGEFYLSTHTSTGSSIQHTQELLKEHEEFQITAKQTKERVKLLIQLADGFCEKGHAHAAEIKKCVTAVDKRYRDFSLRMEKYRTSLEKALGISSDSNKSSKSLQLDIIPASIPGSEVKLRDAAHELNEEKRKSARRKEFIMAELIQTEKAYVRDLRECMDTYLWEMTSGVEEIPPGIVNKELIIFGNMQEIYEFHNNIFLKELEKYEQLPEDVGHCFVTWADKFQMYVTYCKNKPDSTQLILEHAGSYFDEIQQRHGLANSISSYLIKPVQRITKYQLLLKELLTCCEEGKGEIKDGLEVMLSVPKRANDAMHLSMLEGFDENIESQGELILQESFQVWDPKTLIRKGRERHLFLFEMSLVFSKEVKDSSGRSKYLYKSKLFVSIGVQNCKSKGNTIAVFL

SEQ ID NO: 913819 - protein, 1302 aa, Homo sapiens
AAAGAAAAMSGSSGGAAAPAASSGPAAAASAAGSGCGGGAGEGAEEAAKDLADIAAFFRSGFRKNDEMKAMDVLPILKEKVAYLSGGRDKRGGPILTFPARSNHDRIRQEDLRRLISYLACIPSEEVCKRGFTVIVDMRGSKWDSIKPLLKILQESFPCCIHVALIIKPDNFWQKQRTNFGSSKFEFETNMVSLEGLTKVVDPSQLTPEFDGCLEYNHEEWIEIRVAFEDYISNATHMLSRLEELQDILAKKELPQDLEGARNMIEEHSQLKKKVIKAPIEDLDLEGQKLLQRIQSSESFPKKNSGSGNADLQNLLPKVSTMLDRLHSTRQHLHQMWHVRKLKLDQCFQLRLFEQDAEKMFDWITHNKGLFLNSYTEIGTSHPHAMELQTQHNHFAMNCMNVYVNINRIMSVANRLVESGHYASQQIRQIASQLEQEWKAFAAALDERSTLLDMSSIFHQKAEKYMSNVDSWCKACGEVDLPSELQDLEDAIHHHQGIYEHITLAYSEVSQDGKSLLDKLQRPLTPGSSDSLTASANYSKAVHHVLDVIHEVLHHQRQRENIWQHRKVRLHQRLQLCVFQQDVQQVLDWIENHGEAFLSKHTGVGKSLHRARALQKRHEDFEEVAQNTYTNADKLLEAAEQLAQTGECDPEEIYQAAHQLEDRIQDFVRRVEQRKILLDMSVSFHTHVKELWTWLEELQKELLDDVYAESVEAVQDLIKRFGQQQQTTLQVTVNVIKEGEDLIQQLRDSAISSNKTPHNSSINHIETVLQQLDEAQSQMEELFQERKIKLELFLHVRIFERDAIDIISDLESWNDELSQQMNDFDTEDLTIAEQRLQHHADKALTMNNLTFDVIHQGQDLLQYVNEVQASGVELLCDRDVDMATRVQDLLEFLHEKQQELDLAAEQHRKHLEQCVQLRHLQAEVKQVLGWIRNGESMLNAGLITASSLQEAEQLQREHEQFQHAIEKTHQSALQVQQKAEAMLQANHYDMDMIRDCAEKVASHWQQLMLKMEDRLKLVNASVAFYKTSEQVCSVLESLEQEYKREEDWCGGADKLGPNSETDHVTPMISKHLEQKEAFLKACTLARRNADVFLKYLHRNSVNMPGMVTHIKAPEQQVKNILNELFQRENRVLHYWTMRKRRLDQCQQYVVFERSAKQALEWIHDNGEFYLSTHTSTGSSIQHTQELLKEHEEFQITAKQTKERVKLLIQLADGFCEKGHAHAAEIKKCVTAVDKRYRDFSLRMEKYRTSLEKALGISSDSNKSSKSLQLDIIPASIPGSEVKLRDAAHELNEEKRKSARRKE

SEQ ID NO: 913820 - protein, 475 aa, Homo sapiens
AAAGAAAAMSGSSGGAAAPAASSGPAAAASAAGSGCGGGAGEGAEEAAKDLADIAAFFRSGFRKNDEMKAMDVLPILKEKVAYLSGGRDKRGGPILTFPARSNHDRIRQEDLRRLISYLACIPSEEVCKRGFTVIVDMRGSKWDSIKPLLKILQESFPCCIHVALIIKPDNFWQKQRTNFGSSKFEFETNMVSLEGLTKVVDPSQLTPEFDGCLEYNHEEWIEIRVAFEDYISNATHMLSRLEELQDILAKKELPQDLEGARNMIEEHSQLKKKVIKAPIEDLDLEGQKLLQRIQSSESFPKKNSGSGNADLQNLLPKVSTMLDRLHSTRQHLHQMWHVRKLKLDQCFQLRLFEQDAEKMFDWITHNKGLFLNSYTEIGTSHPHAMELQTQHNHFAMNCMNVYVNINRIMSVANRLVESGHYASQQIRQIASQLEQEWKAFAAALDERSTLLDMSSIFHQKAEKVSALNPQPTRW

SEQ ID NO: 913821 - protein, 405 aa, Homo sapiens
AAAGAAAAMSGSSGGAAAPAASSGPAAAASAAGSGCGGGAGEGAEEAAKDLADIAAFFRSGFRKNDEMKAMDVLPILKEKVAYLSGGRDKRGGPILTFPARSNHDRIRQEDLRRLISYLACIPSEEVCKRGFTVIVDMRGSKWDSIKPLLKILQESFPCCIHVALIIKPDNFWQKQRTNFGSSKFEFETNMVSLEGLTKVVDPSQLTPEFDGCLEYNHEEWIEIRVAFEDYISNATHMLSRLEELQDILAKKELPQDLEGARNMIEEHSQLKKKVIKAPIEDLDLEGQKLLQRIQSSESFPKKNSGSGNADLQNLLPKVSTMLDRLHSTRQHLHQMWHVRKLKLDQCFQLRLFEQDAEKMFDWITHNKGLFLNSYTEIGTSHPHAMELQTQHNHIGESKIHQLGS

SEQ ID NO: 913822 - protein, 600 aa, Homo sapiens
AAAGAAAAMSGSSGGAAAPAASSGPAAAASAAGSGCGGGAGEGAEEAAKDLADIAAFFRSGFRKNDEMKAMDVLPILKEKVAYLSGGRDKRGGPILTFPARSNHDRIRQEDLRRLISYLACIPSEEVCKRGFTVIVDMRGSKWDSIKPLLKILQESFPCCIHVALIIKPDNFWQKQRTNFGSSKFEFETNMVSLEGLTKVVDPSQLTPEFDGCLEYNHEEWIEIRVAFEDYISNATHMLSRLEELQDILAKKELPQDLEGARNMIEEHSQLKKKVIKAPIEDLDLEGQKLLQRIQSSESFPKKNSGSGNADLQNLLPKVSTMLDRLHSTRQHLHQMWHVRKLKLDQCFQLRLFEQDAEKMFDWITHNKGLFLNSYTEIGTSHPHAMELQTQHNHFAMNCMNVYVNINRIMSVANRLVESGHYASQQIRQIASQLEQEWKAFAAALDERSTLLDMSSIFHQKAEKYMSNVDSWCKACGEVDLPSELQDLEDAIHHHQGIYEHITLAYSEVSQDGKSLLDKLQRPLTPGSSDSLTASANYSKAVHHVLDVIHEVLHHQRQRENNLATPQGPAASEAAAVCFPAGRSAGQFRLMPFCMGNGLC

SEQ ID NO: 913823 - protein, 103 aa, Homo sapiens
FRSVISQIPTAQKIIPAELPQAQTKGAGADAALEAISHLCRSDLGEATLKIVGVTTEDDGIYTCIAVNDMGSASSSASLRVLGKHRATRILRDPVGHVFQESP

SEQ ID NO: 913824 - protein, 2928 aa, Homo sapiens; identical to SEQ ID NO: 913810

SEQ ID NO: 913825 - protein, 3105 aa, Homo sapiens
AAAGAAAAMSGSSGGAAAPAASSGPAAAASAAGSGCGGGAGEGAEEAAKDLADIAAFFRSGFRKNDEMKAMDVLPILKEKVAYLSGGRDKRGGPILTFPARSNHDRIRQEDLRRLISYLACIPSEEVCKRGFTVIVDMRGSKWDSIKPLLKILQESFPCCIHVALIIKPDNFWQKQRTNFGSSKFEFETNMVSLEGLTKVVDPSQLTPEFDGCLEYNHEEWIEIRVAFEDYISNATHMLSRLEELQDILAKKELPQDLEGARNMIEEHSQLKKKVIKAPIEDLDLEGQKLLQRIQSSESFPKKNSGSGNADLQNLLPKVSTMLDRLHSTRQHLHQMWHVRKLKLDQCFQLRLFEQDAEKMFDWITHNKGLFLNSYTEIGTSHPHAMELQTQHNHFAMNCMNVYVNINRIMSVANRLVESGHYASQQIRQIASQLEQEWKAFAAALDERSTLLDMSSIFHQKAEKYMSNVDSWCKACGEVDLPSELQDLEDAIHHHQGIYEHITLAYSEVSQDGKSLLDKLQRPLTPGSSDSLTASANYSKAVHHVLDVIHEVLHHQRQRENIWQHRKVRLHQRLQLCVFQQDVQQVLDWIENHGEAFLSKHTGVGKSLHRARALQKRHEDFEEVAQNTYTNADKLLEAAEQLAQTGECDPEEIYQAAHQLEDRIQDFVRRVEQRKILLDMSVSFHTHVKELWTWLEELQKELLDDVYAESVEAVQDLIKRFGQQQQTTLQVTVNVIKEGEDLIQQLRDSAISSNKTPHNSSINHIETVLQQLDEAQSQMEELFQERKIKLELFLHVRIFERDAIDIISDLESWNDELSQQMNDFDTEDLTIAEQRLQHHADKALTMNNLTFDVIHQGQDLLQYVNEVQASGVELLCDRDVDMATRVQDLLEFLHEKQQELDLAAEQHRKHLEQCVQLRHLQAEVKQVLGWIRNGESMLNAGLITASSLQEAEQLQREHEQFQHAIEKTHQSALQVQQKAEAMLQANHYDMDMIRDCAEKVASHWQQLMLKMEDRLKLVNASVAFYKTSEQVCSVLESLEQEYKREEDWCGGADKLGPNSETDHVTPMISKHLEQKEAFLKACTLARRNADVFLKYLHRNSVNMPGMVTHIKAPEQQVKNILNELFQRENRVLHYWTMRKRRLDQCQQYVVFERSAKQALEWIHDNGEFYLSTHTSTGSSIQHTQELLKEHEEFQITAKQTKERVKLLIQLADGFCEKGHAHAAEIKKCVTAVDKRYRDFSLRMEKYRTSLEKALGISSDSNKSSKSLQLDIIPASIPGSEVKLRDAAHELNEEKRKSARRKEFIMAELIQTEKAYVRDLRECMDTYLWEMTSGVEEIPPGIVNKELIIFGNMQEIYEFHNNIFLKELEKYEQLPEDVGHCFVTWADKFQMYVTYCKNKPDSTQLILEHAGSYFDEIQQRHGLANSISSYLIKPVQRITKYQLLLKELLTCCEEGKGEIKDGLEVMLSVPKRANDAMHLSMLEGFDENIESQGELILQESFQVWDPKTLIRKGRERHLFLFEMSLVFSKEVKDSSGRSKYLYKSKLFTSELGVTEHVEGDPCKFALWVGRTPTSDNKIVLKASSIENKQDWIKHIREVIQERTIHLKGALKEPIHIPKTAPATRQKGRRDGEDLDSQGDGSSQPDTISIASRTSQNTLDSDKLSGGCELTVVIHDFTACNSNELTIRRGQTVEVLERPHDKPDWCLVRTTDRSPAAEGLVPCGSLCIAHSRSSMEMEGIFNHKDSLSVSSNDASPPASVASLQPHMIGAQSSPGPKRPGNTLRKWLTSPVRRLSSGKADGHVKKLAHKHKKSREVRKSADAGSQKDSDDSAATPQDETVEERGRNEGLSSGTLSKSSSSGMQSCGEEEGEEGADAVPLPPPMAIQQHSLLQPDSQDDKASSRLLVRPTSSETPSAAELVSAIEELVKSKMALEDRPSSLLVDQGDSSSPSFNPSDNSLLSSSSPIDEMEERKSSSLKRRHYVLQELVETERDYVRDLGYVVEGYMALMKEDGVPDDMKGKDKIVFGNIHQIYDWHRDFFLGELEKCLEDPEKLGSLFVKHERRLHMYIAYCQNKPKSEHIVSEYIDTFFEDLKQRLGHRLQLTDLLIKPVQRIMKYQLLLKDFLKYSKKASLDTSELERAVEVMCIVPRRCNDMMNVGRLQGFDGKIVAQGKLLLQDTFLVTDQDAGLLPRCRERRIFLFEQIVIFSEPLDKKKGFSMPGFLFKNSIKVSCLCLEENVENDPCKFALTSRTGDVVETFILHSSSPSVRQTWIHEINQILENQRNFLNALTSPIEYQRNHSGGGGGGGSGGSGGGGGSGGGGAPSGGSGHSGGPSSCGGAPSTSRSRPSRIPQPVRHHPPVLVSSAASSQAEADKMSGTSTPGPSLPPPGAAPEAGPSAPSRRPPGADAEGSEREAEPIPKMKVLESPRKGAANASGSSPDAPAKDARASLGTLPLGKPRAGAASPLNSPLSSAVPSLGKEPFPPSSPLQKGGSFWSSIPASPASRPGSFTFPGDSDSLQRQTPRHAAPGKDTDRMSTCSSASEQSVQSTQSNGSESSSSSNISTMLVTHDYTAVKEDEINVYQGEVVQILASNQQNMFLVFRAATDQCPAAEGWIPGFVLGHTSAVIVENPDGTLKKSTSWHTALRLRKKSEKKDKDGKREGKLENGYRKSREGLSNKVSVKLLNPNYIYDVPPEFVIPLSEVTCETGETVVLRCRVCGRPKASITWKGPEHNTLNNDGHYSISYSDLGEATLKIVGVTTEDDGIYTCIAVNDMGSASSSASLRVLGPGMDGIMVTWKDNFDSFYSEVAELGRGRFSVVKKCDQKGTKRAVATKFVNKKLMKRDQVTHELGILQSLQHPLLVGLLDTFETPTSYILVLEMADQGRLLDCVVRWGSLTEGKIRAHLGEVLEAVRYLHNCRIAHLDLKPENILVDESLAKPTIKLADFGDAVQLNTTYYIHQLLGNPEFAAPEIILGNPVSLTSDTWSVGVLTYVLLSGVSPFLDDSVEETCLNICRLDFSFPDDYFKGVSQKAKEFVCFLLQEDPAKRPSAALALQEQWLQAGNGRSTGVLDTSRLTSFIERRKHQNDVRPIRSIKNFLQSRLLPRV

SEQ ID NO: 913826 - protein, 889 aa, Homo sapiens; identical to SEQ ID NO: 913813

SEQ ID NO: 913827 - protein, 542 aa, Homo sapiens [sequence omitted]

SEQ ID NO: 913828 - protein, 2095 aa, Homo sapiens
AAAGAAAAMSGSSGGAAAPAASSGPAAAASAAGSGCGGGAGEGAEEAAKDLADIAAFFRSGFRKNDEMKAMDVLPILKEKVAYLSGGRDKRGGPILTFPARSNHDRIRQEDLRRLISYLACIPSEEVCKRGFTVIVDMRGSKWDSIKPLLKILQESFPCCIHVALIIKPDNFWQKQRTNFGSSKFEFETNMVSLEGLTKVVDPSQLTPEFDGCLEYNHEEWIEIRVAFEDYISNATHMLSRLEELQDILAKKELPQDLEGARNMIEEHSQLKKKVIKAPIEDLDLEGQKLLQRIQSSESFPKKNSGSGNADLQNLLPKVSTMLDRLHSTRQHLHQMWHVRKLKLDQCFQLRLFEQDAEKMFDWITHNKGLFLNSYTEIGTSHPHAMELQTQHNHFAMNCMNVYVNINRIMSVANRLVESGHYASQQIRQIASQLEQEWKAFAAALDERSTLLDMSSIFHQKAEKYMSNVDSWCKACGEVDLPSELQDLEDAIHHHQGIYEHITLAYSEVSQDGKSLLDKLQRPLTPGSSDSLTASANYSKAVHHVLDVIHEVLHHQRQRENIWQHRKVRLHQRLQLCVFQQDVQQVLDWIENHGEAFLSKHTGVGKSLHRARALQKRHEDFEEVAQNTYTNADKLLEAAEQLAQTGECDPEEIYQAAHQLEDRIQDFVRRVEQRKILLDMSVSFHTHVKELWTWLEELQKELLDDVYAESVEAVQDLIKRFGQQQQTTLQVTVNVIKEGEDLIQQLRDSAISSNKTPHNSSINHIETVLQQLDEAQSQMEELFQERKIKLELFLHVRIFERDAIDIISDLESWNDELSQQMNDFDTEDLTIAEQRLQHHADKALTMNNLTFDVIHQGQDLLQYVNEVQASGVELLCDRDVDMATRVQDLLEFLHEKQQELDLAAEQHRKHLEQCVQLRHLQAEVKQVLGWIRNGESMLNAGLITASSLQEAEQLQREHEQFQHAIEKTHQSALQVQQKAEAMLQANHYDMDMIRDCAEKVASHWQQLMLKMEDRLKLVNASVAFYKTSEQVCSVLESLEQEYKREEDWCGGADKLGPNSETDHVTPMISKHLEQKEAFLKACTLARRNADVFLKYLHRNSVNMPGMVTHIKAPEQQVKNILNELFQRENRVLHYWTMRKRRLDQCQQYVVFERSAKQALEWIHDNGEFYLSTHTSTGSSIQHTQELLKEHEEFQITAKQTKERVKLLIQLADGFCEKGHAHAAEIKKCVTAVDKRYRDFSLRMEKYRTSLEKALGISSDSNKSSKSLQLDIIPASIPGSEVKLRDAAHELNEEKRKSARRKEFIMAELIQTEKAYVRDLRECMDTYLWEMTSGVEEIPPGIVNKELIIFGNMQEIYEFHNNIFLKELEKYEQLPEDVGHCFVTWADKFQMYVTYCKNKPDSTQLILEHAGSYFDEIQQRHGLANSISSYLIKPVQRITKYQLLLKELLTCCEEGKGEIKDGLEVMLSVPKRANDAMHLSMLEGFDENIESQGELILQESFQVWDPKTLIRKGRERHLFLFEMSLVFSKEVKDSSGRSKYLYKSKLFTSELGVTEHVEGDPCKFALWVGRTPTSDNKIVLKASSIENKQDWIKHIREVIQERTIHLKGALKEPIHIPKTAPATRQKGRRDGEDLDSQGDGSSQPDTISIASRTSQNTLDSDKLSGGCELTVVIHDFTACNSNELTIRRGQTVEVLERPHDKPDWCLVRTTDRSPAAEGLVPCGSLCIAHSRSSMEMEGIFNHKDSLSVSSNDASPPASVASLQPHMIGAQSSPGPKRPGNTLRKWLTSPVRRLSSGKADGHVKKLAHKHKKSREVRKSADAGSQKDSDDSAATPQDETVEERGRNEGLSSGTLSKSSSSGMQSCGEEEGEEGADAVPLPPPMAIQQHSLLQPDSQDDKASSRLLVRPTSSETPSAAELVSAIEELVKSKMALEDRPSSLLVDQGDSSSPSFNPSDNSLLSSSSPIDEMEERKSSSLKRRHYVLQELVETERDYVRDLGYVVEGYMALMKEDGVPDDMKGKDKIVFGNIHQIYDWHRDFFLGELEKCLEDPEKLGSLFVKHVSTIALLISCSDGVILSHWFVRLKENSLILYVSAYV

SEQ ID NO: 913829 - protein, 2008 aa, Homo sapiens
AAAGAAAAMSGSSGGAAAPAASSGPAAAASAAGSGCGGGAGEGAEEAAKDLADIAAFFRSGFRKNDEMKAMDVLPILKEKVAYLSGGRDKRGGPILTFPARSNHDRIRQEDLRRLISYLACIPSEEVCKRGFTVIVDMRGSKWDSIKPLLKILQESFPCCIHVALIIKPDNFWQKQRTNFGSSKFEFETNMVSLEGLTKVVDPSQLTPEFDGCLEYNHEEWIEIRVAFEDYISNATHMLSRLEELQDILAKKELPQDLEGARNMIEEHSQLKKKVIKAPIEDLDLEGQKLLQRIQSSESFPKKNSGSGNADLQNLLPKVSTMLDRLHSTRQHLHQMWHVRKLKLDQCFQLRLFEQDAEKMFDWITHNKGLFLNSYTEIGTSHPHAMELQTQHNHFAMNCMNVYVNINRIMSVANRLVESGHYASQQIRQIASQLEQEWKAFAAALDERSTLLDMSSIFHQKAEKYMSNVDSWCKACGEVDLPSELQDLEDAIHHHQGIYEHITLAYSEVSQDGKSLLDKLQRPLTPGSSDSLTASANYSKAVHHVLDVIHEVLHHQRQRENIWQHRKVRLHQRLQLCVFQQDVQQVLDWIENHGEAFLSKHTGVGKSLHRARALQKRHEDFEEVAQNTYTNADKLLEAAEQLAQTGECDPEEIYQAAHQLEDRIQDFVRRVEQRKILLDMSVSFHTHVKELWTWLEELQKELLDDVYAESVEAVQDLIKRFGQQQQTTLQVTVNVIKEGEDLIQQLRDSAISSNKTPHNSSINHIETVLQQLDEAQSQMEELFQERKIKLELFLHVRIFERDAIDIISDLESWNDELSQQMNDFDTEDLTIAEQRLQHHADKALTMNNLTFDVIHQGQDLLQYVNEVQASGVELLCDRDVDMATRVQDLLEFLHEKQQELDLAAEQHRKHLEQCVQLRHLQAEVKQVLGWIRNGESMLNAGLITASSLQEAEQLQREHEQFQHAIEKTHQSALQVQQKAEAMLQANHYDMDMIRDCAEKVASHWQQLMLKMEDRLKLVNASVAFYKTSEQVCSVLESLEQEYKREEDWCGGADKLGPNSETDHVTPMISKHLEQKEAFLKACTLARRNADVFLKYLHRNSVNMPGMVTHIKAPEQQVKNILNELFQRENRVLHYWTMRKRRLDQCQQYVVFERSAKQALEWIHDNGEFYLSTHTSTGSSIQHTQELLKEHEEFQITAKQTKERVKLLIQLADGFCEKGHAHAAEIKKCVTAVDKRYRDFSLRMEKYRTSLEKALGISSDSNKSSKSLQLDIIPASIPGSEVKLRDAAHELNEEKRKSARRKEFIMAELIQTEKAYVRDLRECMDTYLWEMTSGVEEIPPGIVNKELIIFGNMQEIYEFHNNIFLKELEKYEQLPEDVGHCFVTWADKFQMYVTYCKNKPDSTQLILEHAGSYFDEIQQRHGLANSISSYLIKPVQRITKYQLLLKELLTCCEEGKGEIKDGLEVMLSVPKRANDAMHLSMLEGFDENIESQGELILQESFQVWDPKTLIRKGRERHLFLFEMSLVFSKEVKDSSGRSKYLYKSKLFTSELGVTEHVEGDPCKFALWVGRTPTSDNKIVLKASSIENKQDWIKHIREVIQERTIHLKGALKEPIHIPKTAPATRQKGRRDGEDLDSQGDGSSQPDTISIASRTSQNTLDSDKLSGGCELTVVIHDFTACNSNELTIRRGQTVEVLERPHDKPDWCLVRTTDRSPAAEGLVPCGSLCIAHSRSSMEMEGIFNHKDSLSVSSNDASPPASVASLQPHMIGAQSSPGPKRPGNTLRKWLTSPVRRLSSGKADGHVKKLAHKHKKSREVRKSADAGSQKDSDDSAATPQDETVEERGRNEGLSSGTLSKSSSSGMQSCGEEEGEEGADAVPLPPPMAIQQHSLLQPDSQDDKASSRLLVRPTSSETPSAAELVSAIEELVKSKMVRPPRESLTFGSCSVLLLADGFALVFVLLWAAECGCGLWHISGVPMTTLGFTDLKDSENSGKPLFPHLQCIPMKGHRSK

SEQ ID NO: 913830 - protein, 1423 aa, Homo sapiens
AAAGAAAAMSGSSGGAAAPAASSGPAAAASAAGSGCGGGAGEGAEEAAKDLADIAAFFRSGFRKNDEMKAMDVLPILKEKVAYLSGGRDKRGGPILTFPARSNHDRIRQEDLRRLISYLACIPSEEVCKRGFTVIVDMRGSKWDSIKPLLKILQESFPCCIHVALIIKPDNFWQKQRTNFGSSKFEFETNMVSLEGLTKVVDPSQLTPEFDGCLEYNHEEWIEIRVAFEDYISNATHMLSRLEELQDILAKKELPQDLEGARNMIEEHSQLKKKVIKAPIEDLDLEGQKLLQRIQSSESFPKKNSGSGNADLQNLLPKVSTMLDRLHSTRQHLHQMWHVRKLKLDQCFQLRLFEQDAEKMFDWITHNKGLFLNSYTEIGTSHPHAMELQTQHNHFAMNCMNVYVNINRIMSVANRLVESGHYASQQIRQIASQLEQEWKAFAAALDERSTLLDMSSIFHQKAEKYMSNVDSWCKACGEVDLPSELQDLEDAIHHHQGIYEHITLAYSEVSQDGKSLLDKLQRPLTPGSSDSLTASANYSKAVHHVLDVIHEVLHHQRQRENIWQHRKVRLHQRLQLCVFQQDVQQVLDWIENHGEAFLSKHTGVGKSLHRARALQKRHEDFEEVAQNTYTNADKLLEAAEQLAQTGECDPEEIYQAAHQLEDRIQDFVRRVEQRKILLDMSVSFHTHVKELWTWLEELQKELLDDVYAESVEAVQDLIKRFGQQQQTTLQVTVNVIKEGEDLIQQLRDSAISSNKTPHNSSINHIETVLQQLDEAQSQMEELFQERKIKLELFLHVRIFERDAIDIISDLESWNDELSQQMNDFDTEDLTIAEQRLQHHADKALTMNNLTFDVIHQGQDLLQYVNEVQASGVELLCDRDVDMATRVQDLLEFLHEKQQELDLAAEQHRKHLEQCVQLRHLQAEVKQVLGWIRNGESMLNAGLITASSLQEAEQLQREHEQFQHAIEKTHQSALQVQQKAEAMLQANHYDMDMIRDCAEKVASHWQQLMLKMEDRLKLVNASVAFYKTSEQVCSVLESLEQEYKREEDWCGGADKLGPNSETDHVTPMISKHLEQKEAFLKACTLARRNADVFLKYLHRNSVNMPGMVTHIKAPEQQVKNILNELFQRENRVLHYWTMRKRRLDQCQQYVVFERSAKQALEWIHDNGEFYLSTHTSTGSSIQHTQELLKEHEEFQITAKQTKERVKLLIQLADGFCEKGHAHAAEIKKCVTAVDKRYRDFSLRMEKYRTSLEKALGISSDSNKSSKSLQLDIIPASIPGSEVKLRDAAHELNEEKRKSARRKEFIMAELIQTEKAYVRDLRECMDTYLWEMTSGVEEIPPGIVNKELIIFGNMQEIYEFHNNIFLKELEKYEQLPEDVGHCFVTWADKFQMYVTYCKNKPDSTQLILEHAGSYFDVSNRFLKRP

SEQ ID NO: 913831 - protein, 1110 aa, Homo sapiens
AAAGAAAAMSGSSGGAAAPAASSGPAAAASAAGSGCGGGAGEGAEEAAKDLADIAAFFRSGFRKNDEMKAMDVLPILKEKVAYLSGGRDKRGGPILTFPARSNHDRIRQEDLRRLISYLACIPSEEVCKRGFTVIVDMRGSKWDSIKPLLKILQESFPCCIHVALIIKPDNFWQKQRTNFGSSKFEFETNMVSLEGLTKVVDPSQLTPEFDGCLEYNHEEWIEIRVAFEDYISNATHMLSRLEELQDILAKKELPQDLEGARNMIEEHSQLKKKVIKAPIEDLDLEGQKLLQRIQSSESFPKKNSGSGNADLQNLLPKVSTMLDRLHSTRQHLHQMWHVRKLKLDQCFQLRLFEQDAEKMFDWITHNKGLFLNSYTEIGTSHPHAMELQTQHNHFAMNCMNVYVNINRIMSVANRLVESGHYASQQIRQIASQLEQEWKAFAAALDERSTLLDMSSIFHQKAEKYMSNVDSWCKACGEVDLPSELQDLEDAIHHHQGIYEHITLAYSEVSQDGKSLLDKLQRPLTPGSSDSLTASANYSKAVHHVLDVIHEVLHHQRQRENIWQHRKVRLHQRLQLCVFQQDVQQVLDWIENHGEAFLSKHTGVGKSLHRARALQKRHEDFEEVAQNTYTNADKLLEAAEQLAQTGECDPEEIYQAAHQLEDRIQDFVRRVEQRKILLDMSVSFHTHVKELWTWLEELQKELLDDVYAESVEAVQDLIKRFGQQQQTTLQVTVNVIKEGEDLIQQLRDSAISSNKTPHNSSINHIETVLQQLDEAQSQMEELFQERKIKLELFLHVRIFERDAIDIISDLESWNDELSQQMNDFDTEDLTIAEQRLQHHADKALTMNNLTFDVIHQGQDLLQYVNEVQASGVELLCDRDVDMATRVQDLLEFLHEKQQELDLAAEQHRKHLEQCVQLRHLQAEVKQVLGWIRNGESMLNAGLITASSLQEAEQLQREHEQFQHAIEKTHQSALQVQQKAEAMLQANHYDMDMIRDCAEKVASHWQQLMLKMEDRLKLVNASVAFYKTSEQVCSVLESLEQEYKREEDWCGGADKLGPNSETDHVTPMISKHLEQKEAFLKACTLARRNADVFLKYPAQDHTPAQEGSSRS

SEQ ID NO: 913832 - protein, 409 aa, Homo sapiens
AAAGAAAAMSGSSGGAAAPAASSGPAAAASAAGSGCGGGAGEGAEEAAKDLADIAAFFRSGFRKNDEMKAMDVLPILKEKVAYLSGGRDKRGGPILTFPARSNHDRIRQEDLRRLISYLACIPSEEVCKRGFTVIVDMRGSKWDSIKPLLKILQESFPCCIHVALIIKPDNFWQKQRTNFGSSKFEFETNMVSLEGLTKVVDPSQLTPEFDGCLEYNHEEWIEIRVAFEDYISNATHMLSRLEELQDILAKKELPQDLEGARNMIEEHSQLKKKVIKAPIEDLDLEGQKLLQRIQSSESFPKKNSGSGNADLQNLLPKVSTMLDRLHSTRQHLHQMWHVRKLKLDQCFQLRLFEQDAEKVKTGEANASVDMGEASAGGFGWKEREKVENGKAILTVCALNQRESFQKWH

SEQ ID NO: 913833 - protein, 199 aa, Homo sapiens
AAAGAAAAMSGSSGGAAAPAASSGPAAAASAAGSGCGGGAGEGAEEAAKDLADIAAFFRSGFRKNDEMKAMDVLPILKEKVAYLSGGRDKRGGPILTFPARSNHDRIRQEDLRRLISYLACIPSEEVCKRGFTVIVDMRGSKWDSIKPLLKILQESFPCCIHVALIIKPDNFWQKQRTNFGSSKFEFEVTSPVWLDPLN

SEQ ID NO: 913834 - protein, 206 aa, Homo sapiens
MAANKPKGQNSLALHKVIMVGSGGVGKSALTLQFMYDEFVEDYEPTKADSYRKKVVLDGEEVQIDILDTAGQEDYAAIRDNYFRSGEGFLCVFSITEMESFAATADFREQILRVKEDENVPFLLVGNKSDLEDKRQVSVEEAKNRAEQWNVNYVETSAKTRANVDKVFFDLMREIRARKMEDSKEKNGKKKRKSLAKRIRERCCIL

SEQ ID NO: 913835 - protein, 206 aa, Homo sapiens; identical to SEQ ID NO: 913834

SEQ ID NO: 913836 - protein, 170 aa, Homo sapiens [sequence omitted]

SEQ ID NO: 913837 - protein, 206 aa, Homo sapiens; identical to SEQ ID NO: 913834

SEQ ID NO: 913838 - protein, 136 aa, Homo sapiens
MAANKPKGQNSLALHKVIMVGSGGVGKSALTLQFMYDEFVEDYEPTKADSYRKKVVLDGEEVQIDILDTAGQEDYAAIRDNYFRSGEGFLCVFSITEMESFAATADFRGKNFKEIKKDEELFPFSYWVWVTKIQEF

SEQ ID NO: 913839 - protein, 188 aa, Homo sapiens
MVGSGGVGKSALTLQFMYDEFVEDYEPTKADSYRKKVVLDGEEVQIDILDTAGQEDYAAIRDNYFRSGEGFLCVFSITEMESFAATADFREQILRVKEDENVPFLLVGNKSDLEDKRQVSVEEAKNRAEQWNVNYVETSAKTRANVDKVFFDLMREIRARKMEDSKEKNGKKKRKSLAKRIRERCCIL

SEQ ID NO: 913840 - protein, 126 aa, Homo sapiens
PRPAPQRPGSDLWRLLQSRQEEGGSPQSKASESSSSFSSSSSSSSSRPGSPATRQTPPSTAPGAGPSRRQGPSTLRPEPRSRGFRSPRGGGLARGAGVFLLTPGVRCPMCPGEKIYAWHSFCIENS

SEQ ID NO: 913841 - protein, 745 aa, Homo sapiens [sequence omitted]

SEQ ID NO: 913842 - protein, 739 aa, Homo sapiens
GRTRLVPRGGAPPGEEEEEKVERKRRPLCPRPLKALTSGARALTGQESQVPPLGLPEEAATLEGPEPTAPGPQHHPGGLKRQSQGPSQGFQLPRQQAQGQSNNPSSHLPQLLARCIVRKDPRAFGWQLLQWLLIALPATFVNSAIRYLEGQLALSFRSRLVAHAYRLYFSQQTYYRVSNMDGRLRNPDQSLTEDVVAFAASVAHLYSNLTKPLLDVAVTSYTLLRAARSRGAGTAWPSAIAGLVVFLTANVLRAFSPKFGELVAEEARRKGELRYMHSRVVANSEEIAFYGGHEVELALLQRSYQDLASQINLILLERLWYVMLEQFLMKYVWSASGLLMVAVPIITATGYSESDAEAVKKAALEKKEEELVSERTEAFTIARNLLTAAADAIERIMSSYKEVTELAGYTARVHEMFQVFEDVQRCHFKRPRELEDAQAGSGTIGRSGVRVEGPLKIRGQVVDVEQGIICENIPIVTPSGEVVVASLNIRVEEGMHLLITGPNGCGKSSLFRILGGLWPTYGGVLYKPPPQRMFYIPQRPYMSVGSLRDQVIYPDSVEDMQRKGYSEQDLEAILDVVHLHHILQREGGWEAMCDWKDVLSGGEKQRIGMARMFYHRPKYALLDECTSAVSIDVEGKIFQAAKDAGIALLSITHRPSLWKYHTHLLQFDGEGGWKFEKLDSAARLSLTEEKQRLEQQLAGIPKMQRRLQELCQILGEAVAPAHVPAPSPQGPGGLQGAST

SEQ ID NO: 913843 - protein, 490 aa, Homo sapiens
MPVLSRPRPWRGNTLKRTAVLLALAAYGAHKVYPLVRQCLAPARGLQAPAGEPTQEASGVAAAKAGMNRVFLQRLLWLLRLLFPRVLCRETGLLALHSAALVSRTFLSVYVARLDGRLARCIVRKDPRAFGWQLLQWLLIALPATFVNSAIRYLEGQLALSFRSRLVAHAYRLYFSQQTYYRVSNMDGRLRNPDQSLTEDVVAFAASVAHLYSNLTKPLLDVAVTSYTLLRAARSRGAGTAWPSAIAGLVVFLTANVLRAFSPKFGELVAEEARRKGELRYMHSRVVANSEEIAFYGGHEVELALLQRSYQDLASQINLILLERLWYVMLEQFLMKYVWSASGLLMVAVPIITATGYSESGETQGSKRIQARGLSPIPLGAELTRAQLSQPAATSAAGATEALLPALMLSEVELALPLLVAFCPARTSRPLLPLRQAQDCKSGTLHVTSPGTDTLTHLSLSSTQLRLRGGRMCGVPGVSPFITPALVSSP

SEQ ID NO: 913844 - protein, 745 aa, Homo sapiens [sequence omitted]

SEQ ID NO: 913845 - protein, 745 aa, Homo sapiens [sequence omitted]

SEQ ID NO: 913846 - protein, 745 aa, Homo sapiens [sequence omitted]

SEQ ID NO: 913847 - protein, 412 aa, Homo sapiens
LFSTVAAPFYLPASSVGGFHLFIVASTDAEAVKKAALEKKEEELVSERTEAFTIARNLLTAAADAIERIMSSYKEVTELAGYTARVHEMFQVFEDVQRCHFKRPRELEDAQAGSGTIGRSGVRVEGPLKIRGQVVDVEQGIICENIPIVTPSGEVVVASLNIRVEEGMHLLITGPNGCGKSSLFRILGGLWPTYGGVLYKPPPQRMFYIPQRPYMSVGSLRDQVIYPDSVEDMQRKGYSEQDLEAILDVVHLHHILQREGGWEAMCDWKDVLSGGEKQRIGMARMFYHRPKYALLDECTSAVSIDVEGKIFQAAKDAGIALLSITHRPSLWKYHTHLLQFDGEGGWKFEKLDSAARLSLTEEKQRLEQQLAGIPKMQRRLQELCQILGEAVAPAHVPAPSPQGPGGLQGAST

SEQ ID NO: 913848 - protein, 214 aa, Homo sapiens
MGCDGGTIPKRHELVKGPKKVEKVDKDAELVAQWNYCTLSQEILRRPIVACELGRLYNKDAVIEFLLDKSAEKALGKAASHIKSIKNVTELKLSDNPAWEGDKGNTKGDKHDDLQRARFICPVVGLEMNGRHRFCFLRCCGCVFSERALKEIKAEVCHTCGAAFQEDDVIVLNGTKEDVDVLKTRMEERRLRAKLGKENKETQGSRVCFKTRCQ

SEQ ID NO: 913849 - protein, 214 aa, Homo sapiens; identical to SEQ ID NO: 913848

SEQ ID NO: 913850 - protein, 214 aa, Homo sapiens; identical to SEQ ID NO: 913848

SEQ ID NO: 913851 - protein, 214 aa, Homo sapiens; identical to SEQ ID NO: 913848

SEQ ID NO: 913852 - protein, 263 aa, Homo sapiens
KQNMSQGTRLGVGSDSRPAMGCDGGTIPKRHELVKGPKKVEKIWHLKNGKEWCSLHSEGKNKNGKEWDMEYDVDKDAELVAQWNYCTLSQEILRRPIVACELGRLYNKDAVIEFLLDKSAEKALGKAASHIKSIKNVTELKLSDNPAWEGDKGNTKGDKHDDLQRARFICPVVGLEMNGRHRFCFLRCCGCVFSERALKEIKAEVCHTCGAAFQEDDVIVLNGTKEDVDVLKTRMEERRLRAKLGKENKETQGSRVCFKTRCQ

SEQ ID NO: 913853 - protein, 195 aa, Homo sapiens
MEYDVDKDAELVAQWNYCTLSQEILRRPIVACELGRLYNKDAVIEFLLDKSAEKALGKAASHIKSIKNVTELKLSDNPAWEGDKGNTKGDKHDDLQRARFICPVVGLEMNGRHRFCFLRCCGCVFSERALKEIKAEVCHTCGAAFQEDDVIVLNGTKEDVDVLKTRMEERRLRAKLGKENKETQGSRVCFKTRCQ

SEQ ID NO: 913854 - protein, 195 aa, Homo sapiens; identical to SEQ ID NO: 913853

SEQ ID NO: 913855 - protein, 121 aa, Homo sapiens
SRGAYFFMVRRKTRIYMHDDLQRARFICPVVGLEMNGRHRFCFLRCCGCVFSERALKEIKAEVCHTCGAAFQEDDVIVLNGTKEDVDVLKTRMEERRLRAKLGKENKETQGSRVCFKTRCQ

SEQ ID NO: 913856 - protein, 104 aa, Homo sapiens
MGCDGGTIPKRHELVKGPKKVEKVDKDAELVAQWNYCTLSQEILRRPIVACELGRLYNKDAVIEFKEDVDVLKTRMEERRLRAKLGKENKETQGSRVCFKTRCQ

SEQ ID NO: 913857 - protein, 214 aa, Homo sapiens; identical to SEQ ID NO: 913848

SEQ ID NO: 913858 - protein, 214 aa, Homo sapiens
MGCDGGTIPKRHELVKGPKKVEKVDKDAELVAQWNYCTLSQEILRRPIVACELGRLYNKDAVIEFLLDKSAEKALGKAASHIKSIKNVTELKLSDNPAWEGDKGNTKGDKHDDLQRARFICPVVGLEMNGRHRFCFLRCCGCVFSERALKEIKAEVCHTCGAAFQEDDVIVLNGTKEDVDVLKTRMTSLRLLTKPVHLPLCSLLFVSSCCSPLL

SEQ ID NO: 913859 - protein, 214 aa, Homo sapiens; identical to SEQ ID NO: 913848

SEQ ID NO: 913860 - protein, 214 aa, Homo sapiens; identical to SEQ ID NO: 913848

SEQ ID NO: 913861 - protein, 195 aa, Homo sapiens; identical to SEQ ID NO: 913853

SEQ ID NO: 913862 - protein, 214 aa, Homo sapiens; identical to SEQ ID NO: 913848

SEQ ID NO: 913863 - protein, 288 aa, Homo sapiens
MGCDGGTIPKRHELVKGPKKVEKVDKDAELVAQWNYCTLSQEILRRPIVACELGRLYNKDAVIEFLLDKSAEKALGKAASHIKSIKNVTELKLSDNPAWEGDKGNTKGDKHDDLQRARFICPVVGLEMNGRHRFCFLRCCGCVFSERALKEIKAEVCHTCGAAFQEDDVIVLNGTKEDVDVLKTRMEERRLRAKLGKEAPGPSKVKTGKPEEASLDSREKKTNLAPKSTAMNESSSGKAGKPPCGATKRSIADSEESEAYKSLFTTHSSAKRSKEESAHWVTHTSYCF

SEQ ID NO: 913864 - protein, 135 aa, Homo sapiens
PGTDCVTVPDTTDWMDDERLSATLEKKTKKPKAAESVSKPDVSEEAPGPSKVKTGKPEEASLDSREKKTNLAPKSTAMNESSSGKAGKPPCGATKRSIADSEESEAYKSLFTTHSSAKRSKEESAHWVTHTSYCF

SEQ ID NO: 913865 - protein, 105 aa, Homo sapiens
MGPGHQKHQAKIRSLELSAPPHPHPSGRRRGIGHGVNNPSCLRGGVSIKIPEVEGLEIFWVADNIHKEDVDVLKTRMEERRLRAKLGKENKETQGSRVCFKTRCQ

SEQ ID NO: 913866 - protein, 631 aa, Homo sapiens
MTPALTALLCLGLSLGPRTRVQAGPFPKPTLWAEPGSVISWGSPVTIWCQGSLEAQEYQLDKEGSPEPWDRNNPLEPKNKARFSIPSMTQHHAGRYRCHYYSSAGWSEPSDPLELVMTGFYNKPTLSALPSPVVASGGNMTLRCGSQKGYHHFVLMKEGEHQLPRTLDSQQLHSGGFQALFPVGPVTPSHRWRFTCYYYYTNTPWVWSHPSDPLEILPSGVSRKPSLLTLQGPVLAPGQSLTLQCGSDVGYDRFVLYKEGERDFLQRPGQQPQAGLSQANFTLGPVSPSYGGQYRCYGAHNLSSEWSAPSDPLNILMAGQIYDTVSLSAQPGPTVASGENVTLLCQSWWQFDTFLLTKEGAAHPPLRLRSMYGAHKYQAEFPMSPVTSAHAGTYRCYGSRSSNPHLLSLPSEPLELMVSGHSGGSSLPPTGPPSTPGLGRYLEVLIGVSVAFVLLLFLLLFLLLRRQRHSKHRTSDQRKTDFQRPAGAAETEPKDRGLLRRSSPAADVQEENLYAAVKDTQSEDRVELDSQSPHDEDPQAVTYAPVKHSSPRREMASPPSSLSGEFLDTKDRQVEEDRQMDTEAAASEASQDVTYAQLHSLTLRRKATEPPPSQEGEPPAEPSIYATLAIH

SEQ ID NO: 913867 - protein, 631 aa, Homo sapiens
MTPALTALLCLGLSLGPRTRVQAGPFPKPTLWAEPGSVISWGSPVTIWCQGSLEAQEYQLDKEGSPEPWDRNNPLEPKNKARFSIPSMTQHHAGRYRCHYYSSAGWSEPSDPLELVMTGAYSKPTLSALPSPVVASGGNMTLRCGSQKRYHHFVLMKEGEHQLPRTLDSQQLHSGGFQALFPVGPVNPSHRWRFTCYYYYMNTPRVWSHPSDPLEILPSGVSRKPSLLTLQGPVLAPGQSLTLQCGSDVGYDRFVLYKEGERDFLQRPGQQPQAGLSQANFTLGPVSPSNGGQYRCYGAHNLSSEWSAPSDPLNILMAGQIYDTVSLSAQPGPTVASGENVTLLCQSWWQFDTFLLTKEGAAHPPLRLRSMYGAHKYQAEFPMSPVTSAHAGTYRCYGSRSSNPHLLSLPSEPLELMVSGHSGGSSLPPTGPPSTPGLGRYLEVLIGVSVAFVLLLFLLLFLLLRRQRHSKHRTSDQRKTDFQRPAGAAETEPKDRGLLRRSSPAADVQEENLYAAVKDTQSEDRVELDSQSPHDEDPQAVTYAPVKHSSPRREMASPPSSLSGEFLDTKDRQVEEDRQMDTEAAASEASQDVTYAQLHSLTLRRKATEPPPSQEGEPPAEPSIYATLAIH

SEQ ID NO: 913868 - protein, 315 aa, Homo sapiens
MAGQIYDTVSLSAQPGPTVASGENVTLLCQSWWQFDTFLLTKEGAAHPPLRLRSMYGAHKYQAEFPMSPVTSAHAGTYRCYGSRSSNPHLLSLPSEPLELMVSGHSGGSSLPPTGPPSTPGLGRYLEVLIGVSVAFVLLLFLLLFLLLRRQRHSKHRTSDQRKTDFQRPAGAAETEPKDRGLLRRSSPAADVQEENLYAAVKDTQSEDRVELDSQSPHDEDPQAVTYAPVKHSSPRREMASPPSSLSGEFLDTKDRQVEEDRQMDTEAAASEASQDVTYAQLHSLTLRRKATEPPPSQEGEPPAEPSIYATLAIH

SEQ ID NO: 913869 - protein, 194 aa, Homo sapiens
MTPALTALLCLGLSLGPRTRVQAGPFPKPTLWAEPGSVISWGSPVTIWCQGSLEAQEYQLDKEGSPEPWDRNNPLEPKNKARFSIPSMTQHHAGRYRCHYYSSAGWSEPSDPLELVMTGFYNKPTLSALPSPVVASGGNMTLRCGSQKGYHHFVLMKEGEHQLPRTLDSQQLHSGGFQALFPVGPVTPSHRWRV

SEQ ID NO: 913870 - protein, 106 aa, Homo sapiens
MTSFPLLTSSCQGLGRYLEVLIGVSVAFVLLLFLLLFLLLRRQRHSKHRTSDQRKTDFQRPAGAAETEPKDRGLLRRSSPAADVQEENLCKRKRGDKWGCWRDRSP

SEQ ID NO: 913871 - protein, 461 aa, Homo sapiens
MQAGPFPKPTLWAEPGSVISWGSPVTIWCQGSLEAQEYQLDKEGSPEPWDRNNPLEPKNKARFSIPSMTQHHAGRYRCHYYSSAGWSEPSDPLELVMTGFYNKPTLSALPSPVVASGGNMTLRCGSQKGYHHFVLMKEGEHQLPRTLDSQQLHSGGFQALFPVGPVTPSHRWRFTCYYYYTNTPWVWSHPSDPLEILPSGVSRKPSLLTLQGPVLAPGQSLTLQCGSDVGYDRFVLYKEGERDFLQRPGQQPQAGLSQANFTLGPVSPSYGGQYRCYGAHNLSSEWSAPSDPLNILMAGQIYDTVSLSAQPGPTVASGENVTLLCQSWWQFDTFLLTKEGAAHPPLRLRSMYGAHKYQAEFPMSPVTSAHAGTYRCYGSYSSNPHLLSFPSEPLELMVSGHSGGSSLPPTGPPSTPASHAKDYTVENLIRMGMAGLVLVFLGILLFEAQHSQRNPQDAARR

SEQ ID NO: 913872 - protein, 489 aa, Homo sapiens
MTPALTALLCLGLSLGPRTRVQAGPFPKPTLWAEPGSVISWGSPVTIWCQGSLEAQEYQLDKEGSPEPWDRNNPLEPKNKARFSIPSMTQHHAGRYRCHYYSSAGWSEPSDPLELVMTGFYNKPTLSALPSPVVASGGNMTLRCGSQKGYHHFVLMKEGEHQLPRTLDSQQLHSGGFQALFPVGPVTPSHRWRFTCYYYYTNTPWVWSHPSDPLEILPSGVSRKPSLLTLQGPVLAPGQSLTLQCGSDVGYDRFVLYKEGERDFLQRPGQQPQAGLSQANFTLGPVSPSYGGQYRCYGAHNLSSEWSAPSDPLNILMAGQIYDTVSLSAQPGPTVASGENVTLLCQSWWQFDTFLLTKEGAAHPPLRLRSMYGAHKYQAEFPMSPVTSAHAGTYRCYGSRSSNPHLLSLPSEPLELMVSGHSGGSSLPPTGPPSTPGLGRYLEVLIGVSVAFVLLLFLLLFLLLRRQRHSKHRTSGLRLCPSSPRPEKD

SEQ ID NO: 913873 - protein, 648 aa, Homo sapiens
MTPALTALLCLGLSLGPRTRVQAGPFPKPTLWAEPGSVISWGSPVTIWCQGSLEAQEYQLDKEGSPEPWDRNNPLEPKNKARFSIPSMTQHHAGRYRCHYYSSAGWSEPSDPLELVMTGAYSKPTLSALPSPVVASGGNMTLRCGSQKRYHHFVLMKEGEHQLPRTLDSQQLHSGGFQALFPVGPVNPSHRWRFTCYYYYMNTPRVWSHPSDPLEILPSGVSRKPSLLTLQGPVLAPGQSLTLQCGSDVGYDRFVLYKEGERDFLQRPGQQPQAGLSQANFTLGPVSPSNGGQYRCYGAHNLSSEWSAPSDPLNILMAGQIYDTVSLSAQPGPTVASGENVTLLCQSWWQFDTFLLTKEGAAHPPLRLRSMYGAHKYQAEFPMSPVTSAHAGTYRCYGSRSSNPHLLSLPSEPLELMVSGHSGGSSLPPTGPPSTPGGPEDQPLNPPGSGPQNGLGRYLEVLIGVSVAFVLLLFLLLFLLLRRQRHSKHRTSDQRKTDFQRPAGAAETEPKDRGLLRRSSPAADVQEENLYAAVKDTQSEDRVELDSQSPHDEDPQAVTYAPVKHSSPRREMASPPSSLSGEFLDTKDRQVEEDRQMDTEAAASEASQDVTYAQLHSLTLRRKATEPPPSQEGEPPAEPSIYATLAIH

SEQ ID NO: 913874 - protein, 464 aa, Homo sapiens
MTPILTVLICLGLSLGPRTHVQAGPFPKPTLWAEPGSVISWGSPVTIWCQGSLEAQEYQLDKEGSPEPWDRNNPLEPKNKARFSIPSMTQHHAGRYRCHYYSSAGWSEPSDPLELVMTGFYNKPTLSALPSPVVASGGNMTLRCGSQKGYHHFVLMKEGEHQLPRTLDSQQLHSGGFQALFPVGPVTPSHRWRFTCYYYYTNTPWVWSHPSDPLEILPSGVSRKPSLLTLQGPVLAPGQSLTLQCGSDVGYDRFVLYKEGERDFLQRPGQQPQAGLSQANFTLGPVSPSYGGQYRCYGAHNLSSEWSAPSDPLNILMAGQIYDTVSLSAQPGPTVASGENVTLLCQSWWQFDTFLLTKEGAAHPPLRLRSMYGAHKYQAEFPMSPVTSAHAGTYRCYGSYSSNPHLLSFPSEPLELMVSASHAKDYTVENLIRMGMAGLVLVFLGILLFEAQHSQRNPQDAARR

SEQ ID NO: 913875 - protein, 611 aa, Homo sapiens
MQAGPFPKPTLWAEPGSVISWGSPVTIWCQGSLEAQEYQLDKEGSPEPWDRNNPLEPKNKARFSIPSMTQHHAGRYRCHYYSSAGWSEPSDPLELVMTGFYNKPTLSALPSPVVASGGNMTLRCGSQKGYHHFVLMKEGEHQLPRTLDSQQLHSGGFQALFPVGPVTPSHRWRFTCYYYYTNTPWVWSHPSDPLEILPSGVSRKPSLLTLQGPVLAPGQSLTLQCGSDVGYDRFVLYKEGERDFLQRPGQQPQAGLSQANFTLGPVSPSYGGQYRCYGAHNLSSEWSAPSDPLNILMAGQIYDTVSLSAQPGPTVASGENVTLLCQSWWQFDTFLLTKEGAAHPPLRLRSMYGAHKYQAEFPMSPVTSAHAGTYRCYGSRSSNPHLLSLPSEPLELMVSGHSGGSSLPPTGPPSTPGLGRYLEVLIGVSVAFVLLLFLLLFLLLRRQRHSKHRTSDQRKTDFQRPAGAAETEPKDRGLLRRSSPAADVQEENLYAAVKDTQSEDRVELDSQSPHDEDPQAVTYAPVKHSSPRREMASPPSSLSGEFLDTKDRQVEEDRQMDTEAAASEASQDVTYAQLHSLTLRRKATEPPPSQEGEPPAEPSIYATLAIH

SEQ ID NO: 913876 - protein, 103 aa, Homo sapiens
MASPPSSLSGEFLDTKDRQVEEDRQMDTEVSPFLSRPPASPTPTTFLTSHSPPLQAAASEASQDVTYAQLHSLTLRRKATEPPPSQEGEPPAEPSIYATLAIH

SEQ ID NO: 913877 - protein, 51 aa, Homo sapiens
MPSLHSSIPDDFKNVFDQKTDNLPRKSKLVVGGKVFAEVCMVSQPRPCFQR

SEQ ID NO: 913878 - protein, 51 aa, Homo sapiens; identical to SEQ ID NO: 913877

SEQ ID NO: 913879 - protein, 108 aa, Homo sapiens
MTSRMFLTRKPTTFPESPSSWWVEKCSPRGLLLTCLMSAFLLLLLAITRCRCGRLFLYSCVNLPRHGFLCSALEYPGSCLGHSSESREKHPSTPSLSRLAEDALHLTS

SEQ ID NO: 913880 - protein, 109 aa, Homo sapiens
TRLQAGSHCRSDKLWVVNAEKATMYSTYPGSVHLGFMLEPILLPPPLHIEGECIFARASHCPSCTSALGQESANYSPEGMSGPRLVFVNKVLLEPGAVAHNCNPHTLGS

SEQ ID NO: 913881 - protein, 108 aa, Homo sapiens; identical to SEQ ID NO: 913879

SEQ ID NO: 913882 - protein, 51 aa, Homo sapiens; identical to SEQ ID NO: 913877

SEQ ID NO: 913883 - protein, 51 aa, Homo sapiens; identical to SEQ ID NO: 913877

SEQ ID NO: 913884 - protein, 109 aa, Homo sapiens
ETTAWRDARAGETSGIHLLGDADKGRDSVTERPWRHTEGMSAEVPGEGRLERHTSTHKVMSARGSGRWDTGSCRQVTAFHHPVTLEQGLLVSGEMEARFRKIRNGKVCL

SEQ ID NO: 913885 - protein, 174 aa, Homo sapiens
AAASPEPARAPPEPAPPAEATGAPAPSRPCAPEPAASPAGPEEPGEPAGLGELGEPAGPGEPEGPGDPAAAPAEAEEQAVEARQEEEQDLDGEKGPSSEGPEEEDGEGFSFKYSPGKLRGNQYKKMMTKEELEEEQRVQKEQLAAIFKLMKDNKETFGEMSDGDVQEQLRLYDM

SEQ ID NO: 913886 - protein, 100 aa, Homo sapiens
ACVRPNQLRCSKWVLFSFSSCSEKQPQSHKREESPNSAGCTQAPSLPSGLGAPSSSLSFLLDRVQKEQLAAIFKLMKDNKETFGEMSDGDVQEQLRLYDM

SEQ ID NO: 913887 - protein, 140 aa, Homo sapiens
AAASPEPARAPPEPAPPAEATGAPAPSRPCAPEPAASPAGPEEPGEPAGLGELGEPAGPGEPEGPGDPAAAPAEAEEQAVEARQEEEQDLDGEKGPSSEGPEEEDGEGFSFKYSPGKLRGNQYKKMMTKEELEEEQRTEE

SEQ ID NO: 913888 - protein, 140 aa, Homo sapiens; identical to SEQ ID NO: 913887

SEQ ID NO: 913889 - protein, 147 aa, Homo sapiens
AAASPEPARAPPEPAPPAEATGAPAPSRPCAPEPAASPAGPEEPGEPAGLGELGEPAGPGEPEGPGDPAAAPAEAEEQAVEARQEEEQDLDGEKGPSSEGPEEEDGEGFSFKYSPGKLRGNQYKKMMTKEELEEEQRIELTSDLTSL

SEQ ID NO: 913890 - protein, 169 aa, Homo sapiens
AAASPEPARAPPEPAPPAEATGAPAPSRPCAPEPAASPAGPEEPGEPAGLGELGEPAGPGEPEGPGDPAAAPAEAEEQAVEARQVRTGALAAPSPPPGLRLPLPFPAEPGSGAAASSPGCPQEAQNPRPAGNAGPAMLSRSPANSPPSPRKCGEGRARRSLFGGVLLSP

SEQ ID NO: 913891 - protein, 147 aa, Homo sapiens; identical to SEQ ID NO: 913889

SEQ ID NO: 913892 - protein, 140 aa, Homo sapiens; identical to SEQ ID NO: 913887

SEQ ID NO: 913893 - protein, 140 aa, Homo sapiens; identical to SEQ ID NO: 913887

SEQ ID NO: 913894 - protein, 140 aa, Homo sapiens; identical to SEQ ID NO: 913887

SEQ ID NO: 913895 - protein, 293 aa, Homo sapiens
PRDSEGVNGGAAGRARTGAREAPARKPGAARWGAQGRAGAGMEDGVAGPQLGAAAEAAEAAEARARPGVTLRPFAPLSGAAEADEGGGDWSFIDCEMEEVDLQDLPSATIACHLDPRVFVDGLCRAKFESLFRTYDKDITFQYFKSFKRVRINFSNPFSAADARLQLHKTEFLGKEMKLYFAQTLHIGSSHLAPPNPDKQFLISPPASPPVGWKQVEDATPVINYDLLYAISKLGPGEKYELHAATDTTPSVVVHVCESDQEKEEEEEMERMRRPKPKIIQTRRPEYTPIHLS

SEQ ID NO: 913896 - protein, 224 aa, Homo sapiens
PCALAIAPHLLAGGGGHLIPREEETDIERRRDSVFINEDDVPAFPICTIGRKANVWAKFESLFRTYDKDITFQYFKSFKRVRINFSNPFSAADARLQLHKTEFLGKEMKLYFAQTLHIGSSHLAPPNPDKQFLISPPASPPVGWKQVEDATPVINYDLLYAISKLGPGEKYELHAATDTTPSVVVHVCESDQEKEEEEEMERMRRPKPKIIQTRRPEYTPIHLS

SEQ ID NO: 913897 - protein, 197 aa, Homo sapiens
MHFRNFNYSFSSLIACVANSDIFSESETRAKFESLFRTYDKDITFQYFKSFKRVRINFSNPFSAADARLQLHKTEFLGKEMKLYFAQTLHIGSSHLAPPNPDKQFLISPPASPPVGWKQVEDATPVINYDLLYAISKLGPGEKYELHAATDTTPSVVVHVCESDQEKEEEEEMERMRRPKPKIIQTRRPEYTPIHLS

SEQ ID NO: 913898 - protein, 317 aa, Homo sapiens
MEDGVAGPQLGAAAEAAEAAEARARPGVTLRPFAPLSGAAEADEGGGDWSFIDCEMEEVDLQDLPSATIACHLDPRVFVDGLCRLKKAVVAAYVIGFIVELYLKLHSSELILEHISHCPEQTGLFLQKDSCAVNQSQIVLNFPTYSICQAKFESLFRTYDKDITFQYFKSFKRVRINFSNPFSAADARLQLHKTEFLGKEMKLYFAQTLHIGSSHLAPPNPDKQFLISPPASPPVGWKQVEDATPVINYDLLYAISKLGPGEKYELHAATDTTPSVVVHVCESDQEKEEEEEMERMRRPKPKIIQTRRPEYTPIHLS

SEQ ID NO: 913899 - protein, 197 aa, Homo sapiens; identical to SEQ ID NO: 913897

SEQ ID NO: 913900 - protein, 104 aa, Homo sapiens
MQCGNCSVSFLPSCSHVCACILLIYKTNLCSYIKLHRCCFTSFGKPGKRLENVSPFPDSRILDSLQQHLLAELFLECIHSASPTVQRVTCAFAKEVDLKFLCRI

SEQ ID NO: 913901 - protein, 104 aa, Homo sapiens; identical to SEQ ID NO: 913900

SEQ ID NO: 913902 - protein, 99 aa, Homo sapiens
WRWLVTTSSEVAAEIGVGWKQVEDATPVINYDLLYAISKLGPGEKYELHAATDTTPSVVVHVCESDQEKEEEEEMERMRRPKPKIIQTRRPEYTPIHLS

SEQ ID NO: 913903 - protein, 154 aa, Homo sapiens
MHFRNFNYSFSSLIACVANSDIFSESETRAKFESLFRTYDKDITFQYFKSFKRVRINFSNPFSAADARLQLHKTEFLGKEMKLYFAQTLHIGSSHLAPPNPDKQFLISPPASPPVGWKQVEDATPVINYDLLYAISKLGPDDWLEGAAQRNLSG

SEQ ID NO: 913904 - protein, 197 aa, Homo sapiens; identical to SEQ ID NO: 913897

SEQ ID NO: 913905 - protein, 171 aa, Homo sapiens
MVYAKFESLFRTYDKDITFQYFKSFKRVRINFSNPFSAADARLQLHKTEFLGKEMKLYFAQTLHIGSSHLAPPNPDKQFLISPPASPPVGWKQVEDATPVINYDLLYAISKLGPGEKYELHAATDTTPSVVVHVCESDQEKEEEEEMERMRRPKPKIIQTRRPEYTPIHLS

SEQ ID NO: 913906 - protein, 293 aa, Homo sapiens; identical to SEQ ID NO: 913895

SEQ ID NO: 913907 - protein, 117 aa, Homo sapiens
MKLYFAQTLHIGSSHLAPPNPDKQFLISPPASPPVGWKQVEDATPVINYDLLYAISKLGPGEKYELHAATDTTPSVVVHVCESDQEKEEEEEMERMRRPKPKIIQTRRPEYTPIHLS

SEQ ID NO: 913908 - protein, 197 aa, Homo sapiens; identical to SEQ ID NO: 913897

SEQ ID NO: 913909 - protein, 197 aa, Homo sapiens; identical to SEQ ID NO: 913897

SEQ ID NO: 913910 - protein, 197 aa, Homo sapiens; identical to SEQ ID NO: 913897

SEQ ID NO: 913911 - protein, 257 aa, Homo sapiens
MSPLDQAVIRAVCLSGGSCWGGVRCLVRGGPNIGPAAQLLGGIPLCWPPAVTAGEVKLLLSSETPIEGKNMSFVNDLTVTQDGRKIYFTDSSSKWQRRDYLLLVMEGTDDGRLLEYDTVTREVKVLLDQLRFPNGVQLSPAEDFVLVAETTMARIRRVYVSGLMKGGADLFVENMPGFPDNIRPSSSGGYWVGMSTIRPNPGFSMLDFLSERPWIKRMIFKLFVQETGDEVGAAVTASFQNSGQGGIGEGRMIRRVV

SEQ ID NO: 913912 - protein, 444 aa, Homo sapiens
EKKLGLGTRLGVNRPREVVSAGEAGARTMSEADGLRQRRPLRPQVVTDDDGQAPEAKDGSSFSGRVFRVTFLMLAVSLTVPLLGAMMLLESPIDPQPLSFKEPPLLLGVLHPNTKLRQAERLFENQLVGPESIAHIGDVMFTGTADGRVVKLENGEIETIARFGSGPCKTRDDEPVCGRPLGIRAGPNGTLFVADAYKGLFEVNPWKREVKLLLSSETPIEGKNMSFVNDLTVTQDGRKIYFTDSSSKWQRRDYLLLVMEGTDDGRLLEYDTVTREVKVLLDQLRFPNGVQLSPAEDFVLVAETTMARIRRVYVSGLMKGGADLFVENMPGFPDNIRPSSSGGYWVGMSTIRPNPGFSMLDFLSERPWIKRMIFKLFSQETVMKFVPRYSLVLELSDSGAFRRSLHDPDGLVATYISEVHEHDGHLYLGSFRSPFLCRLSLQAV

SEQ ID NO: 913913 - protein, 362 aa, Homo sapiens
EKKLGLGTRLGVNRPRDFKEPPLLLGVLHPNTKLRQAERLFENQLVGPESIAHIGDVMFTGTADGRVVKLENGEIETIARFGSGPCKTRDDEPVCGRPLGIRAGPNGTLFVADAYKGLFEVNPWKREVKLLLSSETPIEGKNMSFVNDLTVTQDGRKIYFTDSSSKWQRRDYLLLVMEGTDDGRLLEYDTVTREVKVLLDQLRFPNGVQLSPAEDFVLVAETTMARIRRVYVSGLMKGGADLFVENMPGFPDNIRPSSSGGYWVGMSTIRPNPGFSMLDFLSERPWIKRMIFKLFSQETVMKFVPRYSLVLELSDSGAFRRSLHDPDGLVATYISEVHEHDGHLYLGSFRSPFLCRLSLQAV

SEQ ID NO: 913914 - protein, 440 aa, Homo sapiens
MKGPLRWSRPRRGFIYYRRKTSSVSGGWRATASVGSRSGRHDERRLEGRLASRTTMMHPELGRALREFRVTLMLLFLTVPVHDAVDLLIQALVEDFKEPPLLLGVLHPNTKLRQAERLFENQLVGPESIAHIGDVMFTGTADGRVVKLENGEIETIARFGSGPCKTRDDEPVCGRPLGIRAGPNGTLFVADAYKGLFEVNPWKREVKLLLSSETPIEGKNMSFVNDLTVTQDGRKIYFTDSSSKWQRRDYLLLVMEGTDDGRLLEYDTVTREVKVLLDQLRFPNGVQLSPAEDFVLVAETTMARIRRVYVSGLMKGGADLFVENMPGFPDNIRPSSSGGYWVGMSTIRPNPGFSMLDFLSERPWIKRMIFKLFSQETVMKFVPRYSLVLELSDSGAFRRSLHDPDGLVATYISEVHEHDGHLYLGSFRSPFLCRLSLQAV

SEQ ID NO: 913915 - protein, 397 aa, Homo sapiens
MSEADGLRQRRPLRPQVVTDDDGQAPEAKDGSSFSGRVFRVTFLMLAVSLTVPLLGAMMLLESPIDPQPLSFKEPPLLLGVLHPNTKLRQAERLFENQLVGPESIAHIGDVMFTGTADGRVVKLENGEIETIARFGSGPCKTRDDEPVCGRPLGIRAGPNGTLFVADAYKGLFEVNPWKREVKLLLSSETPIEGKNMSFVNDLTVTQDGRKIYFTDSSSKWQRRDYLLLVMEGTDDGRLLEYDTVTREVKVLLDQLRFPNGVQLSPAEDFVLVAETTMARIRRVYVSGLMKGGADLFVENMPGFPDNIRPSSSGGYWVGMSTIRPNPGFSMLDFLSERPWIKRMIFKASLRICTPRFEESSGILLFVLEAMLCGLWTCLLFLNVSCSQISIICTLPI

SEQ ID NO: 913916 - protein, 416 aa, Homo sapiens
MSEADGLRQRRPLRPQVVTDDDGQAPEAKDGSSFSGRVFRVTFLMLAVSLTVPLLGAMMLLESPIDPQPLSFKEPPLLLGVLHPNTKLRQAERLFENQLVGPESIAHIGDVMFTGTADGRVVKLENGEIETIARFGSGPCKTRDDEPVCGRPLGIRAGPNGTLFVADAYKGLFEVNPWKREVKLLLSSETPIEGKNMSFVNDLTVTQDGRKIYFTDSSSKWQRRDYLLLVMEGTDDGRLLEYDTVTREVKVLLDQLRFPNGVQLSPAEDFVLVAETTMARIRRVYVSGLMKGGADLFVENMPGFPDNIRPSSSGGYWVGMSTIRPNPGFSMLDFLSERPWIKRMIFKLFSQETVMKFVPRYSLVLELSDSGAFRRSLHDPDGLVATYISEVHEHDGHLYLGSFRSPFLCRLSLQAV

SEQ ID NO: 913917 - protein, 416 aa, Homo sapiens; identical to SEQ ID NO: 913916

SEQ ID NO: 913918 - protein, 416 aa, Homo sapiens; identical to SEQ ID NO: 913916

SEQ ID NO: 913919 - protein, 290 aa, Homo sapiens
MSPLDQAVIRAVCLSGGSCWGGVRCLVRGGPNIGPAAQLLGGIPLCWPPAVTAGEVKLLLSSETPIEGKNMSFVNDLTVTQDGRKIYFTDSSSKWQRRDYLLLVMEGTDDGRLLEYDTVTREVKVLLDQLRFPNGVQLSPAEDFVLVAETTMARIRRVYVSGLMKGGADLFVENMPGFPDNIRPSSSGGYWVGMSTIRPNPGFSMLDFLSERPWIKRMIFKLFSQETVMKFVPRYSLVLELSDSGAFRRSLHDPDGLVATYISEVHEHDGHLYLGSFRSPFLCRLSLQAV

SEQ ID NO: 913920 - protein, 416 aa, Homo sapiens; identical to SEQ ID NO: 913916

SEQ ID NO: 913921 - protein, 416 aa, Homo sapiens; identical to SEQ ID NO: 913916

SEQ ID NO: 913922 - protein, 354 aa, Homo sapiens
MSEADGLRQRRPLRPQVVTDDDGQAPEAKDGSSFSGRVFRVTFLMLAVSLTVPLLGAMMLLESPIDPQPLSFKEPPLLLGVLHPNTKLRQAERLFENQLVGPESIAHIGDVMFTGTADGRVVKLENGEIETIARFGSGPCKTRDDEPVCGRPLGIRAGPNGTLFVADAYKGLFEVNPWKREVKLLLSSETPIEGKNMSFVNDLTVTQDGRKIYFTDSSSKWQRRDYLLLVMEGTDDGRLLEYDTVTREVKVLLDQLRFPNGVQLSPAEDFVLVAETTMARIRRVYVSGLMKGGADLFVENMPGFPDNIRPSSSGGYWVGMSTIRPNPGFSMLDFLSERPWIKRMIFKPGKLRWL

SEQ ID NO: 913923 - protein, 363 aa, Homo sapiens
PWGESAEAGIPIDPQPLSFKEPPLLLGVLHPNTKLRQAERLFENQLVGPESIAHIGDVMFTGTADGRVVKLENGEIETIARFGSGPCKTRDDEPVCGRPLGIRAGPNGTLFVADAYKGLFEVNPWKREVKLLLSSETPIEGKNMSFVNDLTVTQDGRKIYFTDSSSKWQRRDYLLLVMEGTDDGRLLEYDTVTREVKVLLDQLRFPNGVQLSPAEDFVLVAETTMARIRRVYVSGLMKGGADLFVENMPGFPDNIRPSSSGGYWVGMSTIRPNPGFSMLDFLSERPWIKRMIFKLFSQETVMKFVPRYSLVLELSDSGAFRRSLHDPDGLVATYISEVHEHDGHLYLGSFRSPFLCRLSLQAV

SEQ ID NO: 913924 - protein, 354 aa, Homo sapiens; identical to SEQ ID NO: 913922

SEQ ID NO: 913925 - protein, 487 aa, Homo sapiens
MSEADGLRQRRPLRPQVVTDDDGQAPEAKDGSSFSGRVFRVTFLMLAVSLTVPLLGAMMLLESPIDPQPLSFKEPPLLLGVLHPNTKLRQAERLFENQLVGPESIAHIGDVMFTGTADGRVVKLENGEIETIARFGSGPCKTRDDEPVCGRPLGIRAGPNGTLFVADAYKGLFEVNPWKREVKLLLSSETPIEGKNMSFVNDLTVTQDGRKIYFTDSSSKWQRRDYLLLVMEGTDDGRLLEYDTVTREVKVLLDQLRFPNGVQLSPAEDFVLVAETTMARIRRVYVSGLMKGGADLFVENMPGFPDNIRPSSSGGYWVGMSTIRPNPGFSMLDFLSERPWIKRMIFKASLRICTPRFEESSGILLFVLEAMLCGLWTCLLFLNVSCSQISIICTFYLKCFKSKQKTCVFQGSCAGCDLLFSQETVMKFVPRYSLVLELSDSGAFRRSLHDPDGLVATYISEVHEHDGHLYLGSFRSPFLCRLSLQAV

SEQ ID NO: 913926 - protein, 289 aa, Homo sapiens
MSEADGLRQRRPLRPQVVTDDDGQAPEAKDGSSFSGRVFRVTFLMLAVSLTVPLLGAMMLLESPIDPQPLSFKEPPLLLGVLHPNTKLRQAERLFENQLVGPESIAHIGDVMFTGTADGRVVKLENGEIETIARFGSGPCKTRDDEPVCGRPLGIRAGPNGTLFVADAYKGLFEVNPWKREVKLLLSSETPIEGKNMSFVNDLTVTQDGRKIYFTDSSSKWQRRDYLLLVMEGTDDGRLLEYDTVTREVKVLLDQLRFPNGVQLSPAEDFVLVAETTMARIRSSLVKRR

SEQ ID NO: 913927 - protein, 220 aa, Homo sapiens
MSFVNDLTVTQDGRKIYFTDSSSKWQRRDYLLLVMEGTDDGRLLEYDTVTREVKVLLDQLRFPNGVQLSPAEDFVLVAETTMARIRRVYVSGLMKGGADLFVENMPGFPDNIRPSSSGGYWVGMSTIRPNPGFSMLDFLSERPWIKRMIFKLFSQETVMKFVPRYSLVLELSDSGAFRRSLHDPDGLVATYISEVHEHDGHLYLGSFRSPFLCRLSLQAV

SEQ ID NO: 913928 - protein, 153 aa, Homo sapiens
CGDSRRSRYHPPSSWPGYVRVYVSGLMKGGADLFVENMPGFPDNIRPSSSGGYWVGMSTIRPNPGFSMLDFLSERPWIKRMIFKLFSQETVMKFVPRYSLVLELSDSGAFRRSLHDPDGLVATYISEVHEHDGHLYLGSFRSPFLCRLSLQAV

SEQ ID NO: 913929 - protein, 160 aa, Homo sapiens
MSEADGLRQRRPLRPQVVTDDDGQAPEAKDGSSFSGRVFRVTFLMLAVSLTVPLLGAMMLLESPIDPQPLSFKEPPLLLGVLHPNTKLRQAERLFENQLVGPEPAVRAVLAKTWNCVLKGYVGRGLSIVCMKSLLTLAAQRGLCWVSFCEYLRADHAGIG

SEQ ID NO: 913930 - protein, 259 aa, Homo sapiens
MATATGVAEERLLAALAYLQCAVGCAVFARNRQTNSVYGRHALPSHRLRVPARAAWVVQELPSLALPLYQYASESAPRLRSAPNCILLAMFLVHYGHRCLIYPFLMRGGKPMPLLACTMAIMFCTCNGYLQSRYLSHCAVYADDWVTDPRFLIGFGLWLTGMLINIHSDHILRNLRKPGDTGYKIPRGGLFEYVTAANYFGEIMEWCGYALASWSVQGAAFAFFTFCFLSGRAKEHHEWYLRKFEEYPKFRKIIIPFLF

SEQ ID NO: 913931 - protein, 259 aa, Homo sapiens; identical to SEQ ID NO: 913930

SEQ ID NO: 913932 - protein, 258 aa, Homo sapiens
MATATGVAEERLLAALAYLQCAVGCAVFARNRQTNSVYGRHALPSHRLRVPARAAWVVQELPSLALPLYQYASESAPRLRSAPNCILLAMFLVHYGHRCLIYPFLMRGGKPMPLLACTMAIMFCTCNGYLQSRYLSHCAVYADDWVTDPRFLIGFGLWLTGMLINIHSDHILRNLRKPGDTGYKIPRGGLFEYVTAANYFGEIMEWCGYALASWSVQGAAFAFFTFCFLSGRAKEHHEWYLRKFEEYPKFRKIIIPFF

SEQ ID NO: 913933 - protein, 259 aa, Homo sapiens; identical to SEQ ID NO: 913930

SEQ ID NO: 913934 - protein, 111 aa, Homo sapiens
NFFPLGFGLWLTGMLINIHSDHILRNLRKPGDTGYKIPRGGLFEYVTAANYFGEIMEWCGYALASWSVQGAAFAFFTFCFLSGRAKEHHEWYLRKFEEYPKFRKIIIPFLF

SEQ ID NO: 913935 - protein, 259 aa, Homo sapiens; identical to SEQ ID NO: 913930

SEQ ID NO: 913936 - protein, 211 aa, Homo sapiens
MATATGVAEERLLAALAYLQCAVGCAVFPRLRSAPNCILLAMFLVHYGHRCLIYPFLMRGGKPMPLLACTMAIMFCTCNGYLQSRYLSHCAVYADDWVTDPRFLIGFGLWLTGMLINIHSDHILRNLRKPGDTGYKIPRGGLFEYVTAANYFGEIMEWCGYALASWSVQGAAFAFFTFCFLSGRAKEHHEWYLRKFEEYPKFRKIIIPFLF

SEQ ID NO: 913937 - protein, 211 aa, Homo sapiens; identical to SEQ ID NO: 913936

SEQ ID NO: 913938 - protein, 72 aa, Homo sapiens
APTAPATPEKPDLRTLSAESRQCGTPVAAPPVAAPPAPAPPPYMLPASPQRAQLHPPGHVPRPLRASVLACG

SEQ ID NO: 913939 - protein, 180 aa, Homo sapiens
MATATGVAEERLLAALAYLQCAVGCAVFARNRQTNSVYGRHALPSHRLRVPARAAWVVQELPSLALPLYQYASESAPRLRSAPNCILLAMFLVHYGHRCLIYPFLMRGGKPMPLLACTMAIMFCTCNGYLQSRYLSHCAVYADDWVTDPRFLIEEEQAFEFLCRSHDLCLPMFSEAERMS

SEQ ID NO: 913940 - protein, 117 aa, Homo sapiens
MAAAAAGAGSGPWAAQEKQFPPALLSFFIYNPRFGPREGQEENKILFYHPNEVEKNEKIRNVGLCEAIVQFTRTFSPSKPAKSLHTQKNRQFFNEPEENFWMVMVFTHTVYLSEIVW

SEQ ID NO: 913941 - protein, 233 aa, Homo sapiens
MAAAAAGAGSGPWAAQEKQFPPALLSFFIYNPRFGPREGQEENKILFYHPNEVEKNEKIRNVGLCEAIVQFTRTFSPSKPAKSLHTQKNRQFFNEPEENFWMVMVVRNPIIEKQSKDGKPVIEYQEEELLDKVYSSVLRQCYSMYKLFNGTFLKAMEDGGVKLLKERLEKFFHRYLQTLHLQSCDLLDIFGGISFFPLDKMTYLKIQSFINRMEESLNIVKYTAFLYNDQLIW

SEQ ID NO: 913942 - protein, 102 aa, Homo sapiens
IVVSRCSPFDGVLPGTETKYSFLFMSTTPIGNYGLSGKHLVLMRSGSYGRQEESEQLGKERRDLELCVLITAPQECPVSAGMLSSAGENDTTHRFAPEGEET

SEQ ID NO: 913943 - protein, 482 aa, Homo sapiens
MAAAAAGAGSGPWAAQEKQFPPALLSFFIYNPRFGPREGQEENKILFYHPNEVEKNEKIRNVGLCEAIVQFTRTFSPSKPAKSLHTQKNRQFFNEPEENFWMVMVVRNPIIEKQSKDGKPVIEYQEEELLDKVYSSVLRQCYSMYKLFNGTFLKAMEDGGVKLLKERLEKFFHRYLQTLHLQSCDLLDIFGGISFFPLDKMTYLKIQSFINRMEESLNIVKYTAFLYNDQLIWSGLEQDDMRILYKYLTTSLFPRHIEPELAGRDSPIRAEMPGNLQHYGRFLTGPLNLNDPDAKCRFPKIFVNTDDTYEELHLIVYKAMSAAVCFMIDASVHPTLDFCRRLDSIVGPQLTVLASDICEQFNINKRMSGSEKEPQFKFIYFNHMNLAEKSTVHMRKTPSVSLTSVHPDLMKILGDINSDFTRVDEDEEIIVKAMSDYWVVGKKSDRRELYVILNQKNANLIEVNEEVKKLCATQFNNIFFLD

SEQ ID NO: 913944 - protein, 482 aa, Homo sapiens; identical to SEQ ID NO: 913943

SEQ ID NO: 913945 - protein, 339 aa, Homo sapiens
MYKLFNGTFLKAMEDGGVKLLKERLEKFFHRYLQTLHLQSCDLLDIFGGISFFPLDKMTYLKIQSFINRMEESLNIVKYTAFLYNDQLIWSGLEQDDMRILYKYLTTSLFPRHIEPELAGRDSPIRAEMPGNLQHYGRFLTGPLNLNDPDAKCRFPKIFVNTDDTYEELHLIVYKAMSAAVCFMIDASVHPTLDFCRRLDSIVGPQLTVLASDICEQFNINKRMSGSEKEPQFKFIYFNHMNLAEKSTVHMRKTPSVSLTSVHPDLMKILGDINSDFTRVDEDEEIIVKAMSDYWVVGKKSDRRELYVILNQKNANLIEVNEEVKKLCATQFNNIFFLD

SEQ ID NO: 913946 - protein, 339 aa, Homo sapiens; identical to SEQ ID NO: 913945

SEQ ID NO: 913947 - protein, 226 aa, Homo sapiens [sequence omitted]

SEQ ID NO: 913948 - protein, 137 aa, Homo sapiens
KKILKEESSCIRPECTVFVTCFHRSEKEPQFKFIYFNHMNLAEKSTVHMRKTPSVSLTSVHPDLMKILGDINSDFTRVDEDEEIIVKAMSDYWVVGKKSDRRELYVILNQKNANLIEVNEEVKKLCATQFNNIFFLD

SEQ ID NO: 913949 - protein, 79 aa, Homo sapiens
AAAYYYYIAAASTNSDFTRVDEDEEIIVKAMSDYWVVGKKSDRRELYVILNQKNANLIEVNEEVKKLCATQFNNIFFLD

SEQ ID NO: 913950 - protein, 120 aa, Homo sapiens
WNFRGELYVILNQKNANLIEVNGSEKEPQFKFIYFNHMNLAEKSTVHMRKTPSVSLTSVHPDLMKILGDINSDFTRVDEDEEIIVKAMSDYWVVGKKSDRRELYVILNQKNANLIEVNGK

SEQ ID NO: 913951 - protein, 121 aa, Homo sapiens
MAAAAAGAGSGPWAAQEKQFPPALLSFFIYNPRFGPREGQEHGEVIDCVQELSHSVNKLFGLASAVDRCVRFTNGLGTCGLLSALKSLFAKYVSDFTSTLQSIRKKCKLDHISPNLLQEDW

SEQ ID NO: 913952 - protein, 482 aa, Homo sapiens; identical to SEQ ID NO: 913943

SEQ ID NO: 913953 - protein, 339 aa, Homo sapiens; identical to SEQ ID NO: 913945

SEQ ID NO: 913954 - protein, 466 aa, Homo sapiens
MAAAAAGAGSGPWAAQEKQFPPALLSFFIYNPRFGPREGQEENKILFYHPNEVEKNEKIRNVGLCEAIVQFTRTFSPSKPAKSLHTQKNRQFFNEPEENFWMVMVVRNPIIEKQSKDGKPVIEYQEEELLDKVYSSVLRQCYSMYKLFNGTFLKAMEDGGVKLLKERLEKFFHRYLQTLHLQSCDLLDIFGGISFFPLDKMTYLKIQSFINRMEESLNIVKYTAFLYNDQLIWSGLEQDDMRILYKYLTTSLFPRHIEPELAGRDSPIRAEMPGNLQHYGRFLTGPLNLNDPDAKCRFPKIFVNTDDTYEELHLIVYKAMSAAVCFMIDASVHPTLDFCRRLDSIVGPQLTVLASDICEQFNINKRMSGSEKEPQFKFIYFNHMNLAEKSTVHMRKTPSVSLTSVHPDLMKILGDINSDFTRVDEDEEIIVKAMSDYWVVGKKSDRRELYVILNQKNANLIEVNGK

SEQ ID NO: 913955 - protein, 345 aa, Homo sapiens
DGVSLCRSGWSVEYSGTISAHCSLHLLGSSNSPASASLVAGIAGAHHQNQLIFVVLVEMRFCHVGQAALELLTSGDPPSSASQSAGITGMSHHAQPAYSDMVFAKEQLASKATGVYEVGVCSVSRFLILLHLVESSHVLFLLLRFLTGPLNLNDPDAKCRFPKIFVNTDDTYEELHLIVYKAMSAAVCFMIDASVHPTLDFCRRLDSIVGPQLTVLASDICEQFNINKRMSGSEKEPQFKFIYFNHMNLAEKSTVHMRKTPSVSLTSVHPDLMKILGDINSDFTRVDEDEEIIVKAMSDYWVVGKKSDRRELYVILNQKNANLIEVNEEVKKLCATQFNNIFFLD

SEQ ID NO: 913956 - protein, 325 aa, Homo sapiens
SCQSEQGWRREWERHTVPNPRLQLPTPGSRLPAPGAQSRAAAMNGEEQYYAATQLYKDPCAFQRGPAPEFSASPPACLYMGRQPPPPPPHPFPGALGALEQGSPPDISPYEVPPLADDPAVAHLHHHLPAQLALPHPPAGPFPEGAEPGVLEEPNRVQLPFPWMKSTKAHAWKGQWAGGAYAAEPEENKRTRTAYTRAQLLELEKEFLFNKYISRPRRVELAVMLNLTERHIKIWFQNRRMKWKKEEDKKRGGGTAVGGGGVAEPEQDCAVTSGEELLALPPPPPPGGAVPPAAPVAAREGRLPPGLSASPQPSSVAPRRPQEPR

SEQ ID NO: 913957 - protein, 520 aa, Homo sapiens
MASDPIFTLAPPLHCHYGAFPPNASGWEQPPNASGVSVASAALAASAASRVATSTDPSCSGFAPPDFNHCLKDWDYNGLPVLTTNAIGQWDLVCDLGWQVILEQILFILGFASGYLFLGYPADRFGRRGIVLLTLGLVGPCGVGGAAAGSSTGVMALRFLLGFLLAGVDLGVYLMRLELCDPTQRLRVALAGELVGVGGHFLFLGLALVSKDWRFLQRMITAPCILFLFYGWPGLFLESARWLIVKRQIEEAQSVLRILAERNRPHGQMLGEEAQEALQDLENTCPLPATSSFSFASLLNYRNIWKNLLILGFTNFIAHAIRHCYQPVGGGGSPSDFYLCSLLASGTAALACVFLGVTVDRFGRRGILLLSMTLTGIASLVLLGLWDYLNEAAITTFSVLGLFSSQAAAILSTLLAAEVIPTTVRGRGLGLIMALGALGGLSGPAQRLHMGHGAFLQHVVLAACALLCILSIMLLPETKRKLLPEVLRDGELCRRPSLLRQPPPTRCDHVPLLATPNPAL

SEQ ID NO: 913958 - protein, 520 aa, Homo sapiens; identical to SEQ ID NO: 913957

SEQ ID NO: 913959 - protein, 538 aa, Homo sapiens
MASDPIFTLAPPLHCHYGAFPPNASGWEQPPNASGVSVASAALAASAASRVATSTDPSCSGFAPPDFNHCLKDWDYNGLPVLTTNAIGQWDLVCDLGWQVILEQILFILGFASGYLFLGYPADRFGRRGIVLLTLGLVGPCGVGGAAAGSSTGVMALRFLLGFLLAGVDLGVYLMRLELCDPTQRLRVALAGELVGVGGHFLFLGLALVSKDWRFLQRMITAPCILFLFYGWPGLFLESARWLIVKRQIEEAQSVLRILAERNRPHGQMLGEEAQEALQDLENTCPLPATSSFSFASLLNYRNIWKNLLILGFTNFIAHAIRHCYQPVGGGGSPSDFYLCSLLASGTAALACVFLGVTVDRFGRRGILLLSMTLTGIASLVLLGLWDCEHPIFPTVWAQQGNPNRDLNEAAITTFSVLGLFSSQAAAILSTLLAAEVIPTTVRGRGLGLIMALGALGGLSGPAQRLHMGHGAFLQHVVLAACALLCILSIMLLPETKRKLLPEVLRDGELCRRPSLLRQPPPTRCDHVPLLATPNPAL

SEQ ID NO: 913960 - protein, 336 aa, Homo sapiens
MASDPIFTLAPPLHCHYGAFPPNASGWEQPPNASGVSVASAALAASAASRVATSTDPSCSGFAPPDFNHCLKDWDYNGLPVLTTNAIGQWDLVCDLGWQVILEQILFILGFASGYLFLGYPADRFGRRGIVLLTLGLVGPCGVGGAAAGSSTGVMALRFLLGFLLAGVDLGVYLMRLELCDPTQRLRVALAGELVGVGGHFLFLGLALVSKDWRFLQRMITAPCILFLFYGWPGLFLESARWLIVKRQIEEAQSVLRILAERNRPHGQMLGEEAQEALQASLPMPFATATSLWEEEGAHRTSTCALCWPAAPQPWPVSSWGSPWTDLAAGASFFSP

SEQ ID NO: 913961 - protein, 520 aa, Homo sapiens; identical to SEQ ID NO: 913957

SEQ ID NO: 913962 - protein, 520 aa, Homo sapiens; identical to SEQ ID NO: 913957

SEQ ID NO: 913963 - protein, 520 aa, Homo sapiens
MASDPIFTLAPPLHCHYGAFPPNASGWEQPPNASGVSVASAALAASAASRVATSTDPSCSGFAPPDFNHCLKDWDYNGLPVLTTNAIGQWDLVCDLGWQVILEQILFILGFASGYLFLGYPADRFGRRGIVLLTLGLVGPCGVGGAAAGSSTGVMALRFLLGFLLAGVDLGVYLMRLELCDPTQRLRVALAGELVGVGGHFLFLGLALVSKDWRFLQRMITAPCILFLFYGWPGLFLESARWLIVKRQIEEAQSVLRILAERNRPHGQMLGEEAQEALQDLENTCPLPATSSFSFASLLNYRNIWKNLLILGFTNFIAHAIRHCYQPVGGGGSPSDFYLCSLLASGTAALACVFLGVTVDRFGRRGILLLSMTLTGIASLVLLGLWDYLNEAAITTFSVLGLFSSQAAAILSTLLAAEVIPTTVRGRGLGLIMALGALGGLSGPAQRLHMGHGAFLQHVVLAACALLCILSIMLLPETKRKLLPEVLRDGELCRRPSPPPCCFAFTSLARVRGQGESSTL

SEQ ID NO: 913964 - protein, 387 aa, Homo sapiens
MASDPIFTLAPPLHCHYGAFPPNASGWEQPPNASGVSVASAALAASAASRVATSTDPSCSGFAPPDFNHCLKDWDYNGLPVLTTNAIGQWDLVCDLGWQVILEQILFILGFASGYLFLGYPADRFGRRGIVLLTLGLVGPCGVGGAAAGSSTGVMALRFLLGFLLAGVDLGVYLMRLELCDPTQRLRVALAGELVGVGGHFLFLGLALVSKDWRFLQRMITAPCILFLFYGWPGLFLESARWLIVKRQIEEAQSVLRILAERNRPHGQMLGEEAQEALQDLENTCPLPATSSFSFASLLNYRNIWKNLLILGFTNFIAHAIRHCYQPVGGGGSPSDFYLCSLLASGTAALACVFLGVTVDRFGRRGILLLSMTLTGIASLVLLGLWD

SEQ ID NO: 913965 - protein, 132 aa, Homo sapiens
MASDPIFTLAPPLHCHYGAFPPNASGWEQPPNASGVSVASAALAASAASRVATSTDPSCSGFAPPDFNHCLKDWDYNGLPVLTTNAIGQWDLVCDLGWQVILEQILFILGFASGYLFLGYPQTDLAVAGLCC

SEQ ID NO: 913966 - protein, 101 aa, Homo sapiens
RPRLQSCRAGSLRAVCVRAAGAQLSQRTAHPFGAGRQGPCGRQAGSPGGHRDPRAQWRGRRQNRQHCRDHPHLQRSKCPSPRWRRHPLPAPPPPRSVWHFP

SEQ ID NO: 913967 - protein, 409 aa, Homo sapiens
MAFLCSPPTPSARFGRRGIVLLTLGLVGPCGVGGAAAGSSTGVMALRFLLGFLLAGVDLGVYLMRLELCDPTQRLRVALAGELVGVGGHFLFLGLALVSKDWRFLQRMITAPCILFLFYGWPGLFLESARWLIVKRQIEEAQSVLRILAERNRPHGQMLGEEAQEALQDLENTCPLPATSSFSFASLLNYRNIWKNLLILGFTNFIAHAIRHCYQPVGGGGSPSDFYLCSLLASGTAALACVFLGVTVDRFGRRGILLLSMTLTGIASLVLLGLWDYLNEAAITTFSVLGLFSSQAAAILSTLLAAEVIPTTVRGRGLGLIMALGALGGLSGPAQRLHMGHGAFLQHVVLAACALLCILSIMLLPETKRKLLPEVLRDGELCRRPSLLRQPPPTRCDHVPLLATPNPAL

SEQ ID NO: 913968 - protein, 609 aa, Homo sapiens
EGKAAQRSQRPRRRPRLQSCRAGSLRAVCVRAAGAQLSQRTAHPFGAGRQGPCGRQAGSPGGHRDPRAQWRGRRQNRQHCRDHPHLQRTGRDPRRCGAHGAVHCHYGAFPPNASGWEQPPNASGVSVASAALAASAASRVATSTDPSCSGFAPPDFNHCLKDWDYNGLPVLTTNAIGQWDLVCDLGWQVILEQILFILGFASGYLFLGYPADRFGRRGIVLLTLGLVGPCGVGGAAAGSSTGVMALRFLLGFLLAGVDLGVYLMRLELCDPTQRLRVALAGELVGVGGHFLFLGLALVSKDWRFLQRMITAPCILFLFYGWPGLFLESARWLIVKRQIEEAQSVLRILAERNRPHGQMLGEEAQEALQDLENTCPLPATSSFSFASLLNYRNIWKNLLILGFTNFIAHAIRHCYQPVGGGGSPSDFYLCSLLASGTAALACVFLGVTVDRFGRRGILLLSMTLTGIASLVLLGLWDYLNEAAITTFSVLGLFSSQAAAILSTLLAAEVIPTTVRGRGLGLIMALGALGGLSGPAQRLHMGHGAFLQHVVLAACALLCILSIMLLPETKRKLLPEVLRDGELCRRPSLLRQPPPTRCDHVPLLATPNPAL

SEQ ID NO: 913969 - protein, 520 aa, Homo sapiens; identical to SEQ ID NO: 913957

SEQ ID NO: 913970 - protein, 520 aa, Homo sapiens; identical to SEQ ID NO: 913957

SEQ ID NO: 913971 - protein, 499 aa, Homo sapiens
MASDPIFTLAPPLHCHYGAFPPNASGWEQPPNASGVSVASAALAASAASRVATSTDPSCSGFAPPDFNHCLKDWDYNGLPVLTTNAIGQWDLVCDLGWQVILEQILFILGFASGYLFLGYPADRFGRRGIVLLTLGLVGPCGVGGAAAGSSTGVMALRFLLGFLLAGVDLGVYLMRLELCDPTQRLRVALAGELVGVGGHFLFLGLALVSKDWRFLQRMITAPCILFLFYGWPGLFLESARWLIVKRQIEEAQSVLRILAERNRPHGQMLGEEAQEALQDLENTCPLPATSSFSFASLLNYRNIWKNLLILGFTNFIAHAIRHCYQPVGGGGSPSDFYLCSLLASGTAALACVFLGVTVDRFGRRGILLLSMTLTGIASLVLLGLWDYLNEAAITTFSVLGLFSSQAAAILSTLLAAEVIPTTVRGRGLGLIMALGALGGLSGPAQRLHMGHGAFLRPPLHSQHYAAAGDQAQAPARGAPGRGAVSPAFPAAAATPYPL

SEQ ID NO: 913972 - protein, 433 aa, Homo sapiens
MASDPIFTLAPPLHCHYGAFPPNASGWEQPPNASGVSVASAALAASAASRVATSTDPSCSGFAPPDFNHCLKDWDYNGLPVLTTNAIGQWDLVCDLGWQVILEQILFILGFASGYLFLGYPADRFGRRGIVLLTLGLVGPCGVGGAAAGSSTGVMALRFLLGFLLAGVDLGVYLMRLELCDPTQRLRVALAGELVGVGGHFLFLGLALVSKDWRFLQRMITAPCILFLFYGWPGLFLESARWLIVKRQIEEAQSVLRILAERNRPHGQMLGEEAQEALQDLENTCPLPATSSFSFASLLNYRNIWKNLLILGFTNFIAHAIRHCYQPVGGGGSPSDFYLCSLLASGTAALACVFLGVTVDRFGRRGILLLSMTLTGIASLVLLGLWDYLNEAAITTFSVLGLFSSQAAAILSTVRTPGTNQASHKTGRGCRAL

SEQ ID NO: 913973 - protein, 319 aa, Homo sapiens
MMVLKVEELVTGKKNGNGEAGEFLPEDFRDGEYEAAVTLEKQEDLKTLLAHPVTLGEQQWKSEKQREAELKKKKLEQRSKLENLEDLEIIIQLKKRKKYRKTKVPVVKEPEPEIITEPVDVPTFLKAALENKLPVVEKFLSDKNNPDVCDEYKRTALHRACLEGHLAIVEKLMEAGAQIEFRDMLESTAIHWASRGGNLDVLKLLLNKGAKISARDKLLSTALHVAVRTGHYECAEHLIACEADLNAKDREGDTPLHDAVRLNRYKMIRLLIMYGADLNIKNCAGKTPMDLVLHWQNGTKAIFDSLRENSYKTSRIATF

SEQ ID NO: 913974 - protein, 283 aa, Homo sapiens
MMVLKVEELVTGKKNGNGEAGEFLPEDFRDGEYEAAVTLEKQEDLKTLLAHPVTLGEQQWKSEKQREAELKKKKLEQRSKLENLEDLEIIIQLKKRKKYRKTKVPVVKEPEPEIIYKRTALHRACLEGHLAIVEKLMEAGAQIEFRDMLESTAIHWASRGGNLDVLKLLLNKGAKISARDKLLSTALHVAVRTGHYECAEHLIACEADLNAKDREGDTPLHDAVRLNRYKMIRLLIMYGADLNIKNCAGKTPMDLVLHWQNGTKAIFDSLRENSYKTSRIATF

SEQ ID NO: 913975 - protein, 118 aa, Homo sapiens
MMVLKVEELVTGKKNGNGEAGEFLPEDFRDGEYEAAVTLEKQEDLKTLLAHPVTLGEQQWKSEKQREAELKKKKLEQRSKLENLEDLEITWEDADNKEFKKKAGYKSINTYSMSSTVA

SEQ ID NO: 913976 - protein, 319 aa, Homo sapiens; identical to SEQ ID NO: 913973

SEQ ID NO: 913977 - protein, 190 aa, Homo sapiens
MMVLKVEELVTGKKNGNGEAGEFLPEDFRDGEYEAAVTLEKQEDLKTLLAHPVTLGEQQWKSEKQREAELKKKKLEQRSKLENLEDLEIIIQLKKRKKYRKTKVPVVKEPEPEIITEPVDVPTFLKAALENKLPVVEKFLSDKNNPDVCDEYKRTALHRACLEGHLDCSNCFYFLGIHCASVCQYSSKYE

SEQ ID NO: 913978 - protein, 92 aa, Homo sapiens [sequence omitted]

SEQ ID NO: 913979 - protein, 94 aa, Homo sapiens
MAAGPSGCLVPAFGLRLLLATVLQAVSAFGAEFSSEACRELGFSSNLLCSSCDLLGQFNLLQLDPDCRGCCQEEAQFETKKYSSIVSKQECHHS

SEQ ID NO: 913980 - protein, 92 aa, Homo sapiens [sequence omitted]

SEQ ID NO: 913981 - protein, 92 aa, Homo sapiens [sequence omitted]

SEQ ID NO: 913982 - protein, 1335 aa, Homo sapiens
MIRFELGPSGILDLGTNMKKLKMRAGGMSDSSKWKKQKRSPRPPRHMTKVTPGSELPTPNGTTLSSNLTGGMPFIDVPTPISSASSEAASAVVSPSTDSGLEFSSQTTSKEDLTDLEQPGSPGYSTATEPGSSELGVPEQPDLQEGTHVEKSQSASVESIPEVLEECTSPADHSDSASVHDMDYVNPRGVRFTQSSQKEGTALVPYGLPCIRELFRFLISLTNPHDRHNSEVMIHMGLHLLTVALESAPVAQCQTLLGLIKDEMCRHLFQLLSIERLNLYAASLRVCFLLFESMREHLKFQMEMYIKKLMEIITVENPKMPYEMKEMALEAIVQLWRIPSFVTELYINYDCDYYCSNLFEELTKLLSKNAFPVSGQLYTTHLLSLDALLTVIDSTEAHCQAKVLNSLTQQEKKETARPSCEIVDGTREASNTERTASDGKAVGMASDIPGLHLPGGGRLPPEHGKSGCSDLEEAVDSGADKKFARKPPRFSCLLPDPRELIEIKNKKKLLITGTEQFNQKPKKGIQFLQEKGLLTIPMDNTEVAQWLRENPRLDKKMIGEFVSDRKNIDLLESFVSTFSFQGLRLDEALRLYLEAFRLPGEAPVIQRLLEAFTERWMNCNGSPFANSDACFSLAYAVIMLNTDQHNHNVRKQNAPMTLEEFRKNLKGVNGGKDFEQDILEDMYHAIKNEEIVMPEEQTGLVRENYVWNVLLHRGATPEGIFLRVPTASYDLDLFTMTWGPTIAALSYVFDKSLEETIIQKAISGFRKCAMISAHYGLSDVFDNLIISLCKFTALSSESIENLPSVFGSNPKAHIAAKTVFHLAHRHGDILREGWKNIMEAMLQLFRAQLLPKAMIEVEDFVDPNGKISLQREETPSNRGESTVLSFVSWLTLSGPEQSSVRGPSTENQEAKRVALECIKQCDPEKMITESKFLQLESLQELMKALVSVTPDEETYDEEDAAFCLEMLLRIVLENRDRVGCVWQTVRDHLYHLCVQAQDFCFLVERAVVGLLRLAIRLLRREEISAQVLLSLRILLLMKPSVLSRVSHQVAYGLHELLKTNAANIHSGDDWATLFTLLECIGSGVKPPAALQATARADAPDAGAQSDSELPSYHQNDVSLDRGYTSDSEVYTDHGRPGKIHRSATDADVVNSGWLVVGKDDVDNSKPGPSRPGPSPLINQYSLTVGLDLGPHDTKSLLKCVESLSFIVRDAAHITPDNFELCVKTLRIFVEASLNGGCKSQEKRGKSHKYDSKGNRFKKKSKEGSMLRRPRTSSQHASRGGQSDDDEDEGVPASYHTVSLQYQVARPDAHPAHAGSLYLQLMGGGATPPGDRWPED

SEQ ID NO: 913983 - protein, 1516 aa, Homo sapiens
MVDKNIYIIQGEINIVVGAIKRNARWSTHTPLDEERDPLLHSFGHLKEVLNSITELSEIEPNVFLRPFLEVIRSEDTTGPITGLALTSVNKFLSYALIDPTHEGTAEGMENMADAVTHARFVGTDPASDEVVLMKILQVLRTLLLTPVGAHLTNESVCEIMQSCFRICFEMRLSELLRKSAEHTLVDMVQLLFTRLPQFKEEPKNYVGTNMKKLKMRAGGMSDSSKWKKQKRSPRPPRHMTKVTPGSELPTPNGTTLSSNLTGGMPFIDVPTPISSASSEAASAVVSPSTDSGLEFSSQTTSKEDLTDLEQPGSPGYSTATEPGSSELGVPEQPDLQEGTHVEKSQSASVESIPEVLEECTSPADHSDSASVHDMDYVNPRGVRFTQSSQKEGTALVPYGLPCIRELFRFLISLTNPHDRHNSEVMIHMGLHLLTVALESAPVAQCQTLLGLIKDEMCRHLFQLLSIERLNLYAASLRVCFLLFESMREHLKFQMEMYIKKLMEIITVENPKMPYEMKEMALEAIVQLWRIPSFVTELYINYDCDYYCSNLFEELTKLLSKNAFPVSGQLYTTHLLSLDALLTVIDSTEAHCQAKVLNSLTQQEKKETARPSSERTASDGKAVGMASDIPGLHLPGGGRLPPEHGKSGCSDLEEAVDSGADKKFARKPPRFSCLLPDPRELIEIKNKKKLLITGTEQFNQKPKKGIQFLQEKGLLTIPMDNTEVAQWLRENPRLDKKMIGEFVSDRKNIDLLESFVSTFSFQGLRLDEALRLYLEAFRLPGEAPVIQRLLEAFTERWMNCNGSPFANSDACFSLAYAVIMLNTDQHNHNVRKQNAPMTLEEFRKNLKGVNGGKDFEQDILEDMYHAIKNEEIVMPEEQTGLVRENYVWNVLLHRGATPEGIFLRVPTASYDLDLFTMTWGPTIAALSYVFDKSLEETIIQKAISGFRKCAMISAHYGLSDVFDNLIISLCKFTALSSESIENLPSVFGSNPKAHIAAKTVFHLAHRHGDILREGWKNIMEAMLQLFRAQLLPKAMIEVEDFVDPNGKISLQREETPSNRGESTVLSFVSWLTLSGPEQSSVRGPSTENQEAKRVALECIKQCDPEKMITESKFLQLESLQELMKALVSVTPDEETYDEEDAAFCLEMLLRIVLENRDRVGCVWQTVRDHLYHLCVQAQDFCFLVERAVVGLLRLAIRLLRREEISAQVLLSLRILLLMKPSVLSRVSHQVAYGLHELLKTNAANIHSGDDWATLFTLLECIGSGVKPPAALQATARADAPDAGAQSDSELPSYHQNDVSLDRGYTSDSEVYTDHGRPGKIHRSATDADVVNSGWLVVGKDDVDNSKPGPSRPGPSPLINQYSLTVGLDLGPHDTKSLLKCVESLSFIVRDAAHITPDNFELCVKTLRIFVEASLNGGCKSQEKRGKSHKYDSKGNRFKKKSKEGSMLRRPRTSSQHASRGGQSDDDEDEGVPASYHTVSLQYQVARPDAHPAHAGSLYLQLMGGGATPPGDRWPED

SEQ ID NO: 913984 - protein, 641 aa, Homo sapiens
LFAEDDVRFESNFSIVWALSGNLDMFRKDSVLNILIQSLDWETFEQYCAWQLSLAHNIPLETIIQKAISGFRKCAMISAHYGLSDVFDNLIISLCKFTALSSESIENLPSVFGSNPKAHIAAKTVFHLAHRHGDILREGWKNIMEAMLQLFRAQLLPKAMIEVEDFVDPNGKISLQREETPSNRGESTVLSFVSWLTLSGPEQSSVRGPSTENQEAKRVALECIKQCDPEKMITESKFLQLESLQELMKALVSVTPDEETYDEEDAAFCLEMLLRIVLENRDRVGCVWQTVRDHLYHLCVQAQDFCFLVERAVVGLLRLAIRLLRREEISAQVLLSLRILLLMKPSVLSRVSHQVAYGLHELLKTNAANIHSGDDWATLFTLLECIGSGVKPPAALQATARADAPDAGAQSDSELPSYHQNDVSLDRGYTSDSEVYTDHGRPGKIHRSATDADVVNSGWLVVGKDDVDNSKPGPSRPGPSPLINQYSLTVGLDLGPHDTKSLLKCVESLSFIVRDAAHITPDNFELCVKTLRIFVEASLNGGCKSQEKRGKSHKYDSKGNRFKKKSKEGSMLRRPRTSSQHASRGGQSDDDEDEGVPASYHTVSLQYQVARPDAHPAHAGSLYLQLMGGGATPPGDRWPED

SEQ ID NO: 913985 - protein, 1570 aa, Homo sapiens
MVDKNIYIIQGEINIVVGAIKRNARWSTHTPLDEERDPLLHSFGHLKEVLNSITELSEIEPNVFLRPFLEVIRSEDTTGPITGLALTSVNKFLSYALIDPTHEGTAEGMENMADAVTHARFVGTDPASDEVVLMKILQVLRTLLLTPVGAHLTNESVCEIMQSCFRICFEMRLSELLRKSAEHTLVDMVQLLFTRLPQFKEEPKNYVGTNMKKLKMRAGGMSDSSKWKKQKRSPRPPRHMTKVTPGSELPTPNGTTLSSNLTGGMPFIDVPTPISSASSEAASAVVSPSTDSGLEFSSQTTSKEDLTDLEQPGSPGYSTATEPGSSELGVPEQPDLQEGTHVEKSQSASVESIPEVLEECTSPADHSDSASVHDMDYVNPRGVRFTQSSQKEGTALVPYGLPCIRELFRFLISLTNPHDRHNSEVMIHMGLHLLTVALESAPVAQCQTLLGLIKDEMCRHLFQLLSIERLNLYAASLRVCFLLFESMREHLKFQMEMYIKKLMEIITVENPKMPYEMKEMALEAIVQLWRIPSFVTELYINYDCDYYCSNLFEELTKLLSKNAFPVSGQLYTTHLLSLDALLTVIDSTEAHCQAKVLNSLTQQEKKETARPSCEIVDGTREASNTERTASDGKAVGMASDIPGLHLPGGGRLPPEHGKSGCSDLEEAVDSGADKKFARKPPRFSCLLPDPRELIEIKNKKKLLITGTEQFNQKPKKGIQFLQEKGLLTIPMDNTEVAQWLRENPRLDKKMIGEFVSDRKNIDLLESFVSTFSFQGLRLDEALRLYLEAFRLPGEAPVIQRLLEAFTERWMNCNGSPFANSDACFSLAYAVIMLNTDQHNHNVRKQNAPMTLEEFRKNLKGVNGGKDFEQDILEDMYHAIKNEEIVMPEEQTGLVRENYVWNVLLHRGATPEGIFLRVPTASYDLDLFTMTWGPTIAALSYVFDKSLEETIIQKAISGFRKCAMISAHYGLSDVFDNLIISLCKFTALSSESIENLPSVFGSNPKAHIAAKTVFHLAHRHGDILREGWKNIMEAMLQLFRAQLLPKAMIEVEDFVDPNGKISLQREETPSNRGESTVLSFVSWLTLSGPEQSSVRGPSTENQEAKRVALECIKQCDPEKMITESKFLQLESLQELMKALVSVTPDEETYDEEDAAFCLEMLLRIVLENRDRVGCVWQTVRDHLYHLCVQAQDFCFLVERAVVGLLRLAIRLLRREEISAQVLLSLRILLLMKPSVLSRVSHQVAYGLHELLKTNAANIHSGDDWATLFTLLECIGSGVKPPAALQATARADAPDAGAQSDSELPSYHQNDVSLDRGYTSDSEVYTDHGRPGKIHRSATDADVVNSGWLVVSDNMGSNESLLLDLWEEFLVLCKDIHTGAKPVSPAPLCTLQVGKDDVDNSKPGPSRPGPSPLINQYSLTVGLDLGPHDTKSLLKCVESLSFIVRDAAHITPDNFELCVKTLRIFVEASLNGGCKSQEKRGKSHKYDSKGNRFKKKSKEGSMLRRPRTSSQHASRGGQSDDDEDEGVPASYHTVSLQYQVARPDAHPAHAGSLYLQLMGGGATPPGDRWPED

SEQ ID NO: 913986 - protein, 1528 aa, Homo sapiens
MVDKNIYIIQGEINIVVGAIKRNARWSTHTPLDEERDPLLHSFGHLKEVLNSITELSEIEPNVFLRPFLEVIRSEDTTGPITGLALTSVNKFLSYALIDPTHEGTAEGMENMADAVTHARFVGTDPASDEVVLMKILQVLRTLLLTPVGAHLTNESVCEIMQSCFRICFEMRLSELLRKSAEHTLVDMVQLLFTRLPQFKEEPKNYVGTNMKKLKMRAGGMSDSSKWKKQKRSPRPPRHMTKVTPGSELPTPNGTTLSSNLTGGMPFIDVPTPISSASSEAASAVVSPSTDSGLEFSSQTTSKEDLTDLEQPGSPGYSTATEPGSSELGVPEQPDLQEGTHVEKSQSASVESIPEVLEECTSPADHSDSASVHDMDYVNPRGVRFTQSSQKEGTALVPYGLPCIRELFRFLISLTNPHDRHNSEVMIHMGLHLLTVALESAPVAQCQTLLGLIKDEMCRHLFQLLSIERLNLYAASLRVCFLLFESMREHLKFQMEMYIKKLMEIITVENPKMPYEMKEMALEAIVQLWRIPSFVTELYINYDCDYYCSNLFEELTKLLSKNAFPVSGQLYTTHLLSLDALLTVIDSTEAHCQAKVLNSLTQQEKKETARPSCEIVDGTREASNTERTASDGKAVGMASDIPGLHLPGGGRLPPEHGKSGCSDLEEAVDSGADKKFARKPPRFSCLLPDPRELIEIKNKKKLLITGTEQFNQKPKKGIQFLQEKGLLTIPMDNTEVAQWLRENPRLDKKMIGEFVSDRKNIDLLESFVSTFSFQGLRLDEALRLYLEAFRLPGEAPVIQRLLEAFTERWMNCNGSPFANSDACFSLAYAVIMLNTDQHNHNVRKQNAPMTLEEFRKNLKGVNGGKDFEQDILEDMYHAIKNEEIVMPEEQTGLVRENYVWNVLLHRGATPEGIFLRVPTASYDLDLFTMTWGPTIAALSYVFDKSLEETIIQKAISGFRKCAMISAHYGLSDVFDNLIISLCKFTALSSESIENLPSVFGSNPKAHIAAKTVFHLAHRHGDILREGWKNIMEAMLQLFRAQLLPKAMIEVEDFVDPNGKISLQREETPSNRGESTVLSFVSWLTLSGPEQSSVRGPSTENQEAKRVALECIKQCDPEKMITESKFLQLESLQELMKALVSVTPDEETYDEEDAAFCLEMLLRIVLENRDRVGCVWQTVRDHLYHLCVQAQDFCFLVERAVVGLLRLAIRLLRREEISAQVLLSLRILLLMKPSVLSRVSHQVAYGLHELLKTNAANIHSGDDWATLFTLLECIGSGVKPPAALQATARADAPDAGAQSDSELPSYHQNDVSLDRGYTSDSEVYTDHGRPGKIHRSATDADVVNSGWLVVGKDDVDNSKPGPSRPGPSPLINQYSLTVGLDLGPHDTKSLLKCVESLSFIVRDAAHITPDNFELCVKTLRIFVEASLNGGCKSQEKRGKSHKYDSKGNRFKKKSKEGSMLRRPRTSSQHASRGGQSDDDEDEGVPASYHTVSLQYQVARPDAHPAHAGSLYLQLMGGGATPPGDRWPED

SEQ ID NO: 913987 - protein, 1528 aa, Homo sapiens; identical to SEQ ID NO: 913986

SEQ ID NO: 913988 - protein, 431 aa, Homo sapiens
MADASPRRNVARVTNMTAKGTASRRNPKRDQCFAGLEPPANMPLGAGRVMMMRTKACLPATIRCLYSIRLLDLMHTLHTRAASIYSSWAEEQRHLETGGQKIEADSRTLWAHCWCPLLQGIACLCCDARRQVRMQALTYLQRALLVHDLQKLDALEWESCFNKVLFPLLTKLLENISPADVGGMEETRMRASTLLSKVFLQHLSPLLSLSTFAALWLTILDFMDKYMHAGSSDLLSEAIPESLKNMLLVMDTAEIFHSADARGGGPSALWEITWERIDCFLPHLRDELFKQTVIQDPMPMEPQGQKPLASAHLTSAAGDTRTPGHPPPPEIPSELGACDFEKPESPRAASSSSPGSPVASSPSRLSPTPDGPPPLAQPPLILQPLASPLQVGVPPMTLPIILNPALIEATSPVPLLATPRPTDPIPTSEVN

SEQ ID NO: 913989 - protein, 340 aa, Homo sapiens
ILDSGHSGLGAILGLSHPLGPLLVPFTAGIACLCCDARRQVRMQALTYLQRALLVHDLQKLDALEWESCFNKVLFPLLTKLLENISPADVGGMEETRMRASTLLSKVFLQHLSPLLSLSTFAALWLTILDFMDKYMHAGSSDLLSEAIPESLKNMLLVMDTAEIFHSADARGGGPSALWEITWERIDCFLPHLRDELFKQTVIQDPMPMEPQGQKPLASAHLTSAAGDTRTPGHPPPPEIPSELGACDFEKPESPRAASSSSPGSPVASSPSRLSPTPDGPPPLAQPPLILQPLASPLQVGVPPMTLPIILNPALIEATSPVPLLATPRPTDPIPTSEVN

SEQ ID NO: 913990 - protein, 1528 aa, Homo sapiens; identical to SEQ ID NO: 913986

SEQ ID NO: 913991 - protein, 1528 aa, Homo sapiens; identical to SEQ ID NO: 913986

SEQ ID NO: 913992 - protein, 1287 aa, Homo sapiens
MVDKNIYIIQGEINIVVGAIKRNARWSTHTPLDEERDPLLHSFGHLKEVLNSITELSEIEPNVFLRPFLEVIRSEDTTGPITGLALTSVNKFLSYALIDPTHEGTAEGMENMADAVTHARFVGTDPASDEVVLMKILQVLRTLLLTPVGAHLTNESVCEIMQSCFRICFEMRLSELLRKSAEHTLVDMVQLLFTRLPQFKEEPKNYVGTNMKKLKMRAGGMSDSSKWKKQKRSPRPPRHMTKVTPGSELPTPNGTTLSSNLTGGMPFIDVPTPISSASSEAASAVVSPSTDSGLEFSSQTTSKEDLTDLEQPGSPGYSTATEPGSSELGVPEQPDLQEGTHVEKSQSASVESIPEVLEECTSPADHSDSASVHDMDYVNPRGVRFTQSSQKEGTALVPYGLPCIRELFRFLISLTNPHDRHNSEVMIHMGLHLLTVALESAPVAQCQTLLGLIKDEMCRHLFQLLSIERLNLYAASLRVCFLLFESMREHLKFQMEMYIKKLMEIITVENPKMPYEMKEMALEAIVQLWRIPSFVTELYINYDCDYYCSNLFEELTKLLSKNAFPVSGQLYTTHLLSLDALLTVIDSTEAHCQAKVLNSLTQQEKKETARPSCEIVDGTREASNTERTASDGKAVGMASDIPGLHLPGGGRLPPEHGKSGCSDLEEAVDSGADKKFARKPPRFSCLLPDPRELIEIKNKKKLLITGTEQFNQKPKKGIQFLQEKGLLTIPMDNTEVAQWLRENPRLDKKMIGEFVSDRKNIDLLESFVSTFSFQGLRLDEALRLYLEAFRLPGEAPVIQRLLEAFTERWMNCNGSPFANSDACFSLAYAVIMLNTDQHNHNVRKQNAPMTLEEFRKNLKGVNGGKDFEQDILEDMYHAIKNEEIVMPEEQTGLVRENYVWNVLLHRGATPEGIFLRVPTASYDLDLFTMTWGPTIAALSYVFDKSLEETIIQKAISGFRKCAMISAHYGLSDVFDNLIISLCKFTALSSESIENLPSVFGSNPKAHIAAKTVFHLAHRHGDILREGWKNIMEAMLQLFRAQLLPKAMIEVEDFVDPNGKISLQREETPSNRGESTVLSFVSWLTLSGPEQSSVRGPSTENQEAKRVALECIKQCDPEKMITESKFLQLESLQELMKALVSVTPDEETYDEEDAAFCLEMLLRIVLENRDRVGCVWQTVRDHLYHLCVQAQDFCFLVERAVVGLLRLAIRLLRREEISAQVLPLPAAFWATGLKPQSLTYSRGVQADQGVSRLFGASPLTPPLEKNPKFAKAQTIPTSKGLDLNLGGP

SEQ ID NO: 913993 - protein, 83 aa, Homo sapiens
LSTSLNLSFFAGADPTHEGTAEGMENMADAVTHARFVGTDPASDEVVLMKILQVSEREIAIRLMARGWCRRLYLLCPQHETVF

SEQ ID NO: 913994 - protein, 1528 aa, Homo sapiens; identical to SEQ ID NO: 913986

SEQ ID NO: 913995 - protein, 1311 aa, Homo sapiens
MAVVWMVREMRKRKRSPRPPRHMTKVTPGSELPTPNGTTLSSNLTGGMPFIDVPTPISSASSEAASAVVSPSTDSGLEFSSQTTSKEDLTDLEQPGSPGYSTATEPGSSELGVPEQPDLQEGTHVEKSQSASVESIPEVLEECTSPADHSDSASVHDMDYVNPRGVRFTQSSQKEGTALVPYGLPCIRELFRFLISLTNPHDRHNSEVMIHMGLHLLTVALESAPVAQCQTLLGLIKDEMCRHLFQLLSIERLNLYAASLRVCFLLFESMREHLKFQMEMYIKKLMEIITVENPKMPYEMKEMALEAIVQLWRIPSFVTELYINYDCDYYCSNLFEELTKLLSKNAFPVSGQLYTTHLLSLDALLTVIDSTEAHCQAKVLNSLTQQEKKETARPSCEIVDGTREASNTERTASDGKAVGMASDIPGLHLPGGGRLPPEHGKSGCSDLEEAVDSGADKKFARKPPRFSCLLPDPRELIEIKNKKKLLITGTEQFNQKPKKGIQFLQEKGLLTIPMDNTEVAQWLRENPRLDKKMIGEFVSDRKNIDLLESFVSTFSFQGLRLDEALRLYLEAFRLPGEAPVIQRLLEAFTERWMNCNGSPFANSDACFSLAYAVIMLNTDQHNHNVRKQNAPMTLEEFRKNLKGVNGGKDFEQDILEDMYHAIKNEEIVMPEEQTGLVRENYVWNVLLHRGATPEGIFLRVPTASYDLDLFTMTWGPTIAALSYVFDKSLEETIIQKAISGFRKCAMISAHYGLSDVFDNLIISLCKFTALSSESIENLPSVFGSNPKAHIAAKTVFHLAHRHGDILREGWKNIMEAMLQLFRAQLLPKAMIEVEDFVDPNGKISLQREETPSNRGESTVLSFVSWLTLSGPEQSSVRGPSTENQEAKRVALECIKQCDPEKMITESKFLQLESLQELMKALVSVTPDEETYDEEDAAFCLEMLLRIVLENRDRVGCVWQTVRDHLYHLCVQAQDFCFLVERAVVGLLRLAIRLLRREEISAQVLLSLRILLLMKPSVLSRVSHQVAYGLHELLKTNAANIHSGDDWATLFTLLECIGSGVKPPAALQATARADAPDAGAQSDSELPSYHQNDVSLDRGYTSDSEVYTDHGRPGKIHRSATDADVVNSGWLVVGKDDVDNSKPGPSRPGPSPLINQYSLTVGLDLGPHDTKSLLKCVESLSFIVRDAAHITPDNFELCVKTLRIFVEASLNGGCKSQEKRGKSHKYDSKGNRFKKKSKEGSMLRRPRTSSQHASRGGQSDDDEDEGVPASYHTVSLQYQVARPDAHPAHAGSLYLQLMGGGATPPGDRWPED

SEQ ID NO: 913996 - protein, 1153 aa, Homo sapiens
FFVLEEKFSKSPPIQKEGTALVPYGLPCIRELFRFLISLTNPHDRHNSEVMIHMGLHLLTVALESAPVAQCQTLLGLIKDEMCRHLFQLLSIERLNLYAASLRVCFLLFESMREHLKFQMEMYIKKLMEIITVENPKMPYEMKEMALEAIVQLWRIPSFVTELYINYDCDYYCSNLFEELTKLLSKNAFPVSGQLYTTHLLSLDALLTVIDSTEAHCQAKVLNSLTQQEKKETARPSCEIVDGTREASNTERTASDGKAVGMASDIPGLHLPGGGRLPPEHGKSGCSDLEEAVDSGADKKFARKPPRFSCLLPDPRELIEIKNKKKLLITGTEQFNQKPKKGIQFLQEKGLLTIPMDNTEVAQWLRENPRLDKKMIGEFVSDRKNIDLLESFVSTFSFQGLRLDEALRLYLEAFRLPGEAPVIQRLLEAFTERWMNCNGSPFANSDACFSLAYAVIMLNTDQHNHNVRKQNAPMTLEEFRKNLKGVNGGKDFEQDILEDMYHAIKNEEIVMPEEQTGLVRENYVWNVLLHRGATPEGIFLRVPTASYDLDLFTMTWGPTIAALSYVFDKSLEETIIQKAISGFRKCAMISAHYGLSDVFDNLIISLCKFTALSSESIENLPSVFGSNPKAHIAAKTVFHLAHRHGDILREGWKNIMEAMLQLFRAQLLPKAMIEVEDFVDPNGKISLQREETPSNRGESTVLSFVSWLTLSGPEQSSVRGPSTENQEAKRVALECIKQCDPEKMITESKFLQLESLQELMKALVSVTPDEETYDEEDAAFCLEMLLRIVLENRDRVGCVWQTVRDHLYHLCVQAQDFCFLVERAVVGLLRLAIRLLRREEISAQVLLSLRILLLMKPSVLSRVSHQVAYGLHELLKTNAANIHSGDDWATLFTLLECIGSGVKPPAALQATARADAPDAGAQSDSELPSYHQNDVSLDRGYTSDSEVYTDHGRPGKIHRSATDADVVNSGWLVVGKDDVDNSKPGPSRPGPSPLINQYSLTVGLDLGPHDTKSLLKCVESLSFIVRDAAHITPDNFELCVKTLRIFVEASLNGGCKSQEKRGKSHKYDSKGNRFKKKSKEGSMLRRPRTSSQHASRGGQSDDDEDEGVPASYHTVSLQYQVARPDAHPAHAGSLYLQLMGGGATPPGDRWPED

SEQ ID NO: 913997 - protein, 437 aa, Homo sapiens
SRGSWEAGTENKMGESGLECIQCDPEKMITESKFLQLESLQELMKALVSVTPDEETYDEEDAAFCLEMLLRIVLENRDRVGCVWQTVRDHLYHLCVQAQDFCFLVERAVVGLLRLAIRLLRREEISAQVLLSLRILLLMKPSVLSRVSHQVAYGLHELLKTNAANIHSGDDWATLFTLLECIGSGVKPPAALQATARADAPDAGAQSDSELPSYHQNDVSLDRGYTSDSEVYTDHGRPGKIHRSATDADVVNSGWLVVGKDDVDNSKPGPSRPGPSPLINQYSLTVGLDLGPHDTKSLLKCVESLSFIVRDAAHITPDNFELCVKTLRIFVEASLNGGCKSQEKRGKSHKYDSKGNRFKKKSKEGSMLRRPRTSSQHASRGGQSDDDEDEGVPASYHTVSLQYQVARPDAHPAHAGSLYLQLMGGGATPPGDRWPED

SEQ ID NO: 913998 - protein, 1528 aa, Homo sapiens; identical to SEQ ID NO: 913986

SEQ ID NO: 913999 - protein, 1528 aa, Homo sapiens; identical to SEQ ID NO: 913986

SEQ ID NO: 914000 - protein, 431 aa, Homo sapiens; identical to SEQ ID NO: 913988

SEQ ID NO: 914001 - protein, 1528 aa, Homo sapiens; identical to SEQ ID NO: 913986

SEQ ID NO: 914002 - protein, 1528 aa, Homo sapiens; identical to SEQ ID NO: 913986

SEQ ID NO: 914003 - protein, 1528 aa, Homo sapiens; identical to SEQ ID NO: 913986

SEQ ID NO: 914004 - protein, 631 aa, Homo sapiens [sequence omitted]

SEQ ID NO: 914005 - protein, 570 aa, Homo sapiens
EPVAQVSGSSSAQPGSMIVDKLLDDSRGGEGLRDAAGGCGLMTSPLNLSYFYGASPPAAAPGACDASCSVLGPSAPGSPGSDSSDFSSASSVSSCGAVESRSRGGARAERQPVEPHMGVGRQQRGPFQGVRVKNSVKELLLHIRSHKQKASGQAVDDFKTQGVNIEQFRELKNTVSYSGKRKGPDSLSDGPACKRPALLHSQFLTPPQTPTPGESMEDVHLNEPKQESSADLLQNIINIKNECSPVSLNTVQVSWLNPVVVPQSSPAEQCQDFHGGQVFSPPQKCQPFQVRGSQQMIDQASLYQYSPQNQHVEQQPHYTHKPTLEYSPFPIPPQSPAYEPNLFDGPESQFCPNQSLVSLLGDQRESENIANPMQTSSSVQQQNDAHLHSFSMMPSSACEAMVGHEMASDSSNTSLPFSNMGNPMNTTQLGKSLFQWQVEQEESKLANISQDQFLSKDADGDTFLHIAVAQGRRALSYVLARKMNALHMLDIKEHNGQSAFQVAVAANQHLIVQDLVNIGAQVNTTDCWGRTPLHVCAEKGHSQVLQVRGSKPGFHHCKAREIELDIRSRI

SEQ ID NO: 914006 - protein, 734 aa, Homo sapiens
EPVAQVSGSSSAQPGSMIVDKLLDDSRGGEGLRDAAGGCGLMTSPLNLSYFYGASPPAAAPGACDASCSVLGPSAPGSPGSDSSDFSSASSVSSCGAVESRSRGGARAERQPVEPHMGVGRQQRGPFQGVRVKNSVKELLLHIRSHKQKASGQAVDDFKTQGVNIEQFRELKNTVSYSGKRKGPDSLSDGPACKRPALLHSQFLTPPQTPTPGESMEDVHLNEPKQESSADLLQNIINIKNECSPVSLNTVQVSWLNPVVVPQSSPAEQCQDFHGGQVFSPPQKCQPFQVRGSQQMIDQASLYQYSPQNQHVEQQPHYTHKPTLEYSPFPIPPQSPAYEPNLFDGPESQFCPNQSLVSLLGDQRESENIANPMQTSSSVQQQNDAHLHSFSMMPSSACEAMVGHEMASDSSNTSLPFSNMGNPMNTTQLGKSLFQWQVEQEESKLANISQDQFLSKDADGDTFLHIAVAQGRRALSYVLARKMNALHMLDIKEHNGQSAFQVAVAANQHLIVQDLVNIGAQVNTTDCWGRTPLHVCAEKGHSQVLQAIQKGAVGSNQFVDLEATNYDGLTPLHCAVIAHNAVVHELQRNQQPHSPEVQELLLKNKSLVDTIKCLIQMGAAVEAKDRKSGRTALHLAAEEANLELIRLFLELPSCLSFVNAKAYNGNTALHVAASLQYRLTQLDAVRLLMRKGADPSTRNLENEQPVHLVPDGPVGEQIRRILKGKSIQQRAPPY

SEQ ID NO: 914007 - protein, 697 aa, Homo sapiens
EPVAQVSGSSSAQPGSMIVDKLLDDSRGGEGLRDAAGGCGLMTSPLNLSYFYGASPPAAAPGACDASCSVLGPSAPGSPGSDSSDFSSASSVSSCGAVESRSRGGARAERQPVEPHMGVGRQQRGPFQGVRVKNSVKELLLHIRSHKQKASGQAVDDFKTQGVNIEQFRELKNTVSYSGKRKGPDSLSDGPACKRPALLHSQFLTPPQTPTPGESMEDVHLNEPKQESSADLLQNIINIKNECSPVSLNTVQVSWLNPVVVPQSSPAEQCQDFHGGQVFSPPQKCQPFQVRGSQQMIDQASLYQYSPQNQHVEQQPHYTHKPTLEYSPFPIPPQSPAYEPNLFDGPESQFCPNQSLVSLLGDQRESENIANPMQTSSSVQQQNDAHLHSFSMMPSSACEAMVGHEMASDSSNTSLPFSNMGNPMNTTQLGKSLFQWQVEQEESKLANISQDQFLSKDADGDTFLHIAVAQGRRALSYVLARKMNALHMLDIKEHNGQSAFQVAVAANQHLIVQDLVNIGAQVNTTDCWGRTPLHVCAEKGHSQVLQAIQKGAVGSNQFVDLEATNYDGLTPLHCAVIAHNAVVHELQRNQQPHSPEVQELLLKNKSLVDTIKCLIQMGAAVEAKAYNGNTALHVAASLQYRLTQLDAVRLLMRKGADPSTRNLENEQPVHLVPDGPVGEQIRRILKGKSIQQRAPPY

SEQ ID NO: 914008 - protein, 734 aa, Homo sapiens; identical to SEQ ID NO: 914006

SEQ ID NO: 914009 - protein, 734 aa, Homo sapiens; identical to SEQ ID NO: 914006

SEQ ID NO: 914010 - protein, 570 aa, Homo sapiens; identical to SEQ ID NO: 914005

SEQ ID NO: 914011 - protein, 734 aa, Homo sapiens; identical to SEQ ID NO: 914006

SEQ ID NO: 914012 - protein, 618 aa, Homo sapiens
MGVGRQQRGPFQGVRVKNSVKELLLHIRSHKQKASGQAVDDFKTQGVNIEQFRELKNTVSYSGKRKGPDSLSDGPACKRPALLHSQFLTPPQTPTPGESMEDVHLNEPKQESSADLLQNIINIKNECSPVSLNTVQVSWLNPVVVPQSSPAEQCQDFHGGQVFSPPQKCQPFQVRGSQQMIDQASLYQYSPQNQHVEQQPHYTHKPTLEYSPFPIPPQSPAYEPNLFDGPESQFCPNQSLVSLLGDQRESENIANPMQTSSSVQQQNDAHLHSFSMMPSSACEAMVGHEMASDSSNTSLPFSNMGNPMNTTQLGKSLFQWQVEQEESKLANISQDQFLSKDADGDTFLHIAVAQGRRALSYVLARKMNALHMLDIKEHNGQSAFQVAVAANQHLIVQDLVNIGAQVNTTDCWGRTPLHVCAEKGHSQVLQAIQKGAVGSNQFVDLEATNYDGLTPLHCAVIAHNAVVHELQRNQQPHSPEVQELLLKNKSLVDTIKCLIQMGAAVEAKDRKSGRTALHLAAEEANLELIRLFLELPSCLSFVNAKAYNGNTALHVAASLQYRLTQLDAVRLLMRKGADPSTRNLENEQPVHLVPDGPVGEQIRRILKGKSIQQRAPPY

SEQ ID NO: 914013 - protein, 734 aa, Homo sapiens; identical to SEQ ID NO: 914006

SEQ ID NO: 914014 - protein, 734 aa, Homo sapiens; identical to SEQ ID NO: 914006

SEQ ID NO: 914015 - protein, 103 aa, Homo sapiens
GLLYTLSKFLSSFHEISPFLMSDNSFLCLQAYNGNTALHVAASLQYRLTQLDAVRLLMRKGADPSTRNLENEQPVHLVPDGPVGEQIRRILKGKSIQQRAPPY

SEQ ID NO: 914016 - protein, 462 aa, Homo sapiens
EPVAQVSGSSSAQPGSMIVDKLLDDSRGGEGLRDAAGGCGLMTSPLNLSYFYGASPPAAAPGACDASCSVLGPSAPGSPGSDSSDFSSASSVSSCGAVESRSRGGARAERQPVEPHMGVGRQQRGPFQGVRVKNSVKELLLHIRSHKQKASGQAVDDFKTQGVNIEQFRELKNTVSYSGKRKGPDSLSDGPACKRPALLHSQFLTPPQTPTPGESMEDVHLNEPKQESSADLLQNIINIKNECSPVSLNTVQVSWLNPVVVPQSSPAEQCQDFHGGQVFSPPQKCQPFQVRGSQQMIDQASLYQYSPQNQHVEQQPHYTHKPTLEYSPFPIPPQSPAYEPNLFDGPESQFCPNQSLVSLLGDQRESENIANPMQTSSSVQQQNDAHLHSFSMMPSSACEAMVGHEMASDSSNTSLPFSNMGNPMNTTQLGKSLFQWQVEQEESKLANISQDQFLSKDADGDT

SEQ ID NO: 914017 - protein, 524 aa, Homo sapiens
MFVNSNGYNLGVREDEVVVNDVDLPPWAKKPEDFVRINRMALESEFVSCQLHQWIDLIFGYKQRGPEAVRALNVFHYLTYEGSVNLDSITDPVLREIPEAYFIRDPHTFLLTKDFIKAMEAQIQNFGQTPSQLLIEPHPPRSSAMHLCFLPQSPLMFKDQMQQDVIMVLKFPSNSPVTHVAANTLPHLTIPAVVTVTCSRLFAVNRWHNTVGLRGAPGYSLDQAHHLPIEMDPLIANNSGVNKRQITDLVDQSIQINAHCFVVTADNRYILICGFWDKSFRVYSTETGKLTQIVFGHWDVVTCLARSESYIGGDCYIVSGSRDATLLLWYWSGRHHIIGDNPNSSDYPAPRAVLTGHDHEVVCVSVCAELGLVISGAKEGPCLVHTITGDLLRALEGPENCLFPRLISVSSEGHCIIYYERGRFSNFSINGKLLAQMEINDSTRAILLSSDGQNLVTGGDNGVVEVWQACDFKQLYIYPGCDAGIRAMDLSHDQRTLITGMASGSIVAFNIDFNRWHYEHQNRY

SEQ ID NO: 914018 - protein, 1027 aa, Homo sapiens
NTFFVVGLVCMKSSTSVVELVMLLCSQEWQNSIQKNAGLAFIELINEGRLLCHAMKDHIVRVANEAEFILNRQRAEDVHKHAEFESQCAQYAADRREEEKMCDHLISAAKHRDHVTANQLKQKILNILTNKHGAWGAVSHSQLHDFWRLDYWEDDLRRRRRFVRNAFGSTHAEALLKAAIEYGTEEDVVKSKKTFRSQAIVNQNAETELMLEGDDDAVSLLQEKEIDNLAGPVVLSTPAQLIAPVVVAKGTLSITTTEIYFEVDEDDSAFKKIDTKVLAYTEGLHGKWMFSEIRAVFSRRYLLQNTALEVFMANRTSVMFNFPDQATVKKVVYSLPRVGVGTSYGLPQARRISLATPRQLYKSSNMTQRWQRREISNFEYLMFLNTIAGRTYNDLNQYPVFPWVLTNYESEELDLTLPGNFRDLSKPIGALNPKRAVFYAERYETWEDDQSPPYHYNTHYSTATSTLSWLVRIEPFTTFFLNANDGKFDHPDRTFSSVARSWRTSQRDTSDVKELIPEFYYLPEMFVNSNGYNLGVREDEVVVNDVDLPPWAKKPEDFVRINRMALESEFVSCQLHQWIDLIFGYKQRGPEAVRALNVFHYLTYEGSVNLDSITDPVLREAMEAQIQNFGQTPSQLLIEPHPPRSSAMHLCFLPQSPLMFKDQMQQDVIMVLKFPSNSPVTHVAANTLPHLTIPAVVTVTCSRLFAVNRWHNTVGLRGAPGYSLDQAHHLPIEMDPLIANNSGVNKRQITDLVDQSIQINAHCFVVTADNRYILICGFWDKSFRVYSTETGKLTQIVFGHWDVVTCLARSESYIGGDCYIVSGSRDATLLLWYWSGRHHIIGDNPNSSDYPAPRAVLTGHDHEVVCVSVCAELGLVISGAKEGPCLVHTITGDLLRALEGPENCLFPRLISVSSEGHCIIYYERGRFSNFSINGKLLAQMEINDSTRAILLSSDGQNLVTGGDNGVVEVWQACDFKQLYIYPGCDAGIRAMDLSHDQRTLITGMASGSIVAFNIDFNRWHYEHQNRY

SEQ ID NO: 914019 - protein, 1027 aa, Homo sapiens; identical to SEQ ID NO: 914018

SEQ ID NO: 914020 - protein, 269 aa, Homo sapiens
LCLEVKEECRLLNAPPVPPRGGNGSGRLSSSPPVPPRFPKLQPVHSPSSSLSYYSSGLQDGAGSRSGSGSPSPDTYSLYCYPCTWGDCKEPVLEPFDPFELGQGSSPEPELLRSQEPRAVGTPGPGPRLSPLGPSKAFEPEGLVLHQVPTPLSPAALQGPEAGGALFLTQGRLEGPPASPRDGATGFGVRDASSWQPPADLSALSLEEVSRSLRFIGLSEDVVSFFARERIDGSIFVQLSEDILADDFHLTKLQVKKIMQFIKGWRPKI

SEQ ID NO: 914021 - protein, 269 aa, Homo sapiens; identical to SEQ ID NO: 914020

SEQ ID NO: 914022 - protein, 402 aa, Homo sapiens
LCLEVKEECRLLNAPPVPPRGGNGSGRLSSSPPVPPRFPKLQPVHSPSSSLSYYSSGLQDGAGSRSGSGSPSPDTYSLYCYPCTWGDCKVGESSSRPAPGPLPSTTQPSQASRALTEPLSGRAASLLGADTPVKTYHSCPPLFKPSHPQKRFAPFGALNPFSGPAYPSGPSAALSSGPRTTSGPVATSGPAYSPGPASPGQAYSAAPPSSCAPSSSSSSEWQEPVLEPFDPFELGQGSSPEPELLRSQEPRAVGTPGPGPRLSPLGPSKAFEPEGLVLHQVPTPLSPAALQGPEAGGALFLTQGRLEGPPASPRDGATGFGVRDASSWQPPADLSALSLEEVSRSLRFIGLSEDVVSFFARERIDGSIFVQLSEDILADDFHLTKLQVKKIMQFIKGWRPKI

SEQ ID NO: 914023 - protein, 269 aa, Homo sapiens; identical to SEQ ID NO: 914020

SEQ ID NO: 914024 - protein, 55 aa, Homo sapiens
DEEVVIPVIGWVILELVCEENCFIQKSDDKVTPGKNGWTRPVSQEWTMVSGWWVG

SEQ ID NO: 914025 - protein, 347 aa, Homo sapiens
TEKGSTCGGHDKQAKIAVTVEFDLKVTINQHRQTELRPLLNKFLTTAKDKNRWEDPGKQLYNVEATSYALLALLQLKDFDFVPPVVRWLNEQRYYGGGYGSTQATFMVFQALAQYQKDAPDHQELNLDVSLQLPSRSSKITHRIHWESASLLRSEETKENEGFTVTAEGKGQGTLSVVTMYHAKAKDQLTCNKFDLKVTIKPAPETEKRPQDAKNTMILEICTRYRGDQDATMSILDISMMTGFAPDTDDLKQLANGVDRYISKYELDKAFSDRNTLIIYLDKVSHSEDDCLAFKVHQYFNVELIQPGAVKVYAYYNLEESCTRFYHPEKEDGKLNKLCRDELCRVC

SEQ ID NO: 914026 - protein, 360 aa, Homo sapiens
TEKGSTCGGHDKQAKIAVTVEFDLKVTINQHRQTELRPLLNKFLTTAKDKNRWEDPGKQLYNVEATSYALLALLQLKDFDFVPPVVRWLNEQRYYGGGYGSTQATFMVFQALAQYQKDAPDHQELNLDVSLQLPSRSSKITHRIHWESASLLRSEETKENEGFTVTAEGKGQGTLSVVTMYHAKAKDQLTCNKFDLKVTIKPAPETGIPSPIFLSSVFLEKRPQDAKNTMILEICTRYRGDQDATMSILDISMMTGFAPDTDDLKQLANGVDRYISKYELDKAFSDRNTLIIYLDKVSHSEDDCLAFKVHQYFNVELIQPGAVKVYAYYNLEESCTRFYHPEKEDGKLNKLCRDELCRVC

SEQ ID NO: 914027 - protein, 222 aa, Homo sapiens
TEKGSTCGGHDKQAKIAVTVEFDLKVTINQHRQTELRPLLNKFLTTAKDKNRWEDPGKQLYNVEATSYALLALLQLKDFDFVPPVVRWLNEQRYYGGGYGSTQATFMVFQALAQYQKDAPDHQELNLDVSLQLPSRSSKITHRIHWESASLLRSEETKENEGFTVTAEGKGQGTLSVVTMYHAKAKDQLTCNKFDLKVTIKPAPETGTGETRMPLCLYWTYP

SEQ ID NO: 914028 - protein, 347 aa, Homo sapiens; identical to SEQ ID NO: 914025

SEQ ID NO: 914029 - protein, 347 aa, Homo sapiens; identical to SEQ ID NO: 914025

SEQ ID NO: 914030 - protein, 347 aa, Homo sapiens; identical to SEQ ID NO: 914025

SEQ ID NO: 914031 - protein, 347 aa, Homo sapiens; identical to SEQ ID NO: 914025

SEQ ID NO: 914032 - protein, 319 aa, Homo sapiens
TEKGSTCGGHDKQAKIAVTVEFDLKVTINQHRQTELRPLLNKFLTTAKDKNRWEDPGKQLYNVEATSYALLALLQLKDFDFVPPVVRWLNEQRYYGGGYGSTQATFMVFQALAQYQKDAPDHQELNLDVSLQLPSRSSKITHRIHWESASLLRSEETKENEGFTVTAEGKGQGTLSVVTMYHAKAKDQLTCNKFDLKVTIKPAPETEKRPQDAKNTMILEICTRYRGDQDATMSILDISMMTGFAPDTDDLKQLANGVDRYISKYELDKAFSDRNTLIIYLDKVSHSEDDCLAFKVHQYFNVELIQPGAVKVYAYYNLG

SEQ ID NO: 914033 - protein, 347 aa, Homo sapiens; identical to SEQ ID NO: 914025

SEQ ID NO: 914034 - protein, 319 aa, Homo sapiens; identical to SEQ ID NO: 914032

SEQ ID NO: 914035 - protein, 347 aa, Homo sapiens; identical to SEQ ID NO: 914025

SEQ ID NO: 914036 - protein, 347 aa, Homo sapiens; identical to SEQ ID NO: 914025

SEQ ID NO: 914037 - protein, 347 aa, Homo sapiens
TEKGSTCGGHDKQAKIAVTVEFDLKVTINQHRQTELRPLLNKFLTTAKDKNRWEDPGKQLYNVEATSYALLALLQLKDFDFVPPVVRWLNEQRYYGGGYGSTQATFMVFQALAQYQKDAPDHQELNLDVSLQLPSRSSKITHRIHWESASLLRSEETKENEGFTVTAEGKGQGTLSVVTMYHAKAKDQLTCNKFDLKVTIKPAPETEKRPQDAKNTMILEICTRYRGDQDATMSILDISMMTGFAPDTDDLKQLANGVDRYISKYELDKAFSDRNTLIIYLDKVSHSEDDCLAFKVHQYFNVELIQPGAVKVYAYYNLAGKNGWTRPVSQEWTMCTRPDWSRFSCPQ

SEQ ID NO: 914038 - protein, 347 aa, Homo sapiens; identical to SEQ ID NO: 914025

SEQ ID NO: 914039 - protein, 347 aa, Homo sapiens; identical to SEQ ID NO: 914025

SEQ ID NO: 914040 - protein, 347 aa, Homo sapiens; identical to SEQ ID NO: 914037

SEQ ID NO: 914041 - protein, 333 aa, Homo sapiens
TEKGSTCGGHDKQAKIAVTVEFDLKVTINQHRQTELRPLLNKFLTTAKDKNRWEDPGKQLYNVEATSYALLALLQLKDFDFVPPVVRWLNEQRYYGGGYGSTQATFMVFQALAQYQKDAPDHQELNLDVSLQLPSRSSKITHRIHWESASLLRSEETKENEGFTVTAEGKGQGTLSVVTMYHAKAKDQLTCNKFDLKVTIKPAPETEKRPQDAKNTMILEICTRYRGDQDATMSILDISMMTGFAPDTDDLKQLANGVDRYISKYELDKAFSDRNTLIIYLDKVSHSEDDCLAFKVHQYFNVELIQPGAVKVYAYYNLDTRVATCRQSGPPRS

SEQ ID NO: 914042 - protein, 269 aa, Homo sapiens
TEKGSTCGGHDKQAKIAVTVEFDLKVTINQHRQTELRPLLNKFLTTAKDKNRWEDPGKQLYNVEATSYALLALLQLKDFDFVPPVVRWLNEQRYYGGGYGSTQATFMVFQALAQYQKDAPDHQELNLDVSLQLPSRSSKITHRIHWESASLLRSEETKENEGFTVTAEGKGQGTLSVVTMYHAKAKDQLTCNKFDLKVTIKPAPETEKRPQDAKNTMILEICTRYRGDQDATMSILDISMMTGFAPDTDDLKQLANGVMNSLQDRYGSY

SEQ ID NO: 914043 - protein, 349 aa, Homo sapiens
TEKGSTCGGHDKQAKIAVTVEFDLKVTINQHRQTELRPLLNKFLTTAKDKNRWEDPGKQLYNVEATSYALLALLQLKDFDFVPPVVRWLNEQRYYGGGYGSTQATFMVFQALAQYQKDAPDHQELNLDVSLQLPSRSSKITHRIHWESASLLRSEETKENEGFTVTAEGKGQGTLSVVTMYHAKAKDQLTCNKFDLNASQVQDRKSKSSWAMSAAWDFPLERNRRVLGFPSMNGEDMGLLFLCSEWERSSEGWLCTEKGEVDIIDPLLYLLHLTHRSLAFSLLAGVSCTCASSCKCKECKCTSCKKSECGAISRNLGLWLRLGGNPRLSLSACFWGTGLLCPCRLSLPV

SEQ ID NO: 914044 - protein, 142 aa, Homo sapiens
TEKGSTCGGHDKQAKIAVTVEFDLKVTINQHRQTELRPLLNKFLTTAKDKNRWEDPGKQLYNVEATSYALLALLQLKDFDFVPPVVRWLNEQRYYGGGYGSTQASGPTAPRHMHPCLLRLPTGLLEKTLRPSEAVLHSHEPV

SEQ ID NO: 914045 - protein, 127 aa, Homo sapiens
LSPPLPSQIEDGSGEVVLSRKVLLDGVQNPRAEDLVGKSLYVSATVILHSGSDMVQAERSGIPIVTSPYQIHFTKTPKYFKPGMPFDLMVFVTNPDGSPAYRVPVAVQGEDSYYNCRPAANLVVVVD

SEQ ID NO: 914046 - protein, 183 aa, Homo sapiens
SGTRGKGQGTLSVVTMYHAKAKDQLTCNKFDLKVTIKPAPETEKRPQDAKNTMILEICTRYRGDQDATMSILDISMMTGFAPDTDDLKQLANGVDRYISKYELDKAFSDRNTLIIYLDKVSHSEDDCLAFKVHQYFNVELIQPGAVKVYAYYNLEESCTRFYHPEKEDGKLNKLCRDELCRVC

SEQ ID NO: 914047 - protein, 175 aa, Homo sapiens
TEKGSTCGGHDKQAKIAVTVEFDLKVTINQHRQTEKRPQDAKNTMILEICTRYRGDQDATMSILDISMMTGFAPDTDDLKQLANGVDRYISKYELDKAFSDRNTLIIYLDKVSHSEDDCLAFKVHQYFNVELIQPGAVKVYAYYNLEESCTRFYHPEKEDGKLNKLCRDELCRVC

SEQ ID NO: 914048 - protein, 347 aa, Homo sapiens; identical to SEQ ID NO: 914025

SEQ ID NO: 914049 - protein, 347 aa, Homo sapiens; identical to SEQ ID NO: 914025

SEQ ID NO: 914050 - protein, 347 aa, Homo sapiens; identical to SEQ ID NO: 914025

SEQ ID NO: 914051 - protein, 330 aa, Homo sapiens
TEKGSTCGGHDKQAKIAVTVEFDLKVTINQHRQTELRPLLNKFLTTAKDKNRWEDPGKQLYNVEATSYALLALLQLKDFDFVPPVVRWLNEQRYYGGGYGSTQATFMVFQALAQYQKDAPDHQELNLDVSLQLPSRSSKITHRIHWESASLLRSEETKENEGFTVTAEGKGQGTLSVVTMYHAKAKDQLTCNKFDLKVTIKPAPETEKRPQDAKNTMILEICTRYRGDQDATMSILDISMMTGFAPDTDDLKQLANGVDRYISKYEVSHSEDDCLAFKVHQYFNVELIQPGAVKVYAYYNLEESCTRFYHPEKEDGKLNKLCRDELCRVC

SEQ ID NO: 914052 - protein, 349 aa, Homo sapiens
TEKGSTCGGHDKQAKIAVTVEFDLKVTINQHRQTELRPLLNKFLTTAKDKNRWEDPGKQLYNVEATSYALLALLQLKDFDFVPPVVRWLNEQRYYGGGYGSTQATFMVFQALAQYQKDAPDHQELNLDVSLQLPSRSSKITHRIHWESASLLRSEETKENEGFTVTAEGKGQGTLSVVTMYHAKAKDQLTCNKFDLKVTIKPAPETEKRPQDAKNTMILEICTRYRGDQDATMSILDISMMTGFAPDTDDLKQLANGVDRYISKYELDKAFSDRNTLIIYLDKVSHSEDDCLAFKVHQYFNVELIQPGAVKVYAYYNLEESCTRFYHRIASYKSRMTRSPLERTAGQGL

SEQ ID NO: 914053 - protein, 347 aa, Homo sapiens; identical to SEQ ID NO: 914025

SEQ ID NO: 914054 - protein, 347 aa, Homo sapiens; identical to SEQ ID NO: 914025

SEQ ID NO: 914055 - protein, 347 aa, Homo sapiens; identical to SEQ ID NO: 914025

SEQ ID NO: 914056 - protein, 347 aa, Homo sapiens; identical to SEQ ID NO: 914025

SEQ ID NO: 914057 - protein, 347 aa, Homo sapiens; identical to SEQ ID NO: 914025

SEQ ID NO: 914058 - protein, 183 aa, Homo sapiens; identical to SEQ ID NO: 914046

SEQ ID NO: 914059 - protein, 224 aa, Homo sapiens
TEKGSTCGGHDKQAKIAVTVEFDLKVTINQHRQTELRPLLNKFLTTAKDKNRWEDPGKQLYNVEATSYALLALLQLKDFDFVPPVVRWLNEQRYYGGGYGSTQATFMVFQALAQYQKDAPDHQELNLDVSLQLPSRSSKITHRIHWESASLLRSEETKENEGFTVTAEGKGQGTLSVVTMYHAKAKDQLTCNKFDLKVTIKPAPETEKRPQDAKNTMILEICTR

SEQ ID NO: 914060 - protein, 190 aa, Homo sapiens
TEKGSTCGGHDKQAKIAVTVEFDLKVTINQHRQTELRPLLNKFLTTAKDKNRWEDPGKQLYNVEATSYALLALLQLKDFDFVPPVVRWLNEQRYYGGGYGSTQATFMVFQALAQYQKDAPDHQELNLDVSLQLPSRSSKITHRIHWESASLLRSEETKENEGFTVTAEGKGQGTLSVRNRNPHLPGPCPS

SEQ ID NO: 914061 - protein, 655 aa, Homo sapiens
MSALLQDPMIAGQVSKPLLSVRSEMNAELRGEDKAATSDSELNEPLLAPVESNDSEDTPSKLFGARGNPALSDPGTPDQHQASQTHPPFPVGPQPLLTAQQLASAVAGVMPGGPPALNQPILIPFNMAGQLGGQQGLVLTLPTANLTNIQGLVAAAAAGGIMTLPLQNLQATSSLNSQLQQLQLQLQQQQQQQQQQPPPSTNQHPQPAPQAPSQSQQQPLQPTPPQQPPPASQQPPAPTSQLQQAPQPQQHQPHSHSHNQNQPSPTQQSSSPPQKPSQSPGHGLPSPLTPPNPLQLVNNPLASQAAAAAAAMSSIASSQAFGNALSSLQGVTGQLVTNAQGQIIGTIPLMPNPGPSSQAASGTQGLQVQPITPQLLTNAQGQIIATVIGNQILPVINTQGITLSPIKPGQQLHQPSQTSVGQAASQGNLLHLAHSQASMSQSPVRQASSSSSSSSSSSALSVGQLVSNPQTAAGEVDGVNLEEIREFAKAFKIRRLSLGLTQTQVGQALSATEGPAYSQSAICRFEKLDITPKSAQKIKPVLERWMAEAEARHRAGMQNLTEFIGSEPSKKRKRRTSFTPQALEILNAHFEKNTHPSGQEMTEIAEKLNYDREVVRVWFCNKRQALKNTIKRLKQHEPATAVPLEPLTDSLEENS

SEQ ID NO: 914062 - protein, 443 aa, Homo sapiens
MSALLQDPMIAGQVSKPLLSVRSEMNAELRGEDKAATSDSELNEPLLAPVESNDSEDTPSKLFGARGNPALSDPGTPDQHQASQTHPPFPVGPQPLLTAQQLASAVAGVMPGGPPALNQPILIPFNMAGQLGGQQGLVLTLPTANLTNIQGLVAAAAAGGIMTLPLQNLQATSSLNSQLQQLQLQLQQQQQQQQQQPPPSTNQHPQPAPQAPSQSQQQPLQPTPPQQPPPASQQPPAPTSQLQQAPQPQQHQPHSHSHNQNQPSPTQQSSSPPQKPSQSPGHGLPSPLTPPNPLQLVNNPLASQAAAAAAAMSSIASSQAFGNALSSLQGVTGQLVTNAQGQIIGTIPLMPNPGPSSQAASGTQGLQVQPITPQLLTNAQGQIIATVIGNQILPVINTQGITLSPIKPGQQILKRQRVRWMGLIWRRSENLPKLLKSGACPLA

SEQ ID NO: 914063 - protein, 197 aa, Homo sapiens [sequence omitted]

SEQ ID NO: 914064 - protein, 186 aa, Homo sapiens
MPAPSMDCDVSTLVACVVDVEVFTNQEVKEKFEGLFRTYDDCVTFQLFKSFRRVRINFSNPKSAARARIELHETQFRGKKLKLYFAQVQTPETDGDKLHLAPPQPAKQFLISPPSSPPVGWQPINDATPVLNYDLLYAVAKLGPGEKYELHAGTESTPSVVVHVCDSDIEEEEDPKTSPKPKIIQR

SEQ ID NO: 914065 - protein, 243 aa, Homo sapiens
MRGESYFIGMRSPGQQGHVPEDGGLFLLCCIDRDWAVTRCFAEEAFQAITDFNDLPNSLFACNVHQSVFEGEESKEKFEGLFRTYDDCVTFQLFKSFRRVRINFSNPKSAARARIELHETQFRGKKLKLYFAQVQTPETDGDKLHLAPPQPAKQFLISPPSSPPVGWQPINDATPVLNYDLLYAVAKLGPGEKYELHAGTESTPSVVVHVCDSDIEEEEDPKTSPKPKIIQTRRPGLPPSVSN

SEQ ID NO: 914066 - protein, 483 aa, Homo sapiens
MATIEEIAHQIIEQQMGEIVTEQQTGQKIQIVTALDHNTQGKQFILTNHDGSTPSKVILARQDSTPGKVFLTTPDAAGVNQLFFTTPDLSAQHLQLLTDNSPDQGPNKVFDLCVVCGDKASGRHYGAVTCEGCKGFFKRSIRKNLVYSCRGSKDCIINKHHRNRCQYCRLQRCIAFGMKQDSVQCERKPIEVSREKSSNCAASTEKIYIRKDLRSPLTATPTFVTDSESTRSTGLLDSGMFMNIHPSGVKTESAVLMTSDKAESCQGDLSTLANVVTSLANLGKTKDLSQNSNEMSMIESLSNDDTSLCEFQEMQTNGDVSRAFDTLAKALNPGESTACQSSVAGMEGSVHLITGDSSINYTEKEGPLLSDSHVAFRLTMPSPMPEYLNVHYIGESASRLLFLSMHWALSIPSFQALGQENSISLVKAYWNELFTLGLAQCWQVMNVATILATFVNCLHNSLQQDAKVIAALIHFTRRAITDL

SEQ ID NO: 914067 - protein, 269 aa, Homo sapiens
MATIEEIAHQIIEQQMGEIVTEQQTGQKIQIVTALDHNTQGKQFILTNHDGSTPSKVILARQDSTPGKVFLTTPDAAGVNQLFFTTPDLSAQHLQLLTDNSPDQGPNKVFDLCVVCGDKASGRHYGAVTCEGCKGFFKRSIRKNLVYSCRGSKDCIINKHHRNRCQYCRLQRCIAFGMKQDSVQCERKPIEVSREKSSNCAASTEKIYIRKDLRSPLTATPTFVTDSESTRSTGLLDSGMFMNIHPSGVKTESAVLMTSDKVCLVQFKA

SEQ ID NO: 914068 - protein, 364 aa, Homo sapiens
MFMNIHPSGVKTESAVLMTSDKAESCQGDLSTLANVVTSLANLGKTKDLSQNSNEMSMIESLSNDDTSLCEFQEMQTNGDVSRAFDTLAKALNPGESTACQSSVAGMEGSVHLITGDSSINYTEKEGPLLSDSHVAFRLTMPSPMPEYLNVHYIGESASRLLFLSMHWALSIPSFQALGQENSISLVKAYWNELFTLGLAQCWQVMNVATILATFVNCLHNSLQQDKMSTERRKLLMEHIFKLQEFCNSMVKLCIDGYEYAYLKAIVLFSPDHPSLENMEQIEKFQEKAYVEFQDYITKTYPDDTYRLSRLLLRLPALRLMNATITEELFFKGLIGNIRIDSVIPHILKMEPADYNSQIIGHSI

SEQ ID NO: 914069 - protein, 603 aa, Homo sapiens
MATIEEIAHQIIEQQMGEIVTEQQTGQKIQIVTALDHNTQGKQFILTNHDGSTPSKVILARQDSTPGKVFLTTPDAAGVNQLFFTTPDLSAQHLQLLTDNSPDQGPNKVFDLCVVCGDKASGRHYGAVTCEGCKGFFKRSIRKNLVYSCRGSKDCIINKHHRNRCQYCRLQRCIAFGMKQDSVQCERKPIEVSREKSSNCAASTEKIYIRKDLRSPLTATPTFVTDSESTRSTGLLDSGMFMNIHPSGVKTESAVLMTSDKAESCQGDLSTLANVVTSLANLGKTKDLSQNSNEMSMIESLSNDDTSLCEFQEMQTNGDVSRAFDTLAKALNPGESTACQSSVAGMEGSVHLITGDSSINYTEKEGPLLSDSHVAFRLTMPSPMPEYLNVHYIGESASRLLFLSMHWALSIPSFQALGQENSISLVKAYWNELFTLGLAQCWQVMNVATILATFVNCLHNSLQQDKMSTERRKLLMEHIFKLQEFCNSMVKLCIDGYEYAYLKAIVLFSPDHPSLENMEQIEKFQEKAYVEFQDYITKTYPDDTYRLSRLLLRLPALRLMNATITEELFFKGLIGNIRIDSVIPHILKMEPADYNSQIIGHSI

SEQ ID NO: 914070 - protein, 364 aa, Homo sapiens; identical to SEQ ID NO: 914068

SEQ ID NO: 914071 - protein, 159 aa, Homo sapiens [sequence omitted]

SEQ ID NO: 914072 - protein, 603 aa, Homo sapiens; identical to SEQ ID NO: 914069

SEQ ID NO: 914073 - protein, 467 aa, Homo sapiens
MATIEEIAHQIIEQQMGEIVTEQQTGQKIQIVTALDHNTQGKQFILTNHDGSTPSKVILARQDSTPGKVFLTTPDAAGVNQLFFTTPDLSAQHLQLLTDNSPDQGPNKVFDLCVVCGDKASGRHYGAVTCEGCKGFFKRSIRKNLVYSCRGSKDCIINKHHRNRCQYCRLQRCIAFGMKQDSVQCERKPIEVSREKSSNCAASTEKIYIRKDLRSPLTATPTFVTDSESTRSTGLLDSGMFMNIHPSGVKTESAVLMTSDKAESCQGDLSTLANVVTSLANLGKTKDLSQNSNEMSMIESLSNDDTSLCEFQEMQTNGDVSRAFDTLAKALNPGESTACQSSVAGMEGSVHLITGDSSINYTEKEGPLLSDSHVAFRLTMPSPMPEYLNVHYIGESASRLLFLSMHWALSIPSFQALGQENSISLVKAYWNELFTLGLAQCWQVMNVATILATFVNCLHNSLQQAEG

SEQ ID NO: 914074 - protein, 184 aa, Homo sapiens
MATIEEIAHQIIEQQMGEIVTEQQTGQKIQIVTALDHNTQGKQFILTNHDGSTPSKVILARQDSTPGKVFLTTPDAAGVNQLFFTTPDLSAQHLQLLTDNSPDQGPNKVFDLCVVCGDKASGRHYGAVTCEGCKGFFKRSIRKNLVYSCRGSKDCIINKHHRNRCQYCRLQRCIAFGMKQDCMY

SEQ ID NO: 914075 - protein, 426 aa, Homo sapiens
MKQDSVQCERKPIEVSREKSSNCAASTEKIYIRKDLRSPLTATPTFVTDSESTRSTGLLDSGMFMNIHPSGVKTESAVLMTSDKAESCQGDLSTLANVVTSLANLGKTKDLSQNSNEMSMIESLSNDDTSLCEFQEMQTNGDVSRAFDTLAKALNPGESTACQSSVAGMEGSVHLITGDSSINYTEKEGPLLSDSHVAFRLTMPSPMPEYLNVHYIGESASRLLFLSMHWALSIPSFQALGQENSISLVKAYWNELFTLGLAQCWQVMNVATILATFVNCLHNSLQQDKMSTERRKLLMEHIFKLQEFCNSMVKLCIDGYEYAYLKAIVLFSPDHPSLENMEQIEKFQEKAYVEFQDYITKTYPDDTYRLSRLLLRLPALRLMNATITEELFFKGLIGNIRIDSVIPHILKMEPADYNSQIIGHSI

SEQ ID NO: 914076 - protein, 364 aa, Homo sapiens; identical to SEQ ID NO: 914068

SEQ ID NO: 914077 - protein, 1063 aa, Homo sapiens
METTQYMNEGELRVLADTYDSVYLHPNSYSCACLASGSVLRLVDAVLGAEIRNGMAIIRPPGHHAQHSLMDGYCMFNHVAVAARYAQQKHRIRRVLIVDWDVHHGQGTQFTFDQDPSVLYFSIHRYEQGRFWPHLKASNWSTTGFGQGQGYTINVPWNQVGMRDADYIAAFLHVLLPVALEFQPQLVLVAAGFDALQGDPKGEMAATPAGFAQLTHLLMGLAGGKLILSLEGGYNLRALAEGVSASLHTLLGDPCPMLESPGAPCRSAQASVSCALEALEPFWEVLVRSTETVERDNMEEDNVEESEEEGPWEPPVLPILTWPVLQSRTGLVYDQNMMNHCNLWDSHHPEVPQRILRIMCRLEELGLAGRCLTLTPRPATEAELLTCHSAEYVGHLRATEKMKTRELHRESSNFDSIYICPSTFACAQLATGAACRLVEAVLSGEVLNGAAVVRPPGHHAEQDAACGFCFFNSVAVAARHAQTISGHALRILIVDWDVHHGNGTQHMFEDDPSVLYVSLHRYDHGTFFPMGDEGASSQIGRAAGTGFTVNVAWNGPRMGDADYLAAWHRLVLPIAYEFNPELVLVSAGFDAARGDPLGGCQVSPEGYAHLTHLLMGLASGRIILILEGGYNLTSISESMAACTRSLLGDPPPLLTLPRPPLSGALASITETIQVHRRYWRSLRVMKVEDREGPSSSKLVTKKAPQPAKPRLAERMTTREKKVLEAGMGKVTSASFGEESTPGQTNSETAVVALTQDQPSEAATGGATLAQTISEAAIGGAMLGQTTSEEAVGGATPDQTTSEETVGGAILDQTTSEDAVGGATLGQTTSEEAVGGATLAQTTSEAAMEGATLDQTTSEEAPGGTELIQTPLASSTDHQTPPTSPVQGTTPQISPSTLIGSLRTLELGSESQGASESQAPGEENLLGEAAGGQDMADSMLMQGSRGLTDQAIFYAVTPLPWCPHLVAVCPIPAAGLDVTQPCGDCGTIQENWVCLSCYQVYCGRYINGHMLQHHGNSGHPLVLSYIDLSAWCYYCQAYVHHQALLDVKNIAHQNKFGEDMPHPH

SEQ ID NO: 914078 - protein, 146 aa, Homo sapiens
MTSTGQDSTTTRQRRSRQNPQSPPQDSSVTSKRNIKKGAVPRSIPNLAEVKKKGKMKKLGQAMEEDLIVGLQGMDLNLEAEALAGTGLVLDEQLNEFHCLWDDSFPEGPERLHAIKEQLIQEGLLDRCVSFQARFAEKEELMLVHR

SEQ ID NO: 914079 - protein, 144 aa, Homo sapiens
VCTLLLSSLLLFPGHVWSFPDPPSQLLAPGWLRELSLLHTPPTRHTLGTLTTRNTHHTPCLPLIQISSQCQVALRFDRNEEEEEAIYFSAEKQWEVPDTASECDSLNSSIGRKQSPPLSLEIYQTLSPRKISRDEVSLEDSSRG

SEQ ID NO: 914080 - protein, 1235 aa, Homo sapiens
PKAARDWLKRNRGRGQASSTMTSTGQDSTTTRQRRSRQNPQSPPQDSSVTSKRNIKKGAVPRSIPNLAEVKKKGKMKKLGQAMEEDLIVGLQGMDLNLEAEALAGTGLVLDEQLNEFHCLWDDSFPEGPERLHAIKEQLIQEGLLDRCVSFQARFAEKEELMLVHSLEYIDLMETTQYMNEGELRVLADTYDSVYLHPNSYSCACLASGSVLRLVDAVLGAEIRNGMAIIRPPGHHAQHSLMDGYCMFNHVAVAARYAQQKHRIRRVLIVDWDVHHGQGTQFTFDQDPSVLYFSIHRYEQGRFWPHLKASNWSTTGFGQGQGYTINVPWNQVGMRDADYIAAFLHVLLPVALEFQPQLVLVAAGFDALQGDPKGEMAATPAGFAQLTHLLMGLAGGKLILSLEGGYNLRALAEGVSASLHTLLGDPCPMLESPGAPCRSAQASVSCALEALEPFWEVLVRSTETVERDNMEEDNVEESEEEGPWEPPVLPILTWPVLQSRTGLVYDQNMMNHCNLWDSHHPEVPQRILRIMCRLEELGLAGRCLTLTPRPATEAELLTCHSAEYVGHLRATEKMKTRELHRESSNFDSIYICPSTFACAQLATGAACRLVEAVLSGEVLNGAAVVRPPGHHAEQDAACGFCFFNSVAVAARHAQTISGHALRILIVDWDVHHGNGTQHMFEDDPSVLYVSLHRYDHGTFFPMGDEGASSQIGRAAGTGFTVNVAWNGPRMGDADYLAAWHRLVLPIAYEFNPELVLVSAGFDAARGDPLGGCQVSPEGYAHLTHLLMGLASGRIILILEGGYNLTSISESMAACTRSLLGDPPPLLTLPRPPLSGALASITETIQVHRRYWRSLRVMKVEDREGPSSSKLVTKKAPQPAKPRLAERMTTREKKVLEAGMGKVTSASFGEESTPGQTNSETAVVALTQDQPSEAATGGATLAQTISEAAIGGAMLGQTTSEEAVGGATPDQTTSEETVGGAILDQTTSEDAVGGATLGQTTSEEAVGGATLAQTTSEAAMEGATLDQTTSEEAPGGTELIQTPLASSTDHQTPPTSPVQGTTPQISPSTLIGSLRTLELGSESQGASESQAPGEENLLGEAAGGQDMADSMLMQGSRGLTDQAIFYAVTPLPWCPHLVAVCPIPAAGLDVTQPCGDCGTIQENWVCLSCYQVYCGRYINGHMLQHHGNSGHPLVLSYIDLSAWCYYCQAYVHHQALLDVKNIAHQNKFGEDMPHPH

SEQ ID NO: 914081 - protein, 1253 aa, Homo sapiens
RVPTGRQKLGGASQGRSLRKGLRPMSGANRGRGQASSTMTSTGQDSTTTRQRRSRQNPQSPPQDSSVTSKRNIKKGAVPRSIPNLAEVKKKGKMKKLGQAMEEDLIVGLQGMDLNLEAEALAGTGLVLDEQLNEFHCLWDDSFPEGPERLHAIKEQLIQEGLLDRCVSFQARFAEKEELMLVHSLEYIDLMETTQYMNEGELRVLADTYDSVYLHPNSYSCACLASGSVLRLVDAVLGAEIRNGMAIIRPPGHHAQHSLMDGYCMFNHVAVAARYAQQKHRIRRVLIVDWDVHHGQGTQFTFDQDPSVLYFSIHRYEQGRFWPHLKASNWSTTGFGQGQGYTINVPWNQVGMRDADYIAAFLHVLLPVALEFQPQLVLVAAGFDALQGDPKGEMAATPAGFAQLTHLLMGLAGGKLILSLEGGYNLRALAEGVSASLHTLLGDPCPMLESPGAPCRSAQASVSCALEALEPFWEVLVRSTETVERDNMEEDNVEESEEEGPWEPPVLPILTWPVLQSRTGLVYDQNMMNHCNLWDSHHPEVPQRILRIMCRLEELGLAGRCLTLTPRPATEAELLTCHSAEYVGHLRATEKMKTRELHRESSNFDSIYICPSTFACAQLATGAACRLVEAVLSGEVLNGAAVVRPPGHHAEQDAACGFCFFNSVAVAARHAQTISGHALRILIVDWDVHHGNGTQHMFEDDPSVLYVSLHRYDHGTFFPMGDEGASSQIGRAAGTGFTVNVAWNGPRMGDADYLAAWHRLVLPIAYEFNPELVLVSAGFDAARGDPLGGCQVSPEGYAHLTHLLMGLASGRIILILEGGYNLTSISESMAACTRSLLGDPPPLLTLPRPPLSGALASITETIQVHRRYWRSLRVMKVEDREGPSSSKLVTKKAPQPAKPRLAERMTTREKKVLEAGMGKVTSASFGEESTPGQTNSETAVVALTQDQPSEAATGGATLAQTISEAAIGGAMLGQTTSEEAVGGATPDQTTSEETVGGAILDQTTSEDAVGGATLGQTTSEEAVGGATLAQTTSEAAMEGATLDQTTSEEAPGGTELIQTPLASSTDHQTPPTSPVQGTTPQISPSTLIGSLRTLELGSESQGASESQAPGEENLLGEAAGGQDMADSMLMQGSRGLTDQAIFYAVTPLPWCPHLVAVCPIPAAGLDVTQPCGDCGTIQENWVCLSCYQVYCGRYINGHMLQHHGNSGHPLVLSYIDLSAWCYYCQAYVHHQALLDVKNIAHQNKFGEDMPHPH

SEQ ID NO: 914082 - protein, 1160 aa, Homo sapiens
MKKLGQAMEEDLIVGLQGMDLNLEAEALAGTGLVLDEQLNEFHCLWDDSFPEGPERLHAIKEQLIQEGLLDRCVSFQARFAEKEELMLVHSLEYIDLMETTQYMNEGELRVLADTYDSVYLHPNSYSCACLASGSVLRLVDAVLGAEIRNGMAIIRPPGHHAQHSLMDGYCMFNHVAVAARYAQQKHRIRRVLIVDWDVHHGQGTQFTFDQDPSVLYFSIHRYEQGRFWPHLKASNWSTTGFGQGQGYTINVPWNQVGMRDADYIAAFLHVLLPVALEFQPQLVLVAAGFDALQGDPKGEMAATPAGFAQLTHLLMGLAGGKLILSLEGGYNLRALAEGVSASLHTLLGDPCPMLESPGAPCRSAQASVSCALEALEPFWEVLVRSTETVERDNMEEDNVEESEEEGPWEPPVLPILTWPVLQSRTGLVYDQNMMNHCNLWDSHHPEVPQRILRIMCRLEELGLAGRCLTLTPRPATEAELLTCHSAEYVGHLRATEKMKTRELHRESSNFDSIYICPSTFACAQLATGAACRLVEAVLSGEVLNGAAVVRPPGHHAEQDAACGFCFFNSVAVAARHAQTISGHALRILIVDWDVHHGNGTQHMFEDDPSVLYVSLHRYDHGTFFPMGDEGASSQIGRAAGTGFTVNVAWNGPRMGDADYLAAWHRLVLPIAYEFNPELVLVSAGFDAARGDPLGGCQVSPEGYAHLTHLLMGLASGRIILILEGGYNLTSISESMAACTRSLLGDPPPLLTLPRPPLSGALASITETIQVHRRYWRSLRVMKVEDREGPSSSKLVTKKAPQPAKPRLAERMTTREKKVLEAGMGKVTSASFGEESTPGQTNSETAVVALTQDQPSEAATGGATLAQTISEAAIGGAMLGQTTSEEAVGGATPDQTTSEETVGGAILDQTTSEDAVGGATLGQTTSEEAVGGATLAQTTSEAAMEGATLDQTTSEEAPGGTELIQTPLASSTDHQTPPTSPVQGTTPQISPSTLIGSLRTLELGSESQGASESQAPGEENLLGEAAGGQDMADSMLMQGSRGLTDQAIFYAVTPLPWCPHLVAVCPIPAAGLDVTQPCGDCGTIQENWVCLSCYQVYCGRYINGHMLQHHGNSGHPLVLSYIDLSAWCYYCQAYVHHQALLDVKNIAHQNKFGEDMPHPH

SEQ ID NO: 914083 - protein, 1063 aa, Homo sapiens; identical to SEQ ID NO: 914077

SEQ ID NO: 914084 - protein, 1215 aa, Homo sapiens
MTSTGQDSTTTRQRRSRQNPQSPPQDSSVTSKRNIKKGAVPRSIPNLAEVKKKGKMKKLGQAMEEDLIVGLQGMDLNLEAEALAGTGLVLDEQLNEFHCLWDDSFPEGPERLHAIKEQLIQEGLLDRCVSFQARFAEKEELMLVHSLEYIDLMETTQYMNEGELRVLADTYDSVYLHPNSYSCACLASGSVLRLVDAVLGAEIRNGMAIIRPPGHHAQHSLMDGYCMFNHVAVAARYAQQKHRIRRVLIVDWDVHHGQGTQFTFDQDPSVLYFSIHRYEQGRFWPHLKASNWSTTGFGQGQGYTINVPWNQVGMRDADYIAAFLHVLLPVALEFQPQLVLVAAGFDALQGDPKGEMAATPAGFAQLTHLLMGLAGGKLILSLEGGYNLRALAEGVSASLHTLLGDPCPMLESPGAPCRSAQASVSCALEALEPFWEVLVRSTETVERDNMEEDNVEESEEEGPWEPPVLPILTWPVLQSRTGLVYDQNMMNHCNLWDSHHPEVPQRILRIMCRLEELGLAGRCLTLTPRPATEAELLTCHSAEYVGHLRATEKMKTRELHRESSNFDSIYICPSTFACAQLATGAACRLVEAVLSGEVLNGAAVVRPPGHHAEQDAACGFCFFNSVAVAARHAQTISGHALRILIVDWDVHHGNGTQHMFEDDPSVLYVSLHRYDHGTFFPMGDEGASSQIGRAAGTGFTVNVAWNGPRMGDADYLAAWHRLVLPIAYEFNPELVLVSAGFDAARGDPLGGCQVSPEGYAHLTHLLMGLASGRIILILEGGYNLTSISESMAACTRSLLGDPPPLLTLPRPPLSGALASITETIQVHRRYWRSLRVMKVEDREGPSSSKLVTKKAPQPAKPRLAERMTTREKKVLEAGMGKVTSASFGEESTPGQTNSETAVVALTQDQPSEAATGGATLAQTISEAAIGGAMLGQTTSEEAVGGATPDQTTSEETVGGAILDQTTSEDAVGGATLGQTTSEEAVGGATLAQTTSEAAMEGATLDQTTSEEAPGGTELIQTPLASSTDHQTPPTSPVQGTTPQISPSTLIGSLRTLELGSESQGASESQAPGEENLLGEAAGGQDMADSMLMQGSRGLTDQAIFYAVTPLPWCPHLVAVCPIPAAGLDVTQPCGDCGTIQENWVCLSCYQVYCGRYINGHMLQHHGNSGHPLVLSYIDLSAWCYYCQAYVHHQALLDVKNIAHQNKFGEDMPHPH

SEQ ID NO: 914085 - protein, 1215 aa, Homo sapiens; identical to SEQ ID NO: 914084

SEQ ID NO: 914086 - protein, 659 aa, Homo sapiens
MTSTGQDSTTTRQRRSRQNPQSPPQDSSVTSKRNIKKGAVPRSIPNLAEVKKKGKMKKLGQAMEEDLIVGLQGMDLNLEAEALAGTGLVLDEQLNEFHCLWDDSFPEGPERLHAIKEQLIQEGLLDRCVSFQARFAEKEELMLVHSLEYIDLMETTQYMNEGELRVLADTYDSVYLHPNSYSCACLASGSVLRLVDAVLGAEIRNGMAIIRPPGHHAQHSLMDGYCMFNHVAVAARYAQQKHRIRRVLIVDWDVHHGQGTQFTFDQDPSVLYFSIHRYEQGRFWPHLKASNWSTTGFGQGQGYTINVPWNQVGMRDADYIAAFLHVLLPVALEFQPQLVLVAAGFDALQGDPKGEMAATPAGFAQLTHLLMGLAGGKLILSLEGGYNLRALAEGVSASLHTLLGDPCPMLESPGAPCRSAQASVSCALEALEPFWEVLVRSTETVERDNMEEDNVEESEEEGPWEPPVLPILTWPVLQSRTGLVYDQNMMNHCNLWDSHHPEVPQRILRIMCRLEELGLAGRCLTLTPRPATEAELLTCHSAEYVGHLRATEKMKTRELHRESSNFDSIYICPSTFACAQLATGAACRLVEAVLSGEVLNGAAVVRPPGHHAEQDAACGFCFFNSVAVAARHAQTISGHALREPHWTRLRQRRLQGAPS

SEQ ID NO: 914087 - protein, 146 aa, Homo sapiens; identical to SEQ ID NO: 914078

SEQ ID NO: 914088 - protein, 211 aa, Homo sapiens
MTSTGQDSTTTRQRRSRQNPQSPPQDSSVTSKRNIKKGAVPRSIPNLAEVKKKGKMKKLGQAMEEDLIVGLQGMDLNLEAEALAGTGLVLDEQLNEFHCLWDDSFPEGPERLHAIKEQLIQEGLLDRCVSFQARFAEKEELMLVHSLEYIDLMETTQYMNEGELRVLADTYDSVYLHPNSYSCACLASGSVLRLVDAVLGAEIRNGMAIIR

SEQ ID NO: 914089 - protein, 118 aa, Homo sapiens
HLFLLPLSLYFFSSLLHFQSLLLCLLVSRFCVSISLTCISMSSFVLFSMSLGRHHLLPTKSPYPHAYTSLLSLPQFNPELVLVSAGFDAARGDPLGGCQVSPEGYAHLTHLLMGLASG

SEQ ID NO: 914090 - protein, 1215 aa, Homo sapiens; identical to SEQ ID NO: 914084

SEQ ID NO: 914091 - protein, 146 aa, Homo sapiens; identical to SEQ ID NO: 914078

SEQ ID NO: 914092 - protein, 1215 aa, Homo sapiens; identical to SEQ ID NO: 914084

SEQ ID NO: 914093 - protein, 1215 aa, Homo sapiens; identical to SEQ ID NO: 914084

SEQ ID NO: 914094 - protein, 1063 aa, Homo sapiens; identical to SEQ ID NO: 914077

SEQ ID NO: 914095 - protein, 669 aa, Homo sapiens
MTSTGQDSTTTRQRRSRQNPQSPPQDSSVTSKRNIKKGAVPRSIPNLAEVKKKGKMKKLGQAMEEDLIVGLQGMDLNLEAEALAGTGLVLDEQLNEFHCLWDDSFPEGPERLHAIKEQLIQEGLLDRCVSFQARFAEKEELMLVHSLEYIDLMETTQYMNEGELRVLADTYDSVYLHPNSYSCACLASGSVLRLVDAVLGAEIRNGMAIIRPPGHHAQHSLMDGYCMFNHVAVAARYAQQKHRIRRVLIVDWDVHHGQGTQFTFDQDPSVLYFSIHRYEQGRFWPHLKASNWSTTGFGQGQGYTINVPWNQVGMRDADYIAAFLHVLLPVALEFQPQLVLVAAGFDALQGDPKGEMAATPAGFAQLTHLLMGLAGGKLILSLEGGYNLRALAEGVSASLHTLLGDPCPMLESPGAPCRSAQASVSCALEALEPFWEVLVRSTETVERDNMEEDNVEESEEEGPWEPPVLPILTWPVLQSRTGLVYDQNMMNHCNLWDSHHPEVPQRILRIMCRLEELGLAGRCLTLTPRPATEAELLTCHSAEYVGHLRATEKMKTRELHRESSNFDSIYICPSTFACAQLATGAACRLVEAVLSGEVLNGAAVVRPPGHHAEQDAACGFCFFNSVAVAARHAQTISGHALRILIVDWDVHHGNGTQHMFEDDPRVAIT

SEQ ID NO: 914096 - protein, 1215 aa, Homo sapiens; identical to SEQ ID NO: 914084

SEQ ID NO: 914097 - protein, 1165 aa, Homo sapiens
MTSTGQDSTTTRQRRSRQNPQSPPQDSSVTSKRNIKKGAVPRSIPNLAEVKKKGKMKKLGQAMEEDLIVGLQGMDLNLEAEALAGTGLVLDEQLNEFHCLWDDSFPEGPERLHAIKEQLIQEGLLDRCVSFQARFAEKEELMLVHSLEYIDLMETTQYMNEGELRVLADTYDSVYLHPNSYSCACLASGSVLRLVDAVLGAEIRNGMAIIRPPGHHAQHSLMDGYCMFNHVAVAARYAQQKHRIRRVLIVDWDVHHGQGTQFTFDQDPSVLYFSIHRYEQGRFWPHLKASNWSTTGFGQGQGYTINVPWNQVGMRDADYIAAFLHVLLPVALEFQPQLVLVAAGFDALQGDPKGEMAATPAGFAQLTHLLMGLAGGKLILSLEGGYNLRALAEGVSASLHTLLGDPCPMLESPGAPCRSAQASVSCALEALEPFWEVLVRSTETVERDNMEEDNVEESEEEGPWEPPVLPILTWPVLQSRTGLVYDQNMMNHCNLWDSHHPEVPQRILRIMCRLEELGLAGRCLTLTPRPATEAELLTCHSAEYVGHLRATEKMKTRELHRESSNFDSIYICPSTFACAQLATGAACRLVEAVLSGEVLNGAAVVRPPGHHAEQDAACGFCFFNSVAVAARHAQTISGHALRILIVDWDVHHGNGTQHMFEDDPSVLYVSLHRYDHGTFFPMGDEGASSQIGRAAGTGFTVNVAWNGPRMGDADYLAAWHRLVLPIAYEFNPELVLVSAGFDAARGDPLGGCQVSPEGYAHLTHLLMGLASGRIILILEGGYNLTSISESMAACTRSLLGDPPPLLTLPRPPLSGALASITETIQVHRRYWRSLRVMKVEDREGPSSSKLVTKKAPQPAKPRLAERMTTREKKVLEAGMGKVTSASFGEESTPGQTNSETAVVALTQDQPSEAATGGATLAQTISEAAIGGAMLGQTTSEEAVGGATPDQTTSEETVGGAILDQTTSEDAVGGATLGQTTSEEAVGGATLAQTTSEAAMEGATLDQTTSEEAPGGTELIQTPLASSTDHQTPPTSPVQGTTPQISPSTLIGSLRTLELGSESQGASESQAPGEENLLGEAAGGQDMADSMLMQGSRGLTDQAIFYAVTPLPWCPHLVAVCPIPAAGLDVTQPCGDCGTIQENWVCLSCYQSTVSVTNGKCSHMEF

SEQ ID NO: 914098 - protein, 623 aa, Homo sapiens
MTSTGQDSTTTRQRRSRQNPQSPPQDSSVTSKRNIKKGAVPRSIPNLAEVKKKGKMKKLGQAMEEDLIVGLQGMDLNLEAEALAGTGLVLDEQLNEFHCLWDDSFPEGPERLHAIKEQLIQEGLLDRCVSFQARFAEKEELMLVHSLEYIDLMETTQYMNEGELRVLADTYDSVYLHPNSYSCACLASGSVLRLVDAVLGAEIRNGMAIIRPPGHHAQHSLMDGYCMFNHVAVAARYAQQKHRIRRVLIVDWDVHHGQGTQFTFDQDPSVLYFSIHRYEQGRFWPHLKASNWSTTGFGQGQGYTINVPWNQVGMRDADYIAAFLHVLLPVALEFQPQLVLVAAGFDALQGDPKGEMAATPAGFAQLTHLLMGLAGGKLILSLEGGYNLRALAEGVSASLHTLLGDPCPMLESPGAPCRSAQASVSCALEALEPFWEVLVRSTETVERDNMEEDNVEESEEEGPWEPPVLPILTWPVLQSRTGLVYDQNMMNHCNLWDSHHPEVPQRILRIMCRLEELGLAGRCLTLTPRPATEAELLTCHSAEYVGHLRATEKMKTRELHRESSNFDSIYICPSTFACAQLATGAACRLVEAVLSGEVCPLWAGERRTWGEWKKRAICCFWRL

SEQ ID NO: 914099 - protein, 104 aa, Homo sapiens
MTSTGQDSTTTRQRRSRQNPQSPPQDSSVTSKRNIKKGAVPRSIPNLAEVKKKGKMKKLGQAMEEDLIVGLQGMDLNLEAEALAGTGLVLDEQLNEFHCLWDDR

SEQ ID NO: 914100 - protein, 828 aa, Homo sapiens
IPRQGRPFFLYYASHHTHYPQFSGQSFTKRSGRGPFGDSLMELDGAVGALMTTVGDLGLLEETLVIFTADNGPELMRMSNGGCSGLLRCGKGTTFEGGVREPALVYWPGHITPGVTHELASSLDLLPTLAALTGVLLPNVTLDGVDISPLLLGTGKSPRKSVFFYPPYPDEIHGVFAVRNGKYKAHFFTQGSAHSDTTSDPACHAANRLTAHEPPLLYDLSQDPGENYNVLENQQREEMGKWLSRSFRNSGNRLLLQLLGSPGRRYYSLPPHQKVPLPSLSPTMQAGTIARWEKKEGDKINEGDLIAEVETDKATVGFESLEECYMAKILVAEGTRDVPIGAIICITVGKPEDIEAFKNYTLDSSAAPTPQAAPAPTPAATASPPTPSAQAPGSSYPPHMQVLLPALSPTMTMGTVQRWEKKVGEKLSEGDLLAEIETDKATIGFEVQEEGYLAKILVPEGTRDVPLGTPLCIIVEKEADISAFADYRPTEVTDLKPQVPPPTPPPVAAVPPTPQPLAPTPSAPCPATPAGPKGRVFVSPLAKKLAVEKGIDLTQVKGTGPDGRITKKDIDSFVPSKVAPAPAAVVPPTGPGMAPVPTGVFTDIPISNIRRVIAQRLMQSKQTIPHYYLSIDVNMGEVLLVRKELNKILEGRSKISVNDFIIKASALACLKVPEANSSWMDTVIRQNHVVDVSVAVSTPAGLITPIVFNAHIKGVETIANDVVSLATKAREGKLQPHEFQGGTFTISNLGMFGIKNFSAIINPPQACILAIGASEDKLVPADNEKGFDVASMMSVTLSCDHRVVDGAVGAQWLAEFRKYLEKPITMLL

SEQ ID NO: 914101 - protein, 662 aa, Homo sapiens
SGDGVGFGVWGVGGTMWRVCARRAQNVAPWAGLEARWTALQEVPGTPRVTSRSGPAPARRNSVTTGYGGVRALCGWTPSSGATPRNRLLLQLLGSPGRRYYSLPPHQKVPLPSLSPTMQAGTIARWEKKEGDKINEGDLIAEVETDKATVGFESLEECYMAKILVAEGTRDVPIGAIICITVGKPEDIEAFKNYTLDSSAAPTPQAAPAPTPAATASPPTPSAQAPGSSYPPHMQVLLPALSPTMTMGTVQRWEKKVGEKLSEGDLLAEIETDKATIGFEVQEEGYLAKILVPEGTRDVPLGTPLCIIVEKEADISAFADYRPTEVTDLKPQVPPPTPPPVAAVPPTPQPLAPTPSAPCPATPAGPKGRVFVSPLAKKLAVEKGIDLTQVKGTGPDGRITKKDIDSFVPSKVAPAPAAVVPPTGPGMAPVPTGVFTDIPISNIRRVIAQRLMQSKQTIPHYYLSIDVNMGEVLLVRKELNKILEGRSKISVNDFIIKASALACLKVPEANSSWMDTVIRQNHVVDVSVAVSTPAGLITPIVFNAHIKGVETIANDVVSLATKAREGKLQPHEFQGGTFTISNLGMFGIKNFSAIINPPQACILAIGASEDKLVPADNEKGFDVASMMSVTLSCDHRVVDGAVGAQWLAEFRKYLEKPITMLL

SEQ ID NO: 914102 - protein, 590 aa, Homo sapiens
GRGWQHSRFSLRQNRLLLQLLGSPGRRYYSLPPHQKVPLPSLSPTMQAGTIARWEKKEGDKINEGDLIAEVETDKATVGFESLEECYMAKILVAEGTRDVPIGAIICITVGKPEDIEAFKNYTLDSSAAPTPQAAPAPTPAATASPPTPSAQAPGSSYPPHMQVLLPALSPTMTMGTVQRWEKKVGEKLSEGDLLAEIETDKATIGFEVQEEGYLAKILVPEGTRDVPLGTPLCIIVEKEADISAFADYRPTEVTDLKPQVPPPTPPPVAAVPPTPQPLAPTPSAPCPATPAGPKGRVFVSPLAKKLAVEKGIDLTQVKGTGPDGRITKKDIDSFVPSKVAPAPAAVVPPTGPGMAPVPTGVFTDIPISNIRRVIAQRLMQSKQTIPHYYLSIDVNMGEVLLVRKELNKILEGRSKISVNDFIIKASALACLKVPEANSSWMDTVIRQNHVVDVSVAVSTPAGLITPIVFNAHIKGVETIANDVVSLATKAREGKLQPHEFQGGTFTISNLGMFGIKNFSAIINPPQACILAIGASEDKLVPADNEKGFDVASMMSVTLSCDHRVVDGAVGAQWLAEFRKYLEKPITMLL

SEQ ID NO: 914103 - protein, 828 aa, Homo sapiens; identical to SEQ ID NO: 914100

SEQ ID NO: 914104 - protein, 828 aa, Homo sapiens; identical to SEQ ID NO: 914100

SEQ ID NO: 914105 - protein, 589 aa, Homo sapiens
SGDGVGFGVWGVGGTMWRVCARRAQNVAPWAGLEARWTALQEVPGTPRVTSRSGPAPARRNSVTTGYGGVRALCGWTPSSGATPRNRLLLQLLGSPGRRYYSLPPHQKVPLPSLSPTMQAGTIARWEKKEGDKINEGDLIAEVETDKATVGFESLEECYMAKILVAEGTRDVPIGAIICITVGKPEDIEAFKNYTLDSSAAPTPQAAPAPTPAATASPPTPSAQAPGSSYPPHMQVLLPALSPTMTMGTVQRWEKKVGEKLSEGDLLAEIETDKATIGFEVQEEGYLAKILVPEGTRDVPLGTPLCIIVEKEADISAFADYRPTEVTDLKPQVPPPTPPPVAAVPPTPQPLAPTPSAPCPATPAGPKGRVFVSPLAKKLAVEKGIDLTQVKGTGPDGRITKKDIDSFVPSKVAPAPAAVVPPTGPGMAPVPTGVFTDIPISNIRRVIAQRLMQSKQTIPHYYLSIDVNMGEVLLVRKELNKILEGRSKISVNDFIIKASALACLKVPEANSSWMDTVIRQNHVVDVSVAVSTPAGLITPIVFNAHIKGVETIANDVVSLATKAREGKLQPHEFQRVGHFFQSNFEGKFG

SEQ ID NO: 914106 - protein, 828 aa, Homo sapiens; identical to SEQ ID NO: 914100

SEQ ID NO: 914107 - protein, 704 aa, Homo sapiens
KTAILVGVLPGDGKRNPGNNRERKAYVEAWKDGKKQPWRSLGNCLPVQRGVWGVGGTMWRVCARRAQNVAPWAGLEARWTALQEVPGTPRVTSRSGPAPARRNSVTTGYGGVRALCGWTPSSGATPRNRLLLQLLGSPGRRYYSLPPHQKVPLPSLSPTMQAGTIARWEKKEGDKINEGDLIAEVETDKATVGFESLEECYMAKILVAEGTRDVPIGAIICITVGKPEDIEAFKNYTLDSSAAPTPQAAPAPTPAATASPPTPSAQAPGSSYPPHMQVLLPALSPTMTMGTVQRWEKKVGEKLSEGDLLAEIETDKATIGFEVQEEGYLAKILVPEGTRDVPLGTPLCIIVEKEADISAFADYRPTEVTDLKPQVPPPTPPPVAAVPPTPQPLAPTPSAPCPATPAGPKGRVFVSPLAKKLAVEKGIDLTQVKGTGPDGRITKKDIDSFVPSKVAPAPAAVVPPTGPGMAPVPTGVFTDIPISNIRRVIAQRLMQSKQTIPHYYLSIDVNMGEVLLVRKELNKILEGRSKISVNDFIIKASALACLKVPEANSSWMDTVIRQNHVVDVSVAVSTPAGLITPIVFNAHIKGVETIANDVVSLATKAREGKLQPHEFQGGTFTISNLGMFGIKNFSAIINPPQACILAIGASEDKLVPADNEKGFDVASMMSVTLSCDHRVVDGAVGAQWLAEFRKYLEKPITMLL

SEQ ID NO: 914108 - protein, 828 aa, Homo sapiens; identical to SEQ ID NO: 914100

SEQ ID NO: 914109 - protein, 557 aa, Homo sapiens
SGDGVGFGVWGVGGTMWRVCARRAQNVAPWAGLEARWTALQEVPGTPRVTSRSGPAPARRNSVTTGYGGVRALCGWTPSSGATPRNRLLLQLLGSPGRRYYSLPPHQKVPLPSLSPTMQAGTIARWEKKEGDKINEGDLIAEVETDKATVGFESLEECYMAKILVAEGTRDVPIGAIICITVGKPEDIEAFKNYTLDSSAAPTPQAAPAPTPAATASPPTPSAQAPGSSYPPHMQVAAVPPTPQPLAPTPSAPCPATPAGPKGRVFVSPLAKKLAVEKGIDLTQVKGTGPDGRITKKDIDSFVPSKVAPAPAAVVPPTGPGMAPVPTGVFTDIPISNIRRVIAQRLMQSKQTIPHYYLSIDVNMGEVLLVRKELNKILEGRSKISVNDFIIKASALACLKVPEANSSWMDTVIRQNHVVDVSVAVSTPAGLITPIVFNAHIKGVETIANDVVSLATKAREGKLQPHEFQGGTFTISNLGMFGIKNFSAIINPPQACILAIGASEDKLVPADNEKGFDVASMMSVTLSCDHRVVDGAVGAQWLAEFRKYLEKPITMLL

SEQ ID NO: 914110 - protein, 116 aa, Homo sapiens
PVSPFRMPPLEPYHFPPLSVCYFSQTCARTGPSGTLLPRSAPRPRSVEKERACRAFLAWGAGGVNLREPFYDNVRLCGVADGNAAALGEVTPETALVLGCGGLVALCGASVRDGLR

SEQ ID NO: 914111 - protein, 284 aa, Homo sapiens
AERAQHSGRQRRSPSSRTTKLPFPKRKETARGFWGSQARACEGGREPSRHAQNPEPAPAPPSPAPPPRLRTRRPLQAPLLRPIWSFGGQAAGGETCAAEGEAEPAPAAQRSRSRRRHLGWEPTRLPHPALGTMGLGARGAWAALLLGTLQVLALLGAAHESAAMAASANIENSGLPHNSSANSTETLQHVPSDHTNETSNSTVKPPTSVASDSSNTTVTTMKPTAASNTTTPGMVSTNMTSTTLKSTPKTTSVSQNTSQISTSTMTVTHNSSVTSAASSVTSMY

SEQ ID NO: 914112 - protein, 340 aa, Homo sapiens
AERAQHSGRQRRSPSSRTTKLPFPKRKETARGFWGSQARACEGGREPSRHAQNPEPAPAPPSPAPPPRLRTRRPLQAPLLRPIWSFGGQAAGGETCAAEGEAEPAPAAQRSRSRRRHLGWEPTRLPHPALGTMGLGARGAWAALLLGTLQVLALLGAAHESAAMAASANIENSGLPHNSSANSTETLQHVPSDHTNETSNSTVKPPTSVASDSSNTTVTTMKPTAASNTTTPGMVSTNMTSTTLKSTPKTTSVSQNTSQISTSTMTVTHNSSVTSAASSVTITTTMHSEAKKGSKFDTGSFVGGIVLTLGVLSILYIGCKMYYSRRGIRYRTIDEHDAII

SEQ ID NO: 914113 - protein, 321 aa, Homo sapiens
AERAQHSGRQRRSPSSRTTKLPFPKRKETARGFWGSQARACEGGREPSRHAQNPEPAPAPPSPAPPPRLRTRRPLQAPLLRPIWSFGGQAAGGETCAAEGEAEPAPAAQRSRSRRRHLGWEPTRLPHPALGTMGLGARGAWAALLLGTLQVLALLGAAHESAAMAETLQHVPSDHTNETSNSTVKPPTSVASDSSNTTVTTMKPTAASNTTTPGMVSTNMTSTTLKSTPKTTSVSQNTSQISTSTMTVTHNSSVTSAASSVTITTTMHSEAKKGSKFDTGSFVGGIVLTLGVLSILYIGCKMYYSRRGIRYRTIDEHDAII

SEQ ID NO: 914114 - protein, 320 aa, Homo sapiens
AERAQHSGRQRRSPSSRTTKLPFPKRKETARGFWGSQARACEGGREPSRHAQNPEPAPAPPSPAPPPRLRTRRPLQAPLLRPIWSFGGQAAGGETCAAEGEAEPAPAAQRSRSRRRHLGWEPTRLPHPALGTMGLGARGAWAALLLGTLQVLALLGAAHESAAMAASANIENSGLPHNSSANSTETLQHVPSDHTNETSNSTVKPPTSVASDSSNTTVTTMKPTAASNTTTPGMVSTNMTSTTLKSTPKTTSVSQNTSQISTSTMTVTHNSSVTSAASSVTITTTMHSEAKKGSKFDTGSFVGGIVLTLGVLSILYIGCR

SEQ ID NO: 914115 - protein, 340 aa, Homo sapiens; identical to SEQ ID NO: 914112

SEQ ID NO: 914116 - protein, 340 aa, Homo sapiens; identical to SEQ ID NO: 914112

SEQ ID NO: 914117 - protein, 340 aa, Homo sapiens; identical to SEQ ID NO: 914112

SEQ ID NO: 914118 - protein, 340 aa, Homo sapiens; identical to SEQ ID NO: 914112

SEQ ID NO: 914119 - protein, 340 aa, Homo sapiens; identical to SEQ ID NO: 914112

SEQ ID NO: 914120 - protein, 163 aa, Homo sapiens [sequence omitted]

SEQ ID NO: 914121 - protein, 340 aa, Homo sapiens; identical to SEQ ID NO: 914112

SEQ ID NO: 914122 - protein, 340 aa, Homo sapiens; identical to SEQ ID NO: 914112

SEQ ID NO: 914123 - protein, 449 aa, Homo sapiens
MMLSTEGREGFVVKVRGLPWSCSADEVMRFFSDCKIQNGTSGIRFIYTREGRPSGEAFVELESEEEVKLALKKDRETMGHRYVEVFKSNSVEMDWVLKHTGPNSPDTANDGFVRLRGLPFGCSKEEIVQFFSGLEIVPNGMTLPVDFQGRSTGEAFVQFASQEIAEKALKKHKERIGHRYIEIFKSSRAEVRTHYDPPRKLMAMQRPGPYDRPGAGRGYNSIGRGAGFERMRRGAYGGGYGGYDDYGGYNDGYGFGSDRFGRDLNYCFSGMSDHRYGDGGSSFQSTTGHCVHMRGLPYRATENDIYNFFSPLNPMRVHIEIGPDGRVTGEADVEFATHEDAVAAMAKDKANMQHRYVELFLNSTAGTSGGAYDHSYVELFLNSTAGASGGAYGSQMMGGMGLSNQSSYGGPASQQLSGGYGGGYGGQSSMSGYDQVLQENSSDYQSNLA

SEQ ID NO: 914124 - protein, 449 aa, Homo sapiens; identical to SEQ ID NO: 914123

SEQ ID NO: 914125 - protein, 449 aa, Homo sapiens; identical to SEQ ID NO: 914123

SEQ ID NO: 914126 - protein, 472 aa, Homo sapiens
MLTKIPYNASMNCCCYLEGRGTWVRRLDKVQVPILSLVPSSDLMHIFSRFAWIHYVLISVFVCILSTRRDAHDPSVVDLVKKRVESEEEVKLALKKDRETMGHRYVEVFKSNSVEMDWVLKHTGPNSPDTANDGFVRLRGLPFGCSKEEIVQFFSGLEIVPNGMTLPVDFQGRSTGEAFVQFASQEIAEKALKKHKERIGHRYIEIFKSSRAEVRTHYDPPRKLMAMQRPGPYDRPGAGRGYNSIGRGAGFERMRRGAYGGGYGGYDDYGGYNDGYGFGSDRFGRDLNYCFSGMSDHRYGDGGSSFQSTTGHCVHMRGLPYRATENDIYNFFSPLNPMRVHIEIGPDGRVTGEADVEFATHEDAVAAMAKDKANMQHRYVELFLNSTAGTSGGAYDHSYVELFLNSTAGASGGAYGSQMMGGMGLSNQSSYGGPASQQLSGGYGGGYGGQSSMSGYDQVLQENSSDYQSNLA

SEQ ID NO: 914127 - protein, 449 aa, Homo sapiens; identical to SEQ ID NO: 914123

SEQ ID NO: 914128 - protein, 449 aa, Homo sapiens; identical to SEQ ID NO: 914123

SEQ ID NO: 914129 - protein, 135 aa, Homo sapiens
MRVHIEIGPDGRVTGEADVEFATHEDAVAAMAKDKANMQHRYVELFLNSTAGTSGGAYDHSYVELFLNSTAGASGGAYGSQMMGGMGLSNQSSYGGPASQQLSGGYGGGYGGQSSMSGYDQVLQENSSDYQSNLA

SEQ ID NO: 914130 - protein, 449 aa, Homo sapiens; identical to SEQ ID NO: 914123

SEQ ID NO: 914131 - protein, 449 aa, Homo sapiens; identical to SEQ ID NO: 914123

SEQ ID NO: 914132 - protein, 431 aa, Homo sapiens
MMLSTEGREGFVVKVRGLPWSCSADEVMRFFSDCKIREAFVELESEEEVKLALKKDRETMGHRYVEVFKSNSVEMDWVLKHTGPNSPDTANDGFVRLRGLPFGCSKEEIVQFFSGLEIVPNGMTLPVDFQGRSTGEAFVQFASQEIAEKALKKHKERIGHRYIEIFKSSRAEVRTHYDPPRKLMAMQRPGPYDRPGAGRGYNSIGRGAGFERMRRGAYGGGYGGYDDYGGYNDGYGFGSDRFGRDLNYCFSGMSDHRYGDGGSSFQSTTGHCVHMRGLPYRATENDIYNFFSPLNPMRVHIEIGPDGRVTGEADVEFATHEDAVAAMAKDKANMQHRYVELFLNSTAGTSGGAYDHSYVELFLNSTAGASGGAYGSQMMGGMGLSNQSSYGGPASQQLSGGYGGGYGGQSSMSGYDQVLQENSSDYQSNLA

SEQ ID NO: 914133 - protein, 449 aa, Homo sapiens; identical to SEQ ID NO: 914123

SEQ ID NO: 914134 - protein, 449 aa, Homo sapiens; identical to SEQ ID NO: 914123

SEQ ID NO: 914135 - protein, 193 aa, Homo sapiens
ASPRGTEASPPQNNSGSSSPVFTFRHPLLSSGGPQSPLRGSTGSLKSSPSMSHMEALGKAWNRQLSRPLSQAVSFSTPFGLDSDVDVVMGDPVLLRSVSSDSLGAGEGRAGGERHEKGPDMGHGRGSTAGSRGSTEWGTRGPPDDRSGWRQVQTSPHYRKTPVQSRRGRSSRLREIKEQRTPDTTRQNHDNSN

SEQ ID NO: 914136 - protein, 917 aa, Homo sapiens
ASPRGTEASPPQNNSGSSSPVFTFRHPLLSSGGPQSPLRGSTGSLKSSPSMSHMEALGKAWNRQLSRPLSQAVSFSTPFGLDSDVDVVMGDPVLLRSVSSDSLGPPRPAPARTPTQPPPEPGDLPTIEEALQIIHSAEPRLLPDGAADGSFYLHSPEGPSKPSLASPYLPEGTSKPLSDRPTKAPVYMPHPETPSKPSPCLVGEASKPPAPSEGSPKAVASSPAATNSEVKMTSFAERKKQLVKAEAEAGAGSPTSTPAPPEALSSEMSELSARLEEKRRAIEAQKRRIEAIFAKHRQRLGKSAFLQVQPREASGEAEAEAEEADSGPVPGGERPAGEGQGEPTSRPKAVTFSPDLGPVPHEGLGEYNRAVSKLSAALSSLQRDMQRLTDQQQRLLAPPEAPGSAPPPAAWVIPGPTTGPKAASPSPARRVPATRRSPGPGPSQSPRSPKHTRPAELRLAPLTRVLTPPHDVDSLPHLRKFSPSQVPVQTRSSILLAEETPPEEPAARPGLIEIPLGSLADPAAEDEGDGSPAGAEDSLEEEASSEGEPRVGLGFFYKDEDKPEDEMAQKRASLLERQQRRAEEARRRKQWQEVEKEQRREEAARLAQEEAPGPAPLVSAVPMATPAPAARAPAEEEVGPRKGDFTRQEYERRAQLKLMDDLDKVLRPRAAGSGGPGRGGRRATRPRSGCCDDSALARSPARGLLGSRLSKIYSQSTLSLSTVANEAHNNLGVKRPTSRAPSPSGLMSPSRLPGSRERDWENGSNASSPASVPEYTGPRLYKEPSAKSNKFIIHNALSHCCLAGKVNEPQKNRILEEIEKSKANHFLILFRDSSCQFRALYTLSGETEELSRLAGYGPRTVTPAMVEGIYKYNSDRKRFTQIPAKTMSMSVDAFTIQGHLWQGKKPTTPKKGGGTPK

SEQ ID NO: 914137 - protein, 340 aa, Homo sapiens
MGLQPCWGRGWLAGLGVCPQDEDKPEDEMAQKRASLLERQQRRAEEARRRKQWQEVEKEQRREEAASALLRLALMSDGSRVPMPRLVSVVPDLLTSHAPVRAAVCSQPDVEECVAPGKGGRSQRQWVRGSRLSKIYSQSTLSLSTVANEAHNNLGVKRPTSRAPSPSGLMSPSRLPGSRERDWENGSNASSPASVPEYTGPRLYKEPSAKSNKFIIHNALSHCCLAGKVNEPQKNRILEEIEKSKANHFLILFRDSSCQFRALYTLSGETEELSRLAGYGPRTVTPAMVEGIYKYNSDRKRFTQIPAKTMSMSVDAFTIQGHLWQGKKPTTPKKGGGTPK

SEQ ID NO: 914138 - protein, 364 aa, Homo sapiens
MGLQPCWGRGWLAGLGVCPQDEDKPEDEMAQKRASLLERQQRRAEEARRRKQWQEVEKEQRREEAARLAQEEAPGPAPLVSAVPMATPAPAARAPAEEEVGPRKGDFTRQEYERRAQLKLMDDLDKVLRPRAAGSGGPGRGGRRATRPRSGCCDDSALARSPARGLLGSRLSKIYSQSTLSLSTVANEAHNNLGVKRPTSRAPSPSGLMSPSRLPGSRERDWENGSNASSPAAKSNKFIIHNALSHCCLAGKVNEPQKNRILEEIEKSKANHFLILFRDSSCQFRALYTLSGETEELSRLAGYGPRTVTPAMVEGIYKYNSDRKRFTQIPAKTMSMSVDAFTIQGHLWQGKKPTTPKKGGGTPK

SEQ ID NO: 914139 - protein, 156 aa, Homo sapiens
SSASVPSTQATVYKEPSAKSTSSSSQCLHTAAGGGPGGGAQKKGVERPQKNRILEEIEKSKANHFLILFRDSSCQFRALYTLSGETEELSRLAGYGPRTVTPAMVEGIYKYNSDRKRFTQIPAKTMSMSVDAFTIQGHLWQGKKPTTPKKGGGTPK

SEQ ID NO: 914140 - protein, 917 aa, Homo sapiens; identical to SEQ ID NO: 914136

SEQ ID NO: 914141 - protein, 379 aa, Homo sapiens [sequence omitted]

SEQ ID NO: 914142 - protein, 256 aa, Homo sapiens
AAEGRGVLGRTDSSCVPPTACWTGCCGGQGLLVGTDLQSLSPGSRSRLSKIYSQSTLSLSTVANEAHNNLGVKRPTSRAPSPSGLMSPSRLPGSRERDWENGSNASSPASVPEYTGPRLYKEPSAKSNKFIIHNALSHCCLAGKVNEPQKNRILEEIEKSKANHFLILFRDSSCQFRALYTLSGETEELSRLAGYGPRTVTPAMVEGIYKYNSDRKRFTQIPAKTMSMSVDAFTIQGHLWQGKKPTTPKKGGGTPK

SEQ ID NO: 914143 - protein, 203 aa, Homo sapiens [sequence omitted]

SEQ ID NO: 914144 - protein, 203 aa, Homo sapiens [sequence omitted]

SEQ ID NO: 914145 - protein, 121 aa, Homo sapiens
MVLATRQPLWAIFCADYPAQEGLLSCPHGLRCGSWILPPSHHNPLSVFPQLLPFSRVPLEPNSRSNLELKSQCSLPRSGAPTLPRYQHSSSPPKTSYPHPLPKALRGRKHLLQPVPTPSSA

SEQ ID NO: 914146 - protein, 121 aa, Homo sapiens; identical to SEQ ID NO: 914145

SEQ ID NO: 914147 - protein, 203 aa, Homo sapiens [sequence omitted]

SEQ ID NO: 914148 - protein, 203 aa, Homo sapiens [sequence omitted]

SEQ ID NO: 914149 - protein, 203 aa, Homo sapiens [sequence omitted]

SEQ ID NO: 914150 - protein, 203 aa, Homo sapiens [sequence omitted]

SEQ ID NO: 914151 - protein, 203 aa, Homo sapiens [sequence omitted]

SEQ ID NO: 914152 - protein, 106 aa, Homo sapiens
MLRLTEVRSDNQALGTCRLAGTALCVAAGVLLAICLFWAMIGWLSQDTKAEPLDPEADSHVEVFGDEPEQQLSPIFRNASGQSWFSPPASPFGQSSVQTIQPKRDS

SEQ ID NO: 914153 - protein, 130 aa, Homo sapiens
MSTRKRRGGAINSRQAQKRTREATSTPEISLEAEPIELVETAGDEIVDLTCESLEPVVVDLTHNDSVVIVDERRRPRRNARRLPQDHADSCVVSSDDEELSRDRDVYVTTHTPRNARDEGATGLRYQRAP

SEQ ID NO: 914154 - protein, 75 aa, Homo sapiens
EPRPPKRKWVAVEAAASFSRSSPGRLKKELLLRSAPAVAPADLTSSRLGRALRESSGLENTGNLSGSKLFCKPDE

SEQ ID NO: 914155 - protein, 190 aa, Homo sapiens
MSTRKRRGGAINSRQAQKRTREATSTPEISLEAEPIELVETAGDEIVDLTCESLEPVVVDLTHNDSVVIVDERRRPRRNARRLPQDHADSCVVSSDDEELSRDRDVYVTTHTPRNARDEGATGLRPSGTVSCPICMDGYSEIVQNGRLIVSTECGHVFCSQCLRDSLKNANTCPTCRKKINHKRYHPIYI

SEQ ID NO: 914156 - protein, 190 aa, Homo sapiens; identical to SEQ ID NO: 914155

SEQ ID NO: 914157 - protein, 116 aa, Homo sapiens [sequence omitted]

SEQ ID NO: 914158 - protein, 158 aa, Homo sapiens
MLVEILSFEAGDEIVDLTCESLEPVVVDLTHNDSVVIVDERRRPRRNARRLPQDHADSCVVSSDDEELSRDRDVYVTTHTPRNARDEGATGLRPSGTVSCPICMDGYSEIVQNGRLIVSTECGHVFCSQCLRDSLKNANTCPTCRKKINHKRYHPIYI

SEQ ID NO: 914159 - protein, 141 aa, Homo sapiens
MGVVRTVRVESLQPENVTSYVDERRRPRRNARRLPQDHADSCVVSSDDEELSRDRDVYVTTHTPRNARDEGATGLRPSGTVSCPICMDGYSEIVQNGRLIVSTECGHVFCSQCLRDSLKNANTCPTCRKKINHKRYHPIYI

SEQ ID NO: 914160 - protein, 77 aa, Homo sapiens
EPRPPKRKWVAVEAAASFSRSSPGRLKKELLLRSAPAVAPADLTSSRLGRALRESSALEALERPITGLLPLRVRGHP

SEQ ID NO: 914161 - protein, 190 aa, Homo sapiens; identical to SEQ ID NO: 914155

SEQ ID NO: 914162 - protein, 75 aa, Homo sapiens; identical to SEQ ID NO: 914154

SEQ ID NO: 914163 - protein, 190 aa, Homo sapiens; identical to SEQ ID NO: 914155

SEQ ID NO: 914164 - protein, 191 aa, Homo sapiens
MLKKRKRRGGAINSRQAQKRTREATSTPEISLEAEPIELVETAGDEIVDLTCESLEPVVVDLTHNDSVVIVDERRRPRRNARRLPQDHADSCVVSSDDEELSRDRDVYVTTHTPRNARDEGATGLRPSGTVSCPICMDGYSEIVQNGRLIVSTECGHVFCSQCLRDSLKNANTCPTCRKKINHKRYHPIYI

SEQ ID NO: 914165 - protein, 284 aa, Homo sapiens
EPRPPKRKWVAVEAAASFSRSSPGRLKKELLLRSAPAVAPADLTSSRLGRALRESSGGISLCHPGCSALACSRSHCNLCHLGSSDSPASASGVAGIQRKRRGGAINSRQAQKRTREATSTPEISLEAEPIELVETAGDEIVDLTCESLEPVVVDLTHNDSVVIVDERRRPRRNARRLPQDHADSCVVSSDDEELSRDRDVYVTTHTPRNARDEGATGLRPSGTVSCPICMDGYSEIVQNGRLIVSTECGHVFCSQCLRDSLKNANTCPTCRKKINHKRYHPIYI

SEQ ID NO: 914166 - protein, 75 aa, Homo sapiens; identical to SEQ ID NO: 914154

SEQ ID NO: 914167 - protein, 411 aa, Homo sapiens
LMAAAAGPGAALSPRPCDSDPATPGAQSPKDDNEDNSNDGTQPSKRRRMGSGDSSRSCETSSQDLGFSYYPAENLIEYKWPPDETGEYYMLQEQVSEYLGVTSFKRKYPDLERRDLSHKEKLYLRELNVITETQCTLGLTALRSDEVIDLMIKEYPAKHAEYSVILQEKERQRITDHYKEYSQMQQQNTQKVEASKVPEYIKKAAKKAAEFNSNLNRERMEERRAYFDLQTHVIQVPQGKYKVLPTERTKVSSYPVALIPGQFQEYYKRYSPDELRYLPLNTALYEPPLDPELPALDSDGDSDDGEDGRGDEKRKNKGTSDSSSGNVSEGESPPDSQEDSFQGRQKSKDKAATPRKDGPKRSVLSKSVPGYKPKVIPNAICGICLKGKESNKKGKAESLIHCSQCENSGKY

SEQ ID NO: 914168 - protein, 474 aa, Homo sapiens
LMAAAAGPGAALSPRPCDSDPATPGAQSPKDDNEDNSNDGTQPSKRRRMGSGDSSRSCETSSQDLGFSYYPAENLIEYKWPPDETGEYYMLQEQVSEYLGVTSFKRKYPDLERRDLSHKEKLYLRELNVITETQCTLGLTALRSDEVIDLMIKEYPAKHAEYSVILQEKERQRITDHYKEYSQMQQQNTQKVEASKVPEYIKKAAKKAAEFNSNLNRERMEERRAYFDLQTHVIQVPQGKYKVLPTERTKVSSYPVALIPGQFQEYYKRYSPDELRYLPLNTALYEPPLDPELPALDSDGDSDDGEDGRGDEKRKNKGTSDSSSGNVSEGESPPDSQEDSFQGRQKSKDKAATPRKDGPKRSVLSKSVPGYKPKVIPNAICGICLKGKESNKKGKAESLIHCSQCENSGHPSCLDMTMELVSMIKTYPWQCMECKTCIICGQPHHEEEMMFCDMCDRGYHTFCVGLGAIPSGKD

SEQ ID NO: 914169 - protein, 476 aa, Homo sapiens
LMAAAAGPGAALSPRPCDSDPATPGAQSPKDDNEDNSNDGTQPSKRRRMGSGDSSRSCETSSQDLGFSYYPAENLIEYKWPPDETGEYYMLQEQVSEYLGVTSFKRKYPDLERRDLSHKEKLYLRELNVITETQCTLGLTALRSDEVIDLMIKEYPAKHAEYSVILQEKERQRITDHYKEYSQMQQQNTQKVEASKVPEYIKKAAKKAAEFNSNLNRERMEERRAYFDLQTHVIQVPQGKYKVLPTERTKVSSYPVALIPGQFQEYYKRYSPDELRYLPLNTALYEPPLDPELPALDSDGDSDDGEDGRGDEKRKNKGTSDSSSGNVSEGESPPDSQEDSFQGRQKSKDKAATPRKDGPKRSVLSKSVPGYKPKVIPNAICGICLKGKESNKKGKAESLIHCSQCENSGHPSCLDMTMELVSMIKTYPWQCMECKTCIICGQPHHEEEMMFCDMCDRGYHTFCVGLGAIPSGSLDL

SEQ ID NO: 914170 - protein, 378 aa, Homo sapiens
LMAAAAGPGAALSPRPCDSDPATPGAQSPKDDNEDNSNDGTQPSKRRRMGSGDSSRSCETSSQDLGFSYYPAENLIEYKWPPDETGEYYMLQEQVSEYLGVTSFKRKYPDLERRDLSHKEKLYLRELNVITETQCTLGLTALRSDEVIDLMIKEYPAKHAEYSVILQEKERQRITDHYKEYSQMQQQNTQKVEASKVPEYIKKAAKKAAEFNSNLNRERMEERRAYFDLQTHVIQVPQGKYKVLPTERTKVSSYPVALIPGQFQEYYKRYSPDELRYLPLNTALYEPPLDPELPALDSDGDSDDGEDGRGDEKRKNKGTSDSSSGNVSEGESPPDSQEDSFQGRQKSKDKAATPRKDGPKRSVLSKSVPGYKVEEKSP

SEQ ID NO: 914171 - protein, 73 aa, Homo sapiens
LMAAAAGPGAALSPRPCDSDPATPGAQSPKDDNEDNSNDGTQPSKRRRMGSGDSSRSCETSSQDLGYCHFIGY

SEQ ID NO: 914172 - protein, 185 aa, Homo sapiens
LMAAAAGPGAALSPRPCDSDPATPGAQSPKDDNEDNSNDGTQPSKRRRMGSGDSSRSCETSSQDLGFSYYPAENLIEYKWPPDETGEYYMLQEQVSEYLGVTSFKRKYPDLERRDLSHKEKLYLRELNVITETQCTLGLTALRSDEVIDLMIKEYPAKHAEYSVILQEKERQRITDHYKEYSVSN

SEQ ID NO: 914173 - protein, 436 aa, Homo sapiens
LMAAAAGPGAALSPRPCDSDPATPGAQSPKDDNEDNSNDGTQPSKRRRMGSGDSSRSCETSSQDLGFSYYPAENLIEYKWPPDETGEYYMLQEQVSEYLGVTSFKRKYPDLERRDLSHKEKLYLRELNVITETQCTLGLTALRSDEVIDLMIKEYPAKHAEYSVILQEKERQRITDHYKEYSQMQQQNTQKVEASKVPEYIKKAAKKAAEFNSNLNRERMEERRAYFDLQTHVIQVPQGKYKVLPTERTKVSSYPVALIPGQFQEYYKRYSPDELRYLPLNTALYEPPLDPELPALDSDGDSDDGEDGRGDEKRKNKGTSDSSSGNVSEGESPPDSQEDSFQGRQKSKDKAATPRKDGPKRSVLSKSVPGYKPKVIPNAICGICLKGKESNKKGKAESLIHCSQCENSGRWICDCCQRAPPTPRKVGRRGKNSKEG

SEQ ID NO: 914174 - protein, 415 aa, Homo sapiens
LMAAAAGPGAALSPRPCDSDPATPGAQSPKDDNEDNSNDGTQPSKRRRMGSGDSSRSCETSSQDLGFSYYPAENLIEYKWPPDETGEYYMLQEQVSEYLGVTSFKRKYPDLERRDLSHKEKLYLRELNVITETQCTLGLTALRSDEVIDLMIKEYPAKHAEYSVILQEKERQRITDHYKEYSQMQQQNTQKVEASKVPEYIKKAAKKAAEFNSNLNRERMEERRAYFDLQTHVIQVPQGKYKVLPTERTKVSSYPVALIPGQFQEYYKRYSPDELRYLPLNTALYEPPLDPELPALDSDGDSDDGEDGRGDEKRKNKGTSDSSSGNVSEGESPPDSQEDSFQGRQKSKDKAATPRKDGPKRSVLSKSVPGYKPKVIPNAICGICLKGKESNKKGKAESLIHCSQCENSAILLAWI

SEQ ID NO: 914175 - protein, 149 aa, Homo sapiens
EFGTREREITGPDNKGIYKGDRESSGKYTFAAHMDGTYKFCFSNRMSTMTPKIVMFTIDIGEAPKGQDMETEAHQNKLEEMINELAVAMTAVKHEQEYMEVRERIHRAINDNTNSRVVLWSFFEALVLVAMTLGQIYYLKRFFEVRRVV

SEQ ID NO: 914176 - protein, 104 aa, Homo sapiens
MSTMTPKIVMFTIDIGEAPKGQDMETEAHQNKLEEMINELAVAMTAVKHEQEYMEVRERIHRAINDNTNSRVVLWSFFEALVLVAMTLGQIYYLKRFFEVRRVV

SEQ ID NO: 914177 - protein, 246 aa, Homo sapiens
LVGPTGKKKKKKKGRRWLRRQRGGGGGGGGCGGRSPGPGFGLSPTMVTLAELLVLLAALLATVSGYFVSIDAHAEECFFERVTSGTKMGLIFEVAEGGFLDIDVEITGPDNKGIYKGDRESSGKYTFAAHMDGTYKFCFSNRMSTMTPKIVMFTIDIGEAPKGQDMETEAHQNKLEEMINELAVAMTAVKHEQEYMEVRERIHRAINDNTNSRVVLWSFFEALVLVAMTLGQIYYLKRFFEVRRVV

SEQ ID NO: 914178 - protein, 246 aa, Homo sapiens; identical to SEQ ID NO: 914177

SEQ ID NO: 914179 - protein, 228 aa, Homo sapiens
LVGPTGKKKKKKKGRRWLRRQRGGGGGGGGCGGRSPGPGFGLSPTMVTLAELLVLLAALLATVSGYFVSIDAHAEECFFERVTSGTKMGLIFEVAEGGFLDIDVEITGPDNKGIYKGDRESSGKYTFAAHMDGTYKFCFSNRMSTMTPKIVMFTIDIGEAPNELAVAMTAVKHEQEYMEVRERIHRAINDNTNSRVVLWSFFEALVLVAMTLGQIYYLKRFFEVRRVV

SEQ ID NO: 914180 - protein, 207 aa, Homo sapiens
LVGPTGKKKKKKKGRRWLRRQRGGGGGGGGCGGRSPGPGFGLSPTMVTLAELLVLLAALLATVSGYFVSIDAHAEECFFERVTSGTKMGLIFEVAEGGFLDIDVEITGPDNKGIYKGDRESSGKYTFAAHMDGTYKFCFSNRMSTMTPKIVMFTIDIGEAPKGQDMETEAHQNKLEEMINELAVAMTAVKHEQEYMEVRERIHRASQ

SEQ ID NO: 914181 - protein, 246 aa, Homo sapiens; identical to SEQ ID NO: 914177

SEQ ID NO: 914182 - protein, 246 aa, Homo sapiens; identical to SEQ ID NO: 914177

SEQ ID NO: 914183 - protein, 224 aa, Homo sapiens
LVGPTGKKKKKKKGRRWLRRQRGGGGGGGGCGGRSPGPGFGLSPTMVTLAELLVLLAALLATVSGYFVSIDAHAEECFFERVTSGTKMGLIFEVAEGGFLDIDVEITGPDNKGIYKGDRESSGKYTFAAHMDGTYKFCFSNRMSTMTPKIVMFTIDIGEAPKGQDMETEAHQNKLEEMINELAVAMTAVKHEQEYMEVRERIHRAINDTQQQRVFGPLELCSSA

SEQ ID NO: 914184 - protein, 217 aa, Homo sapiens
LVGPTGKKKKKKKGRRWLRRQRGGGGGGGGCGGRSPGPGFGLSPTMVTLAELLVLLAALLATVSGYFVSIDAHAEECFFERVTSGTKMGLIFEVAEGGFLDIDVEITGPDNKGIYKGDRESSGKYTFAAHMDGTYKFCFSNRMSTMTPKIVMFTIDIGEAPKGQDMETEAHQNKLEEMINELAVAMTAVKHEQEYMEVRERIHRAKKKKKNEEKKRE

SEQ ID NO: 914185 - protein, 246 aa, Homo sapiens; identical to SEQ ID NO: 914177

SEQ ID NO: 914186 - protein, 246 aa, Homo sapiens; identical to SEQ ID NO: 914177

SEQ ID NO: 914187 - protein, 246 aa, Homo sapiens; identical to SEQ ID NO: 914177

SEQ ID NO: 914188 - protein, 246 aa, Homo sapiens; identical to SEQ ID NO: 914177

SEQ ID NO: 914189 - protein, 216 aa, Homo sapiens
LVGPTGKKKKKKKGRRWLRRQRGGGGGGGGCGGRSPGPGFGLSPTMVTLAELLVLLAALLATVSGYFVSIDAHAEECFFERVTSGTKMGLIFEVAEGGFLDIDVEITGPDNKGIYKGDRESSGKYTFAAHMDGTYKFCFSNRMSTMTPKIVMFTIDIGEAPKGQDMETEAHQNKLEEMINELAVAMTAVKHEQEYMESTTTQTAEWSFGPSLKLLF

SEQ ID NO: 914190 - protein, 246 aa, Homo sapiens; identical to SEQ ID NO: 914177

SEQ ID NO: 914191 - protein, 246 aa, Homo sapiens; identical to SEQ ID NO: 914177

SEQ ID NO: 914192 - protein, 126 aa, Homo sapiens
LVGPTGKKKKKKKGRRWLRRQRGGGGGGGGCGGRSPGPGFGLSPTMVTLAELLVLLAALLATVSGYFVSIDAHAEECFFERVTSGTKMGLIFEVAEGGFLDIDVEVRASCPQLRLGRVATRGLVAP

SEQ ID NO: 914193 - protein, 145 aa, Homo sapiens
KEGNHNTELASKSTLPHPRGQKSKRIERNIRKPSYSYCQHWPGVQTLPRPPHHIQGGGPGSTSTVGGPEAPTLGSLPLSRDAWSMLCCSKSQCINHPASLCKEPTRVGCRPVGKAAGPDLRPAVCAPSRVAVLATRRGPREPHGL

SEQ ID NO: 914194 - protein, 195 aa, Homo sapiens
MNPVYSPGSSGVPYANAKGIGYPAGFPMGYAAAAPAYSPNMYPGANPTFQTGYTPGTPYKVSCSPTSGAVPPYSSSPNPYQTAVYPVRSAYPQQSPYAQQGTYYTQPLYAAPPHVIHHTTVVQPNGMPATVYPAPIPPPRGNGVTMGMVAGTTMAMSAGTLLTAHSPTPVAPHPVTVPTYRAPGTPTYSYVPPQW

SEQ ID NO: 914195 - protein, 168 aa, Homo sapiens
MGYAAAAPAYSPNMYPGANPTFQTGYTPGTPYKVSCSPTSGAVPPYSSSPNPYQTAVYPVRSAYPQQSPYAQQGTYYTQPLYAAPPHVIHHTTVVQPNGMPATVYPAPIPPPRGNGVTMGMVAGTTMAMSAGTLLTAHSPTPVAPHPVTVPTYRAPGTPTYSYVPPQW

SEQ ID NO: 914196 - protein, 195 aa, Homo sapiens; identical to SEQ ID NO: 914194

SEQ ID NO: 914197 - protein, 195 aa, Homo sapiens; identical to SEQ ID NO: 914194

SEQ ID NO: 914198 - protein, 195 aa, Homo sapiens; identical to SEQ ID NO: 914194

SEQ ID NO: 914199 - protein, 195 aa, Homo sapiens; identical to SEQ ID NO: 914194

SEQ ID NO: 914200 - protein, 195 aa, Homo sapiens; identical to SEQ ID NO: 914194

SEQ ID NO: 914201 - protein, 123 aa, Homo sapiens
MNPVYSPGSSGVPYANAKGIGYPAGFPMGYAAAAPAYSPNMYPGANPTFQTGYTPGTPYKVSCSPTSGAVPPYSSSPQAVPMSPCADQWARQLGQISGQPFVLLAGLLCWPHGEALESLMDCN

SEQ ID NO: 914202 - protein, 76 aa, Homo sapiens
RGLRRGGPGQAEPSERERGVREAAETRGSEGQPLIVAGLLGTPPLFRPTAKPAAGRRALVTEAQVAAAARDEVSPC

SEQ ID NO: 914203 - protein, 195 aa, Homo sapiens; identical to SEQ ID NO: 914194

SEQ ID NO: 914204 - protein, 195 aa, Homo sapiens; identical to SEQ ID NO: 914194

SEQ ID NO: 914205 - protein, 195 aa, Homo sapiens; identical to SEQ ID NO: 914194

SEQ ID NO: 914206 - protein, 195 aa, Homo sapiens; identical to SEQ ID NO: 914194

SEQ ID NO: 914207 - protein, 116 aa, Homo sapiens
TPLPHSSDRKCFNVQLSVGLLGDISGGSGARGIPVLGFTSAGKCGDGFPGVKMCPLSPVWLLPGQDRTSIGRSSRWQGCGLRWVAASGPPLWCFLRGSLKQSVVGLGEGRARISPL

SEQ ID NO: 914208 - protein, 122 aa, Homo sapiens
MLVGDGYRGKTSPHTPNEKFEGATVLKALKSGYEGRVPLKSARLFYDISEKARRIVESYFMLNSTLYFSYTHMVCRTALSGQQDRRNDLSHPIHADNCLLDPEANECWKEPPAYTFRDYRYS

SEQ ID NO: 914209 - protein, 381 aa, Homo sapiens
CAKAYLLCHPDDEDVLDNVDYYESLLDDSIDPASIEAREDLTMFVKRHKLESELIKSAAEGLGFSYTEPNYWIRYGGRQDENRVPSGVNVEGAEVHGFSMGKKLSPKIDRDLREGGPLLYENITFVYNSEQLNGTQRVLLDNVLSEEQCRELHSVASGIMLVGDGYRGKTSPHTPNEKFEGATVLKALKSGYEGRVPLKSARLFYDISEKARRIVESYFMLNSTLYFSYTHMVCRTALSGQQDRRNDLSHPIHADNCLLDPEANECWKEPPAYTFRDYSALLYMNDDFEGGEFIFTEMDAKTVTASIKPKCGRMISFSSGGENPHGVKAVTKGKRCAVALWFTLDPLYRELERIQADEVIAILDQEQQGKHELNINPKDEL

SEQ ID NO: 914210 - protein, 326 aa, Homo sapiens
CAKAYLLCHPDDEDVLDNVDYYESLLDDSIDPASIEAREDLTMFVKRHKLESELIKSAAEGLGFSYTEPNYWIRYGGRQDENRVPSGVNVEGAEVHGFSMGKKLSPKIDRDLREGGPLLYENITFVYNSEQLNGTQRVLLDNVLSEEQCRELHSVASGIMLVGDGYRGKTSPHTPNEKFEGATVLKALKSGYEGRVPLKSARLFYDISEKARRIVESYFMLNSTLYFSYTHMVCRTALSGQQDRRNDLSHPIHADNCLLDPEANECWKEPPAYTFRDYSALLYMNDDFEGGEFIFTEMDAKTVTASIKPKCGRMISFSSGGENPHG

SEQ ID NO: 914211 - protein, 361 aa, Homo sapiens
CAKAYLLCHPDDEDVLDNVDYYESLLDDSIDPASIEAREDLTMFVKRHKLESELIKSAAEGLGFSYTEPNYWIRYGGRQDENRVPSGVNVEGAEVHGFSMGKKLSPKIDRDLREGGPLLYENITFVYNSEQLNGTQRVLLDNVLSEEQCRELHSVASGIMLVGDGYRGKTSPHTPNEKFEGATVLKALKSGYEGRVPLKSARLFYDISEKARRIVESYFMLNSTLYFSYTHMVCRTALSGQQDRRNDLSHPIHADNCLLDPEANECWKEPPAYTFRDYSALLYMNDDFEGGEFIFTEMDAKTVTASIKPKCGRMISFSSGGENPHGVKAVTKGKRCAVALWFTLDPLYRELVSFSPAQKAN

SEQ ID NO: 914212 - protein, 381 aa, Homo sapiens; identical to SEQ ID NO: 914209

SEQ ID NO: 914213 - protein, 381 aa, Homo sapiens; identical to SEQ ID NO: 914209

SEQ ID NO: 914214 - protein, 343 aa, Homo sapiens
DGVSLHRPGWIAVAGSRLTASSASQVQAILVSASRVAGTTGTCHHARLIFAFLVETGFHLVGKTGLEPLTSGDPPASASQSAGMTGVSDCPWPICSNILGYNALRCNLSTVYSLKTISPYHPRLLCVRGARRFGPCSLGQTPEAHGAVRRVVAPARCERRAAQTARLFCSAEGRAVGRGLRYAASVRDATAATRLAAFLGATPPGDPTRRASSAAPIPLGLLGAALSSVTLYTRKLAGTMGKKQNKKKVEEVLEEEEEEYVVEKVLDRRVVKGKVEYLLKWKGFSDEDNTWEPEENLDCPDLIAEFLQSQKTAHETDKSEGGKRKADSDSEDKGEESTSPGPQ

SEQ ID NO: 914215 - protein, 185 aa, Homo sapiens
MGKKQNKKKVEEVLEEEEEEYVVEKVLDRRVVKGKVEYLLKWKGFSDEDNTWEPEENLDCPDLIAEFLQSQKTAHETDKSEGGKRKADSDSEDKGEESKPKKKKEESEKPRGFARGLEPERIIGATDSSGELMFLMKWKNSDEADLVPAKEANVKCPQVVISFYEERLTWHSYPSEDDDKKDDKN

SEQ ID NO: 914216 - protein, 424 aa, Homo sapiens
DGVSLHRPGWIAVAGSRLTASSASQVQAILVSASRVAGTTGTCHHARLIFAFLVETGFHLVGKTGLEPLTSGDPPASASQSAGMTGVSDCPWPICSNILGYNALRCNLSTVYSLKTISPYHPRLLCVRGARRFGPCSLGQTPEAHGAVRRVVAPARCERRAAQTARLFCSAEGRAVGRGLRYAASVRDATAATRLAAFLGATPPGDPTRRASSAAPIPLGLLGAALSSVTLYTRKLAGTMGKKQNKKKVEEVLEEEEEEYVVEKVLDRRVVKGKVEYLLKWKGFSDEDNTWEPEENLDCPDLIAEFLQSQKTAHETDKSEGGKRKADSDSEDKGEESKPKKKKEESEKPRGFARGLEPERIIGATDSSGELMFLMKWKNSDEADLVPAKEANVKCPQVVISFYEERLTWHSYPSEDDDKKDDKN

SEQ ID NO: 914217 - protein, 424 aa, Homo sapiens; identical to SEQ ID NO: 914216

SEQ ID NO: 914218 - protein, 424 aa, Homo sapiens; identical to SEQ ID NO: 914216

SEQ ID NO: 914219 - protein, 185 aa, Homo sapiens; identical to SEQ ID NO: 914215

SEQ ID NO: 914220 - protein, 424 aa, Homo sapiens; identical to SEQ ID NO: 914216

SEQ ID NO: 914221 - protein, 234 aa, Homo sapiens
MAALRYAGLDDTDSEDELPPGWEERTTKDGWVYYANHTEEKTQWEHPKTGKRKRVAGDLPYGWEQETDENGQVFFVDHINKRTTYLDPRLAFTVDDNPTKPTTRQRYDGSTTAMEILQGRDFTGKVVVVTGANSGIGFETAKSFALHGAHVILACRNMARASEAVSRILEEWQQGAATTVYCAAVPELEGLGGMYFNNCCRCMPSPEAQSEETARTLWALSERLIQERLGSQSG

SEQ ID NO: 914222 - protein, 363 aa, Homo sapiens
MAALRYAGLDDTDSEDELPPGWEERTTKDGWVYYANHTEEKTQWEHPKTGKRKRVAGDLPYGWEQETDENGQVFFVDHINKRTTYLDPRLAFTVDDNPTKPTTRQRYDGSTTAMEILQGRDFTGKVVVVTGANSGIGFETAKSFALHGAHVILACRNMARASEAVSRILEEWHKAKVETMTLDLALLRSVQHFAEAFKAKNVPLHVLVCNAATFALPWSLTKDGLETTFQVNHLGHFYLVQLLQDVLCRSAPARVIVVSSESHRFTDINDSLGKLDFSRLSPTKNDYWAMLAYNRSKLCNILFSNELHRRLSPRGVTSNAVHPGNMMYSNIHRSWWVYTLLFTLARPFTKSMVSDCLVEGGHF

SEQ ID NO: 914223 - protein, 189 aa, Homo sapiens
MAALRYAGLDDTDSEDELPPGWEERTTKDGWVYYANHTEEKTQWEHPKTGKRKRVAGDLPYGWEQETDENGQVFFVDHINKRTTYLDPRLAFTVDDNPTKPTTRQRYDGSTTAMEILQGRDFTGKVVVVTGANSGIGFETAKSFALHGAHVILACRNMARASEAVSRILEEWKTKYHPPPEKCRIKIFH

SEQ ID NO: 914224 - protein, 168 aa, Homo sapiens
MSRFKQQQREKEKFLQIIRERCELNFGMDTVLLSAESTNHFHHVYEIPLAALQRGDKQELIMTEHPPNFLTHSSTGRVYTCGMAAMFVDNPYIHKTGAWELVCCLLPCEDTARKHIQEVEMEPSLDARSAGAMILDFPASRTMWELRCRAVEELAQGCRALSQGQSMG

SEQ ID NO: 914225 - protein, 68 aa, Homo sapiens
FYVLLRLITAFYVSSLPSTSFYVSSLPSTSHHCSRGLAFSYLGKKKQVFTAPCCIDPGDNCFIHPDQD

SEQ ID NO: 914226 - protein, 414 aa, Homo sapiens [sequence omitted]

SEQ ID NO: 914227 - protein, 311 aa, Homo sapiens
MAALRYAGLDDTDSEDELPPGWEERTTKDGWVYYANHTEEKTQWEHPKTGKRKRVAGDLPYGWEQETDENGQVFFVDHINKRTTYLDPRLAFTVDDNPTKPTTRQRYDGSTTAMEILQGRDFTGKVVVVTGANSGIATGSCHHRVLCCCPRTGGSGRDVLQQLLPLHALTRSSERRDGPDPVGAQREADPRTAWQPVRLSGAQSGWAHTPALCVSPHASARAGPLPNVPPTQIRKSKGNKSSHNRVKNLKYQWEAGNSWGKVSLFWGWARHRSLCFLVVACLKVKTCLVCRFRISLEKHQQFSFFYCYRIA

SEQ ID NO: 914228 - protein, 173 aa, Homo sapiens
MAALRYAGLDDTDSEDELPPGWEERTTKDGWVYYANHTEEKTQWEHPKTGKRKRVAGDLPYGWEQETDENGQVFFVDHINKRTTYLDPRLAFTVDDNPTKPTTRQRYDGSTTAMEILQGRDFTGKVVVVTGANSGIGFETAKSFALHGAHVILACRNMARASEAVSRILEEWN

SEQ ID NO: 914229 - protein, 391 aa, Homo sapiens
MAALRYAGLDDTDSEDELPPGWEERTTKDGWVYYANHTEEKTQWEHPKTGKRKRVAGDLPYGWEQETDENGQVFFVDHINKRTTYLDPRLAFTVDDNPTKPTTRQRYDGSTTAMEILQGRDFTGKVVVVTGANSGIGFETAKSFALHGAHVILACRNMARASEAVSRILEEWHKAKVETMTLDLALLRSVQHFAEAFKAKNVPLHVLVCNAATFALPWSLTKDGLETTFQVNHLGHFYLVQLLQDVLCRSAPARVIVVSSESHRFTDINDSLGKLDFSRLSPTKNDYWAMLAYNRSKLCNILFSNELHRRLSPRGVTSNAVHPGNMMYSNIHRSWWVYTLLFTLARPFTKSMFNNCCRCMPSPEAQSEETARTLWALSERLIQERLGSQSG

SEQ ID NO: 914230 - protein, 36 aa, Homo sapiens
MAALRYAGLDDTDSEDELPPGWEERTTKDGWVYYAK

SEQ ID NO: 914231 - protein, 119 aa, Homo sapiens
GHLIMLHHEHPSAFKNSVGRNRMLRELSWSCRGPGTGRSGGGPQQPRIPEPAARPGRSCALPPPGARRSRGTFQELPRAEVPGLGVASSCQIPCSPGDPEKHRAIPDPGTFRRLAAIWE

SEQ ID NO: 914232 - protein, 228 aa, Homo sapiens
HTGPLNQSSQQDWETGVTFPTLQRMKQSGKASEGPYTSDIAKQDLSPGSSVQTYLLGFLSHVYSIAGKVVEDTFWPTLSVYNPERGDPQKPSDMSTATRRVCGNVEGEPETPWSLPSLAGSFLPERSPQGTLEEELSWSCRGPGTGRSGGGPQQPRIPEPAARPGRSCALPPPGARRSRGTFQELPRAEVPGLGVASSCQIPCSPGDPEKHRAIPDPGTFRRLAAIWE

SEQ ID NO: 914233 - protein, 228 aa, Homo sapiens; identical to SEQ ID NO: 914232

SEQ ID NO: 914234 - protein, 228 aa, Homo sapiens; identical to SEQ ID NO: 914232

SEQ ID NO: 914235 - protein, 754 aa, Homo sapiens
MHTGGETSACKPSSVRLAPSFSFHAAGLQMAGQMPHSHQYSDRRQPNISDQQVSALSYSDQIQQPLTNQRRMPQTFRDPATAPLRKLSVDLIKTYKHINEVYYAKKKRRHQQGQGDDSSHKKERKVYNDGYDDDNYDYIVKNGEKWMDRYEIDSLIGKGSFGQVVKAYDRVEQEWVAIKIIKNKKAFLNQAQIEVRLLELMNKHDTEMKYYIVHLKRHFMFRNHLCLVFEMLSYNLYDLLRNTNFRGVSLNLTRKFAQQMCTALLFLATPELSIIHCDLKPENILLCNPKRSAIKIVDFGSSCQLGQRIYQYIQSRFYRSPEVLLGMPYDLAIDMWSLGCILVEMHTGEPLFSGANEVDQMNKIVEVLGIPPAHILDQAPKARKFFEKLPDGTWNLKKTKDGKREYKPPGTRKLHNILGVETGGPGGRRAGESGHTVADYLKFKDLILRMLDYDPKTRIQPYYALQHSFFKKTADEGTNTSNSVSTSPAMEQSQSSGTTSSTSSSSGGSSGTSNSGRARSDPTHQHRHSGGHFTAAVQAMDCETHSPQVRQQFPAPLGWSGTEAPTQVTVETHPVQETTFHVAPQQNALHHHHGNSSHHHHHHHHHHHHHGQQALGNRTRPRVYNSPTNSSSTQDSMEVGHSHHSMTSLSSSTTSSSTSSSSTGNQGNQAYQNRPVAANTLDFGQNGAMDVNLTVYSNPRQETGIAGHPTYQFSANTGPAHYMTEGHLTMRQGADREESPMTGVCVQQSPVASS

SEQ ID NO: 914236 - protein, 584 aa, Homo sapiens
MHTGGETSACKPSSVRLAPSFSFHAAGLQMAGQMPHSHQYSDRRQPNISDQQVSALSYSDQIQQPLTNQVMPDIVMLQRRMPQTFRDPATAPLRKLSVDLIKTYKHINEVYYAKKKRRHQQGQGDDSSHKKERKVYNDGYDDDNYDYIVKNGEKWMDRYEIDSLIGKGSFGQVVKAYDRVEQEWVAIKIIKNKKAFLNQAQIEVRLLELMNKHDTEMKYYIVHLKRHFMFRNHLCLVFEMLSYNLYDLLRNTNFRGVSLNLTRKFAQQMCTALLFLATPELSIIHCDLKPENILLCNPKRSAIKIVDFGSSCQLGQRIYQYIQSRFYRSPEVLLGMPYDLAIDMWSLGCILVEMHTGEPLFSGANEVDQMNKIVEVLGIPPAHILDQAPKARKFFEKLPDGTWNLKKTKDGKREYKPPGTRKLHNILGVETGGPGGRRAGESGHTVADYLKFKDLILRMLDYDPKTRIQPYYALQHSFFKKTADEGTNTSNSVSTSPAMEQSQSSGTTSSTSSSSGGSSGTSNSGRARSDPTHQHRHSGGHFTAAVQAMDCETHSPQVSSHVVHLLVSPAILRWSSTGCQVPLE

SEQ ID NO: 914237 - protein, 763 aa, Homo sapiens
MHTGGETSACKPSSVRLAPSFSFHAAGLQMAGQMPHSHQYSDRRQPNISDQQVSALSYSDQIQQPLTNQVMPDIVMLQRRMPQTFRDPATAPLRKLSVDLIKTYKHINEVYYAKKKRRHQQGQGDDSSHKKERKVYNDGYDDDNYDYIVKNGEKWMDRYEIDSLIGKGSFGQVVKAYDRVEQEWVAIKIIKNKKAFLNQAQIEVRLLELMNKHDTEMKYYIVHLKRHFMFRNHLCLVFEMLSYNLYDLLRNTNFRGVSLNLTRKFAQQMCTALLFLATPELSIIHCDLKPENILLCNPKRSAIKIVDFGSSCQLGQRIYQYIQSRFYRSPEVLLGMPYDLAIDMWSLGCILVEMHTGEPLFSGANEVDQMNKIVEVLGIPPAHILDQAPKARKFFEKLPDGTWNLKKTKDGKREYKPPGTRKLHNILGVETGGPGGRRAGESGHTVADYLKFKDLILRMLDYDPKTRIQPYYALQHSFFKKTADEGTNTSNSVSTSPAMEQSQSSGTTSSTSSSSGGSSGTSNSGRARSDPTHQHRHSGGHFTAAVQAMDCETHSPQVRQQFPAPLGWSGTEAPTQVTVETHPVQETTFHVAPQQNALHHHHGNSSHHHHHHHHHHHHHGQQALGNRTRPRVYNSPTNSSSTQDSMEVGHSHHSMTSLSSSTTSSSTSSSSTGNQGNQAYQNRPVAANTLDFGQNGAMDVNLTVYSNPRQETGIAGHPTYQFSANTGPAHYMTEGHLTMRQGADREESPMTGVCVQQSPVASS

SEQ ID NO: 914238 - protein, 763 aa, Homo sapiens; identical to SEQ ID NO: 914237

SEQ ID NO: 914239 - protein, 763 aa, Homo sapiens; identical to SEQ ID NO: 914237

SEQ ID NO: 914240 - protein, 109 aa, Homo sapiens
MTSLSSSTTSSSTSSSSTGNQGNQAYQNRPVAANTLDFGQNGAMDVNLTVYSNPRQETGIAGHPTYQFSANTGPAHYMTEGHLTMRQGADREESPMTGVCVQQSPVASS

SEQ ID NO: 914241 - protein, 763 aa, Homo sapiens; identical to SEQ ID NO: 914237

SEQ ID NO: 914242 - protein, 763 aa, Homo sapiens; identical to SEQ ID NO: 914237

SEQ ID NO: 914243 - protein, 258 aa, Homo sapiens
RPRSASESGHPERGVRAPPPPLLLLLFLLLLLVPLPPPASRRDRCECECVCEGACARAIVRASVRVCASVCLSVRGLGGGRFGLSWRRSRRRRPGPGASRCAGSERAPFCEIYKILLGKKPPAAAAARRPASPTPPSAPGRPCGPAAWNRGPGTAVFAGEGAVASPAPGAAGTASRGETEQAAARPGAGAPGAERGCRGGAGCGGRGGSAAREPEAETHRRKRRERPAIVPDLTLLPRLECSGMIRAHCSLDFLESVL

SEQ ID NO: 914244 - protein, 763 aa, Homo sapiens; identical to SEQ ID NO: 914237

SEQ ID NO: 914245 - protein, 763 aa, Homo sapiens; identical to SEQ ID NO: 914237

SEQ ID NO: 914246 - protein, 982 aa, Homo sapiens
RPRSASESGHPERGVRAPPPPLLLLLFLLLLLVPLPPPASRRDRCECECVCEGACARAIVRASVRVCASVCLSVRGLGGGRFGLSWRRSRRRRPGPGASRCAGSERAPFCEIYKILLGKKPPAAAAARRPASPTPPSAPGRPCGPAAWNRGPGTAVFAGEGAVASPAPGAAGTASRGETEQAAARPGAGAPGAERGCRGGAGCGGRGGSAAREPEAETHRRKRRERPAIVPGGETSACKPSSVRLAPSFSFHAAGLQMAGQMPHSHQYSDRRQPNISDQQVSALSYSDQIQQPLTNQRRMPQTFRDPATAPLRKLSVDLIKTYKHINEVYYAKKKRRHQQGQGDDSSHKKERKVYNDGYDDDNYDYIVKNGEKWMDRYEIDSLIGKGSFGQVVKAYDRVEQEWVAIKIIKNKKAFLNQAQIEVRLLELMNKHDTEMKYYIVHLKRHFMFRNHLCLVFEMLSYNLYDLLRNTNFRGVSLNLTRKFAQQMCTALLFLATPELSIIHCDLKPENILLCNPKRSAIKIVDFGSSCQLGQRIYQYIQSRFYRSPEVLLGMPYDLAIDMWSLGCILVEMHTGEPLFSGANEVDQMNKIVEVLGIPPAHILDQAPKARKFFEKLPDGTWNLKKTKDGKREYKPPGTRKLHNILGVETGGPGGRRAGESGHTVADYLKFKDLILRMLDYDPKTRIQPYYALQHSFFKKTADEGTNTSNSVSTSPAMEQSQSSGTTSSTSSSSGGSSGTSNSGRARSDPTHQHRHSGGHFTAAVQAMDCETHSPQVRQQFPAPLGWSGTEAPTQVTVETHPVQETTFHVAPQQNALHHHHGNSSHHHHHHHHHHHHHGQQALGNRTRPRVYNSPTNSSSTQDSMEVGHSHHSMTSLSSSTTSSSTSSSSTGNQGNQAYQNRPVAANTLDFGQNGAMDVNLTVYSNPRQETGIAGHPTYQFSANTGPAHYMTEGHLTMRQGADREESPMTGVCVQQSPVASS

SEQ ID NO: 914247 - protein, 763 aa, Homo sapiens; identical to SEQ ID NO: 914237

SEQ ID NO: 914248 - protein, 763 aa, Homo sapiens; identical to SEQ ID NO: 914237

SEQ ID NO: 914249 - protein, 609 aa, Homo sapiens
RPRSASESGHPERGVRAPPPPLLLLLFLLLLLVPLPPPASRRDRCECECVCEGACARAIVRASVRVCASVCLSVRGLGGGRFGLSWRRSRRRRPGPGASRCAGSERAPFCEIYKILLGKKPPAAAAARRPASPTPPSAPGRPCGPAAWNRGPGTAVFAGEGAVASPAPGAAGTASRGETEQAAARPGAGAPGAERGCRGGAGCGGRGGSAAREPEAETHRRKRRERPAIVPGGETSACKPSSVRLAPSFSFHAAGLQMAGQMPHSHQYSDRRQPNISDQQVSALSYSDQIQQPLTNQRRMPQTFRDPATAPLRKLSVDLIKTYKHINEVYYAKKKRRHQQGQGDDSSHKKERKVYNDGYDDDNYDYIVKNGEKWMDRYEIDSLIGKGSFGQVVKAYDRVEQEWVAIKIIKNKKAFLNQAQIEVRLLELMNKHDTEMKYYIVHLKRHFMFRNHLCLVFEMLSYNLYDLLRNTNFRGVSLNLTRKFAQQMCTALLFLATPELSIIHCDLKPENILLCNPKRSAIKIVDFGSSCQLGQRIYQYIQSRFYRSPEVLLGMPYDLAIDMWSLGCILVEMHTGEPLFSGANEVNDVLLYKFCFHNLFLSFICDSVI

SEQ ID NO: 914250 - protein, 228 aa, Homo sapiens
DTSLLILQNITVAHCKSQLASGLFMLMAVLSGVRWLTRALVSAGNPGAWRGLSTSAAAHAASRSQAEDVRVEGSFPVTMLPGDGVGPELMHAVKEVFKAAAVPVEFQEHHLSEVQNMASEEKLEQVLSSMKENKVAIIGKIHTPMEYKGELASYDMRLRRKLDLFANVVHVKSLPGYMTRHNNLDLVIIREQTEGEYSSLEHESARGVIECLNDCHTSQVSADCKVRL

SEQ ID NO: 914251 - protein, 228 aa, Homo sapiens; identical to SEQ ID NO: 914250

SEQ ID NO: 914252 - protein, 202 aa, Homo sapiens
MAALSGVRWLTRALVSAGNPGAWRGLSTSAAAHAASRSQAEDVRVEGSFPVTMLPGDGVGPELMHAVKEVFKAAAVPVEFQEHHLSEVQNMASEEKLEQVLSSMKENKVAIIGKIHTPMEYKGELASYDMRLRRKLDLFANVVHVKSLPGYMTRHNNLDLVIIREQTEGEYSSLEHESARGVIECLNDCHTSQVSADCKVRL

SEQ ID NO: 914253 - protein, 202 aa, Homo sapiens; identical to SEQ ID NO: 914252

SEQ ID NO: 914254 - protein, 202 aa, Homo sapiens; identical to SEQ ID NO: 914252

SEQ ID NO: 914255 - protein, 202 aa, Homo sapiens; identical to SEQ ID NO: 914252

SEQ ID NO: 914256 - protein, 202 aa, Homo sapiens; identical to SEQ ID NO: 914252

SEQ ID NO: 914257 - protein, 202 aa, Homo sapiens; identical to SEQ ID NO: 914252

SEQ ID NO: 914258 - protein, 212 aa, Homo sapiens
NPNIHGRGWCESDEGGVRWLTRALVSAGNPGAWRGLSTSAAAHAASRSQAEDVRVEGSFPVTMLPGDGVGPELMHAVKEVFKAAAVPVEFQEHHLSEVQNMASEEKLEQVLSSMKENKVAIIGKIHTPMEYKGELASYDMRLRRKLDLFANVVHVKSLPGYMTRHNNLDLVIIREQTEGEYSSLEHESARGVIECLNDCHTSQVSADCKVRL

SEQ ID NO: 914259 - protein, 202 aa, Homo sapiens; identical to SEQ ID NO: 914252

SEQ ID NO: 914260 - protein, 204 aa, Homo sapiens
MAALSGVRWLTRALVSAGNPGAWRGLSTSAAAHAASRSQAEDVRVEGSFPVTMLPGDGVGPELMHAVKEVFKAAAVPVEFQEHHLSEVQNMASEEKLEQVLSSMKENKVAIIGKIHTPMEYKGELASYDMRLRRKLDLFANVVHVKSLPGYMTRHNNLDLVIIREQTEGEYSSLEHEVRPQKLGEGKDEDGREVELLVSLPSVT

SEQ ID NO: 914261 - protein, 160 aa, Homo sapiens
MGCSCSAVRKVAELYPKIKFETMIIDNCCMQLVQNPYQFDVLVMPNLYGNIIDNLAAGLVGGAGVVPGESYSAEYAVFETGARHPFAQAVGRNIANPTAMLLSASNMLRHLNLEYHSSMIADAVKKVIKVGKVRTRDMGGYSTTTDFIKSVIGHLQTKGS

SEQ ID NO: 914262 - protein, 160 aa, Homo sapiens; identical to SEQ ID NO: 914261

SEQ ID NO: 914263 - protein, 202 aa, Homo sapiens; identical to SEQ ID NO: 914252

SEQ ID NO: 914264 - protein, 202 aa, Homo sapiens; identical to SEQ ID NO: 914252

SEQ ID NO: 914265 - protein, 212 aa, Homo sapiens [sequence omitted]

SEQ ID NO: 914266 - protein, 165 aa, Homo sapiens
MLCLLGSHILPLICVSHHLCLLSLLSCPGCSTANSGLRGVAGPCASHPGSSFHSCALPFFWLSRILGFHFLNHIALPPFMGSLFSLPTAVAGGGCRCGLETWAATAPQPTSSSLSSVTCRLKGARALYFFQPCKDHTPHTLQCSVPGKRPCASKQWTMVTLLGRA

SEQ ID NO: 914267 - protein, 150 aa, Homo sapiens
MAALSGVRWLTRALVSAGNPGAWRGLSTSAAAHAASRSQAEDVRVEGSFPVTMLPGDGVGPELMHAVKEVFKAAAVPVEFQEHHLSEVQNMASEEKLEQVLSSMKENKVAIIGKIHTPMEYKGELASYDMRLRRKLDLFANVVHVKSLPG

SEQ ID NO: 914268 - protein, 211 aa, Homo sapiens
MAALSGVRWLTRALVSAGNPGAWRGLSTSAAAHAASRSQAEDVRVEGSFPVTMLPGDGVGPELMHAVKEVFKAAAVPVEFQEHHLSEVQNMASEEKLEQVLSSMKENKVAIIGKIHTPMEYKGELASYDMRLRRKLDLFANVVHVKSLRSVHLHIDLTSHLASQGYILDLFHKGTHLTGGHQFFLVLSQVGILSLQQAEVGGNLLLQPRLH

SEQ ID NO: 914269 - protein, 204 aa, Homo sapiens; identical to SEQ ID NO: 914260

SEQ ID NO: 914270 - protein, 228 aa, Homo sapiens; identical to SEQ ID NO: 914250

SEQ ID NO: 914271 - protein, 202 aa, Homo sapiens; identical to SEQ ID NO: 914252

SEQ ID NO: 914272 - protein, 202 aa, Homo sapiens; identical to SEQ ID NO: 914252

SEQ ID NO: 914273 - protein, 202 aa, Homo sapiens; identical to SEQ ID NO: 914252

SEQ ID NO: 914274 - protein, 202 aa, Homo sapiens; identical to SEQ ID NO: 914252

SEQ ID NO: 914275 - protein, 205 aa, Homo sapiens
LFQYCWLGFVVDTYVLGSLAFTPGAWRGLSTSAAAHAASRSQAEDVRVEGSFPVTMLPGDGVGPELMHAVKEVFKAAAVPVEFQEHHLSEVQNMASEEKLEQVLSSMKENKVAIIGKIHTPMEYKGELASYDMRLRRKLDLFANVVHVKSLPGYMTRHNNLDLVIIREQTEGEYSSLEHESARGVIECLNDCHTSQVSADCKVRL

SEQ ID NO: 914276 - protein, 202 aa, Homo sapiens; identical to SEQ ID NO: 914252

SEQ ID NO: 914277 - protein, 202 aa, Homo sapiens; identical to SEQ ID NO: 914252

SEQ ID NO: 914278 - protein, 202 aa, Homo sapiens; identical to SEQ ID NO: 914252

SEQ ID NO: 914279 - protein, 202 aa, Homo sapiens; identical to SEQ ID NO: 914252

SEQ ID NO: 914280 - protein, 202 aa, Homo sapiens; identical to SEQ ID NO: 914252

SEQ ID NO: 914281 - protein, 228 aa, Homo sapiens; identical to SEQ ID NO: 914250

SEQ ID NO: 914282 - protein, 209 aa, Homo sapiens
DTSLLILQNITVAHCKSQLASGLFMLMAVLSGVRWLTRALVSAGNPGAWRGLSTSAAAHAASRSQAEDVRVEGSFPVTMLPGDGVGPELMHAVKEVFKAAAVPVEFQEHHLSEVQNMASEEKLEQVLSSMKENKVAIIGKIHTPMEYKGELASYDMRLRRKLDLFANVVHVKSLPGYMTRHNNLDLVIIREQTEGEYSSLEHESARGVV

SEQ ID NO: 914283 - protein, 248 aa, Homo sapiens
MDLCKNRLVSGGRDCQVKVWDVDTGKCLKTFRHKDPILATRINDTYIVSSCERGLVKVWHIAMAQLVKTLSGHEGAVKCLFFDQWHLLSGSTDGLVMAWSMVGKYERCLMAFKHPKEVPDVSLLFLRIISACANGKIRIYNFLHGNCMKVIKANGRGDPVLSFPRISVCHISTFAKRINVGWNGIEPSATAQGGNASLTECAHVRLHIAGHLPASRLPVAAVQPMTGGMAPTTAPTHVLAMLILFSGV

SEQ ID NO: 914284 - protein, 116 aa, Homo sapiens
MDLCKNRLVSGGRDCQVKVWDVDTGKCLKTFRHKDPILATRINDTYIVSSCERGLVKVWHIAMAQLVKTLSGHEGAVKCLFFDQWHLLSGSTDGLVMAWSMVGKYERCLMAFKHPK

SEQ ID NO: 914285 - protein, 254 aa, Homo sapiens
MDLCKNRLVSGGRDCQVKVWDVDTGKCLKTFRHKDPILATRINDTYIVSSCERGLVKVWHIAMAQLVKTLSGHEGAVKCLFFDQWHLLSGSTDGLVMAWSMVGKYERCLMAFKHPKEVPDVSLLFLRIISACANGKIRIYNFLHGNCMKVIKANGRGDPVLSFFIQGNSHRISVCHISTFAKRINVGWNGIEPSATAQGGNASLTECAHVRLHIAGHLPASRLPVAAVQPMTGGMAPTTAPTHVLAMLILFSGV

SEQ ID NO: 914286 - protein, 179 aa, Homo sapiens
FWIAGSLNHLYSGRSVLWAHELLVSLLFGGARPREVLLESDLMGSMSLCFCDGEQNSTVTFPFPPFSPLPCLPLSPSFSVWDVDTGKCLKTFRHKDPILATRINDTYIVSSCERGLVKVWHIAMAQLVKVSGQWATLAERALGRRWVGSPYLAPQVILEQLSMAFKKDSPEALKGKAPK

SEQ ID NO: 914287 - protein, 172 aa, Homo sapiens
MGKGRFDEKENVSNCIQLKTSVIKGIKNQLIEQFPGIEPWLNQIMPKKDPVKIVRCHEHIEILTVNGELLFFRQREGPFYPTLRLLHKYPFILPHQQVDKGAIKFVLSGANIMCPGLTSPGAKLYPAAVDTIVAIMAEGKQHALCVGVMKMSAEDIEKSHQGNCIENFPFFK

SEQ ID NO: 914288 - protein, 181 aa, Homo sapiens
MFKKFDEKENVSNCIQLKTSVIKGIKNQLIEQFPGIEPWLNQIMPKKDPVKIVRCHEHIEILTVNGELLFFRQREGPFYPTLRLLHKYPFILPHQQVDKGAIKFVLSGANIMCPGLTSPGAKLYPAAVDTIVAIMAEGKQHALCVGVMKMSAEDIEKVNKGIGIENIHYLNDGLWHMKTYK

SEQ ID NO: 914289 - protein, 181 aa, Homo sapiens; identical to SEQ ID NO: 914288

SEQ ID NO: 914290 - protein, 138 aa, Homo sapiens
MPKKDPVKIVRCHEHIEILTVNGELLFFRQREGPFYPTLRLLHKYPFILPHQQVDKGAIKFVLSGANIMCPGLTSPGAKLYPAAVDTIVAIMAEGKQHALCVGVMKMSAEDIEKVNKGIGIENIHYLNDGLWHMKTYK

SEQ ID NO: 914291 - protein, 182 aa, Homo sapiens
MGKGRFDEKENVSNCIQLKTSVIKGIKNQLIEQFPGIEPWLNQIMPKKDPVKIVRCHEHIEILTVNGELLFFRQREGPFYPTLRLLHKYPFILPHQQVDKGAIKFVLSGANIMCPGLTSPGAKLYPAAVDTIVAIMAEGKQHALCVGVMKMSAEDIEKVNKGIGIENIHYLNDGLWHMKTYK

SEQ ID NO: 914292 - protein, 138 aa, Homo sapiens; identical to SEQ ID NO: 914290

SEQ ID NO: 914293 - protein, 181 aa, Homo sapiens; identical to SEQ ID NO: 914288

SEQ ID NO: 914294 - protein, 181 aa, Homo sapiens; identical to SEQ ID NO: 914288

SEQ ID NO: 914295 - protein, 110 aa, Homo sapiens
MFKKFDEKENVSNCIQLKTSVIKGIKNQLIEQFPGIEPWLNQIMPKKDPVKIVRCHEHIEILTVNGELLFFRQREGPFYPTLRLLHKCYHGRRKTACSMCWSHEDVCRRH

SEQ ID NO: 914296 - protein, 236 aa, Homo sapiens
MAKDAGLIEANGELKVFIDQNLSPGKGVVSLVAVHPSTVNPLGKQLLPKTFGQSNVNIAQQVVIGTPQRPAASNTLVVGSPHTPSTHFASQNQPSDSSPWSAGKRNRKGEKNGKGLRHFSMKVCEKVQRKGTTSYNEVADELVAEFSAADNHILPNESAYDQKNIRRRVYDALNVLMAMNIISKEKKEIKWIGLPTNSAQECQNLEVERQRRLERIKQKQSQLQELILQVREYVSV

SEQ ID NO: 914297 - protein, 410 aa, Homo sapiens
MAKDAGLIEANGELKVFIDQNLSPGKGVVSLVAVHPSTVNPLGKQLLPKTFGQSNVNIAQQVVIGTPQRPAASNTLVVGSPHTPSTHFASQNQPSDSSPWSAGKRNRKGEKNGKGLRHFSMKVCEKVQRKGTTSYNEVADELVAEFSAADNHILPNESAYDQKNIRRRVYDALNVLMAMNIISKEKKEIKWIGLPTNSAQECQNLEVERQRRLERIKQKQSQLQELILQQIAFKNLVQRNRHAEQQASRPPPPNSVIHLPFIIVNTSKKTVIDCSISNDKFEYLFNFDNTFEIHDDIEVLKRMGMACGLESGSCSAEDLKMARSLVPKALEPYVTEMAQGTVGGVFITTAGSTSNGTRFSASDLTNGADGMLATSSNGSQYSGSRVETPVSYVGEDDEEDDDFNENDEDD

SEQ ID NO: 914298 - protein, 410 aa, Homo sapiens; identical to SEQ ID NO: 914297

SEQ ID NO: 914299 - protein, 410 aa, Homo sapiens; identical to SEQ ID NO: 914297

SEQ ID NO: 914300 - protein, 410 aa, Homo sapiens; identical to SEQ ID NO: 914297

SEQ ID NO: 914301 - protein, 315 aa, Homo sapiens
MSTLPSKWKRNRKGEKNGKGLRHFSMKVCEKVQRKGTTSYNEVADELVAEFSAADNHILPNESAYDQKNIRRRVYDALNVLMAMNIISKEKKEIKWIGLPTNSAQECQNLEVERQRRLERIKQKQSQLQELILQQIAFKNLVQRNRHAEQQASRPPPPNSVIHLPFIIVNTSKKTVIDCSISNDKFEYLFNFDNTFEIHDDIEVLKRMGMACGLESGSCSAEDLKMARSLVPKALEPYVTEMAQGTVGGVFITTAGSTSNGTRFSASDLTNGADGMLATSSNGSQYSGSRVETPVSYVGEDDEEDDDFNENDEDD

SEQ ID NO: 914302 - protein, 410 aa, Homo sapiens; identical to SEQ ID NO: 914297

SEQ ID NO: 914303 - protein, 337 aa, Homo sapiens
MAKDAGLIEANGELKVFIDQNLSPGKGVVSLVAVHPSTVNPLGKQLLPKTFGQSNVNIAQQVVIGTPQRPAASNTLVVGSPHTPSTHFASQNQPSDSSPWSAGKRNRKGEKNGKGLRHFSMKVCEKVQRKGTTSYNEVADELVAEFSAADNHILPNESAYDQKNIRRRVYDALNVLMAMNIISKEKKEIKWIGLPTNSAQECQNLEVERQRRLERIKQKQSQLQELILQQIAFKNLVQRNRHAEQQASRPPPPNSVIHLPFIIVNTSKKTVIDCSISNDKFEYLFNFDNTFEIHDDIEVLKRMGMACGLESGSCSAEDLKMARSLVPKALEPYVTVT

SEQ ID NO: 914304 - protein, 108 aa, Homo sapiens [sequence omitted]

SEQ ID NO: 914305 - protein, 319 aa, Homo sapiens
SAFHFPGWAKSTARHPLQGHHPVGAMVVGGLRGVKDSKESTSKIGVLLSAVAVEDTFIRARMAVRPLSLSSPLRIPFPERFSPWAAEVSTQRPALAFQMSRPTPRCHVDAGRAVRTPRAQGLRSCAATGHLAPLIFFEQIAFKNLVQRNRHAEQQASRPPPPNSVIHLPFIIVNTSKKTVIDCSISNDKFEYLFNFDNTFEIHDDIEVLKRMGMACGLESGSCSAEDLKMARSLVPKALEPYVTEMAQGTVGGVFITTAGSTSNGTRFSASDLTNGADGMLATSSNGSQYSGSRVETPVSYVGEDDEEDDDFNENDEDD

SEQ ID NO: 914306 - protein, 162 aa, Homo sapiens
MAKDAGLIEANGELKVFIDQNLSPGKGVVSLVAVHPSTVNPLGKQLLPKTFGQSNVNIAQQVVIGTPQRPAASNTLVVGSPHTPSTHFASQNQPSDSSPWSAGKRNRKGEKNGKGLRHFSMKVCEKVQRKGTTSYNEVADELVAEFSAADNHILPNESAYLP

SEQ ID NO: 914307 - protein, 366 aa, Homo sapiens
MAKDAGLIEANGELKVFIDQNLSPGKGVVSLVAVHPSTVNPLGKQLLPKTFGQSNVNIAQQVVIGTPQRPAASNTLVVGSPHTPSTHFASQNQPSDSSPWSAGKRNRKGEKNGKGLRHFSMKVCEKVQRKGTTSYNEVADELVAEFSAADNHILPNESAYDQKNIRRRVYDALNVLMAMNIISKEKKEIKWIGLPTNSAQECQNLEVERQRRLERIKQKQSQLQELILQQIAFKNLVQRNRHAEQQASRPPPPNSVIHLPFIIVNTSKKTVIDCSISNDKFEYLFNFDNTFEIHDDIEVLKRMGMACGLESGSCSAEDLKMARSLVPKALEPYVTEMAQGTVGGVFITTAGSTSNGTRFSARGDSR

SEQ ID NO: 914308 - protein, 116 aa, Homo sapiens
AGGAGDRGAAEEEEEGAEGAKRRAGALRGAGPPPPTSPRRAHVTPARRSARVSPASRRHSAQGRDPATAGTARPGPSPRLSAPPRAPHRALSASPPARPDRAARKIIFLLWEGEHL

SEQ ID NO: 914309 - protein, 410 aa, Homo sapiens; identical to SEQ ID NO: 914297

SEQ ID NO: 914310 - protein, 410 aa, Homo sapiens; identical to SEQ ID NO: 914297

SEQ ID NO: 914311 - protein, 410 aa, Homo sapiens; identical to SEQ ID NO: 914297

SEQ ID NO: 914312 - protein, 464 aa, Homo sapiens
MAKDAGLIEANGELKVFIDQNLSPGKGVVSLVAVHPSTVNPLGKQLLPKTFGQSNVNIAQQVVIGTPQRPAASNTLVVGSPHTPSTHFASQNQPSDSSPWSAGLSTSLWTLRVVGLLAVRTSTFSWATCVTQSCDGAPTRVDASLRITLTHHRGLHRKRNRKGEKNGKGLRHFSMKVCEKVQRKGTTSYNEVADELVAEFSAADNHILPNESAYDQKNIRRRVYDALNVLMAMNIISKEKKEIKWIGLPTNSAQECQNLEVERQRRLERIKQKQSQLQELILQQIAFKNLVQRNRHAEQQASRPPPPNSVIHLPFIIVNTSKKTVIDCSISNDKFEYLFNFDNTFEIHDDIEVLKRMGMACGLESGSCSAEDLKMARSLVPKALEPYVTEMAQGTVGGVFITTAGSTSNGTRFSASDLTNGADGMLATSSNGSQYSGSRVETPVSYVGEDDEEDDDFNENDEDD

SEQ ID NO: 914313 - protein, 410 aa, Homo sapiens; identical to SEQ ID NO: 914297

SEQ ID NO: 914314 - protein, 410 aa, Homo sapiens; identical to SEQ ID NO: 914297

SEQ ID NO: 914315 - protein, 410 aa, Homo sapiens; identical to SEQ ID NO: 914297

SEQ ID NO: 914316 - protein, 162 aa, Homo sapiens; identical to SEQ ID NO: 914306

SEQ ID NO: 914317 - protein, 212 aa, Homo sapiens
MAKDAGLIEANGELKVFIDQNLSPGKGVVSLVAVHPSTVNPLGKQLLPKTFGQSNVNIAQQVVIGTPQRPAASNTLVVGSPHTPSTHFASQNQPSDSSPWSAGKRNRKGEKNGKGLRHFSMKVCEKVQRKGTTSYNEVADELVAEFSAADNHILPNESAYDQKNIRRRVYDALNVLMAMNIISKEKKEIKWIGLPTNSAQECQNLEVERQLF

SEQ ID NO: 914318 - protein, 162 aa, Homo sapiens
MAKDAGLIEANGELKVFIDQNLSPGKGVVSLVAVHPSTVNPLGKQLLPKTFGQSNVNIAQQVVSLPQERTAGISVGGRDRMSRVVGDVPRCAWIWAPVAAWGLSLIREPVASARFSIALCSCPRVVVGEVMAPTALLCAPAHAILPVTGGWWVGPRPQPEAA

SEQ ID NO: 914319 - protein, 354 aa, Homo sapiens
MGWSCLVTGAGGLLGQRIVRLLVEEKELKEIRALDKAFRPELREEFSKLQNRTKLTVLEGDILDEPFLKRACQDVSVVIHTACIIDVFGVTHRESIMNVNVKGTQLLLEACVQASVPVFIYTSSIEVAGPNSYKEIIQNGHEEEPLENTWPTPYPYSKKLAEKAVLAANGWNLKGGPFLSASINEALNNNGILSSVGKFSTVNPVYVGNVAWAHILALRALRDPKKAPSVRGQFYYISDDTPHQSYDNLNYILSKEFGLRLDSRWSLPLTLMYWIGFLLEVVSFLLSPIYSYQPPFNRHTVTLSNSVFTFSYKKAQRDLAYKPLYSWEEAKQKTVEWVGSLVDRHKETLKSKTQ

SEQ ID NO: 914320 - protein, 176 aa, Homo sapiens
MGWSCLVTGAGGLLGQRIVRLLVEEKELKEIRALDKAFRPELREEFSKLQNRTKLTVLEGDILDEPFLKRACQDVSVVIHTACIIDVFGVTHRESIMNVNVKGTQLLLEACVQASVPVFIYTSSIEVAGPNSYKEIIQNGHEEEPLENTWPTPYPYSKKLAEKAVLAANGWNLKKW

SEQ ID NO: 914321 - protein, 354 aa, Homo sapiens; identical to SEQ ID NO: 914319

SEQ ID NO: 914322 - protein, 354 aa, Homo sapiens; identical to SEQ ID NO: 914319

SEQ ID NO: 914323 - protein, 336 aa, Homo sapiens
MGWSCLVTGAGGLLGQRIVRLLVEEKELKEIRALDKAFRPELREEFSKLQNRTKLTVLEGDILDEPFLKRACQDVSVVIHTACIIDVFGVTHRESIMNVNVKGTQLLLEACVQASVPVFIYTSSIEVAGPNSYKEIIQNGHEEEPLENTWPTPYPYSKKLAEKAVLAANGWNLKGGPFLSASINEALNNNGILSSVGKFSTVNPVYVGNVAWAHILALRALRDPKKAPSVRGQFYYISDDTPHQSYDNLNYILSKEFGLRLDSRWSLPLTLMYWIGFLLEVVSFLLSPIYSYQPPFNRHTVTLSNSVFTFSYKKAQRDLAYKPLYSWEEAKQSKTQ

SEQ ID NO: 914324 - protein, 176 aa, Homo sapiens; identical to SEQ ID NO: 914320

SEQ ID NO: 914325 - protein, 176 aa, Homo sapiens; identical to SEQ ID NO: 914320

SEQ ID NO: 914326 - protein, 181 aa, Homo sapiens
MGWSCLVTGAGGLLGQRIVRLLVEEKELKEIRALDKAFRPELREEFSKLQNRTKLTVLEGDILDEPFLKRACQDVSVVIHTACIIDVFGVTHRESIMNVNVKGTQLLLEACVQASVPVFIYTSSIEVAGPNSYKEIIQNGHEEEPLENTWPTPYPYSKKLAEKAVLAANGWNLKGALSFCR

SEQ ID NO: 914327 - protein, 182 aa, Homo sapiens
MGWSCLVTGAGGLLGQRIVRLLVEEKELKEIRALDKAFRPELREEFSKLQNRTKLTVLEGDILDEPFLKRACQDVSVVIHTACIIDVFGVTHRESIMNVNVKGTQLLLEACVQASVPVFIYTSSIEVAGPNSYKEIIQNGHEEEPLENTWPTPYPYSKKLAEKAVLAANGWNLKGPSFLAGK

SEQ ID NO: 914328 - protein, 198 aa, Homo sapiens
MGWSCLVTGAGGLLGQRIVRLLVEEKELKEIRALDKAFRPELREEFSKLQNRTKLTVLEGDILDEPFLKRACQDVSVVIHTACIIDVFGVTHRESIMNVNVKGTQLLLEACVQASVPVFIYTSSIEVAGPNSYKEIIQNGHEEEPLENTWPTPYPYSKKLAEKAVLAANGWNLKSFCHLIGATTRGLSGGKIFLNPPC

SEQ ID NO: 914329 - protein, 183 aa, Homo sapiens
MGKGGPFLSASINEALNNNGILSSVGKFSTVNPVYVGNVAWAHILALRALRDPKKAPSVRGQFYYISDDTPHQSYDNLNYILSKEFGLRLDSRWSLPLTLMYWIGFLLEVVSFLLSPIYSYQPPFNRHTVTLSNSVFTFSYKKAQRDLAYKPLYSWEEAKQKTVEWVGSLVDRHKETLKSKTQ

SEQ ID NO: 914330 - protein, 226 aa, Homo sapiens
PRAVRIRLELLCSAFNNLFYALFWVTLESDLLSSIFCFLASVSCYFGLATMGWSCLVTGAGGLLGQRIVRLLVEEKELKEIRALDKAFRPELREEFSKLQNRTKLTVLEGDILDEPFLKRACQDVSVVIHTACIIDVFGVTHRESIMNVNVKGTQLLLEACVQASVPVFIYTSSIEVAGPNSYKEIIQNGHEEEPLENTWPTPYPYSKKLAEKAVLAANGWNLKKW

SEQ ID NO: 914331 - protein, 183 aa, Homo sapiens; identical to SEQ ID NO: 914329

SEQ ID NO: 914332 - protein, 113 aa, Homo sapiens
MGWSCLVTGAGGLLGQRIVRLLVEEKELKEIRALDKAFRPELREEFSKLQNRTKLTVLEGDILDEPFLVFGVTHRESIMNVNVKGTVAWGGDKTSWLNEDQKEGQEREEKSLH

SEQ ID NO: 914333 - protein, 397 aa, Homo sapiens
MGWSCLVTGAGGLLGQRIVRLLVEEKELKEIRALDKAFRPELREEFSNPWKLTGKSHFLSALDFCYEMAIPLSQSVKVGSKGEADEGSRKELQNRTKLTVLEGDILDEPFLKRACQDVSVVIHTACIIDVFGVTHRESIMNVNVKGTQLLLEACVQASVPVFIYTSSIEVAGPNSYKEIIQNGHEEEPLENTWPTPYPYSKKLAEKAVLAANGWNLKGGPFLSASINEALNNNGILSSVGKFSTVNPVYVGNVAWAHILALRALRDPKKAPSVRGQFYYISDDTPHQSYDNLNYILSKEFGLRLDSRWSLPLTLMYWIGFLLEVVSFLLSPIYSYQPPFNRHTVTLSNSVFTFSYKKAQRDLAYKPLYSWEEAKQKTVEWVGSLVDRHKETLKSKTQ

SEQ ID NO: 914334 - protein, 113 aa, Homo sapiens
MGWSCLVTGAGGLLGQRIVRLLVEEKELKEIRALDKAFRPELREEFSKLQNRTKLTVLEGDILDEPFLKRACQDVSVVIHTACIIDVFGVTHRESIMNVNVKGTVAWGGDSLH

SEQ ID NO: 914335 - protein, 145 aa, Homo sapiens
MGWSCLVTGAGGLLGQRIVRLLVEEKELKEIRALDKAFRPELREEFSIPNQTKLTDFEGNILGEALPEKNPPEPFGCNKPAGYMVVLGGPHRRPPLNAIGKGPPLFWGGLFKQQGPLFFFPPRLKGARPPPPQGKFPQTPPKKTL

SEQ ID NO: 914336 - protein, 81 aa, Homo sapiens
NRTKLTVLEGDILDEPFLKRACQDVSVVIHTACIIDVFGVTHRESIMNVNVKGTVAWGGDKTSWLNEDQKEGQEREEKSLH

SEQ ID NO: 914337 - protein, 354 aa, Homo sapiens; identical to SEQ ID NO: 914319

SEQ ID NO: 914338 - protein, 354 aa, Homo sapiens; identical to SEQ ID NO: 914319

SEQ ID NO: 914339 - protein, 354 aa, Homo sapiens; identical to SEQ ID NO: 914319

SEQ ID NO: 914340 - protein, 176 aa, Homo sapiens; identical to SEQ ID NO: 914320

SEQ ID NO: 914341 - protein, 200 aa, Homo sapiens
MGWSCLVTGAGGLLGQRIVRLLVEEKELKEIRALDKAFRPELREEFSKLQNRTKLTVLEGDILDEPFLKRACQDVSVVIHTACIIDVFGVTHRESIMNVNVKGTQLLLEACVQASVPVFIYTSSIEVAGPNSYKEIIQNGHEEEPLENTWPTPYPYSKKLAEKAVLAANGWNLKPFLSALMRPDNMDLAGWKSLSTSMCT

SEQ ID NO: 914342 - protein, 176 aa, Homo sapiens; identical to SEQ ID NO: 914320

SEQ ID NO: 914343 - protein, 204 aa, Homo sapiens
MGWSCLVTGAGGLLGQRIVRLLVEEKELKEIRALDKAFRPELREEFSKLQNRTKLTVLEGDILDEPFLKRACQDVSVVIHTACIIDVFGVTHRESIMNVNVKGTQLLLEACVQASVPVFIYTSSIEVAGPNSYKEIIQNGHEEEPLENTWPTPYPYSKKLAEKAVLAANGWNLKRGPISFCQFNEGLTTWGPGQGGKVSHEPTP

SEQ ID NO: 914344 - protein, 354 aa, Homo sapiens; identical to SEQ ID NO: 914319

SEQ ID NO: 914345 - protein, 158 aa, Homo sapiens
MGWSCLVTGAGGLLGQRIVRLLVEEKELKEIRALDKAFRPELREEFSKLQNRTKLTVLEGDILDEPFLKRACQDVSVVIHTACIIDVFGVTHRESIMNVNVKGTQLLLEACVQASVPVFIYTSSIEVAGPNSYKEIIQNGHEEEPAVLAANGWNLKKW

SEQ ID NO: 914346 - protein, 113 aa, Homo sapiens; identical to SEQ ID NO: 914332

SEQ ID NO: 914347 - protein, 131 aa, Homo sapiens
MGWSCLVTGAGGLLGQRIVRLLVEEKELKEIRALDKAFRPELREEFSKLQNRTKLTVLEGDILDEPFLKRACQDVSVVIHTACIIDVFGVTHRESIMNVNVKGTVAWGGDKTSWLNEDQKEGQEREEKSLH

SEQ ID NO: 914348 - protein, 102 aa, Homo sapiens
MGWSCLVTGAGGLLGQRIVRLLVEEKELKEIRALDKAFRPELREEFSRLHTEGNRGTSPGPAASLSHNAQLTVFFMSSKTNNMICCYQISVADSEQLWSLLT

SEQ ID NO: 914349 - protein, 616 aa, Homo sapiens
MSSLAVRDPAMDRSLRSVFVGNIPYEATEEQLKDIFSEVGSVVSFRLVYDRETGKPKGYGFCEYQDQETALSAMRNLNGREFSGRALRVDNAASEKNKEELKSLGPAAPIIDSPYGDPIDPEDAPESITRAVASLPPEQMFELMKQMKLCVQNSHQEARNMLLQNPQLAYALLQAQVVMRIMDPEIALKILHRKIHVTPLIPGKSQSVSVSGPGPGPGPGLCPGPNVLLNQQNPPAPQPQHLARRPVKDIPPLMQTPIQGGIPAPGPIPAAVPGAGPGSLTPGGAMQPQLGMPGVGPVPLERGQVQMSDPRAPIPRGPVTPGGLPPRGLLGDAPNDPRGGTLLSVTGEVEPRGYLGPPHQGPPMHHASGHDTRGPSSHEMRGGPLGDPRLLIGEPRGPMIDQRGLPMDGRGGRDSRAMETRAMETEVLETRVMERRGMETCAMETRGMEARGMDARGLEMRGPVPSSRGPMTGGIQGPGPINIGAGGPPQGPRQVPGISGVGNPGAGMQGTGIQGTGMQGAGIQGGGMQGAGIQGVSIQGGGIQGGGIQGASKQGGSQPSSFSPGQSQVTPQDQEKAALIMQVLQLTADQIAMLPPEQRQSILILKEQIQKSTGAS

SEQ ID NO: 914350 - protein, 595 aa, Homo sapiens
MSSLAVRDPAMDRSLRSVFVGNIPYEATEEQLKDIFSEVGSVVSFRLVYDRETGKPKGYGFCEYQDQETALSAMRNLNGREFSGRALRVDNAASEKNKEELKSLGPAAPIIDSPYGDPIDPEDAPESITRAVASLPPEQMFELMKQMKLCVQNSHQEARNMLLQNPQLAYALLQAQVVMRIMDPEIALKILHRKIHVTPLIPGPNVLLNQQNPPAPQPQHLARRPVKDIPPLMQTPIQGGIPAPGPIPAAVPGAGPGSLTPGGAMQPQLGMPGVGPVPLERGQVQMSDPRAPIPRGPVTPGGLPPRGLLGDAPNDPRGGTLLSVTGEVEPRGYLGPPHQGPPMHHASGHDTRGPSSHEMRGGPLGDPRLLIGEPRGPMIDQRGLPMDGRGGRDSRAMETRAMETEVLETRVMERRGMETCAMETRGMEARGMDARGLEMRGPVPSSRGPMTGGIQGPGPINIGAGGPPQGPRQVPGISGVGNPGAGMQGTGIQGTGMQGAGIQGGGMQGAGIQGVSIQGGGIQGGGIQGASKQGGSQPSSFSPGQSQVTPQDQEKAALIMQVLQLTADQIAMLPPEQRQSILILKEQIQKSTGAS

SEQ ID NO: 914351 - protein, 616 aa, Homo sapiens; identical to SEQ ID NO: 914349

SEQ ID NO: 914352 - protein, 616 aa, Homo sapiens; identical to SEQ ID NO: 914349

SEQ ID NO: 914353 - protein, 222 aa, Homo sapiens
MSSLAVRDPAMDRSLRSVFVGNIPYEATEEQLKDIFSEVGSVVSFRLVYDRETGKPKGYGFCEYQDQETALSAMRNLNGREFSGRALRVDNAASEKNKEELKSLGPAAPIIDSPYGDPIDPEDAPESITRAVASLPPEQMFELMKQMKLCVQNSHQEARNMLLQNPQLAYALLQVTPQDQEKAALIMQVLQLTADQIAMLPPEQRQSILILKEQIQKSTGAS

SEQ ID NO: 914354 - protein, 146 aa, Homo sapiens
MSPGPRAGFARKHPTKALGKETNGEEENERLQEGAPVLALPPTWGPSGYQCPWRGFLAASPTKELWSLRTMDALNRNQIGPGCQTQTMVQKGPLDLIETGKGLKVQTDKPHLVSLGSGRLSTAITLLPLEEGKCEQGISLTTPLSL

SEQ ID NO: 914355 - protein, 721 aa, Homo sapiens
MELGKQQEGSWERQRLETILNLCAEYSRADGGPEAGELPSIGEATAALALAGRRPSRGLAGASGRSSEEPGVATQRLWESMERSDEENLKEECSSTESTQQEHEDAPSTKLQGEVLALEEERAQVLGHVEQLKVRVKELEQQLQESAREAEMERALLQGEREAERALLQKEQKAVDQLQEKLVALETGIQKERDKEAEALETETKLFEDLEFQQLERESRVEEERELAGQGLLRSKAELLRSIAKRKERLAILDSQAGQIRAQAVQESERLARDKNASLQLLQKEKEKLTVLERRYHSLTGGRPFPKTTSTLKEVYRSKMDGEATSPLPRTRSGPLPSSSGSSSSSSQLSVATLGRSPSPKSALLTQNGTGSLPRNLAATLQDIETKRQLALQQKGQQVIEEQRRRLAELKQKAAAEAQCQWDALHGAAPFPAGPSGFPPLMHHSILHHLPAGRERGEEGEHAYDTLSLESSDSMETSISTGGNSACSPDNMSSASGLDMGKIEEMEKMLKEAHAEKNRLMESREREMELRRQALEEERRRREQVERRLQSESARRQQLVEKEVKMREKQFSQARPLTRYLPIRKEDFDLKTHIESSGHGVDTCLHVVLSSKVCRGYLVKMGGKIKSWKKRWFVFDRLKRTLSYYVDKHETKLKGVIYFQAIEEVYYDHLRSAAKSPNPALTFCVKTHDRLYYMVAPSAEAMRIWMDVIVTGAEGYTQFMN

SEQ ID NO: 914356 - protein, 1282 aa, Homo sapiens
PCGNACTIDGLPVRQPTRLTQGCMLCLGQSTFLRFNHPAEAKWMKSMIPAGGRAPGPPYSPVPAESESLVNGNHTPQTATRGPSACASHSSLVSSIEKDLQEIMDSLVLEEPGAAGKKPAATSPLSPMANGGRYLLSPPTSPGAMSVGSSYENTSPAFSPLSSPASSGSCASHSPSGQEPGPSVPPLVPARSSSYHLALQPPQSRPSGARSESPRLSRKGGHERPPSPGLRGLLTDSPAATVLAEARRATESPRLGGQLPVVAISLSEYPASGALSQPTSIPGSPKFQPPVPAPRNKIGTLQDRPPSPFREPPGSERVLTTSPSRQLVGRTFSDGLATRTLQPPESPRLGRRGLDSMRELPPLSPSLSRRALSPLPTRTTPDPKLNREVAESPRPRRWAAHGASPEDFSLTLGARGRRTRSPSPTLGESLAPHKGSFSGRLSPAYSLGSLTGASPCQSPCVQRKLSSGDLRVPVTRERKNSITEISDNEDDLLEYHRRQRQERLREQEMERLERQRLETILNLCAEYSRADGGPEAGELPSIGEATAALALAGRRPSRGLAGASGRSSEEPGVATQRLWESMERSDEENLKEECSSTESTQQEHEDAPSTKLQGEVLALEEERAQVLGHVEQLKVRVKELEQQLQESAREAEMERALLQGEREAERALLQKEQKAVDQLQEKLVALETGIQKERDKEAEALETETKLFEDLEFQQLERESRVEEERELAGQGLLRSKAELLRSIAKRKERLAILDSQAGQIRAQAVQESERLARDKNASLQLLQKEKEKLTVLERRYHSLTGGRPFPKTTSTLKELQMEKLLLPAVDLEQWYQELMAGLGTGPAAASPHSSPPPLPAKASRQLQVYRSKMDGEATSPLPRTRSGPLPSSSGSSSSSSQLSVATLGRSPSPKSALLTQNGTGSLPRNLAATLQDIETKRQLALQQKGQQVIEEQRRRLAELKQKAAAEAQCQWDALHGAAPFPAGPSGFPPLMHHSILHHLPAGRERGEEGEHAYDTLSLESSDSMETSISTGGNSACSPDNMSSASGLDMGKIEEMEKMLKEAHAEKNRLMESREREMELRRQALEEERRRREQVERRLQSESARRQQLVEKEVKMREKQFSQARPLTRYLPIRKEDFDLKTHIESSGHGVDTCLHVVLSSKVCRGYLVKMGGKIKSWKKRWFVFDRLKRTLSYYVDKHETKLKGVIYFQAIEEVYYDHLRSAAKKRFFRFTMVTESPNPALTFCVKTHDRLYYMVAPSAEAMRIWMDVIVTGAEGYTQFMN

SEQ ID NO: 914357 - protein, 844 aa, Homo sapiens
PCGNACTIDGLPVRQPTRLTQGCMLCLGQSTFLRFNHPAEAKWMKSMIPAGGRAPGPPYSPVPAESESLVNGNHTPQTATRGPSACASHSSLVSSIEKDLQEIMDSLVLEEPGAAGKKPAATSPLSPMANGGRYLLSPPTSPGAMSVGSSYENTSPAFSPLSSPASSGSCASHSPSGQEPGPSVPPLVPARSSSYHLALQPPQSRPSGARSESPRLSRKGGHERPPSPGLRGLLTDSPAATVLAEARRATESPRLGGQLPVVAISLSEYPASGALSQPTSIPGSPKFQPPVPAPRNKIGTLQDRPPSPFREPPGSERVLTTSPSRQLVGRTFSDGLATRTLQPPESPRLGRRGLDSMRELPPLSPSLSRRALSPLPTRTTPDPKLNREVAESPRPRRWAAHGASPEDFSLTLGARGRRTRSPSPTLGESLAPHKGSFSGRLSPAYSLGSLTGASPCQSPCVQRKLSSGDLRVPVTRERKNSITEISDNEDDLLEYHRRQRQERLREQEMERLERQRLETILNLCAEYSRADGGPEAGELPSIGEATAALALAGRRPSRGLAGASGRSSEEPGVATQRLWESMERSDEENLKEECSSTESTQQEHEDAPSTKLQGEVLALEEERAQVLGHVEQLKVRVKELEQQLQESAREAEMERALLQGEREAERALLQKEQKAVDQLAGLVEKEVKMREKQFSQARPLTRYLPIRKEDFDLKTHIESSGHGVDTCLHVVLSSKVCRGYLVKMGGKIKSWKKRWFVFDRLKRTLSYYVDKHETKLKGVIYFQAIEEVYYDHLRSAAKSPNPALTFCVKTHDRLYYMVAPSAEAMRIWMDVIVTGAEGYTQFMN

SEQ ID NO: 914358 - protein, 194 aa, Homo sapiens
MELRRQALEEERRRREQVERRLQSESARRQQLVEKEVKMREKQFSQARPLTRYLPIRKEDFDLKTHIESSGHGVDTCLHVVLSSKVCRGYLVKMGGKIKSWKKRWFVFDRLKRTLSYYVDKHETKLKGVIYFQAIEEVYYDHLRSAAKSPNPALTFCVKTHDRLYYMVAPSAEAMRIWMDVIVTGAEGYTQFMN

SEQ ID NO: 914359 - protein, 1222 aa, Homo sapiens
PCGNACTIDGLPVRQPTRLTQGCMLCLGQSTFLRFNHPAEAKWMKSMIPAGGRAPGPPYSPVPAESESLVNGNHTPQTATRGPSACASHSSLVSSIEKDLQEIMDSLVLEEPGAAGKKPAATSPLSPMANGGRYLLSPPTSPGAMSVGSSYENTSPAFSPLSSPASSGSCASHSPSGQEPGPSVPPLVPARSSSYHLALQPPQSRPSGARSESPRLSRKGGHERPPSPGLRGLLTDSPAATVLAEARRATESPRLGGQLPVVAISLSEYPASGALSQPTSIPGSPKFQPPVPAPRNKIGTLQDRPPSPFREPPGSERVLTTSPSRQLVGRTFSDGLATRTLQPPESPRLGRRGLDSMRELPPLSPSLSRRALSPLPTRTTPDPKLNREVAESPRPRRWAAHGASPEDFSLTLGARGRRTRSPSPTLGESLAPHKGSFSGRLSPAYSLGSLTGASPCQSPCVQRKLSSGDLRVPVTRERKNSITEISDNEDDLLEYHRRQRQERLREQEMERLERQRLETILNLCAEYSRADGGPEAGELPSIGEATAALALAGRRPSRGLAGASGRSSEEPGVATQRLWESMERSDEENLKEECSSTESTQQEHEDAPSTKLQGEVLALEEERAQVLGHVEQLKVRVKELEQQLQESAREAEMERALLQGEREAERALLQKEQKAVDQLQEKLVALETGIQKERDKEAEALETETKLFEDLEFQQLERESRVEEERELAGQGLLRSKAELLRSIAKRKERLAILDSQAGQIRAQAVQESERLARDKNASLQLLQKEKEKLTVLERRYHSLTGGRPFPKTTSTLKEVYRSKMDGEATSPLPRTRSGPLPSSSGSSSSSSQLSVATLGRSPSPKSALLTQNGTGSLPRNLAATLQDIETKRQLALQQKGQQVIEEQRRRLAELKQKAAAEAQCQWDALHGAAPFPAGPSGFPPLMHHSILHHLPAGRERGEEGEHAYDTLSLESSDSMETSISTGGNSACSPDNMSSASGLDMGKIEEMEKMLKEAHAEKNRLMESREREMELRRQALEEERRRREQVERRLQSESARRQQLVEKEVKMREKQFSQARPLTRYLPIRKEDFDLKTHIESSGHGVDTCLHVVLSSKVCRGYLVKMGGKIKSWKKRWFVFDRLKRTLSYYVDKHETKLKGVIYFQAIEEVYYDHLRSAAKSPNPALTFCVKTHDRLYYMVAPSAEAMRIWMDVIVTGAEGYTQFMN

SEQ ID NO: 914360 - protein, 76 aa, Homo sapiens
GSVPGPVRMCTTTTCAGDKKRFFRFTMVTESPNPALTFCVKTHDRLYYMVAPSAEAMRIWMDVIVTGAEGYTQFMN

SEQ ID NO: 914361 - protein, 84 aa, Homo sapiens
RANPPRSSYRSVRIDHRARCSQIKSVLSASLLVTESPASPNPALTFCVKTHDRLYYMVAPSAEAMRIWMDVIVTGAEGYTQFMN

SEQ ID NO: 914362 - protein, 1222 aa, Homo sapiens; identical to SEQ ID NO: 914359

SEQ ID NO: 914363 - protein, 1222 aa, Homo sapiens; identical to SEQ ID NO: 914359

SEQ ID NO: 914364 - protein, 809 aa, Homo sapiens
PCGNACTIDGLPVRQPTRLTQGCMLCLGQSTFLRFNHPAEAKWMKSMIPAGGRAPGPPYSPVPAESESLVNGNHTPQTATRGPSACASHSSLVSSIEKDLQEIMDSLVLEEPGAAGKKPAATSPLSPMANGGRYLLSPPTSPGAMSVGSSYENTSPAFSPLSSPASSGSCASHSPSGQEPGPSVPPLVPARSSSYHLALQPPQSRPSGARSESPRLSRKGGHERPPSPGLRGLLTDSPAATVLAEARRATESPRLGGQLPVVAISLSEYPASGALSQPTSIPGSPKFQPPVPAPRNKIGTLQDRPPSPFREPPGSERVLTTSPSRQLVGRTFSDGLATRTLQPPESPRLGRRGLDSMRELPPLSPSLSRRALSPLPTRTTPDPKLNREVAESPRPRRWAAHGASPEDFSLTLGARGRRTRSPSPTLGESLAPHKGSFSGRLSPAYSLGSLTGASPCQSPCVQRKLSSGDLRVPVTRERKNSITEISDNEDDLLEYHRRQRQERLREQEMERLERQRLETILNLCAEYSRADGGPEAGELPSIGEATAALALAGRRPSRGLAGASGRSSEEPGVATQRLWESMERSDEENLKEECSSTESTQQEHEDAPSTKLQGEVLALEEERAQVLGHVEQLKVRVKELEQQLQESAREAEMERALLQGEREAERALLQKEQKAVDQLQEKLVALETGIQKERDKERAELAAGRRHLEARQALYAELQTQLDNCPESVREQLQEQLRREAEALETETKLFEDLEFQQLERESRVEEERELAGQGLLRSKAELLRSIAKRKVCPTSFPAACCWRPVTWV

SEQ ID NO: 914365 - protein, 846 aa, Homo sapiens
PCGNACTIDGLPVRQPTRLTQGCMLCLGQSTFLRFNHPAEAKWMKSMIPAGGRAPGPPYSPVPAESESLVNGNHTPQTATRGPSACASHSSLVSSIEKDLQEIMDSLVLEEPGAAGKKPAATSPLSPMANGGRYLLSPPTSPGAMSVGSSYENTSPAFSPLSSPASSGSCASHSPSGQEPGPSVPPLVPARSSSYHLALQPPQSRPSGARSESPRLSRKGGHERPPSPGLRGLLTDSPAATVLAEARRATESPRLGGQLPVVAISLSEYPASGALSQPTSIPGSPKFQPPVPAPRNKIGTLQDRPPSPFREPPGSERVLTTSPSRQLVGRTFSDGLATRTLQPPESPRLGRRGLDSMRELPPLSPSLSRRALSPLPTRTTPDPKLNREVAESPRPRRWAAHGASPEDFSLTLGARGRRTRSPSPTLGESLAPHKGSFSGRLSPAYSLGSLTGASPCQSPCVQRKLSSGDLRVPVTRERKNSITEISDNEDDLLEYHRRQRQERLREQEMERLERQRLETILNLCAEYSRADGGPEAGELPSIGEATAALALAGRRPSRGLAGASGRSSEEPGVATQRLWESMERSDEENLKEECSSTESTQQEHEDAPSTKLQGEVLALEEERAQVLGHVEQLKVRVKELEQQLQESAREAEMERALLQGEREAERALLQKEQKAVDQLQEKLVALETGIQKERDKERAELAAGRRHLEARQALYAELQTQLDNCPESVREQLQEQLRRVSSTAPPPPAPRATPQKEERRAVGRDHLALQYLPDTREAEALETETKLFEDLEFQQLERESRVEEERELAGQGLLRSKAELLRSIAKRKVCPTSFPAACCWRPVTWV

SEQ ID NO: 914366 - protein, 136 aa, Homo sapiens
KAVDQLQEKLVALETGIQKERDKVTHTWPSLVLGTSGLGEKEKCLLWGPVPFTSSSILQYKWSLWLSRDRVTSPPLWKEPAWRALPGAGLVSGVSSVWVCVLPLGACHPRPFMALLGSAKAPSWAVSTAQGTDIGE

SEQ ID NO: 914367 - protein, 34 aa, Homo sapiens
MDSLVLEEPGAAGKKPAATSPLSPMANGGRYLLS

SEQ ID NO: 914368 - protein, 137 aa, Homo sapiens
RGIYGTEEERCSWERKLEGLWLEFCTVLSFRQGKRIPPMLLERKPEQEMMQQRGRALWCRRPSFSLRRVMEMESGGPGLQLSGLALHALTLSPPPLLSFPALSPWLPGPRLGVFSICKHFSRTIKPLDYGKVSGRPV

SEQ ID NO: 914369 - protein, 115 aa, Homo sapiens [sequence omitted]

SEQ ID NO: 914370 - protein, 1222 aa, Homo sapiens; identical to SEQ ID NO: 914359

SEQ ID NO: 914371 - protein, 1176 aa, Homo sapiens
PCGNACTIDGLPVRQPTRLTQGCMLCLGQSTFLRFNHPAEAKWMKSMIPAGGRAPGPPYSPVPAESESLVNGNHTPQTATRGPSACASHSSLVSSIEKDLQEIMDSLVLEEPGAAGKKPAATSPLSPMANGGRYLLSPPTSPGAMSVGSSYENTSPAFSPLSSPASSGSCASHSPSGQEPGPSVPPLVPARSSSYHLALQPPQSRPSGARSESPRLSRKGGHERPPSPGLRGLLTDSPAATVLAEARRATESPRLGGQLPVVAISLSEYPASGALSQPTSIPGSPKFQPPVPAPRNKIGTLQDRPPSPFREPPGSERVLTTSPSRQLVGRTFSDGLATRTLQPPESPRLGRRGLDSMRELPPLSPSLSRRALSPLPTRTTPDPKLNREVAESPRPRRWAAHGASPEDFSLTLGARGRRTRSPSPTLGESLAPHKGSFSGRLSPAYSLGSLTGASPCQSPCVQRKLSSGDLRVPVTRERKNSITEISDNEDDLLEYHRRQRQERLREQEMERLERQRLETILNLCAEYSRADGGPEAGELPSIGEATAALALAGRRPSRGLAGASGRSSEEPGVATQRLWESMERSDEENLKEECSSTESTQQEHEDAPSTKLQGEVLALEEERAQVLGHVEQLKVRVKELEQQLQESAREEAEALETETKLFEDLEFQQLERESRVEEERELAGQGLLRSKAELLRSIAKRKERLAILDSQAGQIRAQAVQESERLARDKNASLQLLQKEKEKLTVLERRYHSLTGGRPFPKTTSTLKEVYRSKMDGEATSPLPRTRSGPLPSSSGSSSSSSQLSVATLGRSPSPKSALLTQNGTGSLPRNLAATLQDIETKRQLALQQKGQQVIEEQRRRLAELKQKAAAEAQCQWDALHGAAPFPAGPSGFPPLMHHSILHHLPAGRERGEEGEHAYDTLSLESSDSMETSISTGGNSACSPDNMSSASGLDMGKIEEMEKMLKEAHAEKNRLMESREREMELRRQALEEERRRREQVERRLQSESARRQQLVEKEVKMREKQFSQARPLTRYLPIRKEDFDLKTHIESSGHGVDTCLHVVLSSKVCRGYLVKMGGKIKSWKKRWFVFDRLKRTLSYYVDKHETKLKGVIYFQAIEEVYYDHLRSAAKSPNPALTFCVKTHDRLYYMVAPSAEAMRIWMDVIVTGAEGYTQFMN

SEQ ID NO: 914372 - protein, 1097 aa, Homo sapiens
PCGNACTIDGLPVRQPTRLTQGCMLCLGQSTFLRFNHPAEAKWMKSMIPAGGRAPGPPYSPVPAESESLVNGNHTPQTATRGPSACASHSSLVSSIEKDLQEIMDSLVLEEPGAAGKKPAATSPLSPMANGGRYLLSPPTSPGAMSVGSSYENTSPAFSPLSSPASSGSCASHSPSGQEPGPSVPPLVPARSSSYHLALQPPQSRPSGARSESPRLSRKGGHERPPSPGLRGLLTDSPAATVLAEARRATESPRLGGQLPVVAISLSEYPASGALSQPTSIPGSPKFQPPVPAPRNKIGTLQDRPPSPFREPPGSERVLTTSPSRQLVGRTFSDGLATRTLQPPESPRLGRRGLDSMRELPPLSPSLSRRALSPLPTRTTPDPKLNREVAESPRPRRWAAHGASPEDFSLTLGARGRRTRSPSPTLGESLAPHKGSFSGRLSPAYSLGSLTGASPCQSPCVQRKLSSGDLRVPVTRERKNSITEISDNEDDLLEYHRRQRQERLREQEMERLERQRLETILNLCAEYSRADGGPEAGELPSIGEATAALALAGRRPSRGLAGASGRSSEEPGVATQRLWESMERSDEENLKEECSSTESTQQEHEDAPSTKLQGEVLALEEERAQVLGHVEQLKVRVKELEQQLQESAREAEMERALLQGEREAERALLQKEQKAVDQLQEKLVALETGIQKERDKEAEALETETKLFEDLEFQQLERESRVEEERELAGQGLLRSKAELLRSIAKRKERLAILDSQAGQIRAQAVQEIRTPGPGQECLLTAAAKGEGEADCAGKEIPLTHRGQAFPEDHIDPQRALMHHSILHHLPAGRERGEEGEHAYDTLSLESSDSMETSISTGGNSACSPDNMSSASGLDMGKIEEMEKMLKEAHAEKNRLMESREREMELRRQALEEERRRREQVERRLQSESARRQQLVEKEVKMREKQFSQARPLTRYLPIRKEDFDLKTHIESSGHGVDTCLHVVLSSKVCRGYLVKMGGKIKSWKKRWFVFDRLKRTLSYYVDKHETKLKGVIYFQAIEEVYYDHLRSAAKSPNPALTFCVKTHDRLYYMVAPSAEAMRIWMDVIVTGAEGYTQFMN

SEQ ID NO: 914373 - protein, 1194 aa, Homo sapiens
PCGNACTIDGLPVRQPTRLTQGCMLCLGQSTFLRFNHPAEAKWMKSMIPAGGRAPGPPYSPVPAESESLVNGNHTPQTATRGPSACASHSSLVSSIEKDLQEIMDSLVLEEPGAAGKKPAATSPLSPMANGGRYLLSPPTSPGAMSVGSSYENTSPAFSPLSSPASSGSCASHSPSGQEPGPSVPPLVPARSSSYHLALQPPQSRPSGARSESPRLSRKGGHERPPSPGLRGLLTDSPAATVLAEARRATESPRLGGQLPVVAISLSEYPASGALSQPTSIPGSPKFQPPVPAPRNKIGTLQDRPPSPFREPPGSERVLTTSPSRQLVGRTFSDGLATRTLQPPESPRLGRRGLDSMRELPPLSPSLSRRALSPLPTRTTPDPKLNREVAESPRPRRWAAHGASPEDFSLTLGARGRRTRSPSPTLGESLAPHKGSFSGRLSPAYSLGSLTGASPCQSPCVQRKLSSGDLRVPVTRERKNSITEISDNEDDLLEYHRRQRQERLREQEMERLERQRLETILNLCAEYSRADGGPEAGELPSIGEATAALALAGRRPSRGLAGASGRSSEEPGVATQRLWESMERSDEENLKEECSSTESTQQEHEDAPSTKLQGEVLALEEERAQVLGHVEQLKVRVKELEQQLQESAREAEMERALLQGEREAERALLQKEQKAVDQLQEKLVALETGIQKERDKEAEALETETKLFEDLEFQQLERESRVEEERELAGQGLLRSKAELLRSIAKRKERLAILDSQAGQIRAQAVQESERLARDKNASLQLLQKEKEKLTVLERRYHSLTGGRPFPKTTSTLKEVYRSKMDGEATSPLPRTRSGPLPSSSGSSSSSSQLSVATLGRSPSPKSALLTQNGTGSLPRNLAATLQDIETKRQLALQQKGQQVIEEQRRRLAELKQKAAAEAQCQWDALHGAAPFPAGPSGFPPLMHHSILHHLPAGRERGEEGEHAYDTLSLESSDSMETSISTGGNSACSPDNMSSASGLDMGKIEEMEKMLKEAHAEKNRLMESREREMELRRQALEEERRRREQVERRLQSESARRQQLVEKEVKMREKQFSQARPLTRYLPIRKEDFDLKTHIESSGHGVDTCLHVVLSSKVCRGYLVKMGGKIKSWKKRWFVFDRLKRTLSYYVDKHETKLKGVIYFQAIEEVYTWWPHLQRPCVSGWMSLSQGLRATLSS

SEQ ID NO: 914374 - protein, 1222 aa, Homo sapiens; identical to SEQ ID NO: 914359

SEQ ID NO: 914375 - protein, 1222 aa, Homo sapiens; identical to SEQ ID NO: 914359

SEQ ID NO: 914376 - protein, 1222 aa, Homo sapiens; identical to SEQ ID NO: 914359

SEQ ID NO: 914377 - protein, 1062 aa, Homo sapiens
PCGNACTIDGLPVRQPTRLTQGCMLCLGQSTFLRFNHPAEAKWMKSMIPAGGRAPGPPYSPVPAESESLVNGNHTPQTATRGPSACASHSSLVSSIEKDLQEIMDSLVLEEPGAAGKKPAATSPLSPMANGGRYLLSPPTSPGAMSVGSSYENTSPAFSPLSSPASSGSCASHSPSGQEPGPSVPPLVPARSSSYHLALQPPQSRPSGARSESPRLSRKGGHERPPSPGLRGLLTDSPAATVLAEARRATESPRLGGQLPVVAISLSEYPASGALSQPTSIPGSPKFQPPVPAPRNKIGTLQDRPPSPFREPPGSERVLTTSPSRQLVGRTFSDGLATRTLQPPESPRLGRRGLDSMRELPPLSPSLSRRALSPLPTRTTPDPKLNREVAESPRPRRWAAHGASPEDFSLTLGARGRRTRSPSPTLGESLAPHKGSFSGRLSPAYSLGSLTGASPCQSPCVQRKLSSGDLRVPVTRERKNSITEISDNEDDLLEYHRRQRQERLREQEMERLERQRLETILNLCAEYSRADGGPEAGELPSIGEATAALALAGRRPSRGLAGASGRSSEEPGVATQRLWESMERSDEENLKEECSSTESTQQEHEDAPSTKLQGEVLALEEERAQVLGHVEQLKVRVKELEQQLQESAREAEMERALLQGEREAERALLQKEQKAVDQLQEKLVALETGIQKERDKEAEALETETKLFEDLEFQQLERESRVEEERELAGQGLLRSKAELLRSIAKRKERLAILDSQAGQIRAQAVQESERLARDKNASLQLLQKEKEKLTVLERRYHSLTGGRPFPKTTSTLKEVYRSKMDGEATSPLPRTRSGPLPSSSGSSSSSSQLSVATLGRSPSPKSALLTQNGTGSLPRNLAATLQDIETKRQLALQQKGQQVIEEQRRRLAELKQKAAAEAQCQWDALHGAAPFPAGPSGFPPLMHHSILHHLPAGRERGEEGEHAYDTLSLESSDSMETSISTGGNSACSPDNMSSASGLDMGKIEEMEKMLKEAHAEKNRLMESREREMELRRQAEALRWKSENEQGTPYILQQMDGIQVGI

SEQ ID NO: 914378 - protein, 959 aa, Homo sapiens
PCGNACTIDGLPVRQPTRLTQGCMLCLGQSTFLRFNHPAEAKWMKSMIPAGGRAPGPPYSPVPAESESLVNGNHTPQTATRGPSACASHSSLVSSIEKDLQEIMDSLVLEEPGAAGKKPAATSPLSPMANGGRYLLSPPTSPGAMSVGSSYENTSPAFSPLSSPASSGSCASHSPSGQEPGPSVPPLVPARSSSYHLALQPPQSRPSGARSESPRLSRKGGHERPPSPGLRGLLTDSPAATVLAEARRATESPRLGGQLPVVAISLSEYPASGALSQPTSIPGSPKFQPPVPAPRNKIGTLQDRPPSPFREPPGSERVLTTSPSRQLVGRTFSDGLATRTLQPPESPRLGRRGLDSMRELPPLSPSLSRRALSPLPTRTTPDPKLNREVAESPRPRRWAAHGASPEDFSLTLGARGRRTRSPSPTLGESLAPHKGSFSGRLSPAYSLGSLTGASPCQSPCVQRKLSSGDLRVPVTRERKNSITEISDNEDDLLEYHRRQRQERLREQEMERLERQRLETILNLCAEYSRADGGPEAGELPSIGEATAALALAGRRPSRGLAGASGRSSEEPGVATQRLWESMERSDEENLKEECSSTESTQQEHEDAPSTKLQGEVLALEEERAQVLGHVEQLKVRVKELEQQLQESAREAEMERALLQGEREAERALLQKEQKAVDQLQEKLVALETGIQKERDKEAEALETETKLFEDLEFQQLERESRVEEERELAGQGLLRSKAELLRSIAKRKERLAILDSQAGQIRAQAVQESERLARDKNASLQLLQKEKEKLTVLERRYHSLTGGRPFPKTTSTLKEVYRSKMDGEATSPLPRTRSGPLPSSSGSSSSSSQLSVATLGRSPSPKSALLTQNGTGSLPRNLAATLQDIETKRQLALQQKGQQVIEEQRRRLAELKQKAAAEAQCQWDALHGAAPFPAGPSGFPPLMHHSILHHLLPCSPSQH

SEQ ID NO: 914379 - protein, 558 aa, Homo sapiens
PCGNACTIDGLPVRQPTRLTQGCMLCLGQSTFLRFNHPAEAKWMKSMIPAGGRAPGPPYSPVPAESESLVNGNHTPQTATRGPSACASHSSLVSSIEKDLQEIMDSLVLEEPGAAGKKPAATSPLSPMANGGRYLLSPPTSPGAMSVGSSYENTSPAFSPLSSPASSGSCASHSPSGQEPGPSVPPLVPARSSSYHLALQPPQSRPSGARSESPRLSRKGGHERPPSPGLRGLLTDSPAATVLAEARRATESPRLGGQLPVVAISLSEYPASGALSQPTSIPGSPKFQPPVPAPRNKIGTLQDRPPSPFREPPGSERVLTTSPSRQLVGRTFSDGLATRTLQPPESPRLGRRGLDSMRELPPLSPSLSRRALSPLPTRTTPDPKLNREVAESPRPRRWAAHGASPEDFSLTLGARGRRTRSPSPTLGESLAPHKGSFSGRLSPAYSLGSLTGASPCQSPCVQRKLSSGDLRVPVTRERKNSITEISDNEDDLLEYHRRQRQERLREQEMERLVSGCQGGLPLSMAESLPGLEQASWQSRRGPQTGLRLLKVPHLQDTL

SEQ ID NO: 914380 - protein, 95 aa, Homo sapiens
PDGEAAAPCCRLRAVVPGADGRAGDWPRCSLPSLFSPASARQSFPSAAGNPSFTARPPQPLHLSTLIPPANPSATQYHLEWRRQPSQGNEGTSGP

SEQ ID NO: 914381 - protein, 94 aa, Homo sapiens
CGLVFQAQSGIASTTQPPLSLSLKEAEALETETKLFEDLEFQQLERESRVEEERELAGQGLLRSKAELLRSIAKRKVCPTSFPAACCWRPVTWV

SEQ ID NO: 914382 - protein, 103 aa, Homo sapiens [sequence omitted]

SEQ ID NO: 914383 - protein, 76 aa, Homo sapiens
ETSRRDCKLPFPKWREGLKTKKARTQTAGLKPRRIRERNTSASVAPDGSEKMDVEDENLSDYFELMFVAMEMLPIC

SEQ ID NO: 914384 - protein, 103 aa, Homo sapiens [sequence omitted]

SEQ ID NO: 914385 - protein, 764 aa, Homo sapiens
MERQQRAGSKTAGPPCQWSRMASEGTNIPSPVVRQIDKQFLICSICLERYKNPKVLPCLHTFCERCLQNYIPAHSLTLSCPVCRQTSILPEKGVAALQNNFFITNLMDVLQRTPGSNAEESSILETVTAVAAGKPLSCPNHDGNVMEFYCQSCETAMCRECTEGEHAEHPTVPLKDVVEQHKASLQVQLDAVNKRLPEIDSALQFISEIIHQLTNQKASIVDDIHSTFDELQKTLNVRKSVLLMELEVNYGLKHKVLQSQLDTLLQGQESIKSCSNFTAQALNHGTETEVLLVKKQMSEKLNELADQDFPLHPRENDQLDFIVETEGLKKSIHNLGTILTTNAVASETVATGEGLRQTIIGQPMSVTITTKDKDGELCKTGNAYLTAELSTPDGSVADGEILDNKNGTYEFLYTVQKEGDFTLSLRLYDQHIRGSPFKLKVIRSADVSPTTEGVKRRVKSPGSGHVKQKAVKRPASMYSTGKRKENPIEDDLIFRVGTKGRNKGEFTNLQGVAASTNGKILIADSNNQCVQIFSNDGQFKSRFGIRGRSPGQLQRPTGVAVHPSGDIIIADYDNKWVSIFSSDGKFKTKIGSGKLMGPKGVSVDRNGHIIVVDNKACCVFIFQPNGKIVTRFGSRGNGDRQFAGPHFAAVNSNNEIIITDFHNHSVKVFNQEGEFMLKFGSNGEGNGQFNAPTGVAVDSNGNIIVADWGNSRIQVFDGSGSFLSYINTSADPLYGPQGLALTSDGHVVVADSGNHCFKVYRYLQ

SEQ ID NO: 914386 - protein, 154 aa, Homo sapiens
MQQRAGSKTAGPPCQWSRMASEGTNIPSPVVRQIDKQFLICSICLERYKNPKVLPCLHTFCERCLQNYIPAHSLTLSCPVCRQTSILPEKGVAALQNNFFITNLMDVLQRTPGSNAEESSILETVTAVAAGKPLSCPNHDGNVSGWDGRYCPGA

SEQ ID NO: 914387 - protein, 744 aa, Homo sapiens
MASEGTNIPSPVVRQIDKQFLICSICLERYKNPKVLPCLHTFCERCLQNYIPAHSLTLSCPVCRQTSILPEKGVAALQNNFFITNLMDVLQRTPGSNAEESSILETVTAVAAGKPLSCPNHDGNVMEFYCQSCETAMCRECTEGEHAEHPTVPLKDVVEQHKASLQVQLDAVNKRLPEIDSALQFISEIIHQLTNQKASIVDDIHSTFDELQKTLNVRKSVLLMELEVNYGLKHKVLQSQLDTLLQGQESIKSCSNFTAQALNHGTETEVLLVKKQMSEKLNELADQDFPLHPRENDQLDFIVETEGLKKSIHNLGTILTTNAVASETVATGEGLRQTIIGQPMSVTITTKDKDGELCKTGNAYLTAELSTPDGSVADGEILDNKNGTYEFLYTVQKEGDFTLSLRLYDQHIRGSPFKLKVIRSADVSPTTEGVKRRVKSPGSGHVKQKAVKRPASMYSTGKRKENPIEDDLIFRVGTKGRNKGEFTNLQGVAASTNGKILIADSNNQCVQIFSNDGQFKSRFGIRGRSPGQLQRPTGVAVHPSGDIIIADYDNKWVSIFSSDGKFKTKIGSGKLMGPKGVSVDRNGHIIVVDNKACCVFIFQPNGKIVTRFGSRGNGDRQFAGPHFAAVNSNNEIIITDFHNHSVKVFNQEGEFMLKFGSNGEGNGQFNAPTGVAVDSNGNIIVADWGNSRIQVFDGSGSFLSYINTSADPLYGPQGLALTSDGHVVVADSGNHCFKVYRYLQ

SEQ ID NO: 914388 - protein, 744 aa, Homo sapiens; identical to SEQ ID NO: 914387

SEQ ID NO: 914389 - protein, 633 aa, Homo sapiens
MAQNQELFLCHPQVMEFYCQSCETAMCRECTEGEHAEHPTVPLKDVVEQHKASLQVQLDAVNKRLPEIDSALQFISEIIHQLTNQKASIVDDIHSTFDELQKTLNVRKSVLLMELEVNYGLKHKVLQSQLDTLLQGQESIKSCSNFTAQALNHGTETEVLLVKKQMSEKLNELADQDFPLHPRENDQLDFIVETEGLKKSIHNLGTILTTNAVASETVATGEGLRQTIIGQPMSVTITTKDKDGELCKTGNAYLTAELSTPDGSVADGEILDNKNGTYEFLYTVQKEGDFTLSLRLYDQHIRGSPFKLKVIRSADVSPTTEGVKRRVKSPGSGHVKQKAVKRPASMYSTGKRKENPIEDDLIFRVGTKGRNKGEFTNLQGVAASTNGKILIADSNNQCVQIFSNDGQFKSRFGIRGRSPGQLQRPTGVAVHPSGDIIIADYDNKWVSIFSSDGKFKTKIGSGKLMGPKGVSVDRNGHIIVVDNKACCVFIFQPNGKIVTRFGSRGNGDRQFAGPHFAAVNSNNEIIITDFHNHSVKVFNQEGEFMLKFGSNGEGNGQFNAPTGVAVDSNGNIIVADWGNSRIQVFDGSGSFLSYINTSADPLYGPQGLALTSDGHVVVADSGNHCFKVYRYLQ

SEQ ID NO: 914390 - protein, 653 aa, Homo sapiens
MERQQRAGSKTAGPPCQWSRMASEGTNIPSPVVRQIDKQFLICSICLERYKNPKVLPCLHTFCERCLQNYIPAHSLTLSCPVCRQTSILPEKGVAALQNNFFITNLMDVLQRTPGSNAEESSILETVTAVAAGKPLSCPNHDGNVLQSQLDTLLQGQESIKSCSNFTAQALNHGTETEVLLVKKQMSEKLNELADQDFPLHPRENDQLDFIVETEGLKKSIHNLGTILTTNAVASETVATGEGLRQTIIGQPMSVTITTKDKDGELCKTGNAYLTAELSTPDGSVADGEILDNKNGTYEFLYTVQKEGDFTLSLRLYDQHIRGSPFKLKVIRSADVSPTTEGVKRRVKSPGSGHVKQKAVKRPASMYSTGKRKENPIEDDLIFRVGTKGRNKGEFTNLQGVAASTNGKILIADSNNQCVQIFSNDGQFKSRFGIRGRSPGQLQRPTGVAVHPSGDIIIADYDNKWVSIFSSDGKFKTKIGSGKLMGPKGVSVDRNGHIIVVDNKACCVFIFQPNGKIVTRFGSRGNGDRQFAGPHFAAVNSNNEIIITDFHNHSVKVFNQEGEFMLKFGSNGEGNGQFNAPTGVAVDSNGNIIVADWGNSRIQVFDGSGSFLSYINTSADPLYGPQGLALTSDGHVVVADSGNHCFKVYRYLQ

SEQ ID NO: 914391 - protein, 744 aa, Homo sapiens; identical to SEQ ID NO: 914387

SEQ ID NO: 914392 - protein, 744 aa, Homo sapiens; identical to SEQ ID NO: 914387

SEQ ID NO: 914393 - protein, 744 aa, Homo sapiens; identical to SEQ ID NO: 914387

SEQ ID NO: 914394 - protein, 136 aa, Homo sapiens
MASEGTNIPSPVVRQIDKQFLICSICLERYKNPKVLPCLHTFCERCLQNYIPAHSLTLSCPVCRQTSILPEKGVAALQNNFFITNLMDVLQRTPGSNAEESSILETVTAVAAGKPLSCPNHDGNVSGWDGRYCPGA

SEQ ID NO: 914395 - protein, 154 aa, Homo sapiens; identical to SEQ ID NO: 914386

SEQ ID NO: 914396 - protein, 302 aa, Homo sapiens
MERQQRAGSKTAGPPCQWSRMASEGTNIPSPVVRQIDKQFLICSICLERYKNPKVLPCLHTFCERCLQNYIPAHSLTLSCPVCRQTSILPEKGVAALQNNFFITNLMDVLQRTPGSNAEESSILETVTAVAAGKPLSCPNHDGNVMEFYCQSCETAMCRECTEGEHAEHPTVPLKDVVEQHKASLQVQLDAVNKRLPEIDSALQFISEIIHQLTNQKASIVDDIHSTFDELQKTLNVRKSVLLMELEVNYGLKHKVLQSQLDTLLQGQESIKSCSVPQLERCSAVVRAVSSRPFCILSTLIS

SEQ ID NO: 914397 - protein, 111 aa, Homo sapiens
MASEGTNIPSPVVRQIDKQFLICSICLERYVHQRLQIETELHVEKSVIKKDFYQQTDYLLTFFDQNYLNNEINLHCVSFTHIVGIPKDSKPVAICKLTYINICVINLWIRI

SEQ ID NO: 914398 - protein, 107 aa, Homo sapiens
VLDYPSEKSAEPGDAMCLQNYIPAHSLTLSCPVCRQTSILPEKGVAALQNNFFITNLMDVLQRTPGSNAEESSILETVTAVAAGKPLSCPNHDGNVSGWDGRYCPGA

SEQ ID NO: 914399 - protein, 144 aa, Homo sapiens
YHIWLDDTKDKDGELCKTGNAYLTAELSTPDGSVADGEILDNKNGTYEFLYTVQKEGDFTLSLRLYDQHIRGSPFKLKVIRSADVSPTTEGVKRRVKSPGSGHVKQKAVKRPASMYSTGKRKENPIEDDLIFRVGKERASVPDA

SEQ ID NO: 914400 - protein, 762 aa, Homo sapiens
MQQRAGSKTAGPPCQWSRMASEGTNIPSPVVRQIDKQFLICSICLERYKNPKVLPCLHTFCERCLQNYIPAHSLTLSCPVCRQTSILPEKGVAALQNNFFITNLMDVLQRTPGSNAEESSILETVTAVAAGKPLSCPNHDGNVMEFYCQSCETAMCRECTEGEHAEHPTVPLKDVVEQHKASLQVQLDAVNKRLPEIDSALQFISEIIHQLTNQKASIVDDIHSTFDELQKTLNVRKSVLLMELEVNYGLKHKVLQSQLDTLLQGQESIKSCSNFTAQALNHGTETEVLLVKKQMSEKLNELADQDFPLHPRENDQLDFIVETEGLKKSIHNLGTILTTNAVASETVATGEGLRQTIIGQPMSVTITTKDKDGELCKTGNAYLTAELSTPDGSVADGEILDNKNGTYEFLYTVQKEGDFTLSLRLYDQHIRGSPFKLKVIRSADVSPTTEGVKRRVKSPGSGHVKQKAVKRPASMYSTGKRKENPIEDDLIFRVGTKGRNKGEFTNLQGVAASTNGKILIADSNNQCVQIFSNDGQFKSRFGIRGRSPGQLQRPTGVAVHPSGDIIIADYDNKWVSIFSSDGKFKTKIGSGKLMGPKGVSVDRNGHIIVVDNKACCVFIFQPNGKIVTRFGSRGNGDRQFAGPHFAAVNSNNEIIITDFHNHSVKVFNQEGEFMLKFGSNGEGNGQFNAPTGVAVDSNGNIIVADWGNSRIQVFDGSGSFLSYINTSADPLYGPQGLALTSDGHVVVADSGNHCFKVYRYLQ

SEQ ID NO: 914401 - protein, 744 aa, Homo sapiens; identical to SEQ ID NO: 914387

SEQ ID NO: 914402 - protein, 394 aa, Homo sapiens
MASEGTNIPSPVVRQIDKQFLICSICLERYILDNKNGTYEFLYTVQKEGDFTLSLRLYDQHIRGSPFKLKVIRSADVSPTTEGVKRRVKSPGSGHVKQKAVKRPASMYSTGKRKENPIEDDLIFRVGTKGRNKGEFTNLQGVAASTNGKILIADSNNQCVQIFSNDGQFKSRFGIRGRSPGQLQRPTGVAVHPSGDIIIADYDNKWVSIFSSDGKFKTKIGSGKLMGPKGVSVDRNGHIIVVDNKACCVFIFQPNGKIVTRFGSRGNGDRQFAGPHFAAVNSNNEIIITDFHNHSVKVFNQEGEFMLKFGSNGEGNGQFNAPTGVAVDSNGNIIVADWGNSRIQVFDGSGSFLSYINTSADPLYGPQGLALTSDGHVVVADSGNHCFKVYRYLQ

SEQ ID NO: 914403 - protein, 744 aa, Homo sapiens; identical to SEQ ID NO: 914387

SEQ ID NO: 914404 - protein, 756 aa, Homo sapiens
MERQQRAGSKTAGPPCQWSRMASEGTNIPSPVVRQIDKQFLICSICLERYKNPKVLPCLHTFCERCLQNYIPAHSLTLSCPVCRQTSILPEKGVAALQNNFFITNLMDVLQRTPGSNAEESSILETVTAVAAGKPLSCPNHDGNVMEFYCQSCETAMCRECTEGEHAEHPTVPLKDVVEQHKASLQVQLDAVNKRLPEIDSALQFISEIIHQLTNQKASIVDDIHSTFDELQKTLNVRKSVLLMELEVNYGLKHKVLQSQLDTLLQGQESIKSCSNFTAQALNHGTETEVLLVKKQMSEKLNELADQDFPLHPRENDQLDFIVETEGLKKSIHNLGTILTTNAVASETVATGEGLRQTIIGQPMSVTITTKDKDGELCKTGNAYLTAELSTPDGSVADGEILDNKNGTYEFLYTVQKEGDFTLSLRLYDQHIRGSPFKLKVIRSADVSPTTEGVKRRVKSPGSGHVKQKAVKRPASMYSTGKRKENPIEDDLIFRVGTKGRNKGEFTNLQGVAASTNGKILIADSNNQCVQIFSNDGQFKSRFGIRGRSPGQLQRPTGVAVHPSGDIIIADYDNKWVSIFSSDGKFKTKIGSGKLMGPKGVSVDRNGHIIVVDNKACCVFIFQPNGKIVTRFGSRGNGDRQFAGPHFAAVNSNNEIIITDFHNHSVKVFNQEGEFMLKFGSNGEGNGQFNAPTGVAVDSNGNIIVADWGNSRIQVFDGSGSFLSYINTSADPLYGPQGLALTSDGHVVVADSGNHY

SEQ ID NO: 914405 - protein, 701 aa, Homo sapiens
MERQQRAGSKTAGPPCQWSRMASEGTNIPSPVVRQIDKQFLICSICLERYKNPKVLPCLHTFCERCLQNYIPAHSLTLSCPVCRQTSILPEKGVAALQNNFFITNLMDVLQRTPGSNAEESSILETVTAVAAGKPLSCPNHDGNVMEFYCQSCETAMCRECTEGEHAEHPTVPLKDVVEQHKASLQVQLDAVNKRLPEIDSALQFISEIIHQLTNQKASIVDDIHSTFDELQKTLNVRKSVLLMELEVNYGLKHKVLQSQLDTLLQGQESIKSCSNFTAQALNHGTETEVLLVKKQMSEKLNELADQDFPLHPRENDQLDFIVETEGLKKSIHNLGTILTTNAVASETVATGEGLRQTIIGQPMSVTITTKDKDGELCKTGNAYLTAELSTPDGSVADGEILDNKNGTYEFLYTVQKEGDFTLSLRLYDQHIRGSPFKLKVIRSADVSPTTEGVKRRVKSPGSGHVKQKAVKRPASMYSTGKRKENPIEDDLIFRVGTKGRNKGEFTNLQGVAASTNGKILIADSNNQCVQIFSNDGQFKSRFGIRGRSPGQLQRPTGVAVHPSGDIIIADYDNKWVSIFSSDGKFKTKIGSGKLMGPKGVSVDRNGHIIVVDNKACCVFIFQPNGKIVTRFGSRGNGDRQFAGPHFAAVNSNNEIIITDFHNHSVKVLQAHELLLTFNCFYGEIGLRENNAILTYGTKGS

SEQ ID NO: 914406 - protein, 445 aa, Homo sapiens
MERQQRAGSKTAGPPCQWSRMASEGTNIPSPVVRQIDKQFLICSICLERYKNPKVLPCLHTFCERCLQNYIPAHSLTLSCPVCRQTSILPEKGVAALQNNFFITNLMDVLQRTPGSNAEESSILETVTAVAAGKPLSCPNHDGNVMEFYCQSCETAMCRECTEGEHAEHPTVPLKDVVEQHKASLQVQLDAVNKRLPEIDSALQFISEIIHQLTNQKASIVDDIHSTFDELQKTLNVRKSVLLMELEVNYGLKHKVLQSQLDTLLQGQESIKSCSNFTAQALNHGTETEVLLVKKQMSEKLNELADQDFPLHPRENDQLDFIVETEGLKKSIHNLGTILTTNAVASETVATGEGLHCMQRAGSKTAGPPCQWSRMASEGTNIPSPVVRQIDKQFLICSICLERYKNPKVLPCLHTFCERCLQNYIPAHSLTLSCPASCRLVPARG

SEQ ID NO: 914407 - protein, 320 aa, Homo sapiens
QGVVRQWHAQQRAAASRPVPRSQLQPPPPRSRRLSCSLCGSVLSGTWAPVAPSKPFRPPQCPPPSPARPSPAKMVDREQLVQKARLAEQAERYDDMAAAMKNVTELNEPLSNEERNLLSVAYKNVVGARRSSWRVISSIEQKTSADGNEKKIEMVRAYREKIEKELEAVCQDVLSLLDNYLIKNCSETQYESKVFYLKMKGDYYRYLAEVATGEKRATVVESSEKAYSEAHEISKEHMQPTHPIRLGLALNYSVFYYEIQNAPEQACHLAKTAFDDAIAELDTLNEDSYKDSTLIMQLLRDNLTLWTSDQQDDDGGEGNN

SEQ ID NO: 914408 - protein, 320 aa, Homo sapiens; identical to SEQ ID NO: 914407

SEQ ID NO: 914409 - protein, 320 aa, Homo sapiens; identical to SEQ ID NO: 914407

SEQ ID NO: 914410 - protein, 320 aa, Homo sapiens; identical to SEQ ID NO: 914407

SEQ ID NO: 914411 - protein, 320 aa, Homo sapiens; identical to SEQ ID NO: 914407

SEQ ID NO: 914412 - protein, 320 aa, Homo sapiens; identical to SEQ ID NO: 914407

SEQ ID NO: 914413 - protein, 320 aa, Homo sapiens; identical to SEQ ID NO: 914407

SEQ ID NO: 914414 - protein, 320 aa, Homo sapiens; identical to SEQ ID NO: 914407

SEQ ID NO: 914415 - protein, 320 aa, Homo sapiens; identical to SEQ ID NO: 914407

SEQ ID NO: 914416 - protein, 106 aa, Homo sapiens
RGLSVSGTHSSRSRLAPGPAVAAPAASSAQPPPQLLALWVGPLRHLGSSRALQALQAAPVSSSFSGQTQPREDGGPRATGAESPAGRAGGALRRHGRGHEERDRAE

SEQ ID NO: 914417 - protein, 320 aa, Homo sapiens; identical to SEQ ID NO: 914407

SEQ ID NO: 914418 - protein, 320 aa, Homo sapiens; identical to SEQ ID NO: 914407

SEQ ID NO: 914419 - protein, 320 aa, Homo sapiens; identical to SEQ ID NO: 914407

SEQ ID NO: 914420 - protein, 320 aa, Homo sapiens; identical to SEQ ID NO: 914407

SEQ ID NO: 914421 - protein, 320 aa, Homo sapiens; identical to SEQ ID NO: 914407

SEQ ID NO: 914422 - protein, 320 aa, Homo sapiens; identical to SEQ ID NO: 914407

SEQ ID NO: 914423 - protein, 246 aa, Homo sapiens
AGGCPSVARTAAAAASRPVPRSQLQPPPPRSRRLSCSLCGSVLSGTWAPVAPSKPFRPPQCPPPSPARPSPAKMVDREQLVQKARLAEQAERYDDMAAAMKNVTELNEPLSNEERNLLSVAYKNVVGARRSSWRVISSIEQKTSADGNEKKIEMVRAYREKIEKELEAVCQDVLSLLDNYLIKNCSETQYESKVFYLKMKGDYYRYLAEVATGEKRATVVESSEKAYSEAHEISKEHMQPTPGLEV

SEQ ID NO: 914424 - protein, 497 aa, Homo sapiens
MSQDGASQFQEVIRQELELSVKKELEKILTTASSHEFEHTKKDLDGFRKLFHRFLQEKGPSVDWGKIQRPPEDSIQPYEKIKARGLPDNISSVLNKLVVVKLNGGLGTSMGCKGPKSLIGVRNENTFLDLTVQQIEHLNKTYNTDVPLVLMNSFNTDEDTKKILQKYNHCRVKIYTFNQSRYPRINKESLLPVAKDVSYSGENTEAWYPPGHGDIYASFYNSGLLDTFIGEGKEYIFVSNIDNLGATVDLYILNHLMNPPNGKRCEFVMEVTNKTRADVKGGTLTQYEGKLRLVEIAQVPKAHVDEFKSVSKFKIFNTNNLWISLAAVKRLQEQNAIDMEIIVNAKTLDGGLNVIQLETAVGAAIKSFENSLGINVPRSRFLPVKTTSDLLLVMSNLYSLNAGSLTMSEKREFPTVPLVKLGSSFTKVQDYLRRFESIPDMLELDHLTVSGDVTFGKNVSLKGTVIIIANHGDRIDIPPGAVLENKIVSGNLRILDH

SEQ ID NO: 914425 - protein, 250 aa, Homo sapiens
MVSTQSAHYGRAPNGKRCEFVMEVTNKTRADVKGGTLTQYEGKLRLVEIAQVPKAHVDEFKSVSKFKIFNTNNLWISLAAVKRLQEQNAIDMEIIVNAKTLDGGLNVIQLETAVGAAIKSFENSLGINVPRSRFLPVKTTSDLLLVMSNLYSLNAGSLTMSEKREFPTVPLVKLGSSFTKVQDYLRRFESIPDMLELDHLTVSGDVTFGKNVSLKGTVIIIANHGDRIDIPPGAVLENKIVSGNLRILDH

SEQ ID NO: 914426 - protein, 497 aa, Homo sapiens; identical to SEQ ID NO: 914424

SEQ ID NO: 914427 - protein, 508 aa, Homo sapiens
MSRFVQDLSKAMSQDGASQFQEVIRQELELSVKKELEKILTTASSHEFEHTKKDLDGFRKLFHRFLQEKGPSVDWGKIQRPPEDSIQPYEKIKARGLPDNISSVLNKLVVVKLNGGLGTSMGCKGPKSLIGVRNENTFLDLTVQQIEHLNKTYNTDVPLVLMNSFNTDEDTKKILQKYNHCRVKIYTFNQSRYPRINKESLLPVAKDVSYSGENTEAWYPPGHGDIYASFYNSGLLDTFIGEGKEYIFVSNIDNLGATVDLYILNHLMNPPNGKRCEFVMEVTNKTRADVKGGTLTQYEGKLRLVEIAQVPKAHVDEFKSVSKFKIFNTNNLWISLAAVKRLQEQNAIDMEIIVNAKTLDGGLNVIQLETAVGAAIKSFENSLGINVPRSRFLPVKTTSDLLLVMSNLYSLNAGSLTMSEKREFPTVPLVKLGSSFTKVQDYLRRFESIPDMLELDHLTVSGDVTFGKNVSLKGTVIIIANHGDRIDIPPGAVLENKIVSGNLRILDH

SEQ ID NO: 914428 - protein, 508 aa, Homo sapiens; identical to SEQ ID NO: 914427

SEQ ID NO: 914429 - protein, 497 aa, Homo sapiens; identical to SEQ ID NO: 914424

SEQ ID NO: 914430 - protein, 104 aa, Homo sapiens [sequence omitted]

SEQ ID NO: 914431 - protein, 508 aa, Homo sapiens; identical to SEQ ID NO: 914427

SEQ ID NO: 914432 - protein, 106 aa, Homo sapiens [sequence omitted]

SEQ ID NO: 914433 - protein, 263 aa, Homo sapiens
MEANGSQGTSGSANDSQHDPGKMFIGGLSWQTSPDSLRDYFSKFGEIRECMVMRDPTTKRSRGFGFVTFADPASVDKVLGQPHHELDSKTIDPKVAFPRRAQPKMVTRTKKIFVGGLSANTVVEDVKQYFEQFGKVEDAMLMFDKTTNRHRGRVAIYEEQMEAKTPFLLWAGCVLLGHLGRPPKTSLKTREIGGCVKMSHLQIGFEVERPFGFSPHLEKSRSSTEDLQTQSLCTAQSLKDLLPFSGSKTHLKRGNKYSRVIHT

SEQ ID NO: 914434 - protein, 92 aa, Homo sapiens
EDTQIVRLSWQSSPDSLRDYFSKFGEIRECMVMRDPTTKRSRGFGFVTFADPASVDKVLGQPHHELDSKTIDPKVAFPRRAQPKSSLQDNLI

SEQ ID NO: 914435 - protein, 356 aa, Homo sapiens
MEANGSQGTSGSANDSQHDPGKMFIGGLSWQTSPDSLRDYFSKFGEIRECMVMRDPTTKRSRGFGFVTFADPASVDKVLGQPHHELDSKTIDPKVAFPRRAQPKMVTRTKKIFVGGLSANTVVEDVKQYFEQFGKVEDAMLMFDKTTNRHRGFGFVTFENEDVVEKVCEIHFHEINNKMVECKKAQPKEVMFPPGTRGRARGLPYTMDAFMLGMGMLGYPNFVATYGRGYPGFAPSYGYQFPASSGLWTSGSSGGGGSKRIRLQPGAARRLPGGQQPRTCRRSLRPCQPGLRSGELHKCGQPTAGLGLRPRHSWTFDCNGLYKWIPLSRCFRCHLTLRAYLDVQARLGEVSEWPFV

SEQ ID NO: 914436 - protein, 128 aa, Homo sapiens
APQNKSPCLGKGTVRLEGSLRIDWRMTSTESTLRLQPGAARRLPGGQQPRTCRRSLRPCQPGLRSGELHKCGQPTAGLGLRPRHSWTFDCNGLYKWIPLSRCFRCHLTLRAYLDVQARLGEVSEWPFV

SEQ ID NO: 914437 - protein, 263 aa, Homo sapiens
MEANGSQGTSGSANDSQHDPGKMFIGGLSWQTSPDSLRDYFSKFGEIRECMVMRDPTTKRSRGFGFVTFADPASVDKVLGQPHHELDSKTIDPKVAFPRRAQPKMVTRTKKIFVGGLSANTVVEDVKQYFEQFGKVEDAMLMFDKTTNRHRGFGFVTFENEDVVEKVCEIHFHEINNKMVECKKAQPKEVMFPPGTRGRARGLPYTMDAFMLGMGMLGYPNFVATYGRGYPGFAPSYGYQFPAQQRLMDQWQQRRWRQQEDQS

SEQ ID NO: 914438 - protein, 263 aa, Homo sapiens; identical to SEQ ID NO: 914437

SEQ ID NO: 914439 - protein, 263 aa, Homo sapiens; identical to SEQ ID NO: 914437

SEQ ID NO: 914440 - protein, 263 aa, Homo sapiens; identical to SEQ ID NO: 914437

SEQ ID NO: 914441 - protein, 263 aa, Homo sapiens; identical to SEQ ID NO: 914437

SEQ ID NO: 914442 - protein, 133 aa, Homo sapiens
EDTQIVRLSWQSSPDSLRDYFSKFGEIRECMVMRDPTTKRSRGFGFVTFADPASVDKVLGQPHHELDSKTIDPKVAFPRRAQPKVSRRINSRILALRDDCQEFQISNSIGHELLKPGIHCSFGVSGQAGQVVL

SEQ ID NO: 914443 - protein, 106 aa, Homo sapiens [sequence omitted]

SEQ ID NO: 914444 - protein, 132 aa, Homo sapiens
MTHACMLLTNTLTHTSSISTGFCASDQLSCTNASMLWQHKLCAAFHFPCTHHIIPMVECKKAQPKEVMFPPGTRGRARGLPYTMDAFMLGMGMLGYPNFVATYGRGYPGFAPSYGYQFPDYLPVSQDIIFIN

SEQ ID NO: 914445 - protein, 263 aa, Homo sapiens; identical to SEQ ID NO: 914437

SEQ ID NO: 914446 - protein, 216 aa, Homo sapiens
QNCLNPGDRCCSELRSCHCTPDWVTEHVFVSNEKKKRTQHGEDAQSPSLWAHEMTQIFPLGHPVLLLENFVPGRAEMIILVAQGLVAQVEDAMLMFDKTTNRHRGFGFVTFENEDVVEKVCEIHFHEINNKMVECKKAQPKEVMFPPGTRGRARGLPYTMDAFMLGMGMLGYPNFVATYGRGYPGFAPSYGYQFPAQQRLMDQWQQRRWRQQEDQS

SEQ ID NO: 914447 - protein, 263 aa, Homo sapiens; identical to SEQ ID NO: 914437

SEQ ID NO: 914448 - protein, 263 aa, Homo sapiens; identical to SEQ ID NO: 914437

SEQ ID NO: 914449 - protein, 263 aa, Homo sapiens; identical to SEQ ID NO: 914437

SEQ ID NO: 914450 - protein, 259 aa, Homo sapiens
MEANGSQGTSGSANDSQHDPGKMFIGGLSWQTSPDSLRDYFSKFGEIRECMVMRDPTTKRSRGFGFVTFADPASVDKVLGQPHHELDSKTIDPKVAFPRRAQPKMVTRTKKIFVGGLSANTVVEDVKQYFEQFGKVEDAMLMFDKTTNRHRGFGFVTFENEDVVEKVCEIHFHEINNKMVECKKAQPKEVMFPPGTRGRARGLPYTMDAFMLGMGMLGESGQDRRSPWTGRAMEASTPNWVTYQWGKLLHLSKPQFPCL

SEQ ID NO: 914451 - protein, 106 aa, Homo sapiens [sequence omitted]

SEQ ID NO: 914452 - protein, 162 aa, Homo sapiens
MAETVADTRRLITKPQNLNDAYGPPSNFLEIDVSNPQTVGVGRGRFTTYEIRVKTNLPIFKLKESTVRRRYSDFEWLRSELERESKVVVPPLPGKAFLRQLPFRGDDGIFDDNFIEERKQGLEQFINKVAGHPLAQNERCLHMFLQDEIIDKSYTPSKIRHA

SEQ ID NO: 914453 - protein, 162 aa, Homo sapiens; identical to SEQ ID NO: 914452

SEQ ID NO: 914454 - protein, 162 aa, Homo sapiens; identical to SEQ ID NO: 914452

SEQ ID NO: 914455 - protein, 162 aa, Homo sapiens; identical to SEQ ID NO: 914452

SEQ ID NO: 914456 - protein, 110 aa, Homo sapiens
MTPLLLTPQSAVPLPSLGRASREPGVAFQLVSRFSPGLGGGSLRGAGRSFACGVNARSTCSFSSRPLRASPVSPRRAAAAAAAAERGGGGGSPRRRQQPTDPPATSSRSM

SEQ ID NO: 914457 - protein, 120 aa, Homo sapiens
MTPLLLTPQSAVPLPSLGRASREPGVAFQLVSRFSPGLGGGSLRGAGRSFACGVNARSTCSFSSRPLRASPVSPRRAAAAAAAAERGGGGGSPRRRQQLHHLRNQGQDKSSYFQAERIYC

SEQ ID NO: 914458 - protein, 105 aa, Homo sapiens
MAETVADTRRLITKPQNLNDAYGPPSNFLEIDVSNPQTVGVGRGRFTTYEIRVKTNLPIFKLKESTVRRRYSDFEWLRSELERESKGRWSSSGTERTLSSHVFTR

SEQ ID NO: 914459 - protein, 162 aa, Homo sapiens; identical to SEQ ID NO: 914452

SEQ ID NO: 914460 - protein, 109 aa, Homo sapiens
GGGEAGSTTHLITNVTTSLDRTAFSILKESTVRRRYSDFEWLRSELERESKVVVPPLPGKAFLRQLPFRGDDGIFDDNFIEERKQGLEQFINKVAGHPLAQNERCLHMF

SEQ ID NO: 914461 - protein, 130 aa, Homo sapiens
MAETVADTRRLITKPQNLNDAYGPPSNFLEIDVSNPQTVGVGRGRFTTYEIRVKVVVPPLPGKAFLRQLPFRGDDGIFDDNFIEERKQGLEQFINKVAGHPLAQNERCLHMFLQDEIIDKSYTPSKIRHA

SEQ ID NO: 914462 - protein, 162 aa, Homo sapiens; identical to SEQ ID NO: 914452

SEQ ID NO: 914463 - protein, 162 aa, Homo sapiens; identical to SEQ ID NO: 914452

SEQ ID NO: 914464 - protein, 140 aa, Homo sapiens
MAETVADTRRLITKPQNLNDAYGPPSNFLEIDTNLPIFKLKESTVRRRYSDFEWLRSELERESKVVVPPLPGKAFLRQLPFRGDDGIFDDNFIEERKQGLEQFINKVAGHPLAQNERCLHMFLQDEIIDKSYTPSKIRHA

SEQ ID NO: 914465 - protein, 129 aa, Homo sapiens
MAETVADTRRLITKPQNLNDAYGPPSNFLEIDVSNPQTVGVGRGRFTTYEIRVKTNLPIFKLKESTVRRRYSDFEWLRSELERESKVVVPPLPGKAFLRQLPFRGDDGRSLVILWHRTNVVFTCFYKMK

SEQ ID NO: 914466 - protein, 144 aa, Homo sapiens
MAETVADTRRLITKPQNLNDAYGPPSNFLEIDVSNPQTVGVGRGRFTTYEIRVKTNLPIFKLKESTVRRRYSDFEWLRSELERESKVVVPPLPGKAFLRQLPFRGDDGIFDDNFIEERKQGLEQFINKVAGHPLAQNERCLHMF

SEQ ID NO: 914467 - protein, 128 aa, Homo sapiens
MAETVADTRRLITKPQNLNDAYGPPSNFLEIDVSNPQTVGVGRGRFTTYEIRVKTNLPIFKLKESTVRRRYSDFEWLRSELERESKVVVPPLPGKAFLRQLPFRGDDGKKMTRVIDGKQNQDWWPATV

SEQ ID NO: 914468 - protein, 548 aa, Homo sapiens
PCRGPTDTTRATTQSRARMAAALRSVMMAGYLSEWRTPTYRSTEMVQRLRMEAVQHSTSTAAVGGLVVSAQGVGVGVFLAAFILMAVAGNLLVILSVACNRHLQTVTNYFIVNLAVADLLLSATVLPFSATMEVLGFWAFGRAFCDVWAAVDVLCCTASILSLCTISVDRYVGVRHSLKYPAIMTERKAAAILALLWVVALVVSVGPLLGWKEPVPPDERFCGITEEAGYAVFSSVCSFYLPMAVIVVMYCRVYVVARSTTRSLEAGVKRERGKASEVVLRIHCRGAATGADGAHGMRSAKGHTFRSSLSVRLLKFSREKKAAKTLAIVVGVFVLCWFPFFFVLPLGSLFPQLKPSEGVFKVIFWLGYFNSCVNPLIYPCSSREFKRAFLRLLRCQCRRRRRRRPLWRVYGHHWRASTSGLRQDCAPSSGDAPPGAPLALTALPDPDPEPPGTPEMQAPVASRRKPPSAFREWRLLGPFRRPTTQLRAKVSSLSHKIRAGGAQRAEAACAQRSEVEAVSLGVPHEVAEGATCQAYELADYSNLRETDI

SEQ ID NO: 914469 - protein, 261 aa, Homo sapiens
MLARRNEQTWLCLLLCLIIRNCQYCTGFELQKQQLHVVLSNSTLVCCLHSLKVILISGRGSLFPQLKPSEGVFKVIFWLGYFNSCVNPLIYPCSSREFKRAFLRLLRCQCRRRRRRRPLWRVYGHHWRASTSGLRQDCAPSSGDAPPGAPLALTALPDPDPEPPGTPEMQAPVASRRKPPSAFREWRLLGPFRRPTTQLRAKVSSLSHKIRAGGAQRAEAACAQRSEVEAVSLGVPHEVAEGATCQAYELADYSNLRETDI

SEQ ID NO: 914470 - protein, 591 aa, Homo sapiens
PCRPLVLCPRPGHRRPRVEMTFRDLLSVSFEGPRPDSSAGGSSAGGGGGSAGGAAPSEGPAVGGVPGGAGGGGGVVGAGSGEDNRSSAGEPGSAGAGGDVNGTAAVGGLVVSAQGVGVGVFLAAFILMAVAGNLLVILSVACNRHLQTVTNYFIVNLAVADLLLSATVLPFSATMEVLGFWAFGRAFCDVWAAVDVLCCTASILSLCTISVDRYVGVRHSLKYPAIMTERKAAAILALLWVVALVVSVGPLLGWKEPVPPDERFCGITEEAGYAVFSSVCSFYLPMAVIVVMYCRVYVVARSTTRSLEAGVKRERGKASEVVLRIHCRGAATGADGAHGMRSAKGHTFRSSLSVRLLKFSREKKAAKTLAIVVGVFVLCWFPFFFVLPLGSLFPQLKPSEGVFKVIFWLGYFNSCVNPLIYPCSSREFKRAFLRLLRCQCRRRRRRRPLWRVYGHHWRASTSGLRQDCAPSSGDAPPGAPLALTALPDPDPEPPGTPEMQAPVASRRKPPSAFREWRLLGPFRRPTTQLRAKVSSLSHKIRAGGAQRAEAACAQRSEVEAVSLGVPHEVAEGATCQAYELADYSNLRETDI

SEQ ID NO: 914471 - protein, 236 aa, Homo sapiens [sequence omitted]

SEQ ID NO: 914472 - protein, 464 aa, Homo sapiens
MAVAGNLLVILSVACNRHLQTVTNYFIVNLAVADLLLSATVLPFSATMEVLGFWAFGRAFCDVWAAVDVLCCTASILSLCTISVDRYVGVRHSLKYPAIMTERKAAAILALLWVVALVVSVGPLLGWKEPVPPDERFCGITEEAGYAVFSSVCSFYLPMAVIVVMYCRVYVVARSTTRSLEAGVKRERGKASEVVLRIHCRGAATGADGAHGMRSAKGHTFRSSLSVRLLKFSREKKAAKTLAIVVGVFVLCWFPFFFVLPLGSLFPQLKPSEGVFKVIFWLGYFNSCVNPLIYPCSSREFKRAFLRLLRCQCRRRRRRRPLWRVYGHHWRASTSGLRQDCAPSSGDAPPGAPLALTALPDPDPEPPGTPEMQAPVASRRKPPSAFREWRLLGPFRRPTTQLRAKVSSLSHKIRAGGAQRAEAACAQRSEVEAVSLGVPHEVAEGATCQAYELADYSNLRETDI

SEQ ID NO: 914473 - protein, 1786 aa, Homo sapiens
MGLLQLLAFSFLALCRARVRAQEPEFSYGCAEGSCYPATGDLLIGRAQKLSVTSTCGLHKPEPYCIVSHLQEDKKCFICNSQDPYHETLNPDSHLIENVVTTFAPNRLKIWWQSENGVENVTIQLDLEAEFHFTHLIMTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFNEEVEGMVHGHCMCRHNTKGLNCELCMDFYHDLPWRPAEGRNSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALRQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECRACDCDPRGIETPQCDQSTGQCVCVEGVEGPRCDKCTRGYSGVFPDCTPCHQCFALWDVIIAELTNRTHRFLEKAKALKISGVIGPYRETVDSVERKVSEIKDILAQSPAAEPLKNIGNLFEEAEKLIKDVTEMMAQVEVKLSDTTSQSNSTAKELDSLQTEAESLDNTVKELAEQLEFIKNSDIRGALDSITKYFQMSLEAEERVNASTTEPNSTVEQSALMRDRVEDVMMERESQFKEKQEEQARLLDELAGKLQSLDLSAAAEMTCGTPPGASCSETECGGPNCRTDEGERKCGGPGCGGLVTVAHNAWQKAMDLDQDVLSALAEVEQLSKMVSEAKLRADEAKQSAEDILLKTNATKEKMDKSNEELRNLIKQIRNFLTQDSADLDSIEAVANEVLKMEMPSTPQQLQNLTEDIRERVESLSQVEVILQHSAADIARAEMLLEEAKRASKSATDVKVTADMVKEALEEAEKAQVAAEKAIKQADEDIQGTQNLLTSIESETAASEETLFNASQRISELERNVEELKRKAAQNSGEAEYIEKVVYTVKQSAEDVKKTLDGELDEKYKKVENLIAKKTEESADARRKAEMLQNEAKTLLAQANSKLQLLKDLERKYEDNQRYLEDKAQELARLEGEVRSLLKDISQKVAVYSTCL

SEQ ID NO: 914474 - protein, 217 aa, Homo sapiens
MTCGTPPGASCSETECGGPNCRTDEGERKCGGPGCGGLVTVAHNAWQKAMDLDQDVLSALAEVEQLSKMVSEAKLRADEAKQSAEDILLKTNATKEKMDKSNEELRNLIKQIRNFLTQDSADLDSIEAVANEVLKMEMPSTPQQLQNLTEDIRERVESLSQVEVILQHSAADIARAEMLLEEAKRASKVHRCKVSSRYDTGSSGRSRKHGRQQESGF

SEQ ID NO: 914475 - protein, 1475 aa, Homo sapiens
GGHEPRLLTHSSNSQTPSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALRQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECRACDCDPRGIETPQCDQSTGQCVCVEGVEGPRCDKCTRGYSGVFPDCTPCHQCFALWDVIIAELTNRTHRFLEKAKALKISGVIGPYRETVDSVERKVSEIKDILAQSPAAEPLKNIGNLFEEAEKLIKDVTEMMAQVEVKLSDTTSQSNSTAKELDSLQTEAESLDNTVKELAEQLEFIKNSDIRGALDSITKYFQMSLEAEERVNASTTEPNSTVEQSALMRDRVEDVMMERESQFKEKQEEQARLLDELAGKLQSLDLSAAAEMTCGTPPGASCSETECGGPNCRTDEGERKCGGPGCGGLVTVAHNAWQKAMDLDQDVLSALAEVEQLSKMVSEAKLRADEAKQSAEDILLKTNATKEKMDKSNEELRNLIKQIRNFLTQDSADLDSIEAVANEVLKMEMPSTPQQLQNLTEDIRERVESLSQVEVILQHSAADIARAEMLLEEAKRASKSATDVKVTADMVKEALEEAEKAQVAAEKAIKQADEDIQGTQNLLTSIESETAASEETLFNASQRISELERNVEELKRKAAQNSGEAEYIEKVVYTVKQSAEDVKKTLDGELDEKYKKVENLIAKKTEESADARRKAEMLQNEAKTLLAQANSKLQLLKDLERKYEDNQRYLEDKAQELARLEGEVRSLLKDISQKVAVYSTCL

SEQ ID NO: 914476 - protein, 1159 aa, Homo sapiens
MADDGGVHPPGQGLLGQQDGHHTLRAAVPIPRCVEGLAGALGAEHPQPQNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALRQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECRACDCDPRGIETPQCDQSTGQCVCVEGVEGPRCDKCTRGYSGVFPDCTPCHQCFALWDVIIAELTNRTHRFLEKAKALKISGVIGPYRETVDSVERKVSEIKDILAQSPAAEPLKNIGNLFEEAEKLIKDVTEMMAQVEVKLSDTTSQSNSTAKELDSLQTEAESLDNTVKELAEQLEFIKNSDIRGALDSITKYFQMSLEAEERVNASTTEPNSTVEQSALMRDRVEDVMMERESQFKEKQEEQARLLDELAGKLQSLDLSAAAEMTCGTPPGASCSETECGGPNCRTDEGERKCGGPGCGGLVTVAHNAWQKAMDLDQDVLSALAEVEQLSKMVSEAKLRADEAKQSAEDILLKTNATKEKMDKSNEELRNLIKQIRNFLTQDSADLDSIEAVANEVLKMEMPSTPQQLQNLTEDIRERVESLSQVEVILQHSAADIARAEMLLEEAKRASKSATDVKVTADMVKEALEEAEKAQVAAEKAIKQADEDIQGTQNLLTSIESETAASEETLFNASQRISELERNVEELKRKAAQNSGEAEYIEKVVYTVKQSAEDVKKTLDGELDEKYKKVENLIAKKTEESADARRKAEMLQNEAKTLLAQANSKLQLLKDLERKYEDNQRYLEDKAQELARLEGEVRSLLKDISQKVAVYSTCL

SEQ ID NO: 914477 - protein, 1786 aa, Homo sapiens; identical to SEQ ID NO: 914473

SEQ ID NO: 914478 - protein, 1786 aa, Homo sapiens; identical to SEQ ID NO: 914473

SEQ ID NO: 914479 - protein, 662 aa, Homo sapiens
MAYSLLACDCDPRGIETPQCDQSTGQCVCVEGVEGPRCDKCTRGYSGVFPDCTPCHQCFALWDVIIAELTNRTHRFLEKAKALKISGVIGPYRETVDSVERKVSEIKDILAQSPAAEPLKNIGNLFEEAEKLIKDVTEMMAQVEVKLSDTTSQSNSTAKELDSLQTEAESLDNTVKELAEQLEFIKNSDIRGALDSITKYFQMSLEAEERVNASTTEPNSTVEQSALMRDRVEDVMMERESQFKEKQEEQARLLDELAGKLQSLDLSAAAEMTCGTPPGASCSETECGGPNCRTDEGERKCGGPGCGGLVTVAHNAWQKAMDLDQDVLSALAEVEQLSKMVSEAKLRADEAKQSAEDILLKTNATKEKMDKSNEELRNLIKQIRNFLTQDSADLDSIEAVANEVLKMEMPSTPQQLQNLTEDIRERVESLSQVEVILQHSAADIARAEMLLEEAKRASKSATDVKVTADMVKEALEEAEKAQVAAEKAIKQADEDIQGTQNLLTSIESETAASEETLFNASQRISELERNVEELKRKAAQNSGEAEYIEKVVYTVKQSAEDVKKTLDGELDEKYKKVENLIAKKTEESADARRKAEMLQNEAKTLLAQANSKLQLLKDLERKYEDNQRYLEDKAQELARLEGEVRSLLKDISQKVAVYSTCL

SEQ ID NO: 914480 - protein, 1758 aa, Homo sapiens
MGLLQLLAFSFLALCRARVRAQEPEFSYGCAEGSCYPATGDLLIGRAQKLSVTSTCGLHKPEPYCIVSHLQEDKKCFICNSQDPYHETLNPDSHLIENVVTTFAPNRLKIWWQSENGVENVTIQLDLEAEFHFTHLIMTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFNEEVEGMVHGHCMCRHNTKGLNCELCMDFYHDLPWRPAEGRNSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALRQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECRACDCDPRGIETPQCDQSTGQCVCVEGVEGPRCDKCTRGYSGVFPDCTPCHQCFALWDVIIAELTNRTHRFLEKAKALKISGVIGPYRETVDSVERKVSEIKDILAQSPAAEPLKNIGNLFEEAEKLIKDVTEMMAQVEVKLSDTTSQSNSTAKELDSLQTEAESLDNTVKELAEQLEFIKNSDIRGALDSITKYFQMSLEAEERVNASTTEPNSTVEQSALMRDRVEDVMMERESQFKEKQEEQARLLDELAGKLQSLDLSAAAEMTCGTPPGASCSETECGGPNCRTDEGERKCGGPGCGGLVTVAHNAWQKAMDLDQDVLSALAEVEQLSKMVSEAKLRADEAKQSAEDILLKTNATKEKMDKSNEELRNLIKQIRNFLTQDSADLDSIEAVANEVLKMEMPSTPQQLQNLTEDIRERVESLSQVEVILQHSAADIARAEMLLEEAKRASKSATDVKVTADMVKEALEEAEKAQVAAEKAIKQADEDIQGTQNLLTSIESETAASEETLFNASQRISELERNVEELKRKAAQNSGEAEYIEKVVYTVKQSAEDVKKTSQWCTVWHSLHLDNFCPKRESCAQEPSAQIETTFLTMSAGPIRDSPPTKPHKEERRPDTTVYFQEDART

SEQ ID NO: 914481 - protein, 1724 aa, Homo sapiens
MGLLQLLAFSFLALCRARVRAQEPEFSYGCAEGSCYPATGDLLIGRAQKLSVTSTCGLHKPEPYCIVSHLQEDKKCFICNSQDPYHETLNPDSHLIENVVTTFAPNRLKIWWQSENGVENVTIQLDLEAEFHFTHLIMTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFNEEVEGMVHGHCMCRHNTKGLNCELCMDFYHDLPWRPAEGRNSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALRQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECRACDCDPRGIETPQCDQSTGQCVCVEGVEGPRCDKCTRGYSGVFPDCTPCHQCFALWDVIIAELTNRTHRFLEKAKALKISGVIGPYRETVDSVERKVSEIKDILAQSPAAEPLKNIGNLFEEAEKLIKDVTEMMAQVEVKLSDTTSQSNSTAKELDSLQTEAESLDNTVKELAEQLEFIKNSDIRGALDSITKYFQMSLEAEERVNASTTEPNSTVEQSALMRDRVEDVMMERESQFKEKQEEQARLLDELAGKLQSLDLSAAAEMTCGTPPGASCSETECGGPNCRTDEGERKCGGPGCGGLVTVAHNAWQKAMDLDQDVLSALAEVEQLSKMVSEAKLRADEAKQSAEDILLKTNATKEKMDKSNEELRNLIKQIRNFLTQDSADLDSIEAVANEVLKMEMPSTPQQLQNLTEDIRERVESLSQVEVILQHSAADIARAEMLLEEAKRASKSATDVKVTADMVKEALEEAEKAQVAAEKAIKQADEDIQGTQNLLTSIESETAASEETLFNASQRISELERNVEELKRGAGGSGAEFIGVVYTVRSAGGVGGGGGGGGGGHPPHTSAAPRPPLPPPPPLFHHRPPLKFRKKI

SEQ ID NO: 914482 - protein, 573 aa, Homo sapiens
MAYSLLACDCDPRGIETPQCDQSTGQCVCVEGVEGPRCDKCTRGYSGVFPDCTPCHQCFALWDVIIAELTNRTHRFLEKAKALKISGVIGPYRETVDSVERKVSEIKDILAQSPAAEPLKNIGNLFEEAEKLIKDVTEMMAQVEVKLSDTKSQFKEKQEEQARLLDELAGKLQSLDLSAAAEMTCGTPPGASCSETECGGPNCRTDEGERKCGGPGCGGLVTVAHNAWQKAMDLDQDVLSALAEVEQLSKMVSEAKLRADEAKQSAEDILLKTNATKEKMDKSNEELRNLIKQIRNFLTQDSADLDSIEAVANEVLKMEMPSTPQQLQNLTEDIRERVESLSQVEVILQHSAADIARAEMLLEEAKRASKSATDVKVTADMVKEALEEAEKAQVAAEKAIKQADEDIQGTQNLLTSIESETAASEETLFNASQRISELERNVEELKRKAAQNSGEAEYIEKVVYTVKQSAEDVKKTLDGELDEKYKKVENLIAKKTEESADARRKAEMLQNEAKTLLAQANSKLQLLKDLERKYEDNQRYLEDKAQELARLEGEVRSLLKDISQKVAVYSTCL

SEQ ID NO: 914483 - protein, 1070 aa, Homo sapiens
MGLLQLLAFSFLALCRARVRAQEPEFSYGCAEGSCYPATGDLLIGRAQKLSVTSTCGLHKPEPYCIVSHLQEDKKCFICNSQDPYHETLNPDSHLIENVVTTFAPNRLKIWWQSENGVENVTIQLDLEAEFHFTHLIMTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFNEEVEGMVHGHCMCRHNTKGLNCELCMDFYHDLPWRPAEGRNSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSCSETECGGPNCRTDEGERKCGGPGCGGLVTVAHNAWQKAMDLDQDVLSALAEVEQLSKMVSEAKLRADEAKQSAEDILLKTNATKEKMDKSNEELRNLIKQIRNFLTQDSADLDSIEAVANEVLKMEMPSTPQQLQNLTEDIRERVESLSQVEVILQHSAADIARAEMLLEEAKRASKSATDVKVTADMVKEALEEAEKAQVAAEKAIKQADEDIQGTQNLLTSIESETAASEETLFNASQRISELERNVEELKRKAAQNSGEAEYIEKVVYTVKQSAEDVKKTLDGELDEKYKKVENLIAKKTEESADARRKAEMLQNEAKTLLAQANSKLQLLKDLERKYEDNQRYLEDKAQELARLEGEVRSLLKDISQKVAVYSTCL

SEQ ID NO: 914484 - protein, 333 aa, Homo sapiens
DSAGSFKLSLMVSEAKLRADEAKQSAEDILLKTNATKEKMDKSNEELRNLIKQIRNFLTQDSADLDSIEAVANEVLKMEMPSTPQQLQNLTEDIRERVESLSQVEVILQHSAADIARAEMLLEEAKRASKSATDVKVTADMVKEALEEAEKAQVAAEKAIKQADEDIQGTQNLLTSIESETAASEETLFNASQRISELERNVEELKRKAAQNSGEAEYIEKVVYTVKQSAEDVKKTLDGELDEKYKKVENLIAKKTEESADARRKAEMLQNEAKTLLAQANSKLQLLKDLERKYEDNQRYLEDKAQELARLEGEVRSLLKDISQKVAVYSTCL

SEQ ID NO: 914485 - protein, 256 aa, Homo sapiens
MEMPSTPQQLQNLTEDIRERVESLSQVEVILQHSAADIARAEMLLEEAKRASKSATDVKVTADMVKEALEEAEKAQVAAEKAIKQADEDIQGTQNLLTSIESETAASEETLFNASQRISELERNVEELKRKAAQNSGEAEYIEKVVYTVKQSAEDVKKTLDGELDEKYKKVENLIAKKTEESADARRKAEMLQNEAKTLLAQANSKLQLLKDLERKYEDNQRYLEDKAQELARLEGEVRSLLKDISQKVAVYSTCL

SEQ ID NO: 914486 - protein, 269 aa, Homo sapiens
MASKGLILCIYHGVKSISLTNETSKKDLCESLWVISGRLFFKEKNTESTFFMFSNNILSHYFLLSKSATDVKVTADMVKEALEEAEKAQVAAEKAIKQADEDIQGTQNLLTSIESETAASEETLFNASQRISELERNVEELKRKAAQNSGEAEYIEKVVYTVKQSAEDVKKTLDGELDEKYKKVENLIAKKTEESADARRKAEMLQNEAKTLLAQANSKLQLLKDLERKYEDNQRYLEDKAQELARLEGEVRSLLKDISQKVAVYSTCL

SEQ ID NO: 914487 - protein, 283 aa, Homo sapiens
SIFNTSLATSFNAVQISIEAVANEVLKMEMPSTPQQLQNLTEDIRERVESLSQVEVILQHSAADIARAEMLLEEAKRASKSATDVKVTADMVKEALEEAEKAQVAAEKAIKQADEDIQGTQNLLTSIESETAASEETLFNASQRISELERNVEELKRKAAQNSGEAEYIEKVVYTVKQSAEDVKKTLDGELDEKYKKVENLIAKKTEESADARRKAEMLQNEAKTLLAQANSKLQLLKDLERKYEDNQRYLEDKAQELARLEGEVRSLLKDISQKVAVYSTCL

SEQ ID NO: 914488 - protein, 1413 aa, Homo sapiens
MGLLQLLAFSFLALCRARVRAQEPEFSYGCAEGSCYPATGDLLIGRAQKLSVTSTCGLHKPEPYCIVSHLQEDKKCFICNSQDPYHETLNPDSHLIENVVTTFAPNRLKIWWQSENGVENVTIQLDLEAEFHFTHLIMTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFNEEVEGMVHGHCMCRHNTKGLNCELCMDFYHDLPWRPAEGRNSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALRQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECRACDCDPRGIETPQCDQSTGQCVCVEGVEGPRCDKCTRGYSGVFPDCTPCHQCFALWDVIIAELTNRTHRFLEKAKALKISGVIGPYRETVDSVERKVSEIKDILAQSPAAEPLKNIGNLFEEAEKLIKDVTEMMAQVEVKLSDTTSQSNSTAKELDSLQTEAESLDNTVKELAEQLEFIKNSDIRGALDSITKYFQMSLEAEERVNASTTEPNSTVEQSALMRDRVEDVMMERESQFKEKQEEQARLLDELAGKLQSLDLSAAAEMVRFGDVALLLWCQAKKK

SEQ ID NO: 914489 - protein, 1138 aa, Homo sapiens
MGLLQLLAFSFLALCRARVRAQEPEFSYGCAEGSCYPATGDLLIGRAQKLSVTSTCGLHKPEPYCIVSHLQEDKKCFICNSQDPYHETLNPDSHLIENVVTTFAPNRLKIWWQSENGVENVTIQLDLEAEFHFTHLIMTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFNEEVEGMVHGHCMCRHNTKGLNCELCMDFYHDLPWRPAEGRNSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALRQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECRGELWAFSH

SEQ ID NO: 914490 - protein, 305 aa, Homo sapiens
MTRPPQFIEKKESAKKRDDLIYKNDGEETRNKTKTKTGEKEDKKRGDIREKKKTNKRGGGGKKTYRAKQQPKERNNKTTTTETKTKQNNTEQTQKVKQKTQKQKRRRRRKEKSKSTSTRREINRSNSTQQPLSTTSGGGPNNRTRHKQHDRTTHHATTPRRKNTTDHNNTTTPDHDKTKNKQQRKREDEKERGKRRNRNERAKEKTGKARGRQKERRERKKTQTKREKERRRKREKEERHSDHTRRQREEKRRQETEEKEKTKTKTGQHGQSGEKRKKQKENKRKQKRGEAGRTAEKKKDGRKET

SEQ ID NO: 914491 - protein, 142 aa, Homo sapiens
MDCPLSAPTPPPPLVRFFRAPLPACVPPTLLPVLPAALCRARVRAQEPEFSYGCAEGSCYPATGDLLIGRAQKLSVTSTCGLHKPEPYCIVSHLQVRAESGVRGSASASSRPDLRGRPWGLRILPAIQIGSAASRGVPGLGL

SEQ ID NO: 914492 - protein, 205 aa, Homo sapiens
DSAGSFKLSLMVSEAKLRADEAKQSAEDILLKTNATKEKMDKSNEELRNLIKQIRNFLTQDSADLDSIEAVANEVLKMEMPSTPQQLQNLTEDIRERVESLSQVEVILQHSAADIARAEMLLEEAKRASKSATDVKVTADMVKEALEEAEKAQVAAEKAIKQADEDIQGTQNLLTSIESETAASEETLFNASQRISESCRYRLDS

SEQ ID NO: 914493 - protein, 1709 aa, Homo sapiens
MGLLQLLAFSFLALCRARVRAQEPEFSYGCAEGSCYPATGDLLIGRAQKLSVTSTCGLHKPEPYCIVSHLQEDKKCFICNSQDPYHETLNPDSHLIENVVTTFAPNRLKIWWQSENGVENVTIQLDLEAEFHFTHLIMTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFNEEVEGMVHGHCMCRHNTKGLNCELCMDFYHDLPWRPAEGRNSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKRAWLVTMATPSLGQEITAALALAQMVPTVDASLPGAATKILLLYSYACVCDPGYIGSRCDDCASGYFGNPSEVGGSCQPCQCHNNIDTTDPEACDKETGRCLKCLYHTEGEHCQFCRFGYYGDALRQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECRACDCDPRGIETPQCDQSTGQCVCVEGVEGPRCDKCTRGYSGVFPDCTPCHQCFALWDVIIAELTNRTHRFLEKAKALKISGVIGPYRETVDSVERKVSEIKDILAQSPAAEPLKNIGNLFEEAEKLIKDVTEMMAQVEVKLSDTTSQSNSTAKELDSLQTEAESLDNTVKELAEQLEFIKNSDIRGALDSITKYFQMSLEAEERVNASTTEPNSTVEQSALMRDRVEDVMMERESQFKEKQEEQARLLDELAGKLQSLDLSAAAEMTCGTPPGASCSETECGGPNCRTDEGERKCGGPGCGGLVTVAHNAWQKAMDLDQDVLSALAEVEQLSKMVSEAKLRADEAKQSAEDILLKTNATKEKMDKSNEELRNLIKQIRNFLTQDSADLDSIEAVANEVLKMEMPSTPQQLQNLTEDIRERVESLSQVEVILQHSAADIARAEMLLEEAKRASKSATDVKVTADMVKEALEEAEKAQVAAEKAIKQADEDIQGTQNLLTSIESETAASEETLFNASQRISELERNVEELKRKAAQNSGEAEYIEKVVYTVKQSAEDVKKTLDGELDEKYKKVENLIAKKTEESADARRKAEMLQNEAKTLLAQANSKLQLLKDLERKYEDNQRYLEDKAQELARLEGEVRSLLKDISQKVAVYSTCL

SEQ ID NO: 914494 - protein, 1786 aa, Homo sapiens; identical to SEQ ID NO: 914473

SEQ ID NO: 914495 - protein, 1786 aa, Homo sapiens; identical to SEQ ID NO: 914473

SEQ ID NO: 914496 - protein, 647 aa, Homo sapiens
TQLQRVQTMYQGASQETGEGPRCDKCTRGYSGVFPDCTPCHQCFALWDVIIAELTNRTHRFLEKAKALKISGVIGPYRETVDSVERKVSEIKDILAQSPAAEPLKNIGNLFEEAEKLIKDVTEMMAQVEVKLSDTTSQSNSTAKELDSLQTEAESLDNTVKELAEQLEFIKNSDIRGALDSITKYFQMSLEAEERVNASTTEPNSTVEQSALMRDRVEDVMMERESQFKEKQEEQARLLDELAGKLQSLDLSAAAEMTCGTPPGASCSETECGGPNCRTDEGERKCGGPGCGGLVTVAHNAWQKAMDLDQDVLSALAEVEQLSKMVSEAKLRADEAKQSAEDILLKTNATKEKMDKSNEELRNLIKQIRNFLTQDSADLDSIEAVANEVLKMEMPSTPQQLQNLTEDIRERVESLSQVEVILQHSAADIARAEMLLEEAKRASKSATDVKVTADMVKEALEEAEKAQVAAEKAIKQADEDIQGTQNLLTSIESETAASEETLFNASQRISELERNVEELKRKAAQNSGEAEYIEKVVYTVKQSAEDVKKTLDGELDEKYKKVENLIAKKTEESADARRKAEMLQNEAKTLLAQANSKLQLLKDLERKYEDNQRYLEDKAQELARLEGEVRSLLKDISQKVAVYSTCL

SEQ ID NO: 914497 - protein, 1855 aa, Homo sapiens
MGLLQLLAFSFLALCRARVRAQEPEFSYGCAEGSCYPATGDLLIGRAQKLSVTSTCGLHKPEPYCIVSHLQEDKKCFICNSQDPYHETLNPDSHLIENVVTTFAPNRLKIWWQSENGVENVTIQLDLEAEFHFTHLIMTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFNEEVEGMVHGHCMCRHNTKGLNCELCMDFYHDLPWRPAEGRNSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALRQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECRACDCDPRGIETPQCDQSTGQCVCVEGVEGPRCDKCTRGYSGVFPDCTPCHQCFALWDVIIAELTNRTHRFLEKAKALKISGVIGPYRETVDSVERKVSEIKDILAQSPAAEPLKNIGNLFEEAEKLIKDVTEMMAQVEVKLSDTTSQSNSTAKELDSLQTEAESLDNTVKELAEQLEFIKNSDIRGALDSITKYFQMSLEAEERVNASTTEPNSTVEQSALMRDRVEDVMMERESQFKEKQEEQARLLDELAGKLQSLDLSAAAEMTCGTPPGASCSETECGGPNCRTDEGERKCGGPGCGGLVTVAHNAWQKAMDLDQDVLSALAEVEQLSKMVSEAKLRADEAKQSAEDILLKTNATKEKMDKSNEELRNLIKQIRNFLTQDSADLDSIEAVANEVLKMEMPSTPQQLQNLTEDIRERVESLSQVEVILQHSAADIARAEMLLEEAKRARYLKTWHLRGLFCVSIMEYKSISLTNETSKKDLCESLWVISGRLFFKEKNTESTFFMFSNNILSHYFLLSKSATDVKVTADMVKEALEEAEKAQVAAEKAIKQADEDIQGTQNLLTSIESETAASEETLFNASQRISELERNVEELKRKAAQNSGEAEYIEKVVYTVKQSAEDVKKTLDGELDEKYKKVENLIAKKTEESADARRKAEMLQNEAKTLLAQANSKLQLLKDLERKYEDNQRYLEDKAQELARLEGEVRSLLKDISQKVAVYSTCL

SEQ ID NO: 914498 - protein, 1658 aa, Homo sapiens
MGLLQLLAFSFLALCRARVRAQEPEFSYGCAEGSCYPATGDLLIGRAQKLSVTSTCGLHKPEPYCIVSHLQEDKKCFICNSQDPYHETLNPDSHLIENVVTTFAPNRLKIWWQSENGVENVTIQLDLEAEFHFTHLIMTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFNEEVEGMVHGHCMCRHNTKGLNCELCMDFYHDLPWRPAEGRNSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALRQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECRACDCDPRGIETPQCDQSTGQCVCVEGVEGPRCDKCTRGYSGVFPDCTPCHQCFALWDVIIAELTNRTHRFLEKAKALKISGVIGPYRETVDSVERKVSEIKDILAQSPAAEPLKNIGNLFEEAEKLIKDVTEMMAQVEVKLSDTTSQSNSTAKELDSLQTEAESLDNTVKELAEQLEFIKNSDIRGALDSITKYFQMSLEAEERVNASTTEPNSTVEQSALMRDRVEDVMMERESQFKEKQEEQARLLDELAGKLQSLDLSAAAEMTCGTPPGASCSETECGGPNCRTDEGERKCGGPGCGGLVTVAHNAWQKAMDLDQDVLSALAEVEQLSKMVSEAKLRADEAKQSAEDILLKTNATKEKMDKSNEELRNLIKQIRNFLTQDSADLDSIEAVANEVLKMEMPSTPQQLQNLTEDIRERVESLSQVEVILQHSAADIARAEMLLEEAKRASKSATDVKVTADMVKEALEEAEKAQVAAEKAIKQADEDIQGTQNLLTSIESETAASEETLFNASQRISESCRYRARF

SEQ ID NO: 914499 - protein, 1525 aa, Homo sapiens
MGLLQLLAFSFLALCRARVRAQEPEFSYGCAEGSCYPATGDLLIGRAQKLSVTSTCGLHKPEPYCIVSHLQEDKKCFICNSQDPYHETLNPDSHLIENVVTTFAPNRLKIWWQSENGVENVTIQLDLEAEFHFTHLIMTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFNEEVEGMVHGHCMCRHNTKGLNCELCMDFYHDLPWRPAEGRNSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALRQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECRACDCDPRGIETPQCDQSTGQCVCVEGVEGPRCDKCTRGYSGVFPDCTPCHQCFALWDVIIAELTNRTHRFLEKAKALKISGVIGPYRETVDSVERKVSEIKDILAQSPAAEPLKNIGNLFEEAEKLIKDVTEMMAQVEVKLSDTTSQSNSTAKELDSLQTEAESLDNTVKELAEQLEFIKNSDIRGALDSITKYFQMSLEAEERVNASTTEPNSTVEQSALMRDRVEDVMMERESQFKEKQEEQARLLDELAGKLQSLDLSAAAEMTCGTPPGASCSETECGGPNCRTDEGERKCGGPGCGGLVTVAHNAWQKAMDLDQDVLSALAEVEQLSKMVSEAKLRADEAKQSAEDILLKTNATKEKMDKSNEELRNLIKQIRNFLTPKVQQMLKSLQIW

SEQ ID NO: 914500 - protein, 1612 aa, Homo sapiens
MGLLQLLAFSFLALCRARVRAQEPEFSYGCAEGSCYPATGDLLIGRAQKLSVTSTCGLHKPEPYCIVSHLQEDKKCFICNSQDPYHETLNPDSHLIENVVTTFAPNRLKIWWQSENGVENVTIQLDLEAEFHFTHLIMTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFNEEVEGMVHGHCMCRHNTKGLNCELCMDFYHDLPWRPAEGRNSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALRQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECRACDCDPRGIETPQCDQSTGQCVCVEGVEGPRCDKCTRGYSGVFPDCTPCHQCFALWDVIIAELTNRTHRFLEKAKALKISGVIGPYRETVDSVERKVSEIKDILAQSPAAEPLKNIGNLFEEAEKLIKDVTEMMAQVEVKLSDTTSQSNSTAKELDSLQTEAESLDNTVKELAEQLEFIKNSDIRGALDSITKYFQMSLEAEERVNASTTEPNSTVEQSALMRDRVEDVMMERESQFKEKQEEQARLLDELAGKLQSLDLSAAAEMTCGTPPGASCSETECGGPNCRTDEGERKCGGPGCGGLVTVAHNAWQKAMDLDQDVLSALAEVEQLSKMVSEAKLRADEAKQSAEDILLKTNATKEKMDKSNEELRNLIKQIRNFLTQDSADLDSIEAVANEVLKMEMPSTPQQLQNLTEDIRERVESLSQVEVILQHSAADIARAEMLLEEAKRASKVHRCKVSSRYDTGSSGRSRKHGRQQESGF

SEQ ID NO: 914501 - protein, 256 aa, Homo sapiens; identical to SEQ ID NO: 914485

SEQ ID NO: 914502 - protein, 1755 aa, Homo sapiens
MGLLQLLAFSFLALCRARVRAQEPEFSYGCAEGSCYPATGDLLIGRAQKLSVTSTCGLHKPEPYCIVSHLQEDKKCFICNSQDPYHETLNPDSHLIENVVTTFAPNRLKIWWQSENGVENVTIQLDLEAEFHFTHLIMTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFNEEVEGMVHGHCMCRHNTKGLNCELCMDFYHDLPWRPAEGRNSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALRQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECRACDCDPRGIETPQCDQSTGQCVCVEGVEGPRCDKCTRGYSGVFPDCTPCHQCFALWDVIIAELTNRTHRFLEKAKALKISGVIGPYRETVDSVERKVSEIKDILAQSPAAEPLKNIGNLFEEAEKLIKDVTEMMAQVEVKLSDTTSQSNSTAKELDSLQTEAESLDNTVKELAEQLEFIKNSDIRGALDSITKYFQMSLEAEERVNASTTEPNSTVEQSALMRDRVEDVMMERESQFKEKQEEQARLLDELAGKLQSLDLSAAAEMVRFGDVALLLWCQAKKKKKKKKTKKKKKHKQTKKNKKTKRGGGPQNPPGGAPQADQTTTFIEKKESAKKRDDLIYKNDGEETRNKTKTKDRRKRRQEERRHPREEENKQKGGRREKNIIEPNNNQKREIKDHNDRDKNKTKQHGANTEGETKNTETINEDAEEKKKSKSTSTRREINRSNSTQQPLSTTSGGGPNNRTRHKQHDRTTHHATTPRRKNTTDHNNTTTPDHDKTKNKQQRKREDEKERGKRRNRNERAKEKTGKEEEDKKREEKDRKHRQKGKRKEDEKEKKEERHSDHTRRQREEKRRQETEEKEKTKTKTGQHGQSGEKRKKQKENKRKQKRGEAGRTAEKKKDGRKET

SEQ ID NO: 914503 - protein, 1188 aa, Homo sapiens
MGLLQLLAFSFLALCRARVRAQEPEFSYGCAEGSCYPATGDLLIGRAQKLSVTSTCGLHKPEPYCIVSHLQEDKKCFICNSQDPYHETLNPDSHLIENVVTTFAPNRLKIWWQSENGVENVTIQLDLEAEFHFTHLIMTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFNEEVEGMVHGHCMCRHNTKGLNCELCMDFYHDLPWRPAEGRNSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALRQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECRDVEDVTQFPDYPGSHNMCGEGRIYHLSPQFMLLTIMLYSSNLPLESLECRGRTKTIKR

SEQ ID NO: 914504 - protein, 959 aa, Homo sapiens
MGLLQLLAFSFLALCRARVRAQEPEFSYGCAEGSCYPATGDLLIGRAQKLSVTSTCGLHKPEPYCIVSHLQEDKKCFICNSQDPYHETLNPDSHLIENVVTTFAPNRLKIWWQSENGVENVTIQLDLEAEFHFTHLIMTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFNEEVEGMVHGHCMCRHNTKGLNCELCMDFYHDLPWRPAEGRNSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPFHGAVPVHAWVWRPHLQRVPGTLLGRPRRGVPRCGRRDSVS

SEQ ID NO: 914505 - protein, 106 aa, Homo sapiens
MSILNWGQGAYKRSMFPLNEFLKAVPCLPVSLACECHLQGSVNAFCNPVTGQCHCFQGVYARQCDRCLPGHWGFPSCQPCQCNGHADDCDPVTGECLNCQDYTMGH

SEQ ID NO: 914506 - protein, 482 aa, Homo sapiens
MASFSAETNSTDLLSQPWNEPPVILSMVILSLTFLLGLPGNGLVLWVAGLKMQRTVNTIWFLHLTLADLLCCLSLPFSLAHLALQGQWPYGRFLCKLIPSIIVLNMFASVFLLTAISLDRCLVVFKPIWCQNHRNVGMACSICGCIWVVAFVMCIPVFVYREIFTTDNHNRCGYKFGLSSSLDYPDFYGDPLENRSLENIVQPPGEMNDRLDPSSFQTNDHPWTVPTVFQPQTFQRPSADSLPRGSARLTSQNLYSNVFKPADVVSPKIPSGFPIEDHETSPLDNSDAFLSTHLKLFPSASSNSFYESELPQGFQDYYNLGQFTDDDQVPTPLVAITITRLVVGFLLPSVIMIACYSFIVFRMQRGRFAKSQSKTFRVAVVVVAVFLVCWTPYHIFGVLSLLTDPETPLGKTLMSWDHVCIALASANSCFNPFLYALLGKDFRKKARQSIQGILEAAFSEELTRSTHCPSNNVISERNSTTV

SEQ ID NO: 914507 - protein, 164 aa, Homo sapiens
MASFSAETNSTDLLSQPWNEPPVILSMVILSLTFLLGLPGNGLVLWVAGLKMQRTVNTIWFLHLTLADLLCCLSLPFSLAHLALQGQWPYGRFLCKLIPSIIVLNMFASVFLLTAISLDRCLVVFKPIWCQNHRNVGMACSICGCIWVVAFVMCIPVFVYREIS

SEQ ID NO: 914508 - protein, 395 aa, Homo sapiens
MASFSAETNSTDLLSQPWNEPPVILSMVILSLTFLLGLPGNGLVLWVAGLKMQRTVNTIWFLHLTLADLLCCLSLPFSLAHLALQGQWPYGRFLCKLIPSIIVLNMFASVFLLTAISLDRCLVVFKPIWCQNHRNVGMACSICGCIWVVAFVMCIPVFVYREIFTTDNHNRCGYKFGLSSSLDYPDFYGDPLENRSLENIVQPPGEMNDRLDPSSFQTNDHPWTVPTVFQPQTFQRPSADSLPRGSARLTSQNLYSNVFKPADVVSPKIPSGFPIEDHETSPLDNSDAFLSTHLKLFPSASSNSFYESELPQGFQDYYNLGQFTDDDQVPTPLVAITITRLVVGFLLPSVIMIACYSFIVFRMQRGRFAKSQSKTFRVAVVVVALESYSVNWPTS

SEQ ID NO: 914509 - protein, 482 aa, Homo sapiens; identical to SEQ ID NO: 914506

SEQ ID NO: 914510 - protein, 482 aa, Homo sapiens; identical to SEQ ID NO: 914506

SEQ ID NO: 914511 - protein, 438 aa, Homo sapiens [sequence omitted]

SEQ ID NO: 914512 - protein, 126 aa, Homo sapiens
MTTYEPGGRRKYTSRMGPYFRNKLIVKEYEVRSSGRVVSLSTPIIWRRGHEPQSFIRRNQDLICSFFTWFSDHSLPESDKIAEIIKEDLWPNPLQYYLLREGVRRARRRPLREPVEIPRPFGFQSG

SEQ ID NO: 914513 - protein, 438 aa, Homo sapiens [sequence omitted]

SEQ ID NO: 914514 - protein, 438 aa, Homo sapiens [sequence omitted]

SEQ ID NO: 914515 - protein, 438 aa, Homo sapiens [sequence omitted]

SEQ ID NO: 914516 - protein, 438 aa, Homo sapiens [sequence omitted]

SEQ ID NO: 914517 - protein, 180 aa, Homo sapiens
MSRQANRGTESKKMSSELFTLTYGALVTQLCKDYENDEDVNKQLDKMGFNIGVRLIEDFLARSNVGRCHDFRETADVIAKVAFKMYLGITPSITNWSPAGDEFSLILENNPLVDFVELPDNHSSLIYSNLLCGVLRGALEMVQMAVEAKFVQDTLKGDGVTEIRMRFIRRIEDNLPAGEE

SEQ ID NO: 914518 - protein, 180 aa, Homo sapiens; identical to SEQ ID NO: 914517

SEQ ID NO: 914519 - protein, 180 aa, Homo sapiens; identical to SEQ ID NO: 914517

SEQ ID NO: 914520 - protein, 134 aa, Homo sapiens
MGFNIGVRLIEDFLARSNVGRCHDFRETADVIAKVAFKMYLGITPSITNWSPAGDEFSLILENNPLVDFVELPDNHSSLIYSNLLCGVLRGALEMVQMAVEAKFVQDTLKGDGVTEIRMRFIRRIEDNLPAGEE

SEQ ID NO: 914521 - protein, 180 aa, Homo sapiens; identical to SEQ ID NO: 914517

SEQ ID NO: 914522 - protein, 134 aa, Homo sapiens; identical to SEQ ID NO: 914520

SEQ ID NO: 914523 - protein, 142 aa, Homo sapiens
MLFSNFLPRGFNIGVRLIEDFLARSNVGRCHDFRETADVIAKVAFKMYLGITPSITNWSPAGDEFSLILENNPLVDFVELPDNHSSLIYSNLLCGVLRGALEMVQMAVEAKFVQDTLKGDGVTEIRMRFIRRIEDNLPAGEE

SEQ ID NO: 914524 - protein, 161 aa, Homo sapiens
MSRQANRGTESKKMSSELFTLTYGALVTQLCKDYENDEDVNKQLDKMGFNIGVRLIEDFLARSNVGRCHDFRETADVIAKVAFKMYLGITPSITNWSPAGDEFSLILENNPLVDFVELPDNHSSLIYSNLLCGVLRGALEMVSATLYLLGHPKCNRDLISV

SEQ ID NO: 914525 - protein, 123 aa, Homo sapiens
SVIRDTELSQCGGPDFRNAELMPVAFKMYLGITPSITNWSPAGDEFSLILENNPLVDFVELPDNHSSLIYSNLLCGVLRGALEMVQMAVEAKFVQDTLKGDGVTEIRMRFIRRIEDNLPAGEE

SEQ ID NO: 914526 - protein, 134 aa, Homo sapiens; identical to SEQ ID NO: 914520

SEQ ID NO: 914527 - protein, 180 aa, Homo sapiens; identical to SEQ ID NO: 914517

SEQ ID NO: 914528 - protein, 180 aa, Homo sapiens; identical to SEQ ID NO: 914517

SEQ ID NO: 914529 - protein, 180 aa, Homo sapiens; identical to SEQ ID NO: 914517

SEQ ID NO: 914530 - protein, 213 aa, Homo sapiens
MQEAGAVIVYLAVLLGVAFSNPWLGEWGGAAGTMSRQANRGTESKKMSSELFTLTYGALVTQLCKDYENDEDVNKQLDKMGFNIGVRLIEDFLARSNVGRCHDFRETADVIAKVAFKMYLGITPSITNWSPAGDEFSLILENNPLVDFVELPDNHSSLIYSNLLCGVLRGALEMVQMAVEAKFVQDTLKGDGVTEIRMRFIRRIEDNLPAGEE

SEQ ID NO: 914531 - protein, 180 aa, Homo sapiens; identical to SEQ ID NO: 914517

SEQ ID NO: 914532 - protein, 161 aa, Homo sapiens
MSRQANRGTESKKMSSELFTLTYGALVTQLCKDYENDEDFLARSNVGRCHDFRETADVIAKVAFKMYLGITPSITNWSPAGDEFSLILENNPLVDFVELPDNHSSLIYSNLLCGVLRGALEMVQMAVEAKFVQDTLKGDGVTEIRMRFIRRIEDNLPAGEE

SEQ ID NO: 914533 - protein, 162 aa, Homo sapiens
MSRQANRGTESKKMSSELFTLTYGALVTQLCKDYENDEDVNKQLDKMGFNIGVRLIEDFLARSNVGRCHDFRETADVIAKVAFKMYLGITPSITNWSPAGDEFSLILVYSNLLCGVLRGALEMVQMAVEAKFVQDTLKGDGVTEIRMRFIRRIEDNLPAGEE

SEQ ID NO: 914534 - protein, 147 aa, Homo sapiens
MQEAGAVIVYLAVLLGVAFSNPWLGEWGGAAGTMSRQANRGTESKKMVAFKMYLGITPSITNWSPAGDEFSLILENNPLVDFVELPDNHSSLIYSNLLCGVLRGALEMVQMAVEAKFVQDTLKGDGVTEIRMRFIRRIEDNLPAGEE

SEQ ID NO: 914535 - protein, 161 aa, Homo sapiens; identical to SEQ ID NO: 914524

SEQ ID NO: 914536 - protein, 421 aa, Homo sapiens
MPGRWRWQRDMHPARKLLSLLFLILMGTELTQVLPTNPEESWQVYSSAQDSEGRCICTVVAPQQTMCSRDARTKQLRQLLEKVQNMSQSIEVLDRRTQRDLQYVEKMENQMKGLESKFKQVEESHKQHLARQFKAIKAKMDELRPLIPVLEEYKADAKLVLQFKEEVQNLTSVLNELQEEIGAYDYDELQSRVSNLEERLRACMQKLACGKLTGISDPVTVKTSGSRFGSWMTDPLAPEGDNRVWYMDGYHNNRFVREYKSMVDFMNTDNFTSHRLPHPWSGTGQVVYNGSIYFNKFQSHIIIRFDLKTETILKTRSLGTMPVTTTCYHYAWGWATRDIDLMVGRERAVGPCYATNQNAGQHRGSVGWTPCPLQTLQTWEHELPQAQRRGGLHHLRHAVRHQRLLRGYQGPLCIPDQCLHL

SEQ ID NO: 914537 - protein, 135 aa, Homo sapiens
MPGRWRWQRDMHPARKLLSLLFLILMGTELTQVLPTNPEESWQVYSSAQDSEGRCICTVVAPQQTMCSRDARTKQLRQLLEKVQNMSQSIEVLDRRTQRDLQYVEKMENQMKGLESKFKQVEESHKQHLARQFKG

SEQ ID NO: 914538 - protein, 77 aa, Homo sapiens
MHPARKLLSLLFLILMGTELTQDSAAPDSLLRSSKGSTRGSLAAIVIWRGKSESRIAKTPGIFRGGGTLVLPPTHTP

SEQ ID NO: 914539 - protein, 125 aa, Homo sapiens
MALPPCFSLSSRRATDVGRNSRICSWNCSPRRPGFPPRPVPLWSNNILKRRGNDCWPSSHRGKNPTVKDGHETFPLESWSSSRGNVAVPRLFEEAMGCTPGRRPSVNSHPHCSARFLDCVAVSLD

SEQ ID NO: 914540 - protein, 262 aa, Homo sapiens
ERRAGRRFPVAAEEPGGTQPGKAGRRAGGARRRARRAEATWPPSLAPGEGAAMAGARGAAAAAGGRRRAEGARGHSQAPLPARCPPPEGRLGAGAGASSERALEAARGAMSVPLLKIGVVLSTMAMITNWMSQTLPSLVGLNTTKLSAAGGGTLDRSTGVLPTNPEESWQVYSSAQDSEGRCICTVVAPQQTMCSRDARTKQLRQLLEKVQNMSQSIEVLDRRTQRDLQYVEKMENQMKGLESKFKQVEESHKQHLARQFKG

SEQ ID NO: 914541 - protein, 236 aa, Homo sapiens
ERRAGRRFPVAAEEPGGTQPGKAGRRAGGARRRARRAEATWPPSLAPGEGAAMAGAPVPAAEGRLGAGAGASSERALEAARGAMSVPLLKIGVVLSTMAMITNWMSQTLPSLVGLNTTKLSAAGGGTLDRSTGVLPTNPEESWQVYSSAQDSEGRCICTVVAPQQTMCSRDARTKQLRQLLEKVQNMSQSIEVLDRRTQRDLQYVEKMENQMKGLESKFKQVEESHKQHLARQFKG

SEQ ID NO: 914542 - protein, 169 aa, Homo sapiens
MPGRWRWQRDMHPARKLLSLLFLILMGTELTQNKRENKAEKMGGPESERKTTGEKTLNELPLFCLEAHAGSLALPRMCSPNPNPAVGLCRPAYPQSPSPGAAQTISQSLLERFCMASRREVFLAPGRPGGGWWLCTVAGQMHSFMCTHTHTHAHTGEQIPAEKSQPGPD

SEQ ID NO: 914543 - protein, 548 aa, Homo sapiens
ERRAGRRFPVAAEEPGGTQPGKAGRRAGGARRRARRAEATWPPSLAPGEGAAMAGARGAAAAAGGRRRAEGARGHSQAPLPARCPPPEGRLGAGAGASSERALEAARGAMSVPLLKIGVVLSTMAMITNWMSQTLPSLVGLNTTKLSAAGGGTLDRSTGVLPTNPEESWQVYSSAQDSEGRCICTVVAPQQTMCSRDARTKQLRQLLEKVQNMSQSIEVLDRRTQRDLQYVEKMENQMKGLESKFKQVEESHKQHLARQFKAIKAKMDELRPLIPVLEEYKADAKLVLQFKEEVQNLTSVLNELQEEIGAYDYDELQSRVSNLEERLRACMQKLACGKLTGISDPVTVKTSGSRFGSWMTDPLAPEGDNRVWYMDGYHNNRFVREYKSMVDFMNTDNFTSHRLPHPWSGTGQVVYNGSIYFNKFQSHIIIRFDLKTETILKTRSLGTMPVTTTCYHYAWGLATRDIDLMVGRERAVGPCYATNQNAGQHRGSVGWTPCPLQTLQTWEHELPQAQRRGGLHHLRHAVRHQRLLRGYQGPLCIPDQCLHL

SEQ ID NO: 914544 - protein, 351 aa, Homo sapiens
MPGRWRWQRDMHPARKLLSLLFLILMGTELTQVLPTNPEESWQVYSSAQDSEGRCICTVVAPQQTMCSRDARTKQLRQLLEKVQNMSQSIEVLDRRTQRDLQYVEKMENQMKGLESKFKQVEESHKQHLARQFKAIKAKMDELRPLIPVLEEYKADAKLVLQFKEEVQNLTSVLNELQEEIGAYDYDELQSRVSNLEERLRACMQKLACGKLTGISDPVTVKTSGSRFGSWMTDPLAPEGDNRVWYMDGYHNNRFVREYKSMVDFMNTDNFTSHRLPHPWSGTGQVVYNGSIYFNKFQSHIIIRFDLKTETILKTRSLGTMPVTTTCYHYAWGWATRDIDLMVGRERAVGP

SEQ ID NO: 914545 - protein, 82 aa, Homo sapiens
PLVELRHPCIPTASPDEGGKGLIFYDTKVTMNRVLNATVQRQRTQRDLQYVEKMENQMKGLESKFKQVEESHKQHLARQFKG

SEQ ID NO: 914546 - protein, 633 aa, Homo sapiens
MPEIRLRHVVSCSSQDSTHCAENLLKADTYRKWRAAKAGEKTISVVLQLEKEEQIHSVDIGNDGSAFVEVLVGSSAGGAGEQDYEVLLVTSSFMSPSESRSGSNPNRVRMFGPDKLVRAAAEKRWDRVKIVCSQPYSKDSPFGLSFVRFHSPPDKDEAEAPSQKVTVTKLGQFRVKEEDESANSLRPGALFFSRINKTSPVTASDPAGPSYAAATLQASSAASSASPVSRAIGSTSKPQESPKGKRKLDLNQEEKKTPSKPPAQLSPSVPKRPKLPAPTRTPATAPVPARAQGAVTGKPRGEGTEPRRPRAGPEELGKILQGVVVVLSGFQNPFRSELRDKALELGAKYRPDWTRDSTHLICAFANTPKYSQVLGLGGRIVRKEWVLDCHRMRRRLPSRRYLMAGPGSSSEEDEASHSGGSGDEAPKLPQKQPQTKTKPTQAAGPSSPQKPPTPEETKAASPVLQEDIDIEGVQSEGQDNGAEDSGDTEDELRRVAEQKEHRLPPGQEENGEDPYAGSTDENTDSEEHQEPPDLPVPELPDFFQGKHFFLYGEFPGDERRKLIRYVTAFNGELEDYMSDRVQFVITAQEWDPSFEEALMDNPSLAFVRPRWIYSCNEKQKLLPHQLYGVVPQA

SEQ ID NO: 914547 - protein, 633 aa, Homo sapiens; identical to SEQ ID NO: 914546

SEQ ID NO: 914548 - protein, 572 aa, Homo sapiens
MPEIRLRHVVSCSSQDSTHCAENLLKADTYRKWRAAKAGEKTISVVLQLEKEEQIHSVDIGNDGSAFVEVLVGSSAGGAGEQDYEVLLVTSSFMSPSESRSGSNPNRVRMFGPDKLVRAAAEKRWDRVKIVCSQPYSKDSPFGLSFVRFHSPPDKDEAEAPSQKVTVTKLGQFRVKEEDESANSLRPGALFFSRINKTSPVTASDPAGPSYAAATLQASSAASSASPVSRAIGSTSKPQESPKGKRKLDLNQEEKKTPSKPPAQLSPSVPKRPKLPAPTRTPATAPVPARAQGAVTGKPRGEGTEPRRPRAGPEELGKILQGVVVVLSGFQNPFRSELRDKALELGAKYRPDWTRDSTHLICAFANTPKYSQVLGLGGRIVRKEWVLDCHRMRRRLPSRRYLMAGPGSSSEEDEASHSGGSGDEAPKLPQKQPQTKTKPTQAAGPSSPQKPPTPEETKAASPVLQEDIDIEGVQSEGQDNGAEDSGDTEDELRRVAEQKEHRLPPGQEENGEDPYAGSTDENTDSEEHQEPPDLPVPELPDFFQGKHFFLYGEFPGDERRKLIRYVTAFNGP

SEQ ID NO: 914549 - protein, 506 aa, Homo sapiens
MPEIRLRHVVSCSSQDSTHCAENLLKADTYRKWRAAKAGEKTISVVLQLEKEEQIHSVDIGNDGSAFVEVLVGSSAGGAGEQDYEVLLVTSSFMSPSESRSGSNPNRVRMFGPDKLVRAAAEKRWDRVKIVCSQPYSKDSPFGLSFVRFHSPPDKDEAEAPSQKVTVTKLGQFRVKEEDESANSLRPGALFFSRINKTSPVTASDPAGPSYAAATLQASSAASSASPVSRAIGSTSKPQESPKGKRKLDLNQEEKKTPSKPPAQLSPSVPKRPKLPAPTRTPATAPVPARAQGAVTGKPRGEGTEPRRPRAGPEELGKILQGVVVVLSGFQNPFRSELRDKALELGAKYRPDWTRDSTHLIEDELRRVAEQKEHRLPPGQEENGEDPYAGSTDENTDSEEHQEPPDLPVPELPDFFQGKHFFLYGEFPGDERRKLIRYVTAFNGELEDYMSDRVQFVITAQEWDPSFEEALMDNPSLAFVRPRWIYSCNEKQKLLPHQLYGVVPQA

SEQ ID NO: 914550 - protein, 662 aa, Homo sapiens
MHGTGLSVDKLHGPRPVHIFTPGEAHDVDMPEIRLRHVVSCSSQDSTHCAENLLKADTYRKWRAAKAGEKTISVVLQLEKEEQIHSVDIGNDGSAFVEVLVGSSAGGAGEQDYEVLLVTSSFMSPSESRSGSNPNRVRMFGPDKLVRAAAEKRWDRVKIVCSQPYSKDSPFGLSFVRFHSPPDKDEAEAPSQKVTVTKLGQFRVKEEDESANSLRPGALFFSRINKTSPVTASDPAGPSYAAATLQASSAASSASPVSRAIGSTSKPQESPKGKRKLDLNQEEKKTPSKPPAQLSPSVPKRPKLPAPTRTPATAPVPARAQGAVTGKPRGEGTEPRRPRAGPEELGKILQGVVVVLSGFQNPFRSELRDKALELGAKYRPDWTRDSTHLICAFANTPKYSQVLGLGGRIVRKEWVLDCHRMRRRLPSRRYLMAGPGSSSEEDEASHSGGSGDEAPKLPQKQPQTKTKPTQAAGPSSPQKPPTPEETKAASPVLQEDIDIEGVQSEGQDNGAEDSGDTEDELRRVAEQKEHRLPPGQEENGEDPYAGSTDENTDSEEHQEPPDLPVPELPDFFQGKHFFLYGEFPGDERRKLIRYVTAFNGELEDYMSDRVQFVITAQEWDPSFEEALMDNPSLAFVRPRWIYSCNEKQKLLPHQLYGVVPQA

SEQ ID NO: 914551 - protein, 819 aa, Homo sapiens
LLAVRNLRPGDSQTAAQARDQTAALLNSAGLGAADLFVLPANCGSSDGCEELERLRAALQSQAEALRRLLPPAQDGFEVLGAAELEAVREAFETGGLEAALSWVRSGLERLGSARLDLAVAGKADVGLVVDMLLGLDPGDPGAAPASVPTAPTPFPAPERPNVVLWTVPLGHTGTATPRPPPLTQRTTTPSSSSPLGPPLRRTGPRSRPCCYQMRLLSACAQTARARIRSVWEKLEKEEQIHSVDIGNDGSAFVEVLVGSSAGGAGEQDYEVLLVTSSFMSPSESRSGSNPNRVRMFGPDKLVRAAAEKRWDRVKIVCSQPYSKDSPFGLSFVRFHSPPDKDEAEAPSQKVTVTKLGQFRVKEEDESANSLRPGALFFSRINKTSPVTASDPAGPSYAAATLQASSAASSASPVSRAIGSTSKPQESPKGKRKLDLNQEEKKTPSKPPAQLSPSVPKRPKLPAPTRTPATAPVPARAQGAVTGKPRGEGTEPRRPRAGPEELGKILQGVVVVLSGFQNPFRSELRDKALELGAKYRPDWTRDSTHLICAFANTPKYSQVLGLGGRIVRKEWVLDCHRMRRRLPSRRYLMAGPGSSSEEDEASHSGGSGDEAPKLPQKQPQTKTKPTQAAGPSSPQKPPTPEETKAASPVLQEDIDIEGVQSEGQDNGAEDSGDTEDELRRVAEQKEHRLPPGQEENGEDPYAGSTDENTDSEEHQEPPDLPVPELPDFFQGKHFFLYGEFPGDERRKLIRYVTAFNGELEDYMSDRVQFVITAQEWDPSFEEALMDNPSLAFVRPRWIYSCNEKQKLLPHQLYGVVPQA

SEQ ID NO: 914552 - protein, 586 aa, Homo sapiens
MLEKEEQIHSVDIGNDGSAFVEVLVGSSAGGAGEQDYEVLLVTSSFMSPSESRSGSNPNRVRMFGPDKLVRAAAEKRWDRVKIVCSQPYSKDSPFGLSFVRFHSPPDKDEAEAPSQKVTVTKLGQFRVKEEDESANSLRPGALFFSRINKTSPVTASDPAGPSYAAATLQASSAASSASPVSRAIGSTSKPQESPKGKRKLDLNQEEKKTPSKPPAQLSPSVPKRPKLPAPTRTPATAPVPARAQGAVTGKPRGEGTEPRRPRAGPEELGKILQGVVVVLSGFQNPFRSELRDKALELGAKYRPDWTRDSTHLICAFANTPKYSQVLGLGGRIVRKEWVLDCHRMRRRLPSRRYLMAGPGSSSEEDEASHSGGSGDEAPKLPQKQPQTKTKPTQAAGPSSPQKPPTPEETKAASPVLQEDIDIEGVQSEGQDNGAEDSGDTEDELRRVAEQKEHRLPPGQEENGEDPYAGSTDENTDSEEHQEPPDLPVPELPDFFQGKHFFLYGEFPGDERRKLIRYVTAFNGELEDYMSDRVQFVITAQEWDPSFEEALMDNPSLAFVRPRWIYSCNEKQKLLPHQLYGVVPQA

SEQ ID NO: 914553 - protein, 526 aa, Homo sapiens
SQEEVSLSEKGLGPWPLSLGQTPCLPPLLSQDSPFGLSFVRFHSPPDKDEAEAPSQKVTVTKLGQFRVKEEDESANSLRPGALFFSRINKTSPVTASDPAGPSYAAATLQASSAASSASPVSRAIGSTSKPQESPKGKRKLDLNQEEKKTPSKPPAQLSPSVPKRPKLPAPTRTPATAPVPARAQGAVTGKPRGEGTEPRRPRAGPEELGKILQGVVVVLSGFQNPFRSELRDKALELGAKYRPDWTRDSTHLICAFANTPKYSQVLGLGGRIVRKEWVLDCHRMRRRLPSRRYLMAGPGSSSEEDEASHSGGSGDEAPKLPQKQPQTKTKPTQAAGPSSPQKPPTPEETKAASPVLQEDIDIEGVQSEGQDNGAEDSGDTEDELRRVAEQKEHRLPPGQEENGEDPYAGSTDENTDSEEHQEPPDLPVPELPDFFQGKHFFLYGEFPGDERRKLIRYVTAFNGELEDYMSDRVQFVITAQEWDPSFEEALMDNPSLAFVRPRWIYSCNEKQKLLPHQLYGVVPQA

SEQ ID NO: 914554 - protein, 242 aa, Homo sapiens [sequence omitted]

SEQ ID NO: 914555 - protein, 485 aa, Homo sapiens
MAADYHGADGRVHPEKVTVTKLGQFRVKEEDESANSLRPGALFFSRINKTSPVTASDPAGPSYAAATLQASSAASSASPVSRAIGSTSKPQESPKGKRKLDLNQEEKKTPSKPPAQLSPSVPKRPKLPAPTRTPATAPVPARAQGAVTGKPRGEGTEPRRPRAGPEELGKILQGVVVVLSGFQNPFRSELRDKALELGAKYRPDWTRDSTHLICAFANTPKYSQVLGLGGRIVRKEWVLDCHRMRRRLPSRRYLMAGPGSSSEEDEASHSGGSGDEAPKLPQKQPQTKTKPTQAAGPSSPQKPPTPEETKAASPVLQEDIDIEGVQSEGQDNGAEDSGDTEDELRRVAEQKEHRLPPGQEENGEDPYAGSTDENTDSEEHQEPPDLPVPELPDFFQGKHFFLYGEFPGDERRKLIRYVTAFNGELEDYMSDRVQFVITAQEWDPSFEEALMDNPSLAFVRPRWIYSCNEKQKLLPHQLYGVVPQA

SEQ ID NO: 914556 - protein, 274 aa, Homo sapiens
MPEIRLRHVVSCSSQDSTHCAENLLKADTYRKWRAAKAGEKTISVVLQLEKEEQIHSVDIGNDGSAFVEVLVGSSAGGAGEQDYEVLLVTSSFMSPSESRSGSNPNRVRMFGPDKLVRAAAEKRWDRVKIVCSQPYSKDSPFGLSFVRFHSPPDKDEAEAPSQKVTVTKLGQFRVKEEDESANSLRPGALFFSRINKTSPVTASDPAGPSYAAATLQASSAASSASPVSRAIGSTSKALMDNPSLAFVRPRWIYSCNEKQKLLPHQLYGVVPQA

SEQ ID NO: 914557 - protein, 231 aa, Homo sapiens [sequence omitted]

SEQ ID NO: 914558 - protein, 190 aa, Homo sapiens
MPEIRLRHVVSCSSQDSTHCAENLLKADTYRKWRAAKAGEKTISVVLQLEKEEQIHSVDIGNDGSAFVEVLVGSSAGGAGEQDYEVLLVTSSFMSPSESRSGSNPNRVRMFGPDKLVRAAAEKRWDRVKIVCSQPYSKDSPFGLSFVRFHSPPDKDEAEAPSQKVTVTKLGQFRVKEEDESANSRSSRTI

SEQ ID NO: 914559 - protein, 633 aa, Homo sapiens; identical to SEQ ID NO: 914546

SEQ ID NO: 914560 - protein, 633 aa, Homo sapiens; identical to SEQ ID NO: 914546

SEQ ID NO: 914561 - protein, 498 aa, Homo sapiens
MPEIRLRHVVSCSSQDSTHCAENLLKADTYRKWRAAKAGEKTISVVLQLEKEEQIHSVDIGNDGSAFVEVLVGSSAGGAGEQDYEVLLVTSSFMSPSESRSGSNPNRVRMFGPDKLVRAAAEKRWDRVKIVCSQPYSKDSPFGLSFVRFHSPPDKDEAEAPSQKVTVTKLGQFRVKEEDESANSLRPGALFFSRINKTSPVTASDPAGPSYAAATLQASSAASSASPVSRAIGSTSKPQESPKGKRKLDLNQEEKKTPSKPPAQLSPSVPKRPKLPAPTRTPATAPVPARAQGAVTGKPRGEGTEPRRPRAGPEELGKILQGVVVVLSGFQNPFRSELRDKALELGAKYRPDWTRDSTHLICAFANTPKYSQVLGLGGRIVRKEWVLDCHRMRRRLPSRRYLMAGPGSSSEEDEASHSGGSGDEAPKLPQKQPQTKTKPTQAAGPSSPQKPPTPEETKAASPISSRASTSFFTGSSLGTSGGNSSDTSQPSMGSSRTI

SEQ ID NO: 914562 - protein, 658 aa, Homo sapiens
MPEIRLRHVVSCSSQDSTHCAENLLKADTYRKWRAAKAGEKTISVVLQLEKEEQIHSVDIGNDGSAFVEVLVGSSAGGAGEQDYEVLLVTSSFMSPSESRSGSNPNRVRMFGPDKLVRAAAEKRWDRVKIVCSQPYSKDSPFGLSFVRFHSPPDKDEAEAPSQKVTVTKLGQFRVKEEDESANSLRPGALFFSRINKTSPVTASDPAGPSYAAATLQASSAASSASPVSRAIGSTSKGEIIRLWWGGGGEKLEAINPSPSPQPQESPKGKRKLDLNQEEKKTPSKPPAQLSPSVPKRPKLPAPTRTPATAPVPARAQGAVTGKPRGEGTEPRRPRAGPEELGKILQGVVVVLSGFQNPFRSELRDKALELGAKYRPDWTRDSTHLICAFANTPKYSQVLGLGGRIVRKEWVLDCHRMRRRLPSRRYLMAGPGSSSEEDEASHSGGSGDEAPKLPQKQPQTKTKPTQAAGPSSPQKPPTPEETKAASPVLQEDIDIEGVQSEGQDNGAEDSGDTEDELRRVAEQKEHRLPPGQEENGEDPYAGSTDENTDSEEHQEPPDLPVPELPDFFQGKHFFLYGEFPGDERRKLIRYVTAFNGELEDYMSDRVQFVITAQEWDPSFEEALMDNPSLAFVRPRWIYSCNEKQKLLPHQLYGVVPQA

SEQ ID NO: 914563 - protein, 635 aa, Homo sapiens
REIRPSDASVDVQRETRTRTHCAENLLKADTYRKWRAAKAGEKTISVVLQLEKEEQIHSVDIGNDGSAFVEVLVGSSAGGAGEQDYEVLLVTSSFMSPSESRSGSNPNRVRMFGPDKLVRAAAEKRWDRVKIVCSQPYSKDSPFGLSFVRFHSPPDKDEAEAPSQKVTVTKLGQFRVKEEDESANSLRPGALFFSRINKTSPVTASDPAGPSYAAATLQASSAASSASPVSRAIGSTSKPQESPKGKRKLDLNQEEKKTPSKPPAQLSPSVPKRPKLPAPTRTPATAPVPARAQGAVTGKPRGEGTEPRRPRAGPEELGKILQGVVVVLSGFQNPFRSELRDKALELGAKYRPDWTRDSTHLICAFANTPKYSQVLGLGGRIVRKEWVLDCHRMRRRLPSRRYLMAGPGSSSEEDEASHSGGSGDEAPKLPQKQPQTKTKPTQAAGPSSPQKPPTPEETKAASPVLQEDIDIEGVQSEGQDNGAEDSGDTEDELRRVAEQKEHRLPPGQEENGEDPYAGSTDENTDSEEHQEPPDLPVPELPDFFQGKHFFLYGEFPGDERRKLIRYVTAFNGELEDYMSDRVQFVITAQEWDPSFEEALMDNPSLAFVRPRWIYSCNEKQKLLPHQLYGVVPQA

SEQ ID NO: 914564 - protein, 603 aa, Homo sapiens
LGTRLSKRAGEKTISVAYLEKEEQIHSVDIGNDGSAFVEVLVGSSAGGAGEQDYEVLLVTSSFMSPSESRSGSNPNRVRMFGPDKLVRAAAEKRWDRVKIVCSQPYSKDSPFGLSFVRFHSPPDKDEAEAPSQKVTVTKLGQFRVKEEDESANSLRPGALFFSRINKTSPVTASDPAGPSYAAATLQASSAASSASPVSRAIGSTSKPQESPKGKRKLDLNQEEKKTPSKPPAQLSPSVPKRPKLPAPTRTPATAPVPARAQGAVTGKPRGEGTEPRRPRAGPEELGKILQGVVVVLSGFQNPFRSELRDKALELGAKYRPDWTRDSTHLICAFANTPKYSQVLGLGGRIVRKEWVLDCHRMRRRLPSRRYLMAGPGSSSEEDEASHSGGSGDEAPKLPQKQPQTKTKPTQAAGPSSPQKPPTPEETKAASPVLQEDIDIEGVQSEGQDNGAEDSGDTEDELRRVAEQKEHRLPPGQEENGEDPYAGSTDENTDSEEHQEPPDLPVPELPDFFQGKHFFLYGEFPGDERRKLIRYVTAFNGELEDYMSDRVQFVITAQEWDPSFEEALMDNPSLAFVRPRWIYSCNEKQKLLPHQLYGVVPQA

SEQ ID NO: 914565 - protein, 486 aa, Homo sapiens
MIWKTPWENLDKGRSHKVTVTKLGQFRVKEEDESANSLRPGALFFSRINKTSPVTASDPAGPSYAAATLQASSAASSASPVSRAIGSTSKPQESPKGKRKLDLNQEEKKTPSKPPAQLSPSVPKRPKLPAPTRTPATAPVPARAQGAVTGKPRGEGTEPRRPRAGPEELGKILQGVVVVLSGFQNPFRSELRDKALELGAKYRPDWTRDSTHLICAFANTPKYSQVLGLGGRIVRKEWVLDCHRMRRRLPSRRYLMAGPGSSSEEDEASHSGGSGDEAPKLPQKQPQTKTKPTQAAGPSSPQKPPTPEETKAASPVLQEDIDIEGVQSEGQDNGAEDSGDTEDELRRVAEQKEHRLPPGQEENGEDPYAGSTDENTDSEEHQEPPDLPVPELPDFFQGKHFFLYGEFPGDERRKLIRYVTAFNGELEDYMSDRVQFVITAQEWDPSFEEALMDNPSLAFVRPRWIYSCNEKQKLLPHQLYGVVPQA

SEQ ID NO: 914566 - protein, 485 aa, Homo sapiens
MPLHSRPGQQEQNFISRKKKLARRGGRCLSQLLRRLMRPGALFFSRINKTSPVTASDPAGPSYAAATLQASSAASSASPVSRAIGSTSKPQESPKGKRKLDLNQEEKKTPSKPPAQLSPSVPKRPKLPAPTRTPATAPVPARAQGAVTGKPRGEGTEPRRPRAGPEELGKILQGVVVVLSGFQNPFRSELRDKALELGAKYRPDWTRDSTHLICAFANTPKYSQVLGLGGRIVRKEWVLDCHRMRRRLPSRRYLMAGPGSSSEEDEASHSGGSGDEAPKLPQKQPQTKTKPTQAAGPSSPQKPPTPEETKAASPVLQEDIDIEGVQSEGQDNGAEDSGDTEDELRRVAEQKEHRLPPGQEENGEDPYAGSTDENTDSEEHQEPPDLPVPELPDFFQGKHFFLYGEFPGDERRKLIRYVTAFNGELEDYMSDRVQFVITAQEWDPSFEEALMDNPSLAFVRPRWIYSCNEKQKLLPHQLYGVVPQA

SEQ ID NO: 914567 - protein, 300 aa, Homo sapiens
LLAVRNLRPGDSQTAAQARDQTAALLNSAGLGAADLFVLPANCGSSDGCEELERLRAALQSQAEALRRLLPPAQDGFEVLGAAELEAVREAFETGGLEAALSWVRSGLERLGSARLDLAVAGKADVGLVVDMLLGLDPGDPGAAPASVPTAPTPFPAPERPNVVLWTVPLGHTGTATTAAAASHPTHYDALILVTPGAPTEKDWAQVQALLLPDAPLVCVRTDGEGEDPECLGEGKMENPKGESLKNAGGGGLENALSKGREKCSAGSQKAGVMPEIISEKARQFCVCVCAHRGVLVVLI

SEQ ID NO: 914568 - protein, 494 aa, Homo sapiens
LLAVRNLRPGDSQTAAQARDQTAALLNSAGLGAADLFVLPANCGSSDGCEELERLRAALQSQAEALRRLLPPAQDGFEVLGAAELEAVREAFETGGLEAALSWVRSGLERLGSARLDLAVAGKADVGLVVDMLLGLDPGDPGAAPASVPTAPTPFPAPERPNVVLWTVPLGHTGTATTAAAASHPTHYDALILVTPGAPTEKDWAQVQALLLPDAPLVCVRTDGEGEDPECLGEGKMENPKGESLKNAGGGGLENALSKGREKCSAGSQKAGSGEGPGKAGSEGLQQVVGMKKSGGGDSERAAALSPEDETWEVLEEAPPPVFPLRPGGLPGLCEWLRRALPPAQAGALLLALPPASPSAARTKAAALRAGAWRPALLASLAAAAAPLPGLGWACDVALLRGQLAEWRRGLGLEPTALARRERALGLASGELAARAHFPGPVTRAEVEARLGAWAGEGTAGGAALGALSFLWPAGGAAATGGLGYRAAHGVLLQ

SEQ ID NO: 914569 - protein, 357 aa, Homo sapiens
PPRPDPFPSPASQCLGPGILASACGAGGTRFPPPRGSASGLVLSPAAPCRRSHRSSYRREWRADQGAAGLPSAIPVSLRPRGPPEPATMPLGLKPTCSVCKTTSSSMWKKGAQGEILCHHCTGRGGAGSGGAGSGAAGGTGGSGGGGFGAATFASTSATPPQSNGGGGGKQSKQEIHRRSARLRNTKYKSAPAAEKKVSTKGKGRRHIFKLKNPIKAPESVSTIITAESIFYKGVYYQIGDVVSVIDEQDGKPYYAQIRGFIQDQYCEKSAALTWLIPTLSSPRDQFDPASYIIGPEEDLPRKMEYLEFVCHAPSEYFKSRSSPFPTVPTRPEKGYIWTHVGPTPAITIKESVANHL

SEQ ID NO: 914570 - protein, 140 aa, Homo sapiens
MFYFYFQCGIIFCFPQGVYYQIGDVVSVIDEQDGKPYYAQIRGFIQDQYCEKSAALTWLIPTLSSPRDQFDPASYIIGPEEDLPRKMEYLEFVCHAPSEYFKSRSSPFPTVPTRPEKGYIWTHVGPTPAITIKESVANHL

SEQ ID NO: 914571 - protein, 357 aa, Homo sapiens; identical to SEQ ID NO: 914569

SEQ ID NO: 914572 - protein, 321 aa, Homo sapiens
MADSMQEKQRMAGQMLLQTFFNIDQISPNKKAHPNMEAGPPESGESTDALKLCPHEEFLRLCKERAEEIYPIKERNNRTRLALIICNTEFDHLPPRNGADFDITGMKELLEGLDYSVDVEENLTARDMESALRAFATRPEHKSSDSTFLVLMSHGILEGICGTVHDEKKPDVLLYDTIFQIFNNRNCLSLKDKPKVIIVQACRGANRGELWVRDSPASLEVASSQSSENLEEDAVYKTHVEKDFIAFCSSTPHNVSWRDSTMGSIFITQLITCFQKYSWCCHLEEVFRKVQQSFETPRAKAQMPTIERLSMTRYFYLFPGN

SEQ ID NO: 914573 - protein, 286 aa, Homo sapiens
MEAGPPESGESTDALKLCPHEEFLRLCKERAEEIYPIKERNNRTRLALIICNTEFDHLPPRNGADFDITGMKELLEGLDYSVDVEENLTARDMESALRAFATRPEHKSSDSTFLVLMSHGILEGICGTVHDEKKPDVLLYDTIFQIFNNRNCLSLKDKPKVIIVQACRGANRGELWVRDSPASLEVASSQSSENLEEDAVYKTHVEKDFIAFCSSTPHNVSWRDSTMGSIFITQLITCFQKYSWCCHLEEVFRKVQQSFETPRAKAQMPTIERLSMTRYFYLFPGN

SEQ ID NO: 914574 - protein, 394 aa, Homo sapiens
NYRQVARLGVESAEGLSLWQGNHRKKPLKVLESLGKDFLTGVLDNLVEQNVLNWKEEEKKKYYDAKTEDKVRVMADSMQEKQRMAGQMLLQTFFNIDQISPNKKAHPNMEAGPPESGESTDALKLCPHEEFLRLCKERAEEIYPIKERNNRTRLALIICNTEFDHLPPRNGADFDITGMKELLEGLDYSVDVEENLTARDMESALRAFATRPEHKSSDSTFLVLMSHGILEGICGTVHDEKKPDVLLYDTIFQIFNNRNCLSLKDKPKVIIVQACRGANRGELWVRDSPASLEVASSQSSENLEEDAVYKTHVEKDFIAFCSSTPHNVSWRDSTMGSIFITQLITCFQKYSWCCHLEEVFRKVQQSFETPRAKAQMPTIERLSMTRYFYLFPGN

SEQ ID NO: 914575 - protein, 321 aa, Homo sapiens; identical to SEQ ID NO: 914572

SEQ ID NO: 914576 - protein, 320 aa, Homo sapiens
MDKGVICPELLQPFGERDRGYLSPLQAALVFWTQVVCTPPESGESTDALKLCPHEEFLRLCKERAEEIYPIKERNNRTRLALIICNTEFDHLPPRNGADFDITGMKELLEGLDYSVDVEENLTARDMESALRAFATRPEHKSSDSTFLVLMSHGILEGICGTVHDEKKPDVLLYDTIFQIFNNRNCLSLKDKPKVIIVQACRGANRGELWVRDSPASLEVASSQSSENLEEDAVYKTHVEKDFIAFCSSTPHNVSWRDSTMGSIFITQLITCFQKYSWCCHLEEVFRKVQQSFETPRAKAQMPTIERLSMTRYFYLFPGN

SEQ ID NO: 914577 - protein, 377 aa, Homo sapiens
MAEGNHRKKPLKVLESLGKDFLTGVLDNLVEQNVLNWKEEEKKKYYDAKTEDKVRVMADSMQEKQRMAGQMLLQTFFNIDQISPNKKAHPNMEAGPPESGESTDALKLCPHEEFLRLCKERAEEIYPIKERNNRTRLALIICNTEFDHLPPRNGADFDITGMKELLEGLDYSVDVEENLTARDMESALRAFATRPEHKSSDSTFLVLMSHGILEGICGTVHDEKKPDVLLYDTIFQIFNNRNCLSLKDKPKVIIVQACRGANRGELWVRDSPASLEVASSQSSENLEEDAVYKTHVEKDFIAFCSSTPHNVSWRDSTMGSIFITQLITCFQKYSWCCHLEEVFRKVQQSFETPRAKAQMPTIERLSMTRYFYLFPGN

SEQ ID NO: 914578 - protein, 359 aa, Homo sapiens
MAEGNHRKKPLKVLESLGKDFLTGVLDNLVEQNVLNWKEEEKKKYYDAKTEDKVRVMADSMQEKQRMAGQMLLQTFFNIDQISPNKKAHPNMEAGPPESGESTDALKLCPHEEFLRLCKERAEEIYPIKERNNRTRLALIICNTEFDHLPPRNGADFDITGMKELLEGLDYSVDVEENLTARDMESALRAFATRPEHKSSDSTFLVLMSHGILEGICGTVHDENCLSLKDKPKVIIVQACRGANRGELWVRDSPASLEVASSQSSENLEEDAVYKTHVEKDFIAFCSSTPHNVSWRDSTMGSIFITQLITCFQKYSWCCHLEEVFRKVQQSFETPRAKAQMPTIERLSMTRYFYLFPGN

SEQ ID NO: 914579 - protein, 263 aa, Homo sapiens
MAEGNHRKKPLKVLESLGKDFLTGVLDNLVEQNVLNWKEEEKKKYYDAKTEDKVRVMADSMQEKQRMAGQMLLQTFFNIDQISPNKKAHPNMEAGPPESGESTDALKLCPHEEFLRLCKERAEEIYPIKERNNRTRLALIICNTEFDHLPPRNGADFDITGMKELLEGLDYSVDVEENLTARDMESALRAFATRPEHKSSDSTFLVLMSHGILEGICGTVHDEKKPDVLLYDTIFQIFNNRNCLSLKDKPKVIIVQACRGGEC

SEQ ID NO: 914580 - protein, 377 aa, Homo sapiens; identical to SEQ ID NO: 914577

SEQ ID NO: 914581 - protein, 263 aa, Homo sapiens; identical to SEQ ID NO: 914579

SEQ ID NO: 914582 - protein, 321 aa, Homo sapiens; identical to SEQ ID NO: 914572

SEQ ID NO: 914583 - protein, 377 aa, Homo sapiens; identical to SEQ ID NO: 914577

SEQ ID NO: 914584 - protein, 361 aa, Homo sapiens
MAEGNHRKKPLKVLESLGKDFLTGVLDNLVEQNVLNWKEEEKKKYYDAKTEDKVRVMADSMQEKQRMAGQMLLQTFFNIDQISPNKKDALKLCPHEEFLRLCKERAEEIYPIKERNNRTRLALIICNTEFDHLPPRNGADFDITGMKELLEGLDYSVDVEENLTARDMESALRAFATRPEHKSSDSTFLVLMSHGILEGICGTVHDEKKPDVLLYDTIFQIFNNRNCLSLKDKPKVIIVQACRGANRGELWVRDSPASLEVASSQSSENLEEDAVYKTHVEKDFIAFCSSTPHNVSWRDSTMGSIFITQLITCFQKYSWCCHLEEVFRKVQQSFETPRAKAQMPTIERLSMTRYFYLFPGN

SEQ ID NO: 914585 - protein, 390 aa, Homo sapiens
MAEGNHRKKPLKVLESLGKDFLTGVLDNLVEQNVLNWKEEEKKKYYDAKTEDKVRVMADSMQEKQRMAGQMLLQTFFNIDQISPNKKAHPNMEAGPPESGESTDALKLCPHEEFLRLCKERAEEIYPIKERNNRTRLALIICNTEFDHLPPRNGADFDITGMKELLEGLDYSVDVEENLTARDMESALRAFATRPEHKSSDSTFLVLMSHGILEGICGTVHDEKKPDVLLYDTIFQIFNNRNCLSLKDKPKVIIVQACRGANRGELWVRDSPASLEVASSQSSENLEEDAVYKTHVEKDFIAFCSSTPHNVSWRDSTMGSIFITQLITCFQKYSWCCHLEEVFRKVSVSFLVTHLFLQEEFVMIHFLLHNDNFCQGSESREVPSFCHSVV

SEQ ID NO: 914586 - protein, 157 aa, Homo sapiens
MAEGNHRKKPLKVLESLGKDFLTGVLDNLVEQNVLNWKEEEKKKYYDAKTEDKVRVMADSMQEKQRMAGQMLLQTFFNIDQISPNKKAHPNMEAGPPESGESTDALKLCPHEEFLRLCKERAEEVLCYLYEIEKKEEISLLSFSAPFLTALNDWGWG

SEQ ID NO: 914587 - protein, 1511 aa, Homo sapiens
AHSWDVGRGRAGAVGSRPWWLRASERPSAPSAMAKRSRGPGRRCLLALVLFCAWGTLAVVAQKPGAGCPSRCLCFRTTVRCMHLLLEAVPAVAPQTSILDLRFNRIREIQPGAFRRLRNLNTLLLNNNQIKRIPSGAFEDLENLKYLYLYKNEIQSIDRQAFKGLASLEQLYLHFNQIETLDPDSFQHLPKLERLFLHNNRITHLVPGTFNHLESMKRLRLDSNTLHCDCEILWLADLLKTYAESGNAQAAAICEYPRRIQGRSVATITPEELNCERPRITSEPQDADVTSGNTVYFTCRAEGNPKPEIIWLRNNNELSMKTDSRLNLLDDGTLMIQNTQETDQGIYQCMAKNVAGEVKTQEVTLRYFGSPARPTFVIQPQNTEVLVGESVTLECSATGHPPPRISWTRGDRTPLPVDPRVNITPSGGLYIQNVVQGDSGEYACSATNNIDSVHATAFIIVQALPQFTVTPQDRVVIEGQTVDFQCEAKGNPPPVIAWTKGGSQLSVDRRHLVLSSGTLRISGVALHDQGQYECQAVNIIGSQKVVAHLTVQPRVTPVFASIPSDTTVEVGANVQLPCSSQGEPEPAITWNKDGVQVTESGKFHISPEGFLTINDVGPADAGRYECVARNTIGSASVSMVLSVNVPDVSRNGDPFVATSIVEAIATVDRAINSTRTHLFDSRPRSPNDLLALFRYPRDPYTVEQARAGEIFERTLQLIQEHVQHGLMVDLNGTSYHYNDLVSPQYLNLIANLSGCTAHRRVNNCSDMCFHQKYRTHDGTCNNLQHPMWGASLTAFERLLKSVYENGFNTPRGINPHRLYNGHALPMPRLVSTTLIGTETVTPDEQFTHMLMQWGQFLDHDLDSTVVALSQARFSDGQHCSNVCSNDPPCFSVMIPPNDSRARSGARCMFFVRSSPVCGSGMTSLLMNSVYPREQINQLTSYIDASNVYGSTEHEARSIRDLASHRGLLRQGIVQRSGKPLLPFATGPPTECMRDENESPIPCFLAGDHRANEQLGLTSMHTLWFREHNRIATELLKLNPHWDGDTIYYETRKIVGAEIQHITYQHWLPKILGEVGMRTLGEYHGYDPGINAGIFNAFATAAFRFGHTLVNPLLYRLDENFQPIAQDHLPLHKAFFSPFRIVNEGGIDPLLRGLFGVAGKMRVPSQLLNTELTERLFSMAHTVALDLAAINIQRGRDHGIPPYHDYRVYCNLSAAHTFEDLKNEIKNPEIREKLKRLYGSTLNIDLFPALVVEDLVPGSRLGPTLMCLLSTQFKRLRDGDRLWYENPGVFSPAQLTQIKQTSLARILCDNADNITRVQSDVFRVAEFPHGYGSCDEIPRVDLRVWQDCCEDCRTRGQFNAFSYHFRGRRSLEFSYQEDKPTKKTRPRKIPSVGRQGEHLSNSTSAFSTRSDASGTNDFREFVLEMQKTITDLRTQIKKLESRLSTTECVDAGGESHANNTKWKKDACTICECKDGQVTCFVEACPPATCAVPVNIPGACCPVCLQKRAEEKP

SEQ ID NO: 914588 - protein, 1148 aa, Homo sapiens
MPTACFSYARPTFVIQPQNTEVLVGESVTLECSATGHPPPRISWTRGDRTPLPVDPRVNITPSGGLYIQNVVQGDSGEYACSATNNIDSVHATAFIIVQALPQFTVTPQDRVVIEGQTVDFQCEAKGNPPPVIAWTKGGSQLSVDRRHLVLSSGTLRISGVALHDQGQYECQAVNIIGSQKVVAHLTVQPRVTPVFASIPSDTTVEVGANVQLPCSSQGEPEPAITWNKDGVQVTESGKFHISPEGFLTINDVGPADAGRYECVARNTIGSASVSMVLSVNVPDVSRNGDPFVATSIVEAIATVDRAINSTRTHLFDSRPRSPNDLLALFRYPRDPYTVEQARAGEIFERTLQLIQEHVQHGLMVDLNGTSYHYNDLVSPQYLNLIANLSGCTAHRRVNNCSDMCFHQKYRTHDGTCNNLQHPMWGASLTAFERLLKSVYENGFNTPRGINPHRLYNGHALPMPRLVSTTLIGTETVTPDEQFTHMLMQWGQFLDHDLDSTVVALSQARFSDGQHCSNVCSNDPPCFSVMIPPNDSRARSGARCMFFVRSSPVCGSGMTSLLMNSVYPREQINQLTSYIDASNVYGSTEHEARSIRDLASHRGLLRQGIVQRSGKPLLPFATGPPTECMRDENESPIPCFLAGDHRANEQLGLTSMHTLWFREHNRIATELLKLNPHWDGDTIYYETRKIVGAEIQHITYQHWLPKILGEVGMRTLGEYHGYDPGINAGIFNAFATAAFRFGHTLVNPLLYRLDENFQPIAQDHLPLHKAFFSPFRIVNEGGIDPLLRGLFGVAGKMRVPSQLLNTELTERLFSMAHTVALDLAAINIQRGRDHGIPPYHDYRVYCNLSAAHTFEDLKNEIKNPEIREKLKRLYGSTLNIDLFPALVVEDLVPGSRLGPTLMCLLSTQFKRLRDGDRLWYENPGVFSPAQLTQIKQTSLARILCDNADNITRVQSDVFRVAEFPHGYGSCDEIPRVDLRVWQDCCEDCRTRGQFNAFSYHFRGRRSLEFSYQEDKPTKKTRPRKIPSVGRQGEHLSNSTSAFSTRSDASGTNDFREFVLEMQKTITDLRTQIKKLESRLSTTECVDAGGESHANNTKWKKDACTICECKDGQVTCFVEACPPATCAVPVNIPGACCPVCLQKRAEEKP

SEQ ID NO: 914589 - protein, 254 aa, Homo sapiens
ERERERERERERERERERERADRLWYENPGVFSPAQLTQIKQTSLARILCDNADNITRVQSDVFRVAEFPHGYGSCDEIPRVDLRVWQDCCEDCRTRGQFNAFSYHFRGRRSLEFSYQEDKPTKKTRPRKIPSVGRQGEHLSNSTSAFSTRSDASGTNDFREFVLEMQKTITDLRTQIKKLESRLSTTECVDAGGESHANNTKWKKDACTICECKDGQVTCFVEACPPATCAVPVNIPGACCPVCLQKRAEEKP

SEQ ID NO: 914590 - protein, 1390 aa, Homo sapiens
AHSWDVGRGRAGAVGSRPWWLRASERPSAPSAMAKRSRGPGRRCLLALVLFCAWGTLAVVAQKPGAGCPSRCLCFRTTVRCMHLLLEAVPAVAPQTSILDLRFNRIREIQPGAFRRLRNLNTLLLNNNQIKRIPSGAFEDLENLKYLYLYKNEIQSIDRQAFKGLASLEQLYLHFNQIETLDPDSFQHLPKLERLFLHNNRITHLVPGTFNHLESMKRLRLDSNTLHCDCEILWLADLLKTYAESGNAQAAAICEYPRRIQGRSVATITPEELNCERPRITSEPQDADVTSGNTVYFTCRAEGNPKPEIIWLRNNNELSMKTDSRLNLLDDGTLMIQNTQETDQGIYQCMAKNVAGEVKTQEVTLRYFGSPARPTFVIQPQNTEVLVGESVTLECSATGHPPPRISWTRGDRTPLPVDPRVNITPSGGLYIQNVVQGDSGEYACSATNNIDSVHATAFIIVQALPQFTVTPQDRVVIEGQTVDFQCEAKGNPPPVIAWTKGGSQLSVDRRHLVLSSGTLRISGVALHDQGQYECQAVNIIGSQKVVAHLTVQPRVTPVFASIPSDTTVEVGANVQLPCSSQGEPEPAITWNKDGVQVTESGKFHISPEGFLTINDVGPADAGRYECVARNTIGSASVSMVLSVNVPDVSRNGDPFVATSIVEAIATVDRAINSTRTHLFDSRPRSPNDLLALFRYPRDPYTVEQARAGEIFERTLQLIQEHVQHGLMVDLNGTSYHYNDLVSPQYLNLIANLSGCTAHRRVNNCSDMCFHQKYRTHDGTCNNLQHPMWGASLTAFERLLKSVYENGFNTPRGINPHRLYNGHALPMPRLVSTTLIGTETVTPDEQFTHMLMQWGQFLDHDLDSTVVALSQARFSDGQHCSNVCSNDPPCFSVMIPPNDSRARSGARCMFFVRSSPVCGSGMTSLLMNSVYPREQINQLTSYIDASNVYGSTEHEARSIRDLASHRGLLRQGIVQRSGKPLLPFATGPPTECMRDENESPIPCFLAGDHRANEQLGLTSMHTLWFREHNRIATELLKLNPHWDGDTIYYETRKIVGAEIQHITYQHWLPKILGEVGMRTLGEYHGYDPGINAGIFNAFATAAFRFGHTLVNPLLYRLDENFQPIAQDHLPLHKAFFSPFRIVNEGGIDPLLRGLFGVAGKMRVPSQLLNTELTERLFSMAHTVALDLAAINIQRGRDHGIPPYHDYRVYCNLSAAHTFEDLKNEIKNPEIREKLKRLYGSTLNIDLFPALVVEDLVPGSRLGPTLMCLLSTQFKRLRDGDRLWYENPGVFSPAQLTQIKQTSLARILCDNADNITRVQSDVFRVAEFPHGYGSCDEIPRVDLRVWQDCCEDCRTRGQFNAFSYHFRGRRSLEFSYQEDKPTKKTRPRKIPR

SEQ ID NO: 914591 - protein, 1511 aa, Homo sapiens; identical to SEQ ID NO: 914587

SEQ ID NO: 914592 - protein, 1511 aa, Homo sapiens; identical to SEQ ID NO: 914587

SEQ ID NO: 914593 - protein, 65 aa, Homo sapiens
RPPLGGGYTHSHNLKLDSSRHLSSSSLGKSHPEAALVQDVDATRAGWERRCQHTPLAPGLFPGNL

SEQ ID NO: 914594 - protein, 981 aa, Homo sapiens
AHSWDVGRGRAGAVGSRPWWLRASERPSAPSAMAKRSRGPGRRCLLALVLFCAWGTLAVVAQKPGAGCPSRCLCFRTTVRCMHLLLEAVPAVAPQTSILDLRFNRIREIQPGAFRRLRNLNTLLLNNNQIKRIPSGAFEDLENLKYLYLYKNEIQSIDRQAFKGLASLEQLYLHFNQIETLDPDSFQHLPKLERLFLHNNRITHLVPGTFNHLESMKRLRLDSNTLHCDCEILWLADLLKTYAESGNAQAAAICEYPRRIQGRSVATITPEELNCERPRITSEPQDADVTSGNTVYFTCRAEGNPKPEIIWLRNNNELSMKTDSRLNLLDDGTLMIQNTQETDQGIYQCMAKNVAGEVKTQEVTLRYFGSPARPTFVIQPQNTEVLVGESVTLECSATGHPPPRISWTRGDRTPLPVDPRVNITPSGGLYIQNVVQGDSGEYACSATNNIDSVHATAFIIVQALPQFTVTPQDRVVIEGQTVDFQCEAKGNPPPVIAWTKGGSQLSVDRRHLVLSSGTLRISGVALHDQGQYECQAVNIIGSQKVVAHLTVQPRVTPVFASIPSDTTVEVGANVQLPCSSQGEPEPAITWNKDGVQVTESGKFHISPEGFLTINDVGPADAGRYECVARNTIGSASVSMVLSVNVPDVSRNGDPFVATSIVEAIATVDRAINSTRTHLFDSRPRSPNDLLALFRYPRDPYTVEQARAGEIFERTLQLIQEHVQHGLMVDLNGTSYHYNDLVSPQYLNLIANLSGCTAHRRVNNCSDMCFHQKYRTHDGTCNNLQHPMWGASLTAFERLLKSVYENGFNTPRGINPHRLYNGHALPMPRLVSTTLIGTETVTPDEQFTHMLMQWGQFLDHDLDSTVVALSQARFSDGQHCSNVRGRFGSGWQVSSTGVWRRGFHGVGEASFLLTGWAHTVPGVICAQPVFQVHILPRRHPDPSSTGRPSCCGGGSISAVRKVIGFMCFICKNGCLNFLTSYW

SEQ ID NO: 914595 - protein, 1511 aa, Homo sapiens; identical to SEQ ID NO: 914587

SEQ ID NO: 914596 - protein, 1292 aa, Homo sapiens
AHSWDVGRGRAGAVGSRPWWLRASERPSAPSAMAKRSRGPGRRCLLALVLFCAWGTLAVVAQKPGAGCPSRCLCFRTTVRCMHLLLEAVPAVAPQTSILDLRFNRIREIQPGAFRRLRNLNTLLLNNNQIKRIPSGAFEDLENLKYLYLYKNEIQSIDRQAFKGLASLEQLYLHFNQIETLDPDSFQHLPKLERLFLHNNRITHLVPGTFNHLESMKRLRLDSNTLHCDCEILWLADLLKTYAESGNAQAAAICEYPRRIQGRSVATITPEELNCERPRITSEPQDADVTSGNTVYFTCRAEGNPKPEIIWLRNNNELSMKTDSRLNLLDDGTLMIQNTQETDQGIYQCMAKNVAGEVKTQEVTLRYFGSPARPTFVIQPQNTEVLVGESVTLECSATGHPPPRISWTRGDRTPLPVDPRVNITPSGGLYIQNVVQGDSGEYACSATNNIDSVHATAFIIVQALPQFTVTPQDRVVIEGQTVDFQCEAKGNPPPVIAWTKGGSQLSVDRRHLVLSSGTLRISGVALHDQGQYECQAVNIIGSQKVVAHLTVQPRVTPVFASIPSDTTVEVGANVQLPCSSQGEPEPAITWNKDGVQVTESGKFHISPEGFLTINDVGPADAGRYECVARNTIGSASVSMVLSVNVPDVSRNGDPFVATSIVEAIATVDRAINSTRTHLFDSRPRSPNDLLALFRYPRDPYTVEQARAGEIFERTLQLIQEHVQHGLMVDLNGTSYHYNDLVSPQYLNLIANLSGCTAHRRVNNCSDMCFHQKYRTHDGTCNNLQHPMWGASLTAFERLLKSVYENGFNTPRGINPHRLYNGHALPMPRLVSTTLIGTETVTPDEQFTHMLMQWGQFLDHDLDSTVVALSQARFSDGQHCSNVCSNDPPCFSVMIPPNDSRARSGARCMFFVRSSPVCGSGMTSLLMNSVYPREQINQLTSYIDASNVYGSTEHEARSIRDLASHRGLLRQGIVQRSGKPLLPFATGPPTECMRDENESPIPCFLAGDHRANEQLGLTSMHTLWFREHNRIATELLKLNPHWDGDTIYYETRKIVGAEIQHITYQHWLPKILGEVGMRTLGEYHGYDPGINAGIFNAFATAAFRFGHTLVNPLLYRLDENFQPIAQDHLPLHKAFFSPFRIVNEGGIDPLLRGLFGVAGKMRVPSQLLNTELTERLFSMAHTVALDLAAINIQRGRDHGIPPYHDYRVYCNLSAAHTFEDLKNEIKNPEIREKLKRLYGSTLNIDLFPALVVEDLVPGSRLGPTLMCLLSTQFKRLRDGDRVVVSDLGVSATK

SEQ ID NO: 914597 - protein, 1525 aa, Homo sapiens
AHSWDVGRGRAGAVGSRPWWLRASERPSAPSAMAKRSRGPGRRCLLALVLFCAWGTLAVVAQKPGAGCPSRCLCFRTTVRCMHLLLEAVPAVAPQTSILNCRSYPSLQQPHPDPSAASNIKARFSTSQKKKTLCRLRDLRFNRIREIQPGAFRRLRNLNTLLLNNNQIKRIPSGAFEDLENLKYLYLHFNQIETLDPDSFQHLPKLERLFLHNNRITHLVPGTFNHLESMKRLRLDSNTLHCDCEILWLADLLKTYAESGNAQAAAICEYPRRIQGRSVATITPEELNCERPRITSEPQDADVTSGNTVYFTCRAEGNPKPEIIWLRNNNELSMKTDSRLNLLDDGTLMIQNTQETDQGIYQCMAKNVAGEVKTQEVTLRYFGSPARPTFVIQPQNTEVLVGESVTLECSATGHPPPRISWTRGDRTPLPVDPRVNITPSGGLYIQNVVQGDSGEYACSATNNIDSVHATAFIIVQALPQFTVTPQDRVVIEGQTVDFQCEAKGNPPPVIAWTKGGSQLSVDRRHLVLSSGTLRISGVALHDQGQYECQAVNIIGSQKVVAHLTVQPRVTPVFASIPSDTTVEVGANVQLPCSSQGEPEPAITWNKDGVQVTESGKFHISPEGFLTINDVGPADAGRYECVARNTIGSASVSMVLSVNVPDVSRNGDPFVATSIVEAIATVDRAINSTRTHLFDSRPRSPNDLLALFRYPRDPYTVEQARAGEIFERTLQLIQEHVQHGLMVDLNGTSYHYNDLVSPQYLNLIANLSGCTAHRRVNNCSDMCFHQKYRTHDGTCNNLQHPMWGASLTAFERLLKSVYENGFNTPRGINPHRLYNGHALPMPRLVSTTLIGTETVTPDEQFTHMLMQWGQFLDHDLDSTVVALSQARFSDGQHCSNVCSNDPPCFSVMIPPNDSRARSGARCMFFVRSSPVCGSGMTSLLMNSVYPREQINQLTSYIDASNVYGSTEHEARSIRDLASHRGLLRQGIVQRSGKPLLPFATGPPTECMRDENESPIPCFLAGDHRANEQLGLTSMHTLWFREHNRIATELLKLNPHWDGDTIYYETRKIVGAEIQHITYQHWLPKILGEVGMRTLGEYHGYDPGINAGIFNAFATAAFRFGHTLVNPLLYRLDENFQPIAQDHLPLHKAFFSPFRIVNEGGIDPLLRGLFGVAGKMRVPSQLLNTELTERLFSMAHTVALDLAAINIQRGRDHGIPPYHDYRVYCNLSAAHTFEDLKNEIKNPEIREKLKRLYGSTLNIDLFPALVVEDLVPGSRLGPTLMCLLSTQFKRLRDGDRLWYENPGVFSPAQLTQIKQTSLARILCDNADNITRVQSDVFRVAEFPHGYGSCDEIPRVDLRVWQDCCEDCRTRGQFNAFSYHFRGRRSLEFSYQEDKPTKKTRPRKIPSVGRQGEHLSNSTSAFSTRSDASGTNDFREFVLEMQKTITDLRTQIKKLESRLSTTECVDAGGESHANNTKWKKDACTICECKDGQVTCFVEACPPATCAVPVNIPGACCPVCLQKRAEEKP

SEQ ID NO: 914598 - protein, 480 aa, Homo sapiens
RTAGTWAAAGRAQSGAGRGGSVRPSVRPRRRPWPSVPKILGEVGMRTLGEYHGYDPGINAGIFNAFATAAFRFGHTLVNPLLYRLDENFQPIAQDHLPLHKAFFSPFRIVNEGGIDPLLRGLFGVAGKMRVPSQLLNTELTERLFSMAHTVALDLAAINIQRGRDHGIPPYHDYRVYCNLSAAHTFEDLKNEIKNPEIREKLKRLYGSTLNIDLFPALVVEDLVPGSRLGPTLMCLLSTQFKRLRDGDRLWYENPGVFSPAQLTQIKQTSLARILCDNADNITRVQSDVFRVAEFPHGYGSCDEIPRVDLRVWQDCCEDCRTRGQFNAFSYHFRGRRSLEFSYQEDKPTKKTRPRKIPSVGRQGEHLSNSTSAFSTRSDASGTNDFREFVLEMQKTITDLRTQIKKLESRLSTTECVDAGGESHANNTKWKKDACTICECKDGQVTCFVEACPPATCAVPVNIPGACCPVCLQKRAEEKP

SEQ ID NO: 914599 - protein, 1511 aa, Homo sapiens; identical to SEQ ID NO: 914587

SEQ ID NO: 914600 - protein, 1511 aa, Homo sapiens; identical to SEQ ID NO: 914587

SEQ ID NO: 914601 - protein, 65 aa, Homo sapiens; identical to SEQ ID NO: 914593

SEQ ID NO: 914602 - protein, 1511 aa, Homo sapiens; identical to SEQ ID NO: 914587

SEQ ID NO: 914603 - protein, 1511 aa, Homo sapiens; identical to SEQ ID NO: 914587

SEQ ID NO: 914604 - protein, 190 aa, Homo sapiens
HIQVTLMQEVGSLGLQQLHPCHFAGYSFPPDYFHGLALNVCGFFQSLLSIRGSLFSPRRNSRASLFSFRGRAKDIGSENDFADDEHSTFEDNDSRRDSLFVPHRHGERRHSNVSQASRASRVLPILPMNGKMHSAVDCNGVVSLVGGPSTLTSAGQLLPEVRPIKIAADVKRVVTGAGRSVFPFPHLRIC

SEQ ID NO: 914605 - protein, 2005 aa, Homo sapiens
MAQSVLVPPGPDSFRFFTRESLAAIEQRIAEEKAKRPKQERKDEDDENGPKPNSDLEAGKSLPFIYGDIPPEMVSVPLEDLDPYYINKKTFIVLNKGKAISRFSATPALYILTPFNPIRKLAIKILVHSLFNMLIMCTILTNCVFMTMSNPPDWTKNVEYTFTGIYTFESLIKILARGFCLEDFTFLRDPWNWLDFTVITFAYVTEFVDLGNVSALRTFRVLRALKTISVIPGLKTIVGALIQSVKKLSDVMILTVFCLSVFALIGLQLFMGNLRNKCLQWPPDNSSFEINITSFFNNSLDGNGTTFNRTVSIFNWDEYIEDKSHFYFLEGQNDALLCGNSSDAGQCPEGYICVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMLEQLKKQQEEAQAAAAAASAESRDFSGAGGIGVFSESSSVASKLSSKSEKELKNRRKKKKQKEQSGEEEKNDRVLKSESEDSIRRKGFRFSLEGSRLTYEKRFSSPHQSLLSIRGSLFSPRRNSRASLFSFRGRAKDIGSENDFADDEHSTFEDNDSRRDSLFVPHRHGERRHSNVSQASRASRVLPILPMNGKMHSAVDCNGVVSLVGGPSTLTSAGQLLPEGTTTETEIRKRRSSSYHVSMDLLEDPTSRQRAMSIASILTNTMEELEESRQKCPPCWYKFANMCLIWDCCKPWLKVKHLVNLVVMDPFVDLAITICIVLNTLFMAMEHYPMTEQFSSVLSVGNLVFTGIFTAEMFLKIIAMDPYYYFQEGWNIFDGFIVSLSLMELGLANVEGLSVLRSFRLLRVFKLAKSWPTLNMLIKIIGNSVGALGNLTLVLAIIVFIFAVVGMQLFGKSYKECVCKISNDCELPRWHMHDFFHSFLIVFRVLCGEWIETMWDCMEVAGQTMCLTVFMMVMVIGNLVVLNLFLALLLSSFSSDNLAATDDDNEMNNLQIAVGRMQKGIDFVKRKIREFIQKAFVRKQKALDEIKPLEDLNNKKDSCISNHTTIEIGKDLNYLKDGNGTTSGIGSSVEKYVVDESDYMSFINNPSLTVTVPIAVGESDFENLNTEEFSSESDMEESKEKLNATSSSEGSTVDIGAPAEGEQPEVEPEESLEPEACFTEDCVRKFKCCQISIEEGKGKLWWNLRKTCYKIVEHNWFETFIVFMILLSSGALAFEDIYIEQRKTIKTMLEYADKVFTYIFILEMLLKWVAYGFQVYFTNAWCWLDFLIVDVSLVSLTANALGYSELGAIKSLRTLRALRPLRALSRFEGMRAVVNALLGAIPSIMNVLLVCLIFWLIFSIMGVNLFAGKFYHCINYTTGEMFDVSVVNNYSECKALIESNQTARWKNVKVNFDNVGLGYLSLLQVATFKGWMDIMYAAVDSRNVELQPKYEDNLYMYLYFVIFIIFGSFFTLNLFIGVIIDNFNQQKKKFGGQDIFMTEEQKKYYNAMKKLGSKKPQKPIPRPANKFQGMVFDFVTKQVFDISIMILICLNMVTMMVETDDQSQEMTNILYWINLVFIVLFTGECVLKLISLRYYYFTIGWNIFDFVVVILSIVGMFLAELIEKYFVSPTLFRVIRLARIGRILRLIKGAKGIRTLLFALMMSLPALFNIGLLLFLVMFIYAIFGMSNFAYVKREVGIDDMFNFETFGNSMICLFQITTSAGWDGLLAPILNSGPPDCDPDKDHPGSSVKGDCGNPSVGIFFFVSYIIISFLVVVNMYIAVILENFSVATEESAEPLSEDDFEMFYEVWEKFDPDATQFIEFAKLSDFADALDPPLLIAKPNKVQLIAMDLPMVSGDRIHCLDILFAFTKRVLGESGEMDALRIQMEERFMASNPSKVSYEPITTTLKRKQEEVSAIIIQRAYRRYLLKQKVKKVSSIYKKDKGKECDGTPIKEDTLIDKLNENSTPEKTDMTPSTTSPPSYDSVTKPEKEKFEKDKSEKEDKGKDIRESKK

SEQ ID NO: 914606 - protein, 2005 aa, Homo sapiens; identical to SEQ ID NO: 914605

SEQ ID NO: 914607 - protein, 128 aa, Homo sapiens
KLAKSWPTLNMLIKIIGNSVGALGNLTLVLAIIVFIFAVVGMQLFGKSYKECVCKISNDCELPRWHMHDFFHSFLIVFRVLCGEWIETMWDCMEVAGQTMCLTVFMMVMVIGNLVVCSKNIFLIFIKR

SEQ ID NO: 914608 - protein, 275 aa, Homo sapiens
PGGAGASGAERGAGPAAKVRGGIDVAAAADDPHPAGRLRRPTLAARQGARRAPRERVPARGSSAASPFGRSGSRLSGPAWRPRLRRGGRQRRPGMASAGSGMEEVRVSVLTPLKLVGLVCIFLALCLDLGAVLSPAWVTADHQYYLSLWESCRKPASLDIWHCESTLSSDWQIATLALLLGGAAIILIAFLVGLISICVGSRRRFYRPVAVMLFAAVVLQVCSLVLYPIKFIETVSLKIYHEFNWGYGLAWGATIFSFGGAILYCLNPKNYEDYY

SEQ ID NO: 914609 - protein, 275 aa, Homo sapiens; identical to SEQ ID NO: 914608

SEQ ID NO: 914610 - protein, 275 aa, Homo sapiens; identical to SEQ ID NO: 914608

SEQ ID NO: 914611 - protein, 275 aa, Homo sapiens; identical to SEQ ID NO: 914608

SEQ ID NO: 914612 - protein, 210 aa, Homo sapiens
AGRSGRERGRARRGAGGEGPGWNRRRCGCRRPTPGRPPPQTHLGRAAGGAQSPEGASPRAWQLGGFSLREVRLPALRTRLASSPAAGRTTAAPRNGFGGQRHGGDWQIATLALLLGGAAIILIAFLVGLISICVGSRRRFYRPVAVMLFAAVVLQVCSLVLYPIKFIETVSLKIYHEFNWGYGLAWGATIFSFGGAILYCLNPKNYEDYY

SEQ ID NO: 914613 - protein, 275 aa, Homo sapiens; identical to SEQ ID NO: 914608

SEQ ID NO: 914614 - protein, 239 aa, Homo sapiens
MAPSVPAAEPEYPKGIRAVLLGPPGAGKGTQAPRLAENFCVCHLATGDMLRAMVASGSELGKKLKATMDAGKLVSDEMVVELIEKNLETPLCKNGFLLDGFPRTVRQAEMLDDLMEKRKEKLDSVIEFSIPDSLLIRRITGRLIHPKSGRSYHEEFNPPKEPMKDDITGEPLIRRSDDNEKALKIRLQAYHTQTTPLIEYYRKRGIHSAIDASQTPDVVFASILAAFSKATCKDLVMFI

SEQ ID NO: 914615 - protein, 239 aa, Homo sapiens; identical to SEQ ID NO: 914614

SEQ ID NO: 914616 - protein, 112 aa, Homo sapiens
MATGHEYLATLLPSLPGPSECLLPLSCLVFLALNQLHPLLMETQSGFVCFWEAHDFWEWARKRSETKTVSYVCLVWDPSLGDSGIMNLRISSPLTRDNCKHLASKLRFLNVC

SEQ ID NO: 914617 - protein, 155 aa, Homo sapiens [sequence omitted]

SEQ ID NO: 914618 - protein, 155 aa, Homo sapiens
MVVELIEKNLETPLCKNGFLLDGFPRTVRQAEMLDDLMEKRKEKLDSVIEFSIPDSLLIRRITGRLIHPKSGRSYHEEFNPPKEPMKDDITGEPLIRRSDDNEKALKIRLQAYHTQTTPLIEYYRKRGIHSAIDASQTPDVVFASILAAFSKATC

SEQ ID NO: 914619 - protein, 155 aa, Homo sapiens [sequence omitted]

SEQ ID NO: 914620 - protein, 155 aa, Homo sapiens [sequence omitted]

SEQ ID NO: 914621 - protein, 155 aa, Homo sapiens [sequence omitted]

SEQ ID NO: 914622 - protein, 168 aa, Homo sapiens
MAPSVPAAEPEYPKGIRAVLLGPPGAGKGTQAPRLAENFCVCHLATGDMLRAMVASGSELGKKLKATMDAGKLVSDEMVVELIEKNLETPLCKNGFLLDGFPRTVRQAEMLDDLMEKRKEKLDSVIEFSIPDSLLIRRITGRLIHPKSGRSYHEEFNPPKEPMKDDRM

SEQ ID NO: 914623 - protein, 162 aa, Homo sapiens [sequence omitted]

SEQ ID NO: 914624 - protein, 158 aa, Homo sapiens
KPGVFSPKLDFGTFSVSSSLYVPRSVRIPVLHIFCELTLKLSRFTIQEFLPSPAPLVVLVSDEMVVELIEKNLETPLCKNGFLLDGFPRTVRQAEMLDDLMEKRKEKLDSVIEFSIPDSLLIRRITGRLIHPKSGRSYHEEFNPPKEPMKDDMIMKRP

SEQ ID NO: 914625 - protein, 232 aa, Homo sapiens
MAPSVPAAEPEYPKGIRAVLLGPPGAGKGTQAPRLAENFCVCHLATGDMLRAMVASGSELGKKLKATMDAGKLVSDEMVVELIEKNLETPLCKNGFLLDGFPRTVRQAEMLDDLMEKRKEKLDSVIEFSIPDSLLIRRITGRLIHPKSGRSYHEEFNPPKEPMKDDITGEPLIRRSDDNEKALKIRLQAYHTQTTPLIEYYRKRGIHSAIDASQTPDVVFASILAAFSKATS

SEQ ID NO: 914626 - protein, 155 aa, Homo sapiens [sequence omitted]

SEQ ID NO: 914627 - protein, 155 aa, Homo sapiens [sequence omitted]

SEQ ID NO: 914628 - protein, 155 aa, Homo sapiens [sequence omitted]

SEQ ID NO: 914629 - protein, 155 aa, Homo sapiens [sequence omitted]

SEQ ID NO: 914630 - protein, 162 aa, Homo sapiens [sequence omitted]

SEQ ID NO: 914631 - protein, 155 aa, Homo sapiens [sequence omitted]

SEQ ID NO: 914632 - protein, 162 aa, Homo sapiens [sequence omitted]

SEQ ID NO: 914633 - protein, 108 aa, Homo sapiens
HFNLLLSVFSIRLLSPVLSLILLLIALELVNIHAVCGKNAHEYQQYLKFVKSILQYTENLVAYTSYEKNKWNETINLTHTALLKMWTFSEKKQMLIHLAKKSTSKVLL

SEQ ID NO: 914634 - protein, 326 aa, Homo sapiens
MEFLWDFLNHQEGPRIRDHLSHGEINLHEFSKETTNQLLAFSLVLLLRFVDDCLLSVFKEKSAVELLISLAEGYSSRCHPVFQLKKQVLSCEESIRVWALLPFPEELTRQAVRLEDNSETNACHSLITKMTDELYHHMPENRCVLKDLDRLPTETWPQLLRELCSTPVPTLFCPRIVLEVLVVLRSISEQCRRVSSQVTVASELRHRQWVERTLRSRQRQNYLRMWSSIRLLSPVLSLILLLIALELVNIHAVCGKNAHEYQQYLKFVKSILQYTENLVAYTSYEKNKWNETINLTHTALLKMWTFSEKKQMLIHLAKKSTSKVLL

SEQ ID NO: 914635 - protein, 642 aa, Homo sapiens
IHARRSGAPEVMEVLIGDPITTCLSPSVYDIICNLGFQLRENCDINSIVTQNGEVCWKTITDCVSYTESEQGLDYWGSVRLLGPVCEAVHSHFLSLTKGQFEIRYAPWFQWTSFPELFPEIFDALESLQSPAISLSLMKLTSCLERALGDVFLLIGKECPFLLRDLLSSEELAQVFSQSVMNVLKVFVGSPCGLNLRNVLWHGFASPEEIPPKYCSMMILLTAGLGQLLKSYLQNTKLTLAHRSFISLTNLEDLIVFPDVTYEVLSVLEEVMMKSAFILKIMLPYWEVALVKFKSHRFADCAILLLTQLETGLRNVFATLNRCPKRLLTAESTALYTTFDQILAKHLNDGKINQLPLFLGEPAMEFLWDFLNHQEGPRIRDHLSHGEINLHEFSKETTNQLLAFSLVLLLRFVDDCLLSVFKEKSAVELLISLAEGYSSRCHPVFQLKKQVLSCEESIRVWALLPFPEELTRQAVRLEDNSETNACHSLITKMTDELYHHMPENRCVLKDLDRLPTETPTSDTPLALAPRKPQPCRCRRRVRPSIRLLSPVLSLILLLIALELVNIHAVCGKNAHEYQQYLKFVKSILQYTENLVAYTSYEKNKWNETINLTHTALLKMWTFSEKKQMLIHLAKKSTSKVLL

SEQ ID NO: 914636 - protein, 197 aa, Homo sapiens
MTDELYHHMPENRCVLKDLDRLPTETWPQLLRELCSTPVPTLFCPRIVLEVLVVLRSISEQCRRVSSQVTVASELRHRQWVERTLRSRQRQNYLRMWSSIRLLSPVLSLILLLIALELVNIHAVCGKNAHEYQQYLKFVKSILQYTENLVAYTSYEKNKWNETINLTHTALLKMWTFSEKKQMLIHLAKKSTSKVLL

SEQ ID NO: 914637 - protein, 325 aa, Homo sapiens
IHARRSGAPEVMEVLIGDPITTCLSPSVYDIICNLGFQLRENCDINSIVTQNGEVCWKTITDCVSYTESEQGLDYWGSVRLLGPVCEAVHSHFLSLTKGQFEIRYAPWFQWTSFPELFPEIFDALESLQSPAISLSLMKLTSCLERALGDVFLLIGKECPFLLRDLLSSEELAQVFSQSVMNVLKVFVGSPCGLNLRNVLWHGFASPEEIPPKYCSMMILLTAGLGQLLKSYLQNTKLTLAHRSFISLTNLEDLIVFPDVTYEVLSVLEEVMMKSAFILKIMLPYWEVALVKFKSHRFADCAILLLTQLETGLRNVFGNGLRLVC

SEQ ID NO: 914638 - protein, 689 aa, Homo sapiens
IHARRSGAPEVMEVLIGDPITTCLSPSVYDIICNLGFQLRENCDINSIVTQNGEVCWKTITDCVSYTESEQGLDYWGSVRLLGPVCEAVHSHFLSLTKGQFEIRYAPWFQWTSFPELFPEIFDALESLQSPAISLSLMKLTSCLERALGDVFLLIGKECPFLLRDLLSSEELAQVFSQSVMNVLKVFVGSPCGLNLRNVLWHGFASPEEIPPKYCSMMILLTAGLGQLLKSYLQNTKLTLAHRSFISLTNLEDLIVFPDVTYEVLSVLEEVMMKSAFILKIMLPYWEVALVKFKSHRFADCAILLLTQLETGLRNVFATLNRCPKRLLTAESTALYTTFDQILAKHLNDGKINQLPLFLGEPAMEFLWDFLNHQEGPRIRDHLSHGEINLHEFSKETTNQLLAFSLVLLLRFVDDCLLSVFKEKSAVELLISLAEGYSSRCHPVFQLKKQVLSCEESIRVWALLPFPEELTRQAVRLEDNSETNACHSLITKMTDELYHHMPENRCVLKDLDRLPTETWPQLLRELCSTPVPTLFCPRIVLEVLVVLRSISEQCRRVSSQVTVASELRHRQWVERTLRSRQRQNYLRMWSSIRLLSPVLSLILLLIALELVNIHAVCGKNAHEYQQYLKFVKSILQYTENLVAYTSYEKNKWNETINLTHTALLKMWTFSEKKQMLIHLAKKSTSKVLL

SEQ ID NO: 914639 - protein, 344 aa, Homo sapiens
IHARRSGAPEVMEVLIGDPITTCLSPSVYDIICNLGFQLRENCDINSIVTQNGEVCWKTITDCVSYTESEQGLDYWGSVRLLGPVCEAVHSHFLSLTKGQFEIRYAPWFQWTSFPELFPEIFDALESLQSPAISLSLMKLTSCLERALGDVFLLIGKECPFLLRDLLSSEELAQVFSQSVMNVLKVFVGSPCGLNLRNVLWHGFASPEEIPPKYCSMMILLTAGLGQLLKSYLQNTKLTLAHRSFISLTNLEDLIVFPDVTYEVLSVLEEVMMKSAFILKIMLPYWEVALVKFKSHRFADCAILLLTQLETGLRNVFATLNRCPKRLLTAESTALYTTFDQVSK

SEQ ID NO: 914640 - protein, 344 aa, Homo sapiens; identical to SEQ ID NO: 914639

SEQ ID NO: 914641 - protein, 344 aa, Homo sapiens; identical to SEQ ID NO: 914639

SEQ ID NO: 914642 - protein, 82 aa, Homo sapiens
AAVGGRAREERRLRLRAGLVSGAAERAGVGRGQRTEPAGASRAPGRLPTAGLGFLSDVPRNNAGVKKFPLFCSKPEDSVPCI

SEQ ID NO: 914643 - protein, 82 aa, Homo sapiens; identical to SEQ ID NO: 914642

SEQ ID NO: 914644 - protein, 82 aa, Homo sapiens; identical to SEQ ID NO: 914642

SEQ ID NO: 914645 - protein, 209 aa, Homo sapiens
MHKEISQRSTATMYIIGGYYWHPLSEVHIWDPLTNVWIQGAEIPDYTRESYGVTCLGPNIYVTGGYRTDNIEALDTVWIYNSESDEWTEGLPMLNARYYHCAVTLGGCVYALGGYRKGAPAEEAEFYDPLKEKWIPIANMIKGVGNATACVLHDVIYVIGGHCGYRGSCTYDKVQSYNSDINEWSLITSSPHPGYMKKMAICKPGSRSS

SEQ ID NO: 914646 - protein, 135 aa, Homo sapiens
GSLQPLPPGFKQFSCLSLLSSWDYRHVPPHLGVGNATACVLHDVIYVIGGHCGYRGSCTYDKVQSYNSDINEWSLITSSPHPDGVSLSPRLECSGAISGHCKLRLPGSRHSPASASRVAGTTGAHYHAWLVFLYF

SEQ ID NO: 914647 - protein, 296 aa, Homo sapiens
MHKEISQRSTATMYIIGGYYWHPLSEVHIWDPLTNVWIQGAEIPDYTRESYGVTCLGPNIYVTGGYRTDNIEALDTVWIYNSESDEWTEGLPMLNARYYHCAVTLGGCVYALGGYRKGAPAEEAEFYDPLKEKWIPIANMIKGVGNATACVLHDVIYVIGGHCGYRGSCTYDKVQSYNSDINEWSLITSSPHPEYGLCSVPFENKLYLVGGQTTITECYDPEQNEWREIAPMMERRMECGAVIMNGCIYVTGGYSYSKGTYLQSIEKYDPDLNKWEIVGNLPSAMRSHGCVCVYNV

SEQ ID NO: 914648 - protein, 296 aa, Homo sapiens; identical to SEQ ID NO: 914647

SEQ ID NO: 914649 - protein, 104 aa, Homo sapiens
MKILLVFDFDNTIIDDNSDTWIVQCAPNKKLPIELRDSYRKGFWTEFMGRVFKYLGDKGVREHEMKRAVTSLPFTPGMVELFNFIRKNRINLTALLFQIQIRSS

SEQ ID NO: 914650 - protein, 115 aa, Homo sapiens
PLPVTTPRPVGRAGCARLAGGGSRRRSGRRRHRRRHRDCSRGDCYLPTGTNTQQPLPPPREPLPELPARTPAVLRSVLHTVKLTHLKCMVQWVLVYYLHRTFSSLRKEEETLNLP

SEQ ID NO: 914651 - protein, 772 aa, Homo sapiens
TVAVTTPRPVGRAGCARLAGGGSRRRSGRRRHRRRHRDCSRGDCYLPTGTNTQQPLPPPREPLPELPARTPDLSMQNSEGGADSPASVALRPSAAAPPVPASPQRVLVQAASSNPKGAQMQPISLPRVQQVPQQVQPVQHVYPAQVQYVEGGDAVYTNGAIRTAYTYNPEPQMYAPSSTASYFEAPGGAQVTVAASSPPAVPSHSMVGITMDVGGSPIVSSAGAYLIHGGMDSTRHSLAHTSRSSPATLQWLLDNYETAEGVSLPRSSLYNHYLRHCQEHKLDPVNAASFGKLIRSVFMGLRTRRLGTRGNSKYHYYGIRLKPDSPLNRLQEDTQYMAMRQQPMHQKPRYRPAQKTDSLGDSGSHSGLHSTPEQTMAVQSQHHQQYIDVSHVFPEFPAPDLGSFLLQDGVTLHDVKALQLVYRRHCEATVDVVMNLQFHYIEKLWLSFWNSKASSSDGPTSLPASDEDPEGAVLPKDKLISLCQCDPILRWMRSCDHILYQALVEILIPDVLRPVPSTLTQAIRNFAKSLEGWLTNAMSDFPQQVIQTKVGVVSAFAQTLRRYTSLNHLAQAARAVLQNTSQINQMLSDLNRVDFANVQEQASWVCQCEESVVQRLEQDFKLTLQQQSSLDQWASWLDSVVTQVLKQHAGSPSFPKAARQFLLKWSFYSSMVIRDLTLRSAASFGSFHLIRLLYDEYMFYLVEHRVAEATGETPIAVMGEFNDLASLSLTLLDKDDMGDEQRGSEAGPDARSLGEPLVKRERSDPNHSLQGI

SEQ ID NO: 914652 - protein, 474 aa, Homo sapiens
MGLRTRRLGTRGNSKYHYYGIRLKPDSPLNRLQEDTQYMAMRQQPMHQKPRYRPAQKTDSLGDSGSHSGLHSTPEQTMAVQSQHHQQYIDVSHVFPEFPAPDLGSFLLQDGVTLHDVKALQLVYRRHCEATVDVVMNLQFHYIEKLWLSFWNSKASSSDGPTSLPASDEDPEGAVLPKDKLISLCQCDPILRWMRSCDHILYQALVEILIPDVLRPVPSTLTQAIRNFAKSLEGWLTNAMSDFPQQVIQTKVGVVSAFAQTLRRYTSLNHLAQAARAVLQNTSQINQMLSDLNRVDFANVQEQASWVCQCEESVVQRLEQDFKLTLQQQSSLDQWASWLDSVVTQVLKQHAGSPSFPKAARQFLLKWSFYSSMVIRDLTLRSAASFGSFHLIRLLYDEYMFYLVEHRVAEATGETPIAVMGEFNDLASLSLTLLDKDDMGDEQRGSEAGPDARSLGEPLVKRERSDPNHSLQGI

SEQ ID NO: 914653 - protein, 189 aa, Homo sapiens
PLPVTTPRPVGRAGCARLAGGGSRRRSGRRRHRRRHRDCSRGDCYLPTGTNTQQPLPPPREPLPELPARTPDLSMQNSEGGADSPASVALRPSAAAPPVPASPQRVLVQAASSNPKGAQMQPISLPRVQQVPQQVQPVQHVYPAQVQYVEGGDAVYTNGAIRTAYTYNPEPGHSGNLDFTGSTKLVPLR

SEQ ID NO: 914654 - protein, 49 aa, Homo sapiens
MFIKAIEDTSSLNNLQATHEGVTGGNAAYPMFQVQPVQHVYPAQVQYVE

SEQ ID NO: 914655 - protein, 797 aa, Homo sapiens
TVAVTTPRPVGRAGCARLAGGGSRRRSGRRRHRRRHRDCSRGDCYLPTGTNTQQPLPPPREPLPELPARTPDLSMQNSEGGADSPASVALRPSAAAPPVPASPQRVLVQAASSNPKGAQMQPISLPRVQQVPQQVQPVQHVYPAQVQYVEGGDAVYTNGAIRTAYTYNPEPQMYAPSSTASYFEAPGGAQVTVAASSPPAVPSHSMVGITMDVGGSPIVSSAGAYLIHGGMDSTRHSLAHTSRSSPATLEMAIENLQKSEGITSHKSGLLNSHLQWLLDNYETAEGVSLPRSSLYNHYLRHCQEHKLDPVNAASFGKLIRSVFMGLRTRRLGTRGNSKYHYYGIRLKPDSPLNRLQEDTQYMAMRQQPMHQKPRYRPAQKTDSLGDSGSHSGLHSTPEQTMAVQSQHHQQYIDVSHVFPEFPAPDLGSFLLQDGVTLHDVKALQLVYRRHCEATVDVVMNLQFHYIEKLWLSFWNSKASSSDGPTSLPASDEDPEGAVLPKDKLISLCQCDPILRWMRSCDHILYQALVEILIPDVLRPVPSTLTQAIRNFAKSLEGWLTNAMSDFPQQVIQTKVGVVSAFAQTLRRYTSLNHLAQAARAVLQNTSQINQMLSDLNRVDFANVQEQASWVCQCEESVVQRLEQDFKLTLQQQSSLDQWASWLDSVVTQVLKQHAGSPSFPKAARQFLLKWSFYSSMVIRDLTLRSAASFGSFHLIRLLYDEYMFYLVEHRVAEATGETPIAVMGEFNDLASLSLTLLDKDDMGDEQRGSEAGPDARSLGEPLVKRERSDPNHSLQGI

SEQ ID NO: 914656 - protein, 653 aa, Homo sapiens
MQPISLPRVQQVPQQVQPVQHVYPAQVQYVEGGDAVYTNGAIRTAYTYNPEPQMYAPSSTASYFEAPGGAQVTVAASSPPAVPSHSMVGITMDVGGSPIVSSAGAYLIHGGMDSTRHSLAHTSRSSPATLQWLLDNYETAEGVSLPRSSLYNHYLRHCQEHKLDPVNAASFGKLIRSVFMGLRTRRLGTRGNSKYHYYGIRLKPDSPLNRLQEDTQYMAMRQQPMHQKPRYRPAQKTDSLGDSGSHSGLHSTPEQTMAVQSQHHQQYIDVSHVFPEFPAPDLGSFLLQDGVTLHDVKALQLVYRRHCEATVDVVMNLQFHYIEKLWLSFWNSKASSSDGPTSLPASDEDPEGAVLPKDKLISLCQCDPILRWMRSCDHILYQALVEILIPDVLRPVPSTLTQAIRNFAKSLEGWLTNAMSDFPQQVIQTKVGVVSAFAQTLRRYTSLNHLAQAARAVLQNTSQINQMLSDLNRVDFANVQEQASWVCQCEESVVQRLEQDFKLTLQQQSSLDQWASWLDSVVTQVLKQHAGSPSFPKAARQFLLKWSFYSSMVIRDLTLRSAASFGSFHLIRLLYDEYMFYLVEHRVAEATGETPIAVMGEFNDLASLSLTLLDKDDMGDEQRGSEAGPDARSLGEPLVKRERSDPNHSLQGI

SEQ ID NO: 914657 - protein, 339 aa, Homo sapiens [sequence omitted]

SEQ ID NO: 914658 - protein, 526 aa, Homo sapiens
HEERGSVESWSSRHRRRRGSPGTAAPGRRVRCSRSPTQGDSRPLVRPGQPGTDPPAQARLQPEGWEGIALAASRGGQAEAREQVRGTKSFADVPGVLRAPAAGTRRPGAREEPVDVLRAAWEPPPPPPQREEECTGRAAAGRAPPLLALLAALLLAARGAAAQETELSVSAELVPTSSWNISSELNKDSYLTLDEPMNNITTSLGQTAELHCKVSGNPPPTIRWFKNDAPVVQEPRRLSFRSTIYGSRLRIRNLDTTDTGYFQCVATNGKEVVSSTGVLFVKFGPPPTASPGYSDEYEEDGFCQPYRGIACARFIGNRTVYMESLHMQGEIENQITAAFTMIGTSSHLSDKCSQFAIPSLCHYAFPYCDETSSVPKPRDLCRDECEILENVLCQTEYIFARSNPMILMRLKLPNCEDLPQPESPEAANCIRIGIPMADPINKNHKCYNSTGVDYRGTVSVTKSGRQCQPWNSQYPHTHTFTALRFPELNGGHSYCRNPGNQKEAPWCFTLDENFKSDLCDIPACGK

SEQ ID NO: 914659 - protein, 381 aa, Homo sapiens
MRGKSPAEPVETTDSFFGETELSVSAELVPTSSWNISSELNKDSYLTLDEPMNNITTSLGQTAELHCKVSGNPPPTIRWFKNDAPVVQEPRRLSFRSTIYGSRLRIRNLDTTDTGYFQCVATNGKEVVSSTGVLFVKFGPPPTASPGYSDEYEEDGFCQPYRGIACARFIGNRTVYMESLHMQGEIENQITAAFTMIGTSSHLSDKCSQFAIPSLCHYAFPYCDETSSVPKPRDLCRDECEILENVLCQTEYIFARSNPMILMRLKLPNCEDLPQPESPEAANCIRIGIPMADPINKNHKCYNSTGVDYRGTVSVTKSGRQCQPWNSQYPHTHTFTALRFPELNGGHSYCRNPGNQKEAPWWFLVKLVDLGTLDPVPEIQD

SEQ ID NO: 914660 - protein, 1070 aa, Homo sapiens
HEERGSVESWSSRHRRRRGSPGTAAPGRRVRCSRSPTQGDSRPLVRPGQPGTDPPAQARLQPEGWEGIALAASRGGQAEAREQVRGTKSFADVPGVLRAPAAGTRRPGAREEPVDVLRAAWEPPPPPPQREEECTGRAAAGRAPPLLALLAALLLAARGAAAQETELSVSAELVPTSSWNISSELNKDSYLTLDEPMNNITTSLGQTAELHCKVSGNPPPTIRWFKNDAPVVQEPRRLSFRSTIYGSRLRIRNLDTTDTGYFQCVATNGKEVVSSTGVLFVKFGPPPTASPGYSDEYEEDGFCQPYRGIACARFIGNRTVYMESLHMQGEIENQITAAFTMIGTSSHLSDKCSQFAIPSLCHYAFPYCDETSSVPKPRDLCRDECEILENVLCQTEYIFARSNPMILMRLKLPNCEDLPQPESPEAANCIRIGIPMADPINKNHKCYNSTGVDYRGTVSVTKSGRQCQPWNSQYPHTHTFTALRFPELNGGHSYCRNPGNQKEAPWCFTLDENFKSDLCDIPACDSKDSKEKNKMEILYILVPSVAIPLAIALLFFFICVCRNNQKSSSAPVQRQPKHVRGQNVEMSMLNAYKPKSKAKELPLSAVRFMEELGECAFGKIYKGHLYLPGMDHAQLVAIKTLKDYNNPQQWMEFQQEASLMAELHHPNIVCLLGAVTQEQPVCMLFEYINQGDLHEFLIMRSPHSDVGCSSDEDGTVKSSLDHGDFLHIAIQIAAGMEYLSSHFFVHKDLAARNILIGEQLHVKISDLGLSREIYSADYYRVQSKSLLPIRWMPPEAIMYGKFSSDSDIWSFGVVLWEIFSFGLQPYYGFSNQEVIEMVRKRQLLPCSEDCPPRMYSLMTECWNEIPSRRPRFKDIHVRLRSWEGLSSHTSSTTPSGGNATTQTTSLSASPVSNLSNPRYPNYMFPSQGITPQGQIAGFIGPPIPQNQRFIPINGYPIPPGYAAFPAAHYQPTGPPRVIQHCPPPKSRSPSSASGSTSTGHVTSLPSSGSNQEANIPLLPHMSIPNHPGGMGITVFGNKSQKPYKIDSKQASLLGDANIHGHTESMISAEL

SEQ ID NO: 914661 - protein, 948 aa, Homo sapiens
TASRSVLVRCGKLGSLLRLSRYTMRGKSPAEPVETTDSFFGETELSVSAELVPTSSWNISSELNKDSYLTLDEPMNNITTSLGQTAELHCKVSGNPPPTIRWFKNDAPVVQEPRRLSFRSTIYGSRLRIRNLDTTDTGYFQCVATNGKEVVSSTGVLFVKFGPPPTASPGYSDEYEEDGFCQPYRGIACARFIGNRTVYMESLHMQGEIENQITAAFTMIGTSSHLSDKCSQFAIPSLCHYAFPYCDETSSVPKPRDLCRDECEILENVLCQTEYIFARSNPMILMRLKLPNCEDLPQPESPEAANCIRIGIPMADPINKNHKCYNSTGVDYRGTVSVTKSGRQCQPWNSQYPHTHTFTALRFPELNGGHSYCRNPGNQKEAPWCFTLDENFKSDLCDIPACDSKDSKEKNKMEILYILVPSVAIPLAIALLFFFICVCRNNQKSSSAPVQRQPKHVRGQNVEMSMLNAYKPKSKAKELPLSAVRFMEELGECAFGKIYKGHLYLPGMDHAQLVAIKTLKDYNNPQQWMEFQQEASLMAELHHPNIVCLLGAVTQEQPVCMLFEYINQGDLHEFLIMRSPHSDVGCSSDEDGTVKSSLDHGDFLHIAIQIAAGMEYLSSHFFVHKDLAARNILIGEQLHVKISDLGLSREIYSADYYRVQSKSLLPIRWMPPEAIMYGKFSSDSDIWSFGVVLWEIFSFGLQPYYGFSNQEVIEMVRKRQLLPCSEDCPPRMYSLMTECWNEIPSRRPRFKDIHVRLRSWEGLSSHTSSTTPSGGNATTQTTSLSASPVSNLSNPRYPNYMFPSQGITPQGQIAGFIGPPIPQNQRFIPINGYPIPPGYAAFPAAHYQPTGPPRVIQHCPPPKSRSPSSASGSTSTGHVTSLPSSGSNQEANIPLLPHMSIPNHPGGMGITVFGNKSQKPYKIDSKQASLLGDANIHGHTESMISAEL

SEQ ID NO: 914662 - protein, 356 aa, Homo sapiens
SRRGYERKASAWRSGARARAVFSSPTMSVRAAVVASFLQTRPARLLNLAEAWSESREVWGEVGGALHACAASERREGAGDPRQRYPVNTQSGAGLTPPPLLTLLAERPPDGRGRPWGWGGQGRGGGGRRWRAVMAAGDGDVKLGTLGSGSESSNDGGSESPGDAGAAAEGGGWAAAALALLTGGGEMLLNVALVALVLLGAYRLWVRWGRRGLGAGAGAGEESPATSLPRMKKRDFSLEQLRQYDGSRNPRILLAVNGKVFDVTKGSKFYGPAGPYGIFAGRDASRGLATFCLDKDALRDEYDDLSDLNAVQMESVREWEMQFKEKYDYVGRLLKPGEEPSEYTDEEDTKDHNKQD

SEQ ID NO: 914663 - protein, 356 aa, Homo sapiens; identical to SEQ ID NO: 914662

SEQ ID NO: 914664 - protein, 356 aa, Homo sapiens; identical to SEQ ID NO: 914662

SEQ ID NO: 914665 - protein, 356 aa, Homo sapiens; identical to SEQ ID NO: 914662

SEQ ID NO: 914666 - protein, 120 aa, Homo sapiens
MAKHVGAVSIVSAMLCLKCKVAELRVDDVSVSSRASGCRVAQWNPVLLTPTISCFTAQCVSQKGMLSGLPILGDTSFKFTNTSSNNQDSTVSLRCPCNHVFDKVSVSWGINDSHKVGIFC

SEQ ID NO: 914667 - protein, 394 aa, Homo sapiens
SRRGYERKASAWRSGARARAVFSSPTMSVRAAVVASFLQTRPARLLNLAEAWSESREVWGEVGGALHACAASERREGAGDPRQRYPVNTQSGAGLTPPPLLTLLAERPPDGRGRPWGWGGQGRGGGGRRWRAVMAAGDGDVKLGTLGSGSESSNDGGSESPGDAGAAAEGGGWAAAALALLTGGGEMLLNVALVALVLLGAYRLWVRWGRRGLGAGAGAGEESPATSLPRMKKRDFSLEQLRQYDGSRNPRILLAVNGKVFDVTKGSKFYGPGEELEGEGKDPLQLKHNPLRTGRPLGTGLVCPAFSSPGPPRLGRRTWDGPSRPYTHTVPPQLRAPPVLPPKPGSPVAPQRPALSIHLSSIPFLLAAFFFCFFGWIFQNRFSCHRSTLALNLF

SEQ ID NO: 914668 - protein, 356 aa, Homo sapiens; identical to SEQ ID NO: 914662

SEQ ID NO: 914669 - protein, 356 aa, Homo sapiens; identical to SEQ ID NO: 914662

SEQ ID NO: 914670 - protein, 356 aa, Homo sapiens; identical to SEQ ID NO: 914662

SEQ ID NO: 914671 - protein, 356 aa, Homo sapiens; identical to SEQ ID NO: 914662

SEQ ID NO: 914672 - protein, 477 aa, Homo sapiens
MKSLPILLLLCVAVCSAYPLDGAARGEDTSMNLVQKYLENYYDLKKDVKQFVRRKDSGPVVKKIREMQKFLGLEVTGKLDSDTLEVMRKPRCGVPDVGHFRTFPGIPKWRKTHLTYRIVNYTPDLPKDAVDSAVEKALKVWEEVTPLTFSRLYEGEADIMISFAVREHGDFYPFDGPGNVLAHAYAPGPGINGDAHFDDDEQWTKDTTGTNLFLVAAHEIGHSLGLFHSANTEALMYPLYHSLTDLTRFRLSQDDINGIQSLYGPPPDSPETPLVPTEPVPPEPGTPANCDPALSFDAVSTLRGEILIFKDRHFWRKSLRKLEPELHLISSFWPSLPSGVDAAYEVTSKDLVFIFKGNQFWAIRGNEVRAGYPRGIHTLGFPPTVRKIDAAISDKEKNKTYFFVEDKYWRFDEKRNSMEPGFPKQIAEDFPGIDSKIDAVFEEFGFFYFFTGSSQLEFDPNAKKVTHTLKSNSWLNC

SEQ ID NO: 914673 - protein, 477 aa, Homo sapiens; identical to SEQ ID NO: 914672

SEQ ID NO: 914674 - protein, 507 aa, Homo sapiens
APPEVSAAALRGRGSGSGGCSCRTQALTLDLRWLPHLSGAMATGADVRDILELGGPEGDAASGTISKKDIINPDKKKSKKSSETLTFKRPEGMHREVYALLYSDKKDAPPLLPSDTGQGYRTVKAKLGSKKVRPWKWMPFTNPARKDGAMFFHWRRAAEEGKDYPFARFNKTVQVPVYSEQEYQLYLHDDAWTKAETDHLFDLSRRFDLRFVVIHDRYDHQQFKKRSVEDLKERYYHICAKLANVRAVPGTDLKIPVFDAGHERRRKEQLERLYNRTPEQVAEEEYLLQELRKIEARKKEREKRSQDLQKLITAADTTAEQRRTERKAPKKKLPQKKEAEKPAVPETAGIKFPDFKSAGVTLRSQRMKLPSSVGQKKIKALEQMLLELGVELSPTPTEELVHMFNELRSDLVLLYELKQACANCEYELQMLRHRHEALARAGVLGGPATPASGPGPASAEPAVTEPGLGPDPKDTIIDVVGAPLTPNSRKRRESASSSSSVKKAKKP

SEQ ID NO: 914675 - protein, 91 aa, Homo sapiens
RPPTTTIARIQASNDVRRHEALARAGVLGGPATPASGPGPASAEPAVTEPGLGPDPKDTIIDVVGAPLTPNSRKRRESASSSSSVKKAKKP

SEQ ID NO: 914676 - protein, 169 aa, Homo sapiens
LEDPTLGSILELGGPEGDAASGTISKKDIINPDKKKSKKSSETLTFKRPEGMHREVYALLYSDKKDAPPLLPSDTGQGYRTVKAKLGSKKVRPWKWMPFTNPARKDGAMFFHWRRAAEEGKDYPFARFNKGKLPSFGHRPRLPSHFEPFVRALQSPRVGSGGTLMPNCD

SEQ ID NO: 914677 - protein, 507 aa, Homo sapiens; identical to SEQ ID NO: 914674

SEQ ID NO: 914678 - protein, 507 aa, Homo sapiens; identical to SEQ ID NO: 914674

SEQ ID NO: 914679 - protein, 523 aa, Homo sapiens
EHRRKFLPRLCGDGGVVVGAAAAGPRSGLAPPPDLSLVLLQALTLDLRWLPHLSGAMATGADVRDILELGGPEGDAASGTISKKDIINPDKKKSKKSSETLTFKRPEGMHREVYALLYSDKKDAPPLLPSDTGQGYRTVKAKLGSKKVRPWKWMPFTNPARKDGAMFFHWRRAAEEGKDYPFARFNKTVQVPVYSEQEYQLYLHDDAWTKAETDHLFDLSRRFDLRFVVIHDRYDHQQFKKRSVEDLKERYYHICAKLANVRAVPGTDLKIPVFDAGHERRRKEQLERLYNRTPEQVAEEEYLLQELRKIEARKKEREKRSQDLQKLITAADTTAEQRRTERKAPKKKLPQKKEAEKPAVPETAGIKFPDFKSAGVTLRSQRMKLPSSVGQKKIKALEQMLLELGVELSPTPTEELVHMFNELRSDLVLLYELKQACANCEYELQMLRHRHEALARAGVLGGPATPASGPGPASAEPAVTEPGLGPDPKDTIIDVVGAPLTPNSRKRRESASSSSSVKKAKKP

SEQ ID NO: 914680 - protein, 320 aa, Homo sapiens
APPEVSAAALRGRGSGSGGCSCRTQALTLDLRWLPHLSGAMATGADVRDILELGGPEGDAASGTISKKDIINPDKKKSKKSSETLTFKRPEGMHREVYALLYSDKKDAPPLLPSDTGQGYRTVKAKLGSKKVRPWKWMPFTNPARKDGAMFFHWRRAAEEGKDYPFARFNKTVQVPVYSEQEYQLYLHDDAWTKAETDHLFDLSRRFDLRFVVIHDRYDHQQFKKRSVEDLKERYYHICAKLANVRAVPGTDLKIPVFDAGHERRRKEQLERLYNRTPEQVAEEEYLLQELRKIEARKKEREKRSQDLQKLITAADTSCS

SEQ ID NO: 914681 - protein, 467 aa, Homo sapiens
MATGADVRDILELGGPEGDAASGTISKKDIINPDKKKSKKSSETLTFKRPEGMHREVYALLYSDKKDAPPLLPSDTGQGYRTVKAKLGSKKVRPWKWMPFTNPARKDGAMFFHWRRAAEEGKDYPFARFNKTVQVPVYSEQEYQLYLHDDAWTKAETDHLFDLSRRFDLRFVVIHDRYDHQQFKKRSVEDLKERYYHICAKLANVRAVPGTDLKIPVFDAGHERRRKEQLERLYNRTPEQVAEEEYLLQELRKIEARKKEREKRSQDLQKLITAADTTAEQRRTERKAPKKKLPQKKEAEKPAVPETAGIKFPDFKSAGVTLRSQRMKLPSSVGQKKIKALEQMLLELGVELSPTPTEELVHMFNELRSDLVLLYELKQACANCEYELQMLRHRHEALARAGVLGGPATPASGPGPASAEPAVTEPGLGPDPKDTIIDVVGAPLTPNSRKRRESASSSSSVKKAKKP

SEQ ID NO: 914682 - protein, 529 aa, Homo sapiens
APPEVSAAALRGRGSGSGGCSCRTQALTLDLRWLPHLSGAMATGADVRDILELGGPEGDAASGTISKKDIINPDKKKSKKSSETLTFKRPEGMHREVYALLYSDKKDAPPLLPSDTGQGYRTVKAKLGSKKVRPWKWMPFTNPARKDGAMFFHWRRAAEEGKDYPFARFNKTVQVPVYSEQEYQLYLHDDAWTKAETDHLFDLSRRFDLRFVVIHDRYDHQQFKKRSVEDLKERYYHICAKLANVRAVPGTDLKIPVFDAGHERRRKEQLERLYNRTPEQVAEEEYLLQELRKIEARKKEREKRSQDLQKLITAADTTAEQRRTERKAPKKKLPQKKEAEKPAVPETAGIKFPDFKSAGVTLRSQRMKLPSSVGQKKIKALEQMLLELGVELSPTPTEELVHMFNELRSDLVLLYELKQACANCEYELQMLRHRHEALARAGVLGGPATPASGPGPASAEPAVTEPGLGPDPKDTIIDVVGAPLTPNSVRVWTGWEARLGPASEHMHMGVGAPLPLVPAAGTIITSVRV

SEQ ID NO: 914683 - protein, 320 aa, Homo sapiens; identical to SEQ ID NO: 914680

SEQ ID NO: 914684 - protein, 466 aa, Homo sapiens
LEDPTLGSILELGGPEGDAASGTISKKDIINPDKKKSKKSSETLTFKRPEGMHREVYALLYSDKKDAPPLLPSDTGQGYRTVKAKLGSKKVRPWKWMPFTNPARKDGAMFFHWRRAAEEGKDYPFARFNKTVQVPVYSEQEYQLYLHDDAWTKAETDHLFDLSRRFDLRFVVIHDRYDHQQFKKRSVEDLKERYYHICAKLANVRAVPGTDLKIPVFDAGHERRRKEQLERLYNRTPEQVAEEEYLLQELRKIEARKKEREKRSQDLQKLITAADTTAEQRRTERKAPKKKLPQKKEAEKPAVPETAGIKFPDFKSAGVTLRSQRMKLPSSVGQKKIKALEQMLLELGVELSPTPTEELVHMFNELRSDLVLLYELKQACANCEYELQMLRHRHEALARAGVLGGPATPASGPGPASAEPAVTEPGLGPDPKDTIIDVVGAPLTPNSRKRRESASSSSSVKKAKKP

SEQ ID NO: 914685 - protein, 657 aa, Homo sapiens
EHRRKFLPRLCGDGGVVVGAAAAGPRSGLAPPPDLSLVLLQALTLDLRWLPHLSGAMATGADVRDILELGGPEGDAASGTISKKDIINPDKKKSKKSSETLTFKRPEGMHREVYALLYSDKNKGSCLLSRMQEDLKSFAPGHDFLAIGDAPPLLPSDTGQGYRTVKAKLGSKKVRPWKWMPFTNPARKDGAMFFHWRRAAEEGKDYPFARFNKKLTFGLHRSTYMWAPHLNYGGRSVCPMTEALELETVKIDPGINQRQATVPNPARTSSQADKFFPHSMLQGHRPRVWQQTGAAVVTGAWSLLDMTSCGHAPTVSLCASETVQVPVYSEQEYQLYLHDDAWTKAETDHLFDLSRRFDLRFVVIHDRYDHQQFKKRSVEDLKERYYHICAKLANVRAVPGTDLKIPVFDAGHERRRKEQLERLYNRTPEQVAEEEYLLQELRKIEARKKEREKRSQDLQKLITAADTTAEQRRTERKAPKKKLPQKKEAEKPAVPETAGIKFPDFKSAGVTLRSQRMKLPSSVGQKKIKALEQMLLELGVELSPTPTEELVHMFNELRSDLVLLYELKQACANCEYELQMLRHRHEALARAGVLGGPATPASGPGPASAEPAVTEPGLGPDPKDTIIDVVGAPLTPNSRKRRESASSSSSVKKAKKP

SEQ ID NO: 914686 - protein, 176 aa, Homo sapiens
APPEVSAAALRGRGSGSGGCSCRTQALTLDLRWLPHLSGAMATGADVRDILELGGPEGDAASGTISKKDIINPDKKKSKKSSETLTFKRPEGMHREVYALLYSDKKDAPPLLPSDTGQGYRTVKAKLGSKKVRPWKWMPFTNPARKDGAMFFHWRRAAEEGKDYPFARFNKVPYIR

SEQ ID NO: 914687 - protein, 467 aa, Homo sapiens; identical to SEQ ID NO: 914681

SEQ ID NO: 914688 - protein, 189 aa, Homo sapiens
TRPPTRPGSGGCSCRTQALTLDLRWLPHLSGAMATGADVRDILELGGPEGDAASGTISKKDIINPDKKKSKKSSETLTFKRPEGMHREVYALLYSDKKDAPPLLPSDTGQGYRTVKAKLGSKKVRPWKWMPFTNPARKDGAMFFHWRRAAEEGKDYPFARFNKIKTCCKVALLLLREAGSYTAVYSPTD

SEQ ID NO: 914689 - protein, 568 aa, Homo sapiens
EHRRKFLPRLCGDGGVVVGAAAAGPRCGSARAQVAEGAVRNIQAVGHRQIPDLTWTTLLLLARPFNSPPLRSGLAPPPDLSLVLLQALTLDLRWLPHLSGAMATGADVRDILELGGPEGDAASGTISKKDIINPDKKKSKKSSETLTFKRPEGMHREVYALLYSDKKDAPPLLPSDTGQGYRTVKAKLGSKKVRPWKWMPFTNPARKDGAMFFHWRRAAEEGKDYPFARFNKTVQVPVYSEQEYQLYLHDDAWTKAETDHLFDLSRRFDLRFVVIHDRYDHQQFKKRSVEDLKERYYHICAKLANVRAVPGTDLKIPVFDAGHERRRKEQLERLYNRTPEQVAEEEYLLQELRKIEARKKEREKRSQDLQKLITAADTTAEQRRTERKAPKKKLPQKKEAEKPAVPETAGIKFPDFKSAGVTLRSQRMKLPSSVGQKKIKALEQMLLELGVELSPTPTEELVHMFNELRSDLVLLYELKQACANCEYELQMLRHRHEALARAGVLGGPATPASGPGPASAEPAVTEPGLGPDPKDTIIDVVGAPLTPNSRKRRESASSSSSVKKAKKP

SEQ ID NO: 914690 - protein, 515 aa, Homo sapiens
EHRRKFLPRLCGDGGVVVGAAAAGPRCGSARAQALTLDLRWLPHLSGAMATGADVRDILELGGPEGDAASGTISKKDIINPDKKKSKKSSETLTFKRPEGMHREVYALLYSDKKDAPPLLPSDTGQGYRTVKAKLGSKKVRPWKWMPFTNPARKDGAMFFHWRRAAEEGKDYPFARFNKTVQVPVYSEQEYQLYLHDDAWTKAETDHLFDLSRRFDLRFVVIHDRYDHQQFKKRSVEDLKERYYHICAKLANVRAVPGTDLKIPVFDAGHERRRKEQLERLYNRTPEQVAEEEYLLQELRKIEARKKEREKRSQDLQKLITAADTTAEQRRTERKAPKKKLPQKKEAEKPAVPETAGIKFPDFKSAGVTLRSQRMKLPSSVGQKKIKALEQMLLELGVELSPTPTEELVHMFNELRSDLVLLYELKQACANCEYELQMLRHRHEALARAGVLGGPATPASGPGPASAEPAVTEPGLGPDPKDTIIDVVGAPLTPNSRKRRESASSSSSVKKAKKP

SEQ ID NO: 914691 - protein, 516 aa, Homo sapiens
APPEVSAAALRGRGSGSGGCSCRTQALTLDLRWLPHLSGAMATGADVRDILELGGPEGDAASGTISKKDIINPDKKKSKKSSETLTFKRPEGMHREVYALLYSDKKDAPPLLPSDTGQGYRTVKAKLGSKKVRPWKWMPFTNPARKDGAMFFHWRRAAEEGKDYPFARFNKTVQVPVYSEQEYQLYLHDDAWTKAETDHLFDLSRRFDLRFVVIHDRYDHQQFKKRSVEDLKERYYHICAKLANVRAVPGTDLKIPVFDAGHERRRKEQLERLYNRTPEQVAEEEYLLQELRKIEARKKEREKRSQDLQKLITAADTTAEQRRTERKAPKKKLPQKKEAEKPAVPETAGIKFPDFKSAGVTLRSQRDLACQLSLQMKLPSSVGQKKIKALEQMLLELGVELSPTPTEELVHMFNELRSDLVLLYELKQACANCEYELQMLRHRHEALARAGVLGGPATPASGPGPASAEPAVTEPGLGPDPKDTIIDVVGAPLTPNSRKRRESASSSSSVKKAKKP

SEQ ID NO: 914692 - protein, 499 aa, Homo sapiens
TRPPTRPGSGGCSCRTQALTLDLRWLPHLSGAMATGADVRDILELGGPEGDAASGTISKKDIINPDKKKSKKSSETLTFKRPEGMHREVYALLYSDKKDAPPLLPSDTGQGYRTVKAKLGSKKVRPWKWMPFTNPARKDGAMFFHWRRAAEEGKDYPFARFNKTVQVPVYSEQEYQLYLHDDAWTKAETDHLFDLSRRFDLRFVVIHDRYDHQQFKKRSVEDLKERYYHICAKLANVRAVPGTDLKIPVFDAGHERRRKEQLERLYNRTPEQVAEEEYLLQELRKIEARKKEREKRSQDLQKLITAADTTAEQRRTERKAPKKKLPQKKEAEKPAVPETAGIKFPDFKSAGVTLRSQRMKLPSSVGQKKIKALEQMLLELGVELSPTPTEELVHMFNELRSDLVLLYELKQACANCEYELQMLRHRHEALARAGVLGGPATPASGPGPASAEPAVTEPGLGPDPKDTIIDVVGAPLTPNSRKRRESASSSSSVKKAKKP

SEQ ID NO: 914693 - protein, 378 aa, Homo sapiens
MLQGHRPRVWQQTGAAVVTGAWSLLDMTSCGHAPTVSLCASETVQVPVYSEQEYQLYLHDDAWTKAETDHLFDLSRRFDLRFVVIHDRYDHQQFKKRSVEDLKERYYHICAKLANVRAVPGTDLKIPVFDAGHERRRKEQLERLYNRTPEQVAEEEYLLQELRKIEARKKEREKRSQDLQKLITAADTTAEQRRTERKAPKKKLPQKKEAEKPAVPETAGIKFPDFKSAGVTLRSQRMKLPSSVGQKKIKALEQMLLELGVELSPTPTEELVHMFNELRSDLVLLYELKQACANCEYELQMLRHRHEALARAGVLGGPATPASGPGPASAEPAVTEPGLGPDPKDTIIDVVGAPLTPNSRKRRESASSSSSVKKAKKP

SEQ ID NO: 914694 - protein, 641 aa, Homo sapiens
APPEVSAAALRGRGSGSGGCSCRTQALTLDLRWLPHLSGAMATGADVRDILELGGPEGDAASGTISKKDIINPDKKKSKKSSETLTFKRPEGMHREVYALLYSDKNKGSCLLSRMQEDLKSFAPGHDFLAIGDAPPLLPSDTGQGYRTVKAKLGSKKVRPWKWMPFTNPARKDGAMFFHWRRAAEEGKDYPFARFNKKLTFGLHRSTYMWAPHLNYGGRSVCPMTEALELETVKIDPGINQRQATVPNPARTSSQADKFFPHSMLQGHRPRVWQQTGAAVVTGAWSLLDMTSCGHAPTVSLCASETVQVPVYSEQEYQLYLHDDAWTKAETDHLFDLSRRFDLRFVVIHDRYDHQQFKKRSVEDLKERYYHICAKLANVRAVPGTDLKIPVFDAGHERRRKEQLERLYNRTPEQVAEEEYLLQELRKIEARKKEREKRSQDLQKLITAADTTAEQRRTERKAPKKKLPQKKEAEKPAVPETAGIKFPDFKSAGVTLRSQRMKLPSSVGQKKIKALEQMLLELGVELSPTPTEELVHMFNELRSDLVLLYELKQACANCEYELQMLRHRHEALARAGVLGGPATPASGPGPASAEPAVTEPGLGPDPKDTIIDVVGAPLTPNSRKRRESASSSSSVKKAKKP

SEQ ID NO: 914695 - protein, 457 aa, Homo sapiens
MATGADVRDILELGGPEGDAASGTISKKDIINPDKKKSKKSSETLTFKRPEGMHREVYALLYSDKKDAPPLLPSDTGQGYRTVKAKLGSKKVRPWKWMPFTNPARKDGAMFFHWRRAAEEGKDYPFARFNKEYQLYLHDDAWTKAETDHLFDLSRRFDLRFVVIHDRYDHQQFKKRSVEDLKERYYHICAKLANVRAVPGTDLKIPVFDAGHERRRKEQLERLYNRTPEQVAEEEYLLQELRKIEARKKEREKRSQDLQKLITAADTTAEQRRTERKAPKKKLPQKKEAEKPAVPETAGIKFPDFKSAGVTLRSQRMKLPSSVGQKKIKALEQMLLELGVELSPTPTEELVHMFNELRSDLVLLYELKQACANCEYELQMLRHRHEALARAGVLGGPATPASGPGPASAEPAVTEPGLGPDPKDTIIDVVGAPLTPNSRKRRESASSSSSVKKAKKP

SEQ ID NO: 914696 - protein, 210 aa, Homo sapiens
APPEVSAAALRGRGSGSGGCSCRTQALTLDLRWLPHLSGAMATGADVRDILELGGPEGDAASGTISKKDIINPDKKKSKKSSETLTFKRPEGMHREVYALLYSDKKDAPPLLPSDTGQGYRTVKAKLGSKKVRPWKWMPFTNPARKDGAMFFHWRRAAEEGKDYPFARFNKGKLPSFGHRPRLPSHFEPFVRALQSPRVGSGGTLMPNCD

SEQ ID NO: 914697 - protein, 127 aa, Homo sapiens
MTAAATATVLKEGVLEKRSGGLLQLWKRKRCVLTERGLQLFEAKGTGGRPKELSFARIKAVECVESTGRHIYFTLVTEGGGEIDFRCPLEDPGWNAQITLGLVKFKNQQAIQTVRARQSLGTGTLVS

SEQ ID NO: 914698 - protein, 127 aa, Homo sapiens; identical to SEQ ID NO: 914697

SEQ ID NO: 914699 - protein, 127 aa, Homo sapiens; identical to SEQ ID NO: 914697

SEQ ID NO: 914700 - protein, 127 aa, Homo sapiens; identical to SEQ ID NO: 914697

SEQ ID NO: 914701 - protein, 127 aa, Homo sapiens; identical to SEQ ID NO: 914697

SEQ ID NO: 914702 - protein, 127 aa, Homo sapiens; identical to SEQ ID NO: 914697

SEQ ID NO: 914703 - protein, 127 aa, Homo sapiens; identical to SEQ ID NO: 914697

SEQ ID NO: 914704 - protein, 137 aa, Homo sapiens
MNDDSVIHHCAGLLLWSWATNRALPAVVLPSVLQTALSPLALCQAWRRAVPHGVPSQRLRNQEASLVPKGVPRAWYPGPLQNGLWTHLEKGELLGLKPTPGGLLLLRSFWDPHPSRPFLCTLLPPPLCIFPPLRCSA

SEQ ID NO: 914705 - protein, 127 aa, Homo sapiens; identical to SEQ ID NO: 914697

SEQ ID NO: 914706 - protein, 249 aa, Homo sapiens
RERGVLGSRDQGLQAGAQECETEAGEPWDWLKGRRRERGVCRGSPRDGWSAELTVWGTLIPNRSEEARVVEGARVLGARSSQGAGGQRARPASPGRQNPALRGREGRRARRSLELSANLGAPMTAAATATVLKEGVLEKRSGGLLQLWKRKRCVLTERGLQLFEAKGTGGRPKELSFARIKAVECVESTGRHIYFTLVTEGGGEIDFRCPLEDPGWNAQITLGLVKFKNQQAIQTVRARQSLGTGTLVS

SEQ ID NO: 914707 - protein, 231 aa, Homo sapiens
MRCGRAAQEASGGTCKGTSRELPPSAQTEPRGAAEALRPHRTRAAALRGQGHGRPAQGAQLRPHQGRGVRGEHRAPHLLHAGDRRGRRDRLPLPPGRSRLERPDHPRPGQVQEPAGHPDSAGPAEPRDRDPRVLNHRAHHLSFMLPTTSVLRTRQLRCSLWLVGARLCSMWQGGRHGRVEEALELKEWTSPGRRAEGYAGLRMKMQPLDGPRLSGHAQLRGFEPQAWPHMA

SEQ ID NO: 914708 - protein, 127 aa, Homo sapiens; identical to SEQ ID NO: 914697

SEQ ID NO: 914709 - protein, 137 aa, Homo sapiens
KFAAASTRHLASYGMRGSWHRSPLPAVVLPSVLQTALSPLALCQAWRRAVPHGVPSQRLRNQEASLVPKGVPRAWYPGPLQNGLWTHLEKGELLGLKPTPGGLLLLRSFWDPHPSRPFLCTLLPPPLCIFPPLRCSA

SEQ ID NO: 914710 - protein, 731 aa, Homo sapiens
MDDEDEDSEDSEDDEDWDTGSTSSDSDSEEEEGKQTALASRFLKKAPTTDEDKKAAEKKREDKAKKKHDRKSKRLDEEEEDNEGGEWERVRGGVPLVKEKPKMFAKGTEITHAVVIKKLNEILQARGKKGTDRAAQIELLQLLVQIAAENNLGEGVIVKIKFNIIASLYDYNPNLATYMKPEMWGKCLDCINELMDILFANPNIFVGENILEESENLHNADQPLRVRGCILTLVERMDEEFTKIMQNTDPHSQEYVEHLKDEAQVCAIIERVQRYLEEKGTTEEVCRIYLLRILHTYYKFDYKAHQRQLTPPEGSSKSEQDQAENEGEDSAVLMERLCKYIYAKDRTDRIRTCAILCHIYHHALHSRWYQARDLMLMSHLQDNIQHADPPVQILYNRTMVQLGICAFRQGLTKDAHNALLDIQSSGRAKELLGQGLLLRSLQERNQEQEKVERRRQVPFHLHINLELLECVYLVSAMLLEIPYMAAHESDARRRMISKQFHHQLRVGERQPLLGPPESMREHVVAASKAMKMGDWKTCHSFIINEKMNGKVWDLFPEADKVRTMLVRKIQEESLRTYLFTYSSVYDSISMETLSDMFELDLPTVHSIISKMIINEELMASLDQPTQTVVMHRTEPTAQQNLALQLAEKLGSLVENNERVFDHKQGTYGGYFRDQKDGYRKNEGYMRRWWLPPAAVSDGLLSSPLCFPPGPSNLEVLNHTSVTKGLFKVCSG

SEQ ID NO: 914711 - protein, 828 aa, Homo sapiens
MDDEDEDSEDSEDDEDWDTGSTSSDSDSEEEEGKQTALASRFLKKAPTTDEDKKAAEKKREDKAKKKHDRKSKRLDEEEEDNEGGEWERVRGGVPLVKEKPKMFAKGTEITHAVVIKKLNEILQARGKKGTDRAAQIELLQLLVQIAAENNLGEGVIVKIKFNIIASLYDYNPNLATYMKPEMWGKCLDCINELMDILFANPNIFVGENILEESENLHNADQPLRVRGCILTLVERMDEEFTKIMQNTDPHSQEYVEHLKDEAQVCAIIERVQRYLEEKGTTEEVCRIYLLRILHTYYKFDYKAHQRQLTPPEGSSKSEQDQAENEGEDSAVLMERLCKYIYAKDRTDRIRTCAILCHIYHHALHSRWYQARDLMLMSHLQDNIQHADPPVQILYNRTMVQLGICAFRQGLTKDAHNALLDIQSSGRAKELLGQGLLLRSLQERNQEQEKVERRRQVPFHLHINLELLECVYLVSAMLLEIPYMAAHESDARRRMISKQFHHQLRVGERQPLLGPPESMREHVVAASKAMKMGDWKTCHSFIINEKMNGKVWDLFPEADKVRTMLVRKIQEESLRTYLFTYSSVYDSISMETLSDMFELDLPTVHSIISKMIINEELMASLDQPTQTVVMHRTEPTAQQNLALQLAEKLGSLVENNERVFDHKQGTYGGYFRDQKDGYRKNEGYMRRWWLPPAAVSDGLLSSPLCFPPGPSNLEVLNHTSVTKGLFKVKKKIKKLSRLVLSLSPSLPNSARGTCCTPKDGLPGCERGWYRRVPKPDLTCTRLPSDMKGPRGEKACAPGTPTKRLKIYQARGQDQRVVNGHEGDPHKVT

SEQ ID NO: 914712 - protein, 177 aa, Homo sapiens
MEGQEGQFLEPIPHGMSQARSDNKITARARGKEHNTTQHNRTRPETVTKQNTKKNTKRARHDGRRARRENTKETTRTQHPRATGARARTTAKLRRQTEPGKREGKKEGPRAHVKAAQEKKHEQKARAQDKENKTAGYRRHERRKEQTTAEHKKAREESEPERRATKDLSRAERKKGG

SEQ ID NO: 914713 - protein, 185 aa, Homo sapiens
MSRFFTTGSDSESESSLSGEELVTKPVGGNYGKQPLLLSEDEEDTKRVVRSAKDKRFEELTNLIRTIRNAMKIRDVTKCLEEFELLGKAYGKAKSIVDKEGVPRFYIRILADLEDYLNELWEDKEGKKKMNKNNAKALSTLRQKIRKYNRDFESHITSYKQNPEQSADEDAEKNEEDSEGSSVWP

SEQ ID NO: 914714 - protein, 55 aa, Homo sapiens
MTRKRTRQAISFSTKWGYSKKAAVSKPETEPSPDTKSVCQHLNLGLPSSQRTVKN

SEQ ID NO: 914715 - protein, 731 aa, Homo sapiens; identical to SEQ ID NO: 914710

SEQ ID NO: 914716 - protein, 828 aa, Homo sapiens; identical to SEQ ID NO: 914711

SEQ ID NO: 914717 - protein, 719 aa, Homo sapiens
MDDEDEDSEDSEDDEDWDTGSTSSDSDSEEEEGKQTALASRFLKKAPTTDEDKKAAEKKREDKAKKKHDRKSKRLDEEEEDNEGGEWERVRGGVPLVKEKPKMFAKGTEITHAVVIKKLNEILQARGKKGTDRAAQIELLQLLVQIAAENNLGEGVIVKIKFNIIASLYDYNPNLATYMKPEMWGKCLDCINELMDILFANPNIFVGENILEESENLHNADQPLRVRGCILTLVERMDEEFTKIMQNTDPHSQEYVEHLKDEAQVCAIIERVQRYLEEKGTTEEVCRIYLLRILHTYYKFDYKAHQRQLTPPEGSSKSEQDQAENEGEDSAVLMERLCKYIYAKDRTDRIRTCAILCHIYHHALHSRWYQARDLMLMSHLQDNIQHADPPVQILYNRTMVQLGICAFRQGLTKDAHNALLDIQSSGRAKELLGQGLLLRSLQERNQEQEKVERRRQVPFHLHINLELLECVYLVSAMLLEIPYMAAHESDARRRMISKQFHHQLRVGERQPLLGPPESMREHVVAASKAMKMGDWKTCHSFIINEKMNGKVWDLFPEADKVRTMLVRKIQEESLRTYLFTYSSVYDSISMETLSDMFELDLPTVHSIISKMIINEELMASLDQPTQTVVMHRTEPTAQQNLALQLAEKLGSLVENNERVFDHKQGTYGGYFRDQKDGYRKNEGYMRRWWLPPAAVSDGLLSSPLCFPPGPSSLRGNGPG

SEQ ID NO: 914718 - protein, 764 aa, Homo sapiens
MDDEDEDSEDSEDDEDWDTGSTSSDSDSEEEEGKQTALASRFLKKAPTTDEDKKAAEKKREDKAKKKHDRKSKRLDEEEEDNEGGEWERVRGGVPLVKEKPKMFAKGTEITHAVVIKKLNEILQARGKKGTDRAAQIELLQLLVQIAAENNLGEGVIVKIKFNIIASLYDYNPNLATYMKPEMWGKCLDCINELMDILFANPNIFVGENILEESENLHNADQPLRVRGCILTLVERMDEEFTKIMQNTDPHSQEYVEHLKDEAQVCAIIERVQRYLEEKGTTEEVCRIYLLRILHTYYKFDYKAHQRQLTPPEGSSKSEQDQAENEGEDSAVLMERLCKYIYAKDRTDRIRTCAILCHIYHHALHSRWYQARDLMLMSHLQDNIQHADPPVQILYNRTMVQLGICAFRQGLTKDAHNALLDIQSSGRAKELLGQGLLLRSLQERNQEQEKVERRRQVPFHLHINLELLECVYLVSAMLLEIPYMAAHESDARRRMISKQFHHQLRVGERQPLLGPPESMREHVVAASKAMKMGDWKTCHSFIINEKMNGKVWDLFPEADKVRTMLVRRADREAVMGRGRRDWLVPFPEALSVSSVPSSHRKIQEESLRTYLFTYSSVYDSISMETLSDMFELDLPTVHSIISKMIINEELMASLDQPTQTVVMHRTEPTAQQNLALQLAEKLGSLVENNERVFDHKQGTYGGYFRDQKDGYRKNEGYMRRWWLPPAAVSDGLLSSPLCFPPGPSNLEVLNHTSVTKGLFKVCSG

SEQ ID NO: 914719 - protein, 731 aa, Homo sapiens
MDDEDEDSEDSEDDEDWDTGSTSSDSDSEEEEGKQTALASRFLKKAPTTDEDKKAAEKKREDKAKKKHDRKSKRLDEEEEDNEGGEWERVRGGVPLVKEKPKMFAKGTEITHAVVIKKLNEILQARGKKGTDRAAQIELLQLLVQIAAENNLGEGVIVKIKFNIIASLYDYNPNLATYMKPEMWGKCLDCINELMDILFANPNIFVGENILEESENLHNADQPLRVRGCILTLVERMDEEFTKIMQNTDPHSQEYVEHLKDEAQVCAIIERVQRYLEEKGTTEEVCRIYLLRILHTYYKFDYKAHQRQLTPPEGSSKSEQDQAENEGEDSAVLMERLCKYIYAKDRTDRIRTCAILCHIYHHALHSRWYQARDLMLMSHLQDNIQHADPPVQILYNRTMVQLGICAFRQGLTKDAHNALLDIQSSGRAKELLGQGLLLRSLQERNQEQEKVERRRQVPFHLHINLELLECVYLVSAMLLEIPYMAAHESDARRRMISKQFHHQLRVGERQPLLGPPESMREHVVAASKAMKMGDWKTCHSFIINEKMNGKVWDLFPEADKVRTMLVRKIQEESLRTYLFTYSSVYDSISMETLSDMFELDLPTVHSIISKMIINEELMASLDQPTQTVVMHRTEPTAQQNLALQLAEKLGSLVENNERVFDHKQGTYGGYFRGEYFGSSPCPLLVPSPPLTWHSLPFLPISLLQTRRTATAKTRATCAAGGYRQQQSQTAY

SEQ ID NO: 914720 - protein, 684 aa, Homo sapiens
MDDEDEDSEDSEDDEDWDTGSTSSDSDSEEEEGKQTALASRFLKKAPTTDEDKKAAEKKREDKAKKKHDRKSKRLDEEEEDNEGGEWERVRGGVPLVKEKPKMFAKGTEITHAVVIKKLNEILQARGKKGTDRAAQIELLQLLVQIAAENNLGEGVIVKIKFNIIASLYDYNPNLATYMKPEMWGKCLDCINELMDILFANPNIFVGENILEESENLHNADQPLRVRGCILTLVERMDEEFTKIMQNTDPHSQEYVEHLKDEAQVCAIIERVQRYLEEKGTTEEVCRIYLLRILHTYYKFDYKAHQRQLTPPEGSSKSEQDQAENEGEDSAVLMERLCKYIYAKDRTDRIRTCAILCHIYHHALHSRWYQARDLMLMSHLQDNIQHADPPVQILYNRTMVQLGICAFRQGLTKDAHNALLDIQSSGRAKELLGQGLLLRSLQERNQEQEKVERRRQVPFHLHINLELLECVYLVSAMLLEIPYMAAHESDARRRMISKQFHHQLRVGERQPLLGPPESMREHVVAASKAMKMGDWKTCHSFIINEKMNGKVWDLFPEADKVRTMLVRKIQEESLRTYLFTYSSVYDSISMETLSDMFELDLPTVHSIISKMIINEELMASLDQPTQTVVMHRTEPTAQLGRNWRRWEPRRVSPRGPGAPARGSRRPPGSQFTTAPPALSPSFVT

SEQ ID NO: 914721 - protein, 216 aa, Homo sapiens
MSRFFTTGSDSESESSLSGEELVTKPVGGNYGKQPLLLSEDEEDTKRVVRSAKDKRFEELTNLIRTIRNAMKIRDVTKCLEEFELLGKAYGKAKSIVDKEGVPRFYIRILADLEDYLNELWEDKEGKKKMNKNNAKALSTLRQKIRKYNRDFESHITSYKQNPEQSADEDAEKNEEDSEGSSDEDEDEDGVSAATFLNEEIRSSFWGESQVPQKDG

SEQ ID NO: 914722 - protein, 731 aa, Homo sapiens; identical to SEQ ID NO: 914710

SEQ ID NO: 914723 - protein, 713 aa, Homo sapiens
MDDEDEDSEDSEDDEDWDTGSTSSDSDSEEEEGKQTALASRFLKKAPTTDEDKKAAEKKREDKAKKKHDRKSKRLDEEEEDNEGGEWERVRGGVPLVKEKPKMFAKGTEITHAVVIKKLNEILQARGKKGTDRAAQIELLQLLVQIAAENNLGEGVIVKIKFNIIASLYDYNPNLATYMKPEMWGKCLDCINELMDILFANPNIFVGENILEESENLHNADQPLRVRGCILTLVERMDEEFTDEAQVCAIIERVQRYLEEKGTTEEVCRIYLLRILHTYYKFDYKAHQRQLTPPEGSSKSEQDQAENEGEDSAVLMERLCKYIYAKDRTDRIRTCAILCHIYHHALHSRWYQARDLMLMSHLQDNIQHADPPVQILYNRTMVQLGICAFRQGLTKDAHNALLDIQSSGRAKELLGQGLLLRSLQERNQEQEKVERRRQVPFHLHINLELLECVYLVSAMLLEIPYMAAHESDARRRMISKQFHHQLRVGERQPLLGPPESMREHVVAASKAMKMGDWKTCHSFIINEKMNGKVWDLFPEADKVRTMLVRKIQEESLRTYLFTYSSVYDSISMETLSDMFELDLPTVHSIISKMIINEELMASLDQPTQTVVMHRTEPTAQQNLALQLAEKLGSLVENNERVFDHKQGTYGGYFRDQKDGYRKNEGYMRRWWLPPAAVSDGLLSSPLCFPPGPSNLEVLNHTSVTKGLFKVCSG

SEQ ID NO: 914724 - protein, 623 aa, Homo sapiens
MDDEDEDSEDSEDDEDWDTGSTSSDSDSEEEEGKQTALASRFLKKAPTTDEDKKAAEKKREDKAKKKHDRKSKRLDEEEEDNEGGEWERVRGGVPLVKEKPKMFAKGTEITHAVVIKKLNEILQARGKKGTDRAAQIELLQLLVQIAAENNLGEGVIVKIKFNIIASLYDYNPNLATYMKPEMWGKCLDCINELMDILFANPNIFVGENILEESENLHNADQPLRVRGCILTLVERMDEEFTKIMQNTDPHSQEYVEHLKDEAQVCAIIERVQRYLEEKGTTEEVCRIYLLRILHTYYKFDYKAHQRQLTPPEGSSKSEQDQAENEGEDSAVLMERLCKYIYAKDRTDRIRTCAILCHIYHHALHSRWYQARDLMLMSHLQDNIQHADPPVQILYNRTMVQLGICAFRQGLTKDAHNALLDIQSSGRAKELLGQGLLLRSLQERNQEQEKVERRRQVPFHLHINLELLECVYLVSAMLLEIPYMAAHESDARRRMISKQFHHQLRVGERQPLLGPPESMREHVVAASKAMKMGDWKTCHSFIINEKMNGKVWDLFPEADKVRTMLVRKIQEESLRTYLFTYSSVYDSISMETLSDMFELDLPTVPGASRVPVDLRFCFFIKEK

SEQ ID NO: 914725 - protein, 745 aa, Homo sapiens
LARYEAGVKSAEGCQGDEDEDSEDSEDDEDWDTGSTSSDSDSEEEEGKQTALASRFLKKAPTTDEDKKAAEKKREDKAKKKHDRKSKRLDEEEEDNEGGEWERVRGGVPLVKEKPKMFAKGTEITHAVVIKKLNEILQARGKKGTDRAAQIELLQLLVQIAAENNLGEGVIVKIKFNIIASLYDYNPNLATYMKPEMWGKCLDCINELMDILFANPNIFVGENILEESENLHNADQPLRVRGCILTLVERMDEEFTKIMQNTDPHSQEYVEHLKDEAQVCAIIERVQRYLEEKGTTEEVCRIYLLRILHTYYKFDYKAHQRQLTPPEGSSKSEQDQAENEGEDSAVLMERLCKYIYAKDRTDRIRTCAILCHIYHHALHSRWYQARDLMLMSHLQDNIQHADPPVQILYNRTMVQLGICAFRQGLTKDAHNALLDIQSSGRAKELLGQGLLLRSLQERNQEQEKVERRRQVPFHLHINLELLECVYLVSAMLLEIPYMAAHESDARRRMISKQFHHQLRVGERQPLLGPPESMREHVVAASKAMKMGDWKTCHSFIINEKMNGKVWDLFPEADKVRTMLVRKIQEESLRTYLFTYSSVYDSISMETLSDMFELDLPTVHSIISKMIINEELMASLDQPTQTVVMHRTEPTAQQNLALQLAEKLGSLVENNERVFDHKQGTYGGYFRDQKDGYRKNEGYMRRWWLPPAAVSDGLLSSPLCFPPGPSNLEVLNHTSVTKGLFKVCSG

SEQ ID NO: 914726 - protein, 596 aa, Homo sapiens
MDDEDEDSEDSEDDEDWDTGSTSSDSDSEEEEGKQTALASRFLKKAPTTDEDKKAAEKKREDKAKKKHDRKSKRLDEEEEDNEGGEWERVRGGVPLVKEKPKMFAKGTEITHAVVIKKLNEILQARGKKGTDRAAQIELLQLLVQIAAENNLGEGVIVKIKFNIIASLYDYNPNLATYMKPEMWGKCLDCINELMDILFANPNIFVGENILEESENLHNADQPLRVRGCILTLVERMDEEFTKIMQNTDPHSQEYVEHLKDEAQVCAIIERVQRYLEEKGTTEEVCRIYLLRILHTYYKFDYKAHQRQLTPPEGSSKSEQDQAENEGEDSAVLMERLCKYIYAKDRTDRIRTCAILCHIYHHALHSRWYQARDLMLMSHLQDNIQHADPPVQILYNRTMVQLGICAFRQGLTKDAHNALLDIQSSGRAKELLGQGLLLRSLQERNQEQEKVERRRQVPFHLHINLELLECVYLVSAMLLEIPYMAAHESDARRRMISKQFHHQLRVGERQPLLGPPESMREHVVAASKAMKMGDWKTCHSFIINEKMNGKVWDLYPGLHAVRRQESLGPPSARGLVRLVRNVVCGPAIKYSRPPHM

SEQ ID NO: 914727 - protein, 561 aa, Homo sapiens
MDDEDEDSEDSEDDEDWDTGSTSSDSDSEEEEGKQTALASRFLKKAPTTDEDKKAAEKKREDKAKKKHDRKSKRLDEEEEDNEGGEWERVRGGVPLVKEKPKMFAKGTEITHAVVIKKLNEILQARGKKGTDRAAQIELLQLLVQIAAENNLGEGVIVKIKFNIIASLYDYNPNLATYMKPEMWGKCLDCINELMDILFANPNIFVGENILEESENLHNADQPLRVRGCILTLVERMDEEFTKIMQNTDPHSQEYVEHLKDEAQVCAIIERVQRYLEEKGTTEEVCRIYLLRILHTYYKFDYKAHQRQLTPPEGSSKSEQDQAENEGEDSAVLMERLCKYIYAKDRTDRIRTCAILCHIYHHALHSRWYQARDLMLMSHLQDNIQHADPPVQILYNRTMVQLGICAYLFTYSSVYDSISMETLSDMFELDLPTVHSIISKMIINEELMASLDQPTQTVVMHRTEPTAQQNLALQLAEKLGSLVENNERVFDHKQGTYGGYFRDQKDGYRKNEGYMRRWWLPPAAVSDGLLSSPLCFPPGPSNLEVLNHTSVTKGLFKVCSG

SEQ ID NO: 914728 - protein, 525 aa, Homo sapiens
MDDEDEDSEDSEDDEDWDTGSTSSDSDSEEEEGKQTALASRFLKKAPTTDEDKKAAEKKREDKAKKKHDRKSKRLDEEEEDNEGGEWERVRGGVPLVKEKPKMFAKGTEITHAVVIKKLNEILQARGKKGTDRAAQIELLQLLVQIAAENNLGEGVIVKIKFNIIASLYDYNPNLATYMKPEMWGKCLDCINELMDILFANPNIFVGENILEESENLHNADQPLRVRGCILTLVERMDEEFTKIMQNTDPHSQEYVEHLKDEAQVCAIIERVQRYLEEKGTTEEVCRIYLLRILHTYYKFDYKAHQRQLTPPEGSSKSEQDQAENEGEDSAVLMERLCKYIYAKDRTDRIRTCAILCHIYHHALHSRWYQARDLMLMSHLQDNIQHADPPVQILYNRTMVQLGICAFRQGLTKDAHNALLDIQSSGRAKELLGQGLLLRSLQERNQEQEKVERRRQVPFHLHINRTWLCSWPRSWAAWWRTTNGCLTTSRAPTGATSETRRTATAKTRATCAAGGYRQQQSQTAY

SEQ ID NO: 914729 - protein, 629 aa, Homo sapiens
MFAKGTEITHAVVIKKLNEILQARGKKGTDRAAQIELLQLLVQIAAENNLGEGVIVKIKFNIIASLYDYNPNLATYMKPEMWGKCLDCINELMDILFANPNIFVGENILEESENLHNADQPLRVRGCILTLVERMDEEFTKIMQNTDPHSQEYVEHLKDEAQVCAIIERVQRYLEEKGTTEEVCRIYLLRILHTYYKFDYKAHQRQLTPPEGSSKSEQDQAENEGEDSAVLMERLCKYIYAKDRTDRIRTCAILCHIYHHALHSRWYQARDLMLMSHLQDNIQHADPPVQILYNRTMVQLGICAFRQGLTKDAHNALLDIQSSGRAKELLGQGLLLRSLQERNQEQEKVERRRQVPFHLHINLELLECVYLVSAMLLEIPYMAAHESDARRRMISKQFHHQLRVGERQPLLGPPESMREHVVAASKAMKMGDWKTCHSFIINEKMNGKVWDLFPEADKVRTMLVRKIQEESLRTYLFTYSSVYDSISMETLSDMFELDLPTVHSIISKMIINEELMASLDQPTQTVVMHRTEPTAQQNLALQLAEKLGSLVENNERVFDHKQGTYGGYFRDQKDGYRKNEGYMRRWWLPPAAVSDGLLSSPLCFPPGPSNLEVLNHTSVTKGLFKVCSG

SEQ ID NO: 914730 - protein, 331 aa, Homo sapiens
MDDEDEDSEDSEDDEDWDTGSTSSDSDSEEEEGKQTALASRFLKKAPTTDEDKKAAEKKREDKAKKKHDRKSKRLDEEEEDNEGGEWERVRGGVPLVKEKPKMFAKGTEITHAVVIKKLNEILQARGKKGTDRAAQIELLQLLVQIAAENNLGEGVIVKIKFNIIASLYDYNPNLATYMKPEMWGKCLDCINELMDILFANPNIFVGENILEESENLHNADQPLRVRGCILTLVERMDEEFTKIMQNTDPHSQEYVEHLKDEAQVCAIIERVQRYLEEKGTTEEPAGAQPGAGEGGAAPSGPLPPAHQPGAAGVCLPGVCHAPGDPLHGRP

SEQ ID NO: 914731 - protein, 270 aa, Homo sapiens
MDDEDEDSEDSEDDEDWDTGSTSSDSDSEEEEGKQTALASRFLKKAPTTDEDKKAAEKKREDKAKKKHDRKSKRLDEEEEDNEGGEWERVRGGVPLVKEKPKMFAKGTEITHAVVIKKLNEILQARGKKGTDRAAQIELLQLLVQIAAENNLGEGVIVKIKFNIIASLYDYNPNLATYMKPEMWGKCLDCINELMDILFANPNIFVGENILEESENLHNADQPLRVRGCILTLVERMDEEFTKIMQNTDPHSQEYVEHLKDEATNGGPSS

SEQ ID NO: 914732 - protein, 357 aa, Homo sapiens
MLMSHLQDNIQHADPPVQILYNRTMVQLGICAFRQGLTKDAHNALLDIQSSGRAKELLGQGLLLRSLQERNQEQEKVERRRQVPFHLHINLELLECVYLVSAMLLEIPYMAAHESDARRRMISKQFHHQLRVGERQPLLGPPESMREHVVAASKAMKMGDWKTCHSFIINEKMNGKVWDLFPEADKVRTMLVRKIQEESLRTYLFTYSSVYDSISMETLSDMFELDLPTVHSIISKMIINEELMASLDQPTQTVVMHRTEPTAQQNLALQLAEKLGSLVENNERVFDHKQGTYGGYFRDQKDGYRKNEGYMRRWWLPPAAVSDGLLSSPLCFPPGPSNLEVLNHTSVTKGLFKVCSG

SEQ ID NO: 914733 - protein, 292 aa, Homo sapiens
ISSSLMIILLMMIKLRQVPFHLHINLELLECVYLVSAMLLEIPYMAAHESDARRRMISKQFHHQLRVGERQPLLGPPESMREHVVAASKAMKMGDWKTCHSFIINEKMNGKVWDLFPEADKVRTMLVRKIQEESLRTYLFTYSSVYDSISMETLSDMFELDLPTVHSIISKMIINEELMASLDQPTQTVVMHRTEPTAQQNLALQLAEKLGSLVENNERVFDHKQGTYGGYFRDQKDGYRKNEGYMRRWWLPPAAVSDGLLSSPLCFPPGPSNLEVLNHTSVTKGLFKVCSG

SEQ ID NO: 914734 - protein, 216 aa, Homo sapiens; identical to SEQ ID NO: 914721

SEQ ID NO: 914735 - protein, 216 aa, Homo sapiens; identical to SEQ ID NO: 914721

SEQ ID NO: 914736 - protein, 216 aa, Homo sapiens; identical to SEQ ID NO: 914721

SEQ ID NO: 914737 - protein, 218 aa, Homo sapiens
MSRFFTTGSDSESESSLSGEELVTKPVGGNYGKQPLLLSEDEEDTKRVVRSAKDKRFEELTNLIRTIRNAMKIRDVTKCLEEFELLGKAYGKAKSIVDKEGVPRFYIRILADLEDYLNELWEDKEGKKKMNKNNAKALSTLRQKIRKYNRDFESHITSYKQNPEQSADEDAEKNEEDSEGSSDEDEDEDGVSAATFLNEEIRSSFWGESQVPQKDGWD

SEQ ID NO: 914738 - protein, 212 aa, Homo sapiens
MSRFFTTGSDSESESSLSGEELVTKPVGGNYGKQPLLLSEDEEDTKRVVRSAKDKRFEELTNLIRTIRNAMKIRDVTKCLEEFELLGKAYGKAKSIVDKEGVPRFYIRILADLEDYLNELWEDKEGKKKMNKNNAKALSTLRQKIRKYNRDFESHITSYKQNPEQSADEDAEKNEEDSEGSSDEDEDEDGVTSLYADVRNRCGAKLTCLPSI

SEQ ID NO: 914739 - protein, 81 aa, Homo sapiens
FQQPVPEHSSSPSLASLTSELGTRRPASIHCCMGNLALVGSILLHLRVLRIEALLEFLRGELVTSTGSRPSGPSCFLSSSS

SEQ ID NO: 914740 - protein, 246 aa, Homo sapiens
MSRFFTTGSDSESESSLSGEELVTKPVGGNYGKQPLLLSEDEEDTKRVVRSAKDKRFEELTNLIRTIRNAMKIRDVTKCLEEFELLGKAYGKAKSIVDKEGVPRFYIRILADLEDYLNELWEDKEGKKKMNKNNAKALSTLRQKIRKYNRDFESHITSYKQNPEQSADEDAEKNEEDSEGSSDEDEDEDGVSAATFLNEEIRSSFWGESQVPQKDGCYDAGRDPNVDWARSTFVQRGQGTPGQYHT

SEQ ID NO: 914741 - protein, 102 aa, Homo sapiens
MCPPCGLCVTPPLCPSVLAQPWLDVHLAYDPVPVFHVLCHVTLCPASRGARVAWVLGPVALARSQSGAFHPALAYHSCLRASAWLHRIPGAAAPCFSRTLKS

SEQ ID NO: 914742 - protein, 73 aa, Homo sapiens
NSRPRRQDDRRERTWLCSWPRSWAAWWRTTNGCLTTSRAPTGATSETRRTATAKTRATCAAGGYRQQQSQTAY

SEQ ID NO: 914743 - protein, 731 aa, Homo sapiens; identical to SEQ ID NO: 914710

SEQ ID NO: 914744 - protein, 216 aa, Homo sapiens; identical to SEQ ID NO: 914721

SEQ ID NO: 914745 - protein, 755 aa, Homo sapiens
MDDEDEDSEDSEDDEDWDTGSTSSDSDSEEEEGKQTALASRFLKKAPTTDEDKKAAEKKREDKAKKKHDRKSKRLDEEEEDNEGGEWERVRGGVPLVKEKPKMFAKGTEITHAVVIKKLNEILQARGKKGTDRAAQIELLQLLVQIAAENNLGEGVIVKIKFNIIASLYDYNPNLATYMKPEMWGKCLDCINELMDILFANPNIFVGENILEESENLHNADQPLRVRGCILTLVERMDEEFTKIMQNTDPHSQEYVEHLKDEAQVCAIIERVQRYLEEKGTTEEVCRIYLLRILHTYYKFDYKAHQRQLTPPEGSSKSEQDQAENEGEDSAVLMERLCKYIYAKDRTDRIRTCAILCHIYHHALHSRWYQARDLMLMSHLQDNIQHADPPVQILYNRTMVQLGICAFRQGLTKDAHNALLDIQSSGRAKELLGQGLLLRSLQERNQEQEKVERRRQVPFHLHINLELLECVYLVSAMLLEIPYMAAHESDARRRMISKQFHHQLRVGERQPLLGPPESMREHVVAASKAMKMGDWKTCHSFIINEKMNGKVWDLFPEADKVRTMLVRKIQEESLRTYLFTYSSVYDSISMETLSDMFELDLPTVHSIISKMIINEELMASLDQPTQTVVMHRTEPTAQQNLALQLAEKLGSLVENNERVFDHKQGTYGGYFRDQKDGYRKNEGYMRRWWLPPAAVSDGLLSSPLCFPPGPSNLEVLNHTSVTKGLFKVLKKKKKKKKQKQKKKTQKKKGDQTPNN

SEQ ID NO: 914746 - protein, 893 aa, Homo sapiens
MDDEDEDSEDSEDDEDWDTGSTSSDSDSEEEEGKQTALASRFLKKAPTTDEDKKAAEKKREDKAKKKHDRKSKRLDEEEEDNEGGEWERVRGGVPLVKEKPKMFAKGTEITHAVVIKKLNEILQARGKKGTDRAAQIELLQLLVQIAAENNLGEGVIVKIKFNIIASLYDYNPNLATYMKPEMWGKCLDCINELMDILFANPNIFVGENILEESENLHNADQPLRVRGCILTLVERMDEEFTKIMQNTDPHSQEYVEHLKDEAQVCAIIERVQRYLEEKGTTEEVCRIYLLRILHTYYKFDYKAHQRQLTPPEGSSKSEQDQAENEGEDSAVLMERLCKYIYAKDRTDRIRTCAILCHIYHHALHSRWYQARDLMLMSHLQDNIQHADPPVQILYNRTMVQLGICAFRQGLTKDAHNALLDIQSSGRAKELLGQGLLLRSLQERNQEQEKVERRRQVPFHLHINLELLECVYLVSAMLLEIPYMAAHESDARRRMISKQFHHQLRVGERQPLLGPPESMREHVVAASKAMKMGDWKTCHSFIINEKMNGKVWDLFPEADKVRTMLVRKIQEESLRTYLFTYSSVYDSISMETLSDMFELDLPTVHSIISKMIINEELMASLDQPTQTVVMHRTEPTAQQNLALQLAEKLGSLVENNERVFDHKQGTYGGYFRDQKDGYRKNEGYMRRWWLPPAAVSDGLLSSPLCFPPGPSIVTEVWFRTSNFGRRLSAGGEAAADSGPRRSRGIAPGLRSVAPGPEPFEAGASGRQTSWGRPSYSGKTPIPPCWYLLTQRSPDGRTALLPASDDGQQTRTKEMAPGPLQLPSPLSNESQTTDRHQPPSASLLQHGPRPDDPIQIRKRADRIRTIQNTPGLNNNTTPRQQTNQPRTHGNHKTY

SEQ ID NO: 914747 - protein, 731 aa, Homo sapiens; identical to SEQ ID NO: 914710

SEQ ID NO: 914748 - protein, 696 aa, Homo sapiens
MDDEDEDSEDSEDDEDWDTGSTSSDSDSEEEEGKQTALASRFLKKAPTTDEDKKAAEKKREDKAKKKHDRKSKRLDEEEEDNEGGEWERVRGGVPLVKEKPKMFAKGTEITHAVVIKKLNEILQARGKKGTDRAAQIELLQLLVQIAAENNLGEGVIVKIKFNIIASLYDYNPNLATYMKPEMWGKCLDCINELMDILFANPNIFVGENILEESENLHNADQPLRVRGCILTLVERMDEEFTKIMQNTDPHSQEYVEHLKDEAQVCAIIERVQRYLEEKGTTEEVCRIYLLRILHTYYKFDYKAHQRQLTPPEGSSKSEQDQAENEGEDSAVLMERLCKYIYAKDRTDRIRTCAILCHIYHHALHSRWYQARDLMLMSHLQDNIQHADPPVQILYNRTMVQLGICAFRQGLTKDAHNALLDIQSSGRAKELLGQGLLLRSLQERNQEQEKVERRRQVPFHLHINLELLECVYLVSAMLLEIPYMAAHESDARRRMISKQFHHQLRVGERQPLLGPPESMREHVVAASKAMKMGDWKTCHSFIINEKMNGKVWDLFPEADKVRTMLVRKIQEESLRTYLFTYSSVYDSISMETLSDMFELDLPTVHSIISKMIINEELMASLDQPTQTVVMHRTEPTAQQNLALQLAEKLGSLVENNERVFDHKQGTYGGYFRDQKDGLPEKRGVHPRRSVPGTFLL

SEQ ID NO: 914749 - protein, 357 aa, Homo sapiens; identical to SEQ ID NO: 914732

SEQ ID NO: 914750 - protein, 731 aa, Homo sapiens; identical to SEQ ID NO: 914710

SEQ ID NO: 914751 - protein, 567 aa, Homo sapiens
MDDEDEDSEDSEDDEDWDTGSTSSDSDSEEEEGKQTALASRFLKKAPTTDEDKKAAEKKREDKAKKKHDRKSKRLDEEEEDNEGGEWERVRGGVPLVKEKPKMFAKGTEITHAVVIKKLNEILQARGKKGTDRAAQIELLQLLVQIAAENNLGEGVIVKIKFNIIASLYDYNPNLATYMKPEMWGKCLDCINELMDILFANPNIFVGENILEESENLHNADQPLRVRGCILTLVERMDEEFTKIMQNTDPHSQEYVEHLKDEAQVCAIIERVQRYLEEKGTTEEVCRIYLLRILHTYYKFDYKAHQRQLTPPEGSSKSEQDQAENEGEDSAVLMERLCKYIYAKDRTDRIRTCAILCHIYHHALHSRWYQARDLMLMSHLQDNIQHADPPVQILYNRTMVQLGICAFRQGLTKDAHNALLDIQSSGRAKELLGQGLLLRSLQERNQEQEKVERRRQVPFHLHINLELLECVYLVSAMLLEIPYMAAHESDARRRMISKQFHHQLRVGERQPLLGPPESMREHVVAASKAMKMGDWKTCHSFIINEKMNGKVWDLFPEADKVRTMLVR

SEQ ID NO: 914752 - protein, 613 aa, Homo sapiens
MDDEDEDSEDSEDDEDWDTGSTSSDSDSEEEEGKQTALASRFLKKAPTTDEDKKAAEKKREDKAKKKHDRKSKRLDEEEEDNEGGEWERVRGGVPLVKEKPKMFAKGTEITHAVVIKKLNEILQARGKKGTDRAAQIELLQLLVQIAAENNLGEGVIVKIKFNIIASLYDYNPNLATYMKPEMWGKCLDCINELMDILFANPNIFVGENILEESENLHNADQPLRVRGCILTLVERMDEEFTKIMQNTDPHSQEYVEHLKDEAQVCAIIERVQRYLEEKGTTEEVCRIYLLRILHTYYKFDYKAHQRQLTPPEGSSKSEQDQAENEGEDSAVLMERLCKYIYAKDRTDRIRTCAILCHIYHHALHSRWYQARDLMLMSHLQDNIQHADPPVQILYNRTMVQLGICAFRQGLTKDAHNALLDIQSSGRAKELLGQGLLLRSLQERNQEQEKVERRRQVPFHLHINLELLECVYLVSAMLLEIPYMAAHESDARRRMISKQFHHQLRVGERQPLLGPPESMREHVVAASKAMKMGDWKTCHSFIINEKMNGKVWDLFPEADKVRTMLVRKIQEESLRTYLFTYSSVYDSISMETLSASGKRSHTFPFIFSLMIKL

SEQ ID NO: 914753 - protein, 659 aa, Homo sapiens
MDDEDEDSEDSEDDEDWDTGSTSSDSDSEEEEGKQTALASRFLKKAPTTDEDKKAAEKKREDKAKKKHDRKSKRLDEEEEDNEGGEWERVRGGVPLVKEKPKMFAKGTEITHAVVIKKLNEILQARGKKGTDRAAQIELLQLLVQIAAENNLGEGVIVKIKFNIIASLYDYNPNLATYMKPEMWGKCLDCINELMDILFANPNIFVGENILEESENLHNADQPLRVRGCILTLVERMDEEFTKIMQNTDPHSQEYVEHLKDEAQVCAIIERVQRYLEEKGTTEEVCRIYLLRILHTYYKFDYKAHQRQLTPPEGSSKSEQDQAENEGEDSAVLMERLCKYIYAKDRTDRIRTCAILCHIYHHALHSRWYQARDLMLMSHLQDNIQHADPPVQILYNRTMVQLGICAFRQGLTKDAHNALLDIQSSGRAKELLGQGLLLRSLQERNQEQEKVERRRQVPFHLHINLELLECVYLVSAMLLEIPYMAAHESDARRRMISKQFHHQLRVGERQPLLGPPESMREHVVAASKAMKMGDWKTCHSFIINEKMNGKVWDLFPEADKVRTMLVRKIQEESLRTYLFTYSSVYDSISMALMSDMFERHLPTCARQQLCNMINSSGTDHLPGPDNTDLSMLSTSGQLCVRRSAYGASDHNQVMIGYYF

SEQ ID NO: 914754 - protein, 581 aa, Homo sapiens
MDDEDEDSEDSEDDEDWDTGSTSSDSDSEEEEGKQTALASRFLKKAPTTDEDKKAAEKKREDKAKKKHDRKSKRLDEEEEDNEGGEWERVRGGVPLVKEKPKMFAKGTEITHAVVIKKLNEILQARGKKGTDRAAQIELLQLLVQIAAENNLGEGVIVKIKFNIIASLYDYNPNLATYMKPEMWGKCLDCINELMDILFANPNIFVGENILEESENLHNADQPLRVRGCILTLVERMDEEFTKIMQNTDPHSQEYVEHLKDEAQVCAIIERVQRYLEEKGTTEEVCRIYLLRILHTYYKFDYKAHQRQLTPPEGSSKSEQDQAENEGEDSAVLMERLCKYIYAKDRTDRIRTCAILCHIYHHALHSRWYQARDLMLMSHLQDNIQHADPPVQILYNRTMVQLGICAFRQGLTKDAHNALLDIQSSGRAKELLGQGLLLRSLQERNQEQEKVERRRQVPFHLHINLELLECVYLVSAMLLEIPYMAAHESDARRRMISKQFHHQLRVGERQPLLGPPESMREHVVAASKAMKMGDWKTCHSFIINEKMNGKVWDLSGHDYDQDCDIVLSKIQQETLETYILN

SEQ ID NO: 914755 - protein, 525 aa, Homo sapiens; identical to SEQ ID NO: 914728

SEQ ID NO: 914756 - protein, 619 aa, Homo sapiens
EEAGGDPGEESHRHEAKKGTTAAQIELLQLLVQIAAENNLGEGVIVKIKFNIIASLYDYNPNLATYMKPEMWGKCLDCINELMDILFANPNIFVGENILEESENLHNADQPLRVRGCILTLVERMDEEFTKIMQNTDPHSQEYVEHLKDEAQVCAIIERVQRYLEEKGTTEEVCRIYLLRILHTYYKFDYKAHQRQLTPPEGSSKSEQDQAENEGEDSAVLMERLCKYIYAKDRTDRIRTCAILCHIYHHALHSRWYQARDLMLMSHLQDNIQHADPPVQILYNRTMVQLGICAFRQGLTKDAHNALLDIQSSGRAKELLGQGLLLRSLQERNQEQEKVERRRQVPFHLHINLELLECVYLVSAMLLEIPYMAAHESDARRRMISKQFHHQLRVGERQPLLGPPESMREHVVAASKAMKMGDWKTCHSFIINEKMNGKVWDLFPEADKVRTMLVRKIQEESLRTYLFTYSSVYDSISMETLSDMFELDLPTVHSIISKMIINEELMASLDQPTQTVVMHRTEPTAQQNLALQLAEKLGSLVENNERVFDHKQGTYGGYFRDQKDGYRKNEGYMRRWWLPPAAVSDGLLSSPLCFPPGPSNLEVLNHTSVTKGLFKVCSG

SEQ ID NO: 914757 - protein, 313 aa, Homo sapiens
MDDEDEDSEDSEDDEDWDTGSTSSDSDSEEEEGKQTALASRFLKKAPTTDEDKKAAEKKREDKAKKKHDRKSKRLDEEEEDNEGGEWERVRGGVPLVKEKPKMFAKGTEITHAVVIKKLNEILQARGKKGTDRAAQIELLQLLVQIAAENNLGEGVIVKIKFNIIASLYDYNPNLATYMKPEMWGKCLDCINELMDILFANPNIFVGENILEESENLHNADQPLRVRGCILTLVERMDEEFTKIMQNTDPHSQEYVEHLKDEAQVCAIIERVQRYLEEKGTTEEVRITWLRDLKVCSSHRKTLGPKWNGKRGP

SEQ ID NO: 914758 - protein, 278 aa, Homo sapiens
MDDEDEDSEDSEDDEDWDTGSTSSDSDSEEEEGKQTALASRFLKKAPTTDEDKKAAEKKRGPPESMREHVVAASKAMKMGDWKTCHSFIINEKMNGKVWDLFPEADKVRTMLVRKIQEESLRTYLFTYSSVYDSISMETLSDMFELDLPTVHSIISKMIINEELMASLDQPTQTVVMHRTEPTAQQNLALQLAEKLGSLVENNERVFDHKQGTYGGYFRDQKDGYRKNEGYMRRWWLPPAAVSDGLLSSPLCFPPGPSNLEVLNHTSVTKGLFKVCSG

SEQ ID NO: 914759 - protein, 240 aa, Homo sapiens
MDDEDEDSEDSEDDEDWDTGSTSSDSDSEEEEGKQTALASRFLKKAPTTDEDKKAAEKKREDKAKKKHDRKSKRLDEEEEDNEGGEWERVRGGVPLVKEKPKMFAKGTEITHAVVIKKLNEILQARGKKGTDRAAQIELLQLLVQIAAENNLGEGVIVKIKFNIIASLYDYNPNLATYMKPEMWGKCLDCINELMDILFANPNIFVGENILEESENLHNADQPLRVRGCILHGAASSMVL

SEQ ID NO: 914760 - protein, 216 aa, Homo sapiens; identical to SEQ ID NO: 914721

SEQ ID NO: 914761 - protein, 216 aa, Homo sapiens; identical to SEQ ID NO: 914721

SEQ ID NO: 914762 - protein, 185 aa, Homo sapiens; identical to SEQ ID NO: 914713

SEQ ID NO: 914763 - protein, 117 aa, Homo sapiens
MQKSCEENEGKPQNMPKAEEDRPLEDVPQEAEGNPQPSEEGVSQEAEGNPRGGPNQPGQGFKEDTPVRHLDPEEMIRGVDELERLREEIRRVRNKFVMMHWKQRHSRSRPYPVCFRP

SEQ ID NO: 914764 - protein, 117 aa, Homo sapiens; identical to SEQ ID NO: 914763

SEQ ID NO: 914765 - protein, 149 aa, Homo sapiens
MPRRSGNNDRHKTSARPLHQNHSREQTKQEQNSHRQSATANRKAQTHRSKQRRPSRKTRADKQHTRENKRTRSNRTTATRGTRNHNNTQTTHSEETHAKEEQEQQGHAEEDTEHARKHKDEYRERNTKQSQTRRDKTTKPTHKEETERE

SEQ ID NO: 914766 - protein, 117 aa, Homo sapiens; identical to SEQ ID NO: 914763

SEQ ID NO: 914767 - protein, 162 aa, Homo sapiens
MLTVPKNPGGIMSVLETLHNIDGEVINGVNPLRSPAGVQLFINGPNNDDCEENEGKPQNMPKAEEDRPLEDVPQEAEGNPQPSEEGVSQEAEGNPRGGPNQPGQGFKEDTPVRHLDPEEMIRGVDELERLREEIRRVRNKFVMMHWKQRHSRSRPYPVCFRP

SEQ ID NO: 914768 - protein, 854 aa, Homo sapiens
MREMAGAWHMTVEQKFGLFSAEIKEADPLAASEASQPKPCPPEVTPHYIWIDFLVQRFEIAKYCSSDQVEIFSSLLQRSMSLNIGGAKGSMNRHVAAIGPRFKLLTLGLSLLHADVVPNATIRNVLREKIYSTAFDYFSCPPKFPTQGEKRLREDISIMIKFWTAMFSDKKYLTASQLVPPDNQDTRSNLDITVGSRQQATQGWINTYPLSSGMSTISKKSGMSKKTNRGSQLHKYYMKRRTLLLSLLATEIERLITWYNPLSAPELELDQAGENSVANWRSKYISLSEKQWKDNVNLAWSISPYLAVQLPARFKNTEAIGNEVTRLVRLDPGAVSDVPEAIKFLVTWHTIDADAPELSHVLCWAPTDPPTGLSYFSSMYPPHPLTAQYGVKVLRSFPPDAILFYIPQIVQALRYDKMGYVREYILWAASKSQLLAHQFIWNMKTNIYLDEEGHQKDPDIGDLLDQLVEEITGSLSGPAKDFYQREFDFFNKITNVSAIIKPYPKGDERKKACLSALSEVKVQPGCYLPSNPEAIVLDIDYKSGTPMQSAAKAPYLAKFKVKRCGVSELEKEGLRCRSDSEDECSTQEADGQKISWQAAIFKVGDDCRQDMLALQIIDLFKNIFQLVGLDLFVFPYRVVATAPGCGVIECIPDCTSRDQLGRQTDFGMYDYFTRQYGDESTLAFQQARYNFIRSMAAYSLLLFLLQIKDRHNGNIMLDKKGHIIHIDFGFMFESSPGGNLGWEPDIKLTDEMVMIMGGKMEATPFKWFMEMCVRGYLAVRPYMDAVVSLVTLMLDTGLPCFRGQTIKLLKHRFSPNMTEREAANFIMKVIQSCFLSNRSRTYDMIQYYQNDIPY

SEQ ID NO: 914769 - protein, 1777 aa, Homo sapiens
MFKMLRDTLYYMHQDLPTSFVKEIHDFVLEQFNTSQGELQKILHDADRIHNELSPLKLRCQANAACVDLMVWAVKDEQGAENLCIKLSEKLQSKTSSKVIIAHLPLLICCLQGLGRLCERFPVVVHSVTPSLRDFLVIPSPVLVKLYKYHSQYHTVAGNDIKISVTNEHSESTLNVMSGKKSQPSMYEQLRDIAIDNICRCLKAGLTVDPVIVEAFLASLSNRLYISQESDKDAHLIPDHTIRALGHIAVALRDTPKVMEPILQILQQKFCQPPSPLDVLIIDQLGCLVITGNQYIYQEVWNLFQQISVKASSVVYSATKDYKDHGYRHCSLAVINALANIAANIQDEHLVDELLMNLLELFVQLGLEGKRASERASEKGPALKASSSAGNLGVLIPVIAVLTRRLPPIKEAKPRLQKLFRDFWLYSVLMGFAVEGSGLWPEEWYEGVCEIATKSPLLTFPSKEPLRSVLQYNSAMKNDTVTPAQDSHLIFTMLSVPIRADLFTVIINTCCQPLGPVCPGGCPMSPRMFLSLQAELSELRSTIINLLDPPPEVSALINKLDFAMSTYLLSVYRLEYMRVLRSTDPDRFQVMFCYFEDKAIQKDKSGMMQCVIAVADKVFDAFLNMMADKAKTKENEEELERHAQFLLVNFNHIHKRIRRVADKYLSGLVDKFPHLLWSGTVLKTMLDILQTLSLSLSADIHKDQPYYDIPDAPYRITVPDTYEARESIVKDFAARCGMILQEAMKWAPTVTKSHLQEYLNKHQNWVSGLSQHTGLAMATESILHFAGYNKQNTTLGATQLSERPACVKKDYSNFMASLNLRNRYAGEVYGMIRFSGTTGQMSDLNKMMVQDLHSALDRSHPQHYTQAMFKLTAMLISSKDCDPQLLHHLCWGPLRMFNEHGMETALACWEWLLAGKDGVEVPFMREMAGAWHMTVEQKFGLFSAEIKEADPLAASEASQPKPCPPEVTPHYIWIDFLVQRFEIAKYCSSDQVEIFSSLLQRSMSLNIGGAKGSMNRHVAAIGPRFKLLTLGLSLLHADVVPNATIRNVLREKIYSTAFDYFSCPPKFPTQGEKRLREDISIMIKFWTAMFSDKKYLTASQLVPPDNQDTRSNLDITVGSRQQATQGWINTYPLSSGMSTISKKSGMSKKTNRGSQLHKYYMKRRTLLLSLLATEIERLITWYNPLSAPELELDQAGENSVANWRSKYISLSEKQWKDNVNLAWSISPYLAVQLPARFKNTEAIGNEVTRLVRLDPGAVSDVPEAIKFLVTWHTIDADAPELSHVLCWAPTDPPTGLSYFSSMYPPHPLTAQYGVKVLRSFPPDAILFYIPQIVQALRYDKMGYVREYILWAASKSQLLAHQFIWNMKTNIYLDEEGHQKDPDIGDLLDQLVEEITGSLSGPAKDFYQREFDFFNKITNVSAIIKPYPKGDERKKACLSALSEVKVQPGCYLPSNPEAIVLDIDYKSGTPMQSAAKAPYLAKFKVKRCGVSELEKEGLRCRSDSEDECSTQEADGQKISWQAAIFKVGDDCRQDMLALQIIDLFKNIFQLVGLDLFVFPYRVVATAPGCGVIECIPDCTSRDQLGRQTDFGMYDYFTRQYGDESTLAFQQARYNFIRSMAAYSLLLFLLQIKDRHNGNIMLDKKGHIIHIDFGFMFESSPGGNLGWEPDIKLTDEMVMIMGGKMEATPFKWFMEMCVRGYLAVRPYMDAVVSLVTLMLDTGLPCFRGQTIKLLKHRFSPNMTEREAANFIMKVIQSCFLSNRSRTYDMIQYYQNDIPY

SEQ ID NO: 914770 - protein, 937 aa, Homo sapiens
MSDLNKMMVQDLHSALDRSHPQHYTQAMFKLTAMLISSKDCDPQLLHHLCWGPLRMFNEHGMETALACWEWLLAGKDGVEVPFMREMAGAWHMTVEQKFGLFSAEIKEADPLAASEASQPKPCPPEVTPHYIWIDFLVQRFEIAKYCSSDQVEIFSSLLQRSMSLNIGGAKGSMNRHVAAIGPRFKLLTLGLSLLHADVVPNATIRNVLREKIYSTAFDYFSCPPKFPTQGEKRLREDISIMIKFWTAMFSDKKYLTASQLVPPDNQDTRSNLDITVGSRQQATQGWINTYPLSSGMSTISKKSGMSKKTNRGSQLHKYYMKRRTLLLSLLATEIERLITWYNPLSAPELELDQAGENSVANWRSKYISLSEKQWKDNVNLAWSISPYLAVQLPARFKNTEAIGNEVTRLVRLDPGAVSDVPEAIKFLVTWHTIDADAPELSHVLCWAPTDPPTGLSYFSSMYPPHPLTAQYGVKVLRSFPPDAILFYIPQIVQALRYDKMGYVREYILWAASKSQLLAHQFIWNMKTNIYLDEEGHQKDPDIGDLLDQLVEEITGSLSGPAKDFYQREFDFFNKITNVSAIIKPYPKGDERKKACLSALSEVKVQPGCYLPSNPEAIVLDIDYKSGTPMQSAAKAPYLAKFKVKRCGVSELEKEGLRCRSDSEDECSTQEADGQKISWQAAIFKVGDDCRQDMLALQIIDLFKNIFQLVGLDLFVFPYRVVATAPGCGVIECIPDCTSRDQLGRQTDFGMYDYFTRQYGDESTLAFQQARYNFIRSMAAYSLLLFLLQIKDRHNGNIMLDKKGHIIHIDFGFMFESSPGGNLGWEPDIKLTDEMVMIMGGKMEATPFKWFMEMCVRGYLAVRPYMDAVVSLVTLMLDTGLPCFRGQTIKLLKHRFSPNMTEREAANFIMKVIQSCFLSNRSRTYDMIQYYQNDIPY

SEQ ID NO: 914771 - protein, 1679 aa, Homo sapiens
MFKMLRDTLYYMHQDLPTSFVKEIHDFVLEQFNTSQGELQKILHDADRIHNELSPLKLRCQANAACVDLMVWAVKDEQGAENLCIKLSEKLQSKTSSKVIIAHLPLLICCLQGLGRLCERFPVVVHSVTPSLRDFLVIPSPVLVKLYKYHSQYHTVAGNDIKISVTNEHSESTLNVMSGKKSQPSMYEQLRDIAIDNICRCLKAGLTVDPVIVEAFLASLSNRLYISQESDKDAHLIPDHTIRALGHIAVALRDTPKVMEPILQILQQKFCQPPSPLDVLIIDQLGCLVITGNQYIYQEVWNLFQQISVKASSVVYSATKDYKDHGYRHCSLAVINALANIAANIQDEHLVDELLMNLLELFVQLGLEGKRASERASEKGPALKASSSAGNLGVLIPVIAVLTRRLPPIKEAKPRLQKLFRDFWLYSVLMGFAVEGSGLWPEEWYEGVCEIATKSPLLTFPSKEPLRSVLQYNSAMKNDTVTPAELSELRSTIINLLDPPPEVSALINKLDFAMSTYLLSVYRLEYMRVLRSTDPDRFQVMFCYFEDKAIQKDKSGMMQCVIAVADKVFDAFLNMMADKAKTKENEEELERHAQFLLVNFNHIHKRIRRVADKYLSGLVDKFPHLLWSGTVLKTMLDILQTLSLSLSADIHKDQPYYDIPDAPYRITVPDTYEARESIVKDFAARCGMILQEAMKWAPTVTKSHLQEYLNKHQNWVSGLSQHTGLAMATESILHFAGYNKQNTTLGATQLSERPACVKKDYSNFMASLNLRNRYAGEVYGMIRFSGTTGQMSDLNKMMVQDLHSALDRSHPQHYTQAMFKLTAMLISSKDCDPQLLHHLCWGPLRMFNEHGMETALACWEWLLAGKDGVEVPFMREMAGAWHMTVEQKFGLFSAEIKEADPLAASEASQPKPCPPEVTPHYIWIDFLVQRFEIAKYCSSDQVEIFSSLLQRSMSLNIGGAKGSMNRHVAAIGPRFKLLTLGLSLLHADVVPNATIRNVLREKIYSTAFDYFSCPPKFPTQGEKRLREDISIMIKFWTAMFSDKKYLTASQLVPPDNQDTRSNLDITVGSRQQATQGWINTYPLSSGMSTISKKSGMSKKTNRGSQLHKYYMKRRTLLLSLLATEIERLITWYNPLSAPELELDQAGENSVANWRSKYISLSEKQWKDNVNLAWSISPYLAVQLPARFKNTEAIGNEVTRLVRLDPGAVSDVPEAIKFLVTWHTIDADAPELSHVLCWAPTDPPTGLSYFSSMYPPHPLTAQYGVKVLRSFPPDAILFYIPQIVQALRYDKMGYVREYILWAASKSQLLAHQFIWNMKTNIYLDEEGHQKDPDIGDLLDQLVEEITGSLSGPAKDFYQREFDFFNKITNVSAIIKPYPKGDERKKACLSALSEVKVQPGLRCRSDSEDECSTQEADGQKISWQAAIFKVGDDCRQDMLALQIIDLFKNIFQLVGLDLFVFPYRVVATAPGCGVIECIPDCTSRDQLGRQTDFGMYDYFTRQYGDESTLAFQQARYNFIRSMAAYSLLLFLLQIKDRHNGNIMLDKKGHIIHIDFGFMFESSPGGNLGWEPDIKLTDEMVMIMGGKMEATPFKWFMEMCVRGYLAVRPYMDAVVSLVTLMLDTGLPCFRGQTIKLLKHRFSPNMTEREAANFIMKVIQSCFLSNRSRTYDMIQYYQNDIPY

SEQ ID NO: 914772 - protein, 1727 aa, Homo sapiens
MFKMLRDTLYYMHQDLPTSFVKEIHDFVLEQFNTSQGELQKILHDADRIHNELSPLKLRCQANAACVDLMVWAVKDEQGAENLCIKLSEKLQSKTSSKVIIAHLPLLICCLQGLGRLCERFPVVVHSVTPSLRDFLVIPSPVLVKLYKYHSQYHTVAGNDIKISVTNEHSESTLNVMSGKKSQPSMYEQLRDIAIDNICRCLKAGLTVDPVIVEAFLASLSNRLYISQESDKDAHLIPDHTIRALGHIAVALRDTPKVMEPILQILQQKFCQPPSPLDVLIIDQLGCLVITGNQYIYQEVWNLFQQISVKASSVVYSATKDYKDHGYRHCSLAVINALANIAANIQDEHLVDELLMNLLELFVQLGLEGKRASERASEKGPALKASSSAGNLGVLIPVIAVLTRRLPPIKEAKPRLQKLFRDFWLYSVLMGFAVEGSGLWPEEWYEGVCEIATKSPLLTFPSKEPLRSVLQYNSAMKNDTVTPAELSELRSTIINLLDPPPEVSALINKLDFAMSTYLLSVYRLEYMRVLRSTDPDRFQVMFCYFEDKAIQKDKSGMMQCVIAVADKVFDAFLNMMADKAKTKENEEELERHAQFLLVNFNHIHKRIRRVADKYLSGLVDKFPHLLWSGTVLKTMLDILQTLSLSLSADIHKDQPYYDIPDAPYRITVPDTYEARESIVKDFAARCGMILQEAMKWAPTVTKSHLQEYLNKHQNWVSGLSQHTGLAMATESILHFAGYNKQNTTLGATQLSERPACVKKDYSNFMASLNLRNRYAGEVYGMIRFSGTTGQMSDLNKMMVQDLHSALDRSHPQHYTQAMFKLTAMLISSKDCDPQLLHHLCWGPLRMFNEHGMETALACWEWLLAGKDGVEVPFMREMAGAWHMTVEQKFGLFSAEIKEADPLAASEASQPKPCPPEVTPHYIWIDFLVQRFEIAKYCSSDQVEIFSSLLQRSMSLNIGGAKGSMNRHVAAIGPRFKLLTLGLSLLHADVVPNATIRNVLREKIYSTAFDYFSCPPKFPTQGEKRLREDISIMIKFWTAMFSDKKYLTASQLVPPDNQDTRSNLDITVGSRQQATQGWINTYPLSSGMSTISKKSGMSKKTNRGSQLHKYYMKRRTLLLSLLATEIERLITWYNPLSAPELELDQAGENSVANWRSKYISLSEKQWKDNVNLAWSISPYLAVQLPARFKNTEAIGNEVTRLVRLDPGAVSDVPEAIKFLVTWHTIDADAPELSHVLCWAPTDPPTGLSYFSSMYPPHPLTAQYGVKVLRSFPPDAILFYIPQIVQALRYDKMGYVREYILWAASKSQLLAHQFIWNMKTNIYLDEEGHQKDPDIGDLLDQLVEEITGSLSGPAKDFYQREFDFFNKITNVSAIIKPYPKGDERKKACLSALSEVKVQPGCYLPSNPEAIVLDIDYKSGTPMQSAAKAPYLAKFKVKRCGVSELEKEGLRCRSDSEDECSTQEADGQKISWQAAIFKVGDDCRQDMLALQIIDLFKNIFQLVGLDLFVFPYRVVATAPGCGVIECIPDCTSRDQLGRQTDFGMYDYFTRQYGDESTLAFQQARYNFIRSMAAYSLLLFLLQIKDRHNGNIMLDKKGHIIHIDFGFMFESSPGGNLGWEPDIKLTDEMVMIMGGKMEATPFKWFMEMCVRGYLAVRPYMDAVVSLVTLMLDTGLPCFRGQTIKLLKHRFSPNMTEREAANFIMKVIQSCFLSNRSRTYDMIQYYQNDIPY

SEQ ID NO: 914773 - protein, 1727 aa, Homo sapiens; identical to SEQ ID NO: 914772

SEQ ID NO: 914774 - protein, 375 aa, Homo sapiens
WAVPQQPVPPGDKARISFLFLRPYPKGDERKKACLSALSEVKVQPGCYLPSNPEAIVLDIDYKSGTPMQSAAKAPYLAKFKVKRCGVSELEKEGLRCRSDSEDECSTQEADGQKISWQAAIFKVGDDCRQDMLALQIIDLFKNIFQLVGLDLFVFPYRVVATAPGCGVIECIPDCTSRDQLGRQTDFGMYDYFTRQYGDESTLAFQQARYNFIRSMAAYSLLLFLLQIKDRHNGNIMLDKKGHIIHIDFGFMFESSPGGNLGWEPDIKLTDEMVMIMGGKMEATPFKWFMEMCVRGYLAVRPYMDAVVSLVTLMLDTGLPCFRGQTIKLLKHRFSPNMTEREAANFIMKVIQSCFLSNRSRTYDMIQYYQNDIPY

SEQ ID NO: 914775 - protein, 268 aa, Homo sapiens [sequence omitted]

SEQ ID NO: 914776 - protein, 1347 aa, Homo sapiens
MFKMLRDTLYYMHQDLPTSFVKEIHDFVLEQFNTSQGELQKILHDADRIHNELSPLKLRCQANAACVDLMVWAVKDEQGAENLCIKLSEKLQSKTSSKVIIAHLPLLICCLQGLGRLCERFPVVVHSVTPSLRDFLVIPSPVLVKLYKYHSQYHTVAGNDIKISVTNEHSESTLNVMSGKKSQPSMYEQLRDIAIDNICRCLKAGLTVDPVIVEAFLASLSNRLYISQESDKDAHLIPDHTIRALGHIAVALRDTPKVMEPILQILQQKFCQPPSPLDVLIIDQLGCLVITGNQYIYQEVWNLFQQISVKASSVVYSATKDYKDHGYRHCSLAVINALANIAANIQDEHLVDELLMNLLELFVQLGLEGKRASERASEKGPALKASSSAGNLGVLIPVIAVLTRRLPPIKEAKPRLQKLFRDFWLYSVLMGFAVEGSGLWPEEWYEGVCEIATKSPLLTFPSKEPLRSVLQYNSAMKNDTVTPAELSELRSTIINLLDPPPEVSALINKLDFAMSTYLLSVYRLEYMRVLRSTDPDRFQVMFCYFEDKAIQKDKSGMMQCVIAVADKVFDAFLNMMADKAKTKENEEELERHAQFLLVNFNHIHKRIRRVADKYLSGLVDKFPHLLWSGTVLKTMLDILQTLSLSLSADIHKDQPYYDIPDAPYRITVPDTYEARESIVKDFAARCGMILQEAMKWAPTVTKSHLQEYLNKHQNWVSGLSQHTGLAMATESILHFAGYNKQNTTLGATQLSERPACVKKDYSNFMASLNLRNRYAGEVYGMIRFSGTTGQMSDLNKMMVQDLHSALDRSHPQHYTQAMFKLTAMLISSKDCDPQLLHHLCWGPLRMFNEHGMETALACWEWLLAGKDGVEVPFMREMAGAWHMTVEQKFGLFSAEIKEADPLAASEASQPKPCPPEVTPHYIWIDFLVQRFEIAKYCSSDQVEIFSSLLQRSMSLNIGGAKGSMNRHVAAIGPRFKLLTLGLSLLHADVVPNATIRNVLREKIYSTAFDYFSCPPKFPTQGEKRLREDISIMIKFWTAMFSDKKYLTASQLVPPDNQDTRSNLDITVGSRQQATQGWINTYPLSSGMSTISKKSGMSKKTNRGSQLHKYYMKRRTLLLSLLATEIERLITWYNPLSAPELELDQAGENSVANWRSKYISLSEKQWKDNVNLAWSISPYLAVQLPARFKNTEAIGNEVTRLVRLDPGAVSDVPEAIKFLVTWHTIDADAPELSHVLCWAPTDPPTGLSYFSSMYPPHPLTAQYGVKVLRSFPPDAILFYIPQIVQALRYDKVSLHLHGRPLHSQSVFHTSLCPVCPQPSQAPQSLLRGRAAQQSPCSPYPRPCDCPLI

SEQ ID NO: 914777 - protein, 1059 aa, Homo sapiens
MFKMLRDTLYYMHQDLPTSFVKEIHDFVLEQFNTSQGELQKILHDADRIHNELSPLKLRCQANAACVDLMVWAVKDEQGAENLCIKLSEKLQSKTSSKVIIAHLPLLICCLQGLGRLCERFPVVVHSVTPSLRDFLVIPSPVLVKLYKYHSQYHTVAGNDIKISVTNEHSESTLNVMSGKKSQPSMYEQLRDIAIDNICRCLKAGLTVDPVIVEAFLASLSNRLYISQESDKDAHLIPDHTIRALGHIAVALRDTPKVMEPILQILQQKFCQPPSPLDVLIIDQLGCLVITGNQYIYQEVWNLFQQISVKASSVVYSATKDYKDHGYRHCSLAVINALANIAANIQDEHLVDELLMNLLELFVQLGLEGKRASERASEKGPALKASSSAGNLGVLIPVIAVLTRRLPPIKEAKPRLQKLFRDFWLYSVLMGFAVEGSGLWPEEWYEGVCEIATKSPLLTFPSKEPLRSVLQYNSAMKNDTVTPAELSELRSTIINLLDPPPEVSALINKLDFAMSTYLLSVYRLEYMRVLRSTDPDRFQVMFCYFEDKAIQKDKSGMMQCVIAVADKVFDAFLNMMADKAKTKENEEELERHAQFLLVNFNHIHKRIRRVADKYLSGLVDKFPHLLWSGTVLKTMLDILQTLSLSLSADIHKDQPYYDIPDAPYRITVPDTYEARESIVKDFAARCGMILQEAMKWAPTVTKSHLQEYLNKHQNWVSGLSQHTGLAMATESILHFAGYNKQNTTLGATQLSERPACVKKDYSNFMASLNLRNRYAGEVYGMIRFSGTTGQMSDLNKMMVQDLHSALDRSHPQHYTQAMFKLTAMLISSKDCDPQLLHHLCWGPLRMFNEHGMETALACWEWLLAGKDGVEVPFMREMAGAWHMTVEQKFGLFSAEIKEADPLAASEASQPKPCPPEVTPHYIWIDFLVQRFEIAKYCSSDQVEIFSSLLQRSMSLNIGGAKGSMNRHVAAIGPRFKLLTLGLSLLHADVVPNATIRNVLREKIYSTAFDYFSCPPKFPTQGEKRLREDISIMIKFWTAMFSDKKYLTASQLVPPDNQDT

SEQ ID NO: 914778 - protein, 875 aa, Homo sapiens
MFKMLRDTLYYMHQDLPTSFVKEIHDFVLEQFNTSQGELQKILHDADRIHNELSPLKLRCQANAACVDLMVWAVKDEQGAENLCIKLSEKLQSKTSSKVIIAHLPLLICCLQGLGRLCERFPVVVHSVTPSLRDFLVIPSPVLVKLYKYHSQYHTVAGNDIKISVTNEHSESTLNVMSGKKSQPSMYEQLRDIAIDNICRCLKAGLTVDPVIVEAFLASLSNRLYISQESDKDAHLIPDHTIRALGHIAVALRDTPKVMEPILQILQQKFCQPPSPLDVLIIDQLGCLVITGNQYIYQEVWNLFQQISVKASSVVYSATKDYKDHGYRHCSLAVINALANIAANIQDEHLVDELLMNLLELFVQLGLEGKRASERASEKGPALKASSSAGNLGVLIPVIAVLTRRLPPIKEAKPRLQKLFRDFWLYSVLMGFAVEGSGLWPEEWYEGVCEIATKSPLLTFPSKEPLRSVLQYNSAMKNDTVTPAELSELRSTIINLLDPPPEVSALINKLDFAMSTYLLSVYRLEYMRVLRSTDPDRFQVMFCYFEDKAIQKDKSGMMQCVIAVADKVFDAFLNMMADKAKTKENEEELERHAQFLLVNFNHIHKRIRRVADKYLSGLVDKFPHLLWSGTVLKTMLDILQTLSLSLSADIHKDQPYYDIPDAPYRITVPDTYEARESIVKDFAARCGMILQEAMKWAPTVTKSHLQEYLNKHQNWVSGLSQHTGLAMATESILHFAGYNKQNTTLGATQLSERPACVKKDYSNFMASLNLRNRYAGEVYGMIRFSGTTGQMSDLNKMMVQDLHSALDRSHPQHYTQAMFKLTAMLISSKDCDPQLLHHLCWGPLRMFNEHGMETALACWEWLLAGKDGVEVPVGP

SEQ ID NO: 914779 - protein, 551 aa, Homo sapiens
MFKMLRDTLYYMHQDLPTSFVKEIHDFVLEQFNTSQGELQKILHDADRIHNELSPLKLRCQANAACVDLMVWAVKDEQGAENLCIKLSEKLQSKTSSKVIIAHLPLLICCLQGLGRLCERFPVVVHSVTPSLRDFLVIPSPVLVKLYKYHSQYHTVAGNDIKISVTNEHSESTLNVMSGKKSQPSMYEQLRDIAIDNICRCLKAGLTVDPVIVEAFLASLSNRLYISQESDKDAHLIPDHTIRALGHIAVALRDTPKVMEPILQILQQKFCQPPSPLDVLIIDQLGCLVITGNQYIYQEVWNLFQQISVKASSVVYSATKDYKDHGYRHCSLAVINALANIAANIQDEHLVDELLMNLLELFVQLGLEGKRASERASEKGPALKASSSAGNLGVLIPVIAVLTRRLPPIKEAKPRLQKLFRDFWLYSVLMGFAVEGSGLWPEEWYEGVCEIATKSPLLTFPSKEPLRSVLQYNSAMKNDTVTPAELSELRSTIINLLDPPPEVSALINKLDFAMSTYLLSVYRLEYMRYTCLHHHAHAHPHLSRVFIFVPS

SEQ ID NO: 914780 - protein, 309 aa, Homo sapiens
MFKMLRDTLYYMHQDLPTSFVKEIHDFVLEQFNTSQGELQKILHDADRIHNELSPLKLRCQANAACVDLMVWAVKDEQGAENLCIKLSEKLQSKTSSKVIIAHLPLLICCLQGLGRLCERFPVVVHSVTPSLRDFLVIPSPVLVKLYKYHSQYHTVAGNDIKISVTNEHSESTLNVMSGKKSQPSMYEQLRDIAIDNICRCLKAGLTVDPVIVEAFLASLSNRLYISQESDKDAHLIPDHTIRALGHIAVALRDTPKVMEPILQILQQKFCQPPSPLDVLIIDQLGCLVITGNVREARARTPLTLCKLR

SEQ ID NO: 914781 - protein, 205 aa, Homo sapiens
MSQKSCWGARTPTDRILRLPASQDMLALQIIDLFKNIFQLVGLDLFVFPYRVVATAPGCGVIECIPDCTSRDQLGRQTDFGMYDYFTRQYGDESTLAFQQARYNFIRSMAAYSLLLFLLQIKDRHNGNIMLDKKGHIIHIGQPATAPPSSPFTPGTQGWIGIPTPQRGECPGPPCQECQGPALRSELSATKLFCCRGCLAPAPGS

SEQ ID NO: 914782 - protein, 149 aa, Homo sapiens
GDERKKACLSALSEVKVQPGEQVASGGSDQPLPAGGRRGVKAAALSRHCRMWTQWLGQPHTCLGPRCLVPQDPSPSPESAASERELLVSGCPSSSLLPAVFLEADSDLSSCYSRRGFLGSSITGAGHTDEGMAGPVWDGSGVLGPISTT

SEQ ID NO: 914783 - protein, 2045 aa, Homo sapiens
MCPVDFHGIFQLDERRRDAVIALGIFLIESDLQHKDCVVPYLLRLLKGLPKVYWVEESTARKGRGALPVAESFSFCLVTLLSDVAYRDPSLRDEILEVLLQVLHVLLGMCQALEIQDKEYLCKYAIPCLIGISRAFGRYSNMEESLLSKLFPKIPPHSLRVLEELEGVRRRSFNDFRSILPSNLLTVCQEGTLKRKTSSVSSISQVSPERGMPPPSSPGGSAFHYFEASCLPDGTALEPEYYFSTISSSFSVSPLFNGVTYKEFNIPLEMLRELLNLVKKIVEEAVLKSLDAIVASVMEANPSADLYYTSFSDPLYLTMFKMLRDTLYYMHQDLPTSFVKEIHDFVLEQFNTSQGELQKILHDADRIHNELSPLKLRCQANAACVDLMVWAVKDEQGAENLCIKLSEKLQSKTSSKVIIAHLPLLICCLQGLGRLCERFPVVVHSVTPSLRDFLVIPSPVLVKLYKYHSQYHTVAGNDIKISVTNEHSESTLNVMSGKKSQPSMYEQLRDIAIDNICRCLKAGLTVDPVIVEAFLASLSNRLYISQESDKDAHLIPDHTIRALGHIAVALRDTPKVMEPILQILQQKFCQPPSPLDVLIIDQLGCLVITGNQYIYQEVWNLFQQISVKASSVVYSATKDYKDHGYRHCSLAVINALANIAANIQDEHLVDELLMNLLELFVQLGLEGKRASERASEKGPALKASSSAGNLGVLIPVIAVLTRRLPPIKEAKPRLQKLFRDFWLYSVLMGFAVEGSGLWPEEWYEGVCEIATKSPLLTFPSKEPLRSVLQYNSAMKNDTVTPAELSELRSTIINLLDPPPEVSALINKLDFAMSTYLLSVYRLEYMRVLRSTDPDRFQVMFCYFEDKAIQKDKSGMMQCVIAVADKVFDAFLNMMADKAKTKENEEELERHAQFLLVNFNHIHKRIRRVADKYLSGLVDKFPHLLWSGTVLKTMLDILQTLSLSLSADIHKDQPYYDIPDAPYRITVPDTYEARESIVKDFAARCGMILQEAMKWAPTVTKSHLQEYLNKHQNWVSGLSQHTGLAMATESILHFAGYNKQNTTLGATQLSERPACVKKDYSNFMASLNLRNRYAGEVYGMIRFSGTTGQMSDLNKMMVQDLHSALDRSHPQHYTQAMFKLTAMLISSKDCDPQLLHHLCWGPLRMFNEHGMETALACWEWLLAGKDGVEVPFMREMAGAWHMTVEQKFGLFSAEIKEADPLAASEASQPKPCPPEVTPHYIWIDFLVQRFEIAKYCSSDQVEIFSSLLQRSMSLNIGGAKGSMNRHVAAIGPRFKLLTLGLSLLHADVVPNATIRNVLREKIYSTAFDYFSCPPKFPTQGEKRLREDISIMIKFWTAMFSDKKYLTASQLVPPDNQDTRSNLDITVGSRQQATQGWINTYPLSSGMSTISKKSGMSKKTNRGSQLHKYYMKRRTLLLSLLATEIERLITWYNPLSAPELELDQAGENSVANWRSKYISLSEKQWKDNVNLAWSISPYLAVQLPARFKNTEAIGNEVTRLVRLDPGAVSDVPEAIKFLVTWHTIDADAPELSHVLCWAPTDPPTGLSYFSSMYPPHPLTAQYGVKVLRSFPPDAILFYIPQIVQALRYDKMGYVREYILWAASKSQLLAHQFIWNMKTNIYLDEEGHQKDPDIGDLLDQLVEEITGSLSGPAKDFYQREFDFFNKITNVSAIIKPYPKGDERKKACLSALSEVKVQPGCYLPSNPEAIVLDIDYKSGTPMQSAAKAPYLAKFKVKRCGVSELEKEGLRCRSDSEDECSTQEADGQKISWQAAIFKVGDDCRQDMLALQIIDLFKNIFQLVGLDLFVFPYRVVATAPGCGVIECIPDCTSRDQLGRQTDFGMYDYFTRQYGDESTLAFQQARYNFIRSMAAYSLLLFLLQIKDRHNGNIMLDKKGHIIHIDFGFMFESSPGGNLGWEPDIKLTDEMVMIMGGKMEATPFKWFMEMCVRGYLAVRPYMDAVVSLVTLMLDTGLPCFRGQTIKLLKHRFSPNMTEREAANFIMKVIQSCFLSNRSRTYDMIQYYQNDIPY

SEQ ID NO: 914784 - protein, 1727 aa, Homo sapiens; identical to SEQ ID NO: 914772

SEQ ID NO: 914785 - protein, 1960 aa, Homo sapiens
MFKMLRDTLYYMHQDLPTSFVKEIHDFVLEQFNTSQGELQKILHDADRIHNELSPLKLRCQANAACVDLMVWAVKDEQGAENLCIKLSEKLQSKTSSKVIIAHLPLLICCLQGLGRLCERFPVVVHSVTPSLRDFLVIPSPVLVKLYKYHSQYHTVAGNDIKISVTNEHSESTLNVMSGKKSQPSMYEQLRDIAIDNICRCLKAGLTVDPVIVEAFLASLSNRLYISQESDKDAHLIPDHTIRALGHIAVALRDTPKVMEPILQILQQKFCQPPSPLDVLIIDQLGCLVITGNQYIYQEVWNLFQQISVKASSVVYSATKDYKDHGYRHCSLAVINALANIAANIQDEHLVDELLMNLLELFVQLGLEGKRASERASEKGPALKASSSAGNLGVLIPVIAVLTRRLPPIKEAKPRLQKLFRDFWLYSVLMGFAVEGSGLWPEEWYEGVCEIATKSPLLTFPSKEPLRSVLQYNSAMKNDTVTPAELSELRSTIINLLDPPPEVSALINKLDFAMSTYLLSVYRLEYMRVLRSTDPDRFQVMFCYFEDKAIQKDKSGMMQCVIAVADKVFDAFLNMMADKAKTKENEEELERHAQFLLVNFNHIHKRIRRVADKYLSGLVDKFPHLLWSGTVLKTMLDILQTLSLSLSADIHKDQPYYDIPDAPYRITVPDTYEARESIVKDFAARCGMILQEAMKWAPTVTKSHLQEYLNKHQNWVSGLSQHTGLAMATESILHFAGYNKQNTTLGATQLSERPACVKKDYSNFMASLNLRNRYAGEVYGMIRFSGTTGQMSDLNKMMVQDLHSALDRSHPQHYTQAMFKLTAMLISSKDCDPQLLHHLCWGPLRMFNEHGMETALACWEWLLAGKDGVEVPFMREMAGAWHMTVEQKFGLFSAEIKEADPLAASEASQPKPCPPEVTPHYIWIDFLVQRFEIAKYCSSDQVEIFSSLLQRSMSLNIGGAKGSMNRHVAAIGPRFKLLTLGLSLLHADVVPNATIRNVLREKIYSTAFDYFSCPPKFPTQGEKRLREDISIMIKFWTAMFSDKKYLTASQLVPPDNQDTRSNLDITVGSRQQATQGWINTYPLSSGMSTISKKSGMSKKTNRGSQLHKYYMKRRTLLLSLLATEIERLITWYNPLSAPELELDQAGENSVANWRSKYISLSEKQWKDNVNLAWSISPYLAVQLPARFKNTEAIGNEVTRLVRLDPGAVSDVPEAIKFLVTWHTIDADAPELSHVLCWAPTDPPTGLSYFSSMYPPHPLTAQYGVKVLRSFPPDAILFYIPQIVQALRYDKMGYVREYILWAASKSQLLAHQFIWNMKTNIYLDEEGHQKDPDIGDLLDQLVEEITGSLSGPAKDFYQREFDFFNKITNVSAIIKPYPKGDERKKACLSALSEVKVQPGCYLPSNPEAIVLDIDYKSGTPMQSAAKAPYLAKFKVKRCGVSELEKEGLRCRSDSEDECSTQEADGQKISWQAAIFKVGDDCRQDMLALQIIDLFKNIFQLVGLDLFVFPYRVVATAPGCGVIECIPDCTSRDQLGRQTDFGMYDYFTRQYGDESTLAFQQARYNFIRSMAAYSLLLFLLQIKDRHNGNIMLDKKGHIIHIDFGFMFESSPGGNLGWEPDIKLTDEMVMIMGGKMEATPFKWFMEMCVRGYLAVRLSLGEGQGGGGGGVWNVLRSPLDEGNPVPESEVGASSHLLTYTCPLVTSVCPPVPVNSCSGHLIPTTFPTILPTPSAMGSPFLGIPSTLSPKPEHLPPHRLRAKDGLCPSFIYRSLGQGTVQPGSSPLPCRERQVSVSASHPSAEAMAGSLMWGTGQDTQPVQSACGQPLPGRYGLPSAADRKLPRGCARCGRRGGWQEPTPEAVGISQATGLQAGPPPRLASAHRSLLSLPRPYMDAVVSLVTLMLDTGLPCFRGQTIKLLKHRFSPNMTEREAANFIMKVIQSCFLSNRSRTYDMIQYYQNDIPY

SEQ ID NO: 914786 - protein, 975 aa, Homo sapiens
MFKMLRDTLYYMHQDLPTSFVKEIHDFVLEQFNTSQGELQKILHDADRIHNELSPLKLRCQANAACVDLMVWAVKDEQGAENLCIKLSEKLQSKTSSKVIIAHLPLLICCLQGLGRLCERFPVVVHSVTPSLRDFLVIPSPVLVKLYKYHSQYHTVAGNDIKISVTNEHSESTLNVMSGKKSQPSMYEQLRDIAIDNICRCLKAGLTVDPVIVEAFLASLSNRLYISQESDKDAHLIPDHTIRALGHIAVALRDTPKVMEPILQILQQKFCQPPSPLDVLIIDQLGCLVITGNQYIYQEVWNLFQQISVKASSVVYSATKDYKDHGYRHCSLAVINALANIAANIQDEHLVDELHKYYMKRRTLLLSLLATEIERLITWYNPLSAPELELDQAGENSVANWRSKYISLSEKQWKDNVNLAWSISPYLAVQLPARFKNTEAIGNEVTRLVRLDPGAVSDVPEAIKFLVTWHTIDADAPELSHVLCWAPTDPPTGLSYFSSMYPPHPLTAQYGVKVLRSFPPDAILFYIPQIVQALRYDKMGYVREYILWAASKSQLLAHQFIWNMKTNIYLDEEGHQKDPDIGDLLDQLVEEITGSLSGPAKDFYQREFDFFNKITNVSAIIKPYPKGDERKKACLSALSEVKVQPGCYLPSNPEAIVLDIDYKSGTPMQSAAKAPYLAKFKVKRCGVSELEKEGLRCRSDSEDECSTQEADGQKISWQAAIFKVGDDCRQDMLALQIIDLFKNIFQLVGLDLFVFPYRVVATAPGCGVIECIPDCTSRDQLGRQTDFGMYDYFTRQYGDESTLAFQQARYNFIRSMAAYSLLLFLLQIKDRHNGNIMLDKKGHIIHIDFGFMFESSPGGNLGWEPDIKLTDEMVMIMGGKMEATPFKWFMEMCVRGYLAVRPYMDAVVSLVTLMLDTGLPCFRGQTIKLLKHRFSPNMTEREAANFIMKVIQSCFLSNRSRTYDMIQYYQNDIPY

SEQ ID NO: 914787 - protein, 1727 aa, Homo sapiens; identical to SEQ ID NO: 914772

SEQ ID NO: 914788 - protein, 1664 aa, Homo sapiens
MFKMLRDTLYYMHQDLPTSFVKEIHDFVLEQFNTSQGELQKILHDADRIHNELSPLKLRCQANAACVDLMVWAVKDEQGAENLCIKLSEKLQSKTSSKVIIAHLPLLICCLQGLGRLCERFPVVVHSVTPSLRDFLVIPSPVLVKLYKYHSQYHTVAGNDIKISVTNEHSESTLNVMSGKKSQPSMYEQLRDIAIDNICRCLKAGLTVDPVIVEAFLASLSNRLYISQESDKDAHLIPDHTIRALGHIAVALRDTPKVMEPILQILQQKFCQPPSPLDVLIIDQLGCLVITGNQYIYQEVWNLFQQISVKASSVVYSATKDYKDHGYRHCSLAVINALANIAANIQDEHLVDELLMNLLELFVQLGLEGKRASERASEKGPALKASSSAGNLGVLIPVIAVLTRRLPPIKEAKPRLQKLFRDFWLYSVLMGFAVEGSGLWPEEWYEGVCEIATKSPLLTFPSKEPLRSVLQYNSAMKNDTVTPAELSELRSTIINLLDPPPEVSALINKLDFAMSTYLLSVYRLEYMRVLRSTDPDRFQVMFCYFEDKAIQKDKSGMMQCVIAVADKVFDAFLNMMADKAKTKENEEELERHAQFLLVNFNHIHKRIRRVADKYLSGLVDKFPHLLWSGTVLKTMLDILQTLSLSLSADIHKDQPYYDIPDAPYRITVPDTYEARESIVKDFAARCGMILQEAMKWAPTVTKSHLQEYLNKHQNWVSGLSQHTGLAMATESILHFAGYNKQNTTLGATQLSERPACVKKDYSNFMASLNLRNRYAGEVYGMIRFSGTTGQMSDLNKMMVQDLHSALDRSHPQHYTQAMFKLTAMLISSKDCDPQLLHHLCWGPLRMFNEHGMETALACWEWLLAGKDGVEVPFMREMAGAWHMTVEQKFGLFSAEIKEADPLAASEASQPKPCPPEVTPHYIWIDFLVQRFEIAKYCSSDQVEIFSSLLQRSMSLNIGGAKGSMNRHVAAIGPRFKLLTLGLSLLHADVVPNATIRNVLREKIYSTAFDYFSCPPKFPTQGEKRLREDISIMIKFWTAMFSDKKYLTASQLVPPDNQDTRSNLDITVGSRQQATQGWINTYPLSSGMSTISKKSGMSKKTNRGSQLHKYYMKRRTLLLSLLATEIERLITWYNPLSAPELELDQAGENSVANWRSKYISLSEKQWKDNVNLAWSISPYLAVQLPARFKNTEAIGNEVTRLVRLDPGAVSDVPEAIKFLVTWHTIDADAPELSHVLCWAPTDPPTGLSYFSSMYPPHPLTAQYGVKVLRSFPPDAILFYIPQIVQALRYDKMGYVREYILWAASKSQLLAHQFIWNMKTNIYLDEEGHQKDPDIGDLLDQLVEEITGSLSGPAKDFYQREFDFFNKITNVSAIIKPYPKGDERKKACLSALSEVKVQPGCYLPSNPEAIVLDIDYKSGTPMQSAAKAPYLAKFKVKRCGVSELEKEGLRCRSDSEDECSTQEADGQKISWQAAIFKVGDDCRQDMLALQIIDLFKNIFQLVGLDLFVFPYRVVATAPGCGVIECIPDCTSRDQLGRQTDFGMYDYFTRQYGDESTLAFQQARYNFIRSMAAYSLLLFLLQIKDRHNGNIMLDKKGHIIHIGQPATAPPSSPFTPGTQGWIGIPTPQRGECPGPPCQECQGPALRSELSATKLFCCRGCLAPAPGS

SEQ ID NO: 914789 - protein, 1443 aa, Homo sapiens
MFKMLRDTLYYMHQDLPTSFVKEIHDFVLEQFNTSQGELQKILHDADRIHNELSPLKLRCQANAACVDLMVWAVKDEQGAENLCIKLSEKLQSKTSSKVIIAHLPLLICCLQGLGRLCERFPVVVHSVTPSLRDFLVIPSPVLVKLYKYHSQYHTVAGNDIKISVTNEHSESTLNVMSGKKSQPSMYEQLRDIAIDNICRCLKAGLTVDPVIVEAFLASLSNRLYISQESDKDAHLIPDHTIRALGHIAVALRDTPKVMEPILQILQQKFCQPPSPLDVLIIDQLGCLVITGNQYIYQEVWNLFQQISVKASSVVYSATKDYKDHGYRHCSLAVINALANIAANIQDEHLVDELLMNLLELFVQLGLEGKRASERASEKGPALKASSSAGNLGVLIPVIAVLTRRLPPIKEAKPRLQKLFRDFWLYSVLMGFAVEGSGLWPEEWYEGVCEIATKSPLLTFPSKEPLRSVLQYNSAMKNDTVTPAELSELRSTIINLLDPPPEVSALINKLDFAMSTYLLSVYRLEYMRVLRSTDPDRFQVMFCYFEDKAIQKDKSGMMQCVIAVADKVFDAFLNMMADKAKTKENEEELERHAQFLLVNFNHIHKRIRRVADKYLSGLVDKFPHLLWSGTVLKTMLDILQTLSLSLSADIHKDQPYYDIPDAPYRITVPDTYEARESIVKDFAARCGMILQEAMKWAPTVTKSHLQEYLNKHQNWVSGLSQHTGLAMATESILHFAGYNKQNTTLGATQLSERPACVKKDYSNFMASLNLRNRYAGEVYGMIRFSGTTGQMSDLNKMMVQDLHSALDRSHPQHYTQAMFKLTAMLISSKDCDPQLLHHLCWGPLRMFNEHGMETALACWEWLLAGKDGVEVPFMREMAGAWHMTVEQKFGLFSAEIKEADPLAASEASQPKPCPPEVTPHYIWIDFLVQRFEIAKYCSSDQVEIFSSLLQRSMSLNIGGAKGSMNRHVAAIGPRFKLLTLGLSLLHADVVPNATIRNVLREKIYSTAFDYFSCPPKFPTQGEKRLREDISIMIKFWTAMFSDKKYLTASQLVPPDNQDTRSNLDITVGSRQQATQGWINTYPLSSGMSTISKKSGMSKKTNRGSQLHKYYMKRRTLLLSLLATEIERLITWYNPLSAPELELDQAGENSVANWRSKYISLSEKQWKDNVNLAWSISPYLAVQLPARFKNTEAIGNEVTRLVRLDPGAVSDVPEAIKFLVTWHTIDADAPELSHVLCWAPTDPPTGLSYFSSMYPPHPLTAQYGVKVLRSFPPDAILFYIPQIVQALRYDKMGYVREYILWAASKSQLLAHQFIWNMKTNIYLDEEGHQKDPDIGDLLDQLVEEITGSLSGPAKDFYQREFDFFNKITNVSAIINPATSLPCRHMQWRRGLWPKEPGSASWGSTWVGAALVTPWTAATINGWCCLCTGVSPLFALDIFPTCLIS

SEQ ID NO: 914790 - protein, 1218 aa, Homo sapiens
MFKMLRDTLYYMHQDLPTSFVKEIHDFVLEQFNTSQGELQKILHDADRIHNELSPLKLRCQANAACVDLMVWAVKDEQGAENLCIKLSEKLQSKTSSKVIIAHLPLLICCLQGLGRLCERFPVVVHSVTPSLRDFLVIPSPVLVKLYKYHSQYHTVAGNDIKISVTNEHSESTLNVMSGKKSQPSMYEQLRDIAIDNICRCLKAGLTVDPVIVEAFLASLSNRLYISQESDKDAHLIPDHTIRALGHIAVALRDTPKVMEPILQILQQKFCQPPSPLDVLIIDQLGCLVITGNQYIYQEVWNLFQQISVKASSVVYSATKDYKDHGYRHCSLAVINALANIAANIQDEHLVDELLMNLLELFVQLGLEGKRASERASEKGPALKASSSAGNLGVLIPVIAVLTRRLPPIKEAKPRLQKLFRDFWLYSVLMGFAVEGSGLWPEEWYEGVCEIATKSPLLTFPSKEPLRSVLQYNSAMKNDTVTPAELSELRSTIINLLDPPPEVSALINKLDFAMSTYLLSVYRLEYMRVLRSTDPDRFQVMFCYFEDKAIQKDKSGMMQCVIAVADKVFDAFLNMMADKAKTKENEEELERHAQFLLVNFNHIHKRIRRVADKYLSGLVDKFPHLLWSGTVLKTMLDILQTLSLSLSADIHKDQPYYDIPDAPYRITVPDTYEARESIVKDFAARCGMILQEAMKWAPTVTKSHLQEYLNKHQNWVSGLSQHTGLAMATESILHFAGYNKQNTTLGATQLSERPACVKKDYSNFMASLNLRNRYAGEVYGMIRFSGTTGQMSDLNKMMVQDLHSALDRSHPQHYTQAMFKLTAMLISSKDCDPQLLHHLCWGPLRMFNEHGMETALACWEWLLAGKDGVEVPFMREMAGAWHMTVEQKFGLFSAEIKEADPLAASEASQPKPCPPEVTPHYIWIDFLVQRFEIAKYCSSDQVEIFSSLLQRSMSLNIGGAKGSMNRHVAAIGPRFKLLTLGLSLLHADVVPNATIRNVLREKIYSTAFDYFSCPPKFPTQGEKRLREDISIMIKFWTAMFSDKKYLTASQLVPPDNQDTRSNLDITVGSRQQATQGWINTYPLSSGMSTISKKSGMSKKTNRGSQLHKYYMKRRTLLLSLLATEIERLITWYNPLSAPELELDQAGENSVANWRSKYISLSEKQWKDNVNLAWSISPYLAVQLPARFKNTEAIGNEVTRLVRLDPGAVSDVPEAIKVV

SEQ ID NO: 914791 - protein, 601 aa, Homo sapiens
MFKMLRDTLYYMHQDLPTSFVKEIHDFVLEQFNTSQGELQKILHDADRIHNELSPLKLRCQANAACVDLMVWAVKDEQGAENLCIKLSEKLQSKTSSKVIIAHLPLLICCLQGLGRLCERFPVVVHSVTPSLRDFLVIPSPVLVKLYKYHSQYHTVAGNDIKISVTNEHSESTLNVMSGKKSQPSMYEQLRDIAIDNICRCLKAGLTVDPVIVEAFLASLSNRLYISQESDKDAHLIPDHTIRALGHIAVALRDTPKVMEPILQILQQKFCQPPSPLDVLIIDQLGCLVITGNQYIYQEVWNLFQQISVKASSVVYSATKDYKDHGYRHCSLAVINALANIAANIQDEHLVDELLMNLLELFVQLGLEGKRASERASEKGPALKASSSAGNLGVLIPVIAVLTRRLPPIKEAKPRLQKLFRDFWLYSVLMGFAVEGSGLWPEEWYEGVCEIATKSPLLTFPSKEPLRSVLQYNSAMKNDTVTPAQDSHLIFTMLSVPIRADLFTVIINTCCQPLGPVCPGGCPMSPRMFLSLQAELSELRSTIINLLDPPPEVSALINKLDFAMSTYLLSVYRLEYMRYTCLHHHAHAHPHLSRVFIFVPS

SEQ ID NO: 914792 - protein, 569 aa, Homo sapiens
MFKMLRDTLYYMHQDLPTSFVKEIHDFVLEQFNTSQGELQKILHDADRIHNELSPLKLRCQANAACVDLMVWAVKDEQGAENLCIKLSEKLQSKTSSKVIIAHLPLLICCLQGLGRLCERFPVVVHSVTPSLRDFLVIPSPVLVKLYKYHSQYHTVAGNDIKISVTNEHSESTLNVMSGKKSQPSMYEQLRDIAIDNICRCLKAGLTVDPVIVEAFLASLSNRLYISQESDKDAHLIPDHTIRALGHIAVALRDTPKVMEPILQILQQKFCQPPSPLDVLIIDQLGCLVITGNQYIYQEVWNLFQQISVKASSVVYSATKDYKDHGYRHCSLAVINALANIAANIQDEHLVDELLMNLLELFVQLGLEGKRASERASEKGPALKASSSAGNLGVLIPVIAVLTRRLPPIKEAKPRLQKLFRDFWLYSVLMGFAVEGSGLWPEEWYEGVCEIATKSPLLTFPSKEPLRSVLQYNSAMKNDTVTPAELSELRSTIINLLDPPPEVSALINKLDFAMSTYLLSVYRLEYMRVLRSTDPDRFQVMFCYFEDKAIQKDKSGERLSNNKIETANL

SEQ ID NO: 914793 - protein, 328 aa, Homo sapiens
MFKMLRDTLYYMHQDLPTSFVKEIHDFVLEQFNTSQGELQKILHDADRIHNELSPLKLRCQANAACVDLMVWAVKDEQGAENLCIKLSEKLQSKTSSKVIIAHLPLLICCLQGLGRLCERFPVVVHSVTPSLRDFLVIPSPVLVKLYKYHSQYHTVAGNDIKISVTNEHSESTLNVMSGKKSQPSMYEQLRDIAIDNICRCLKAGLTVDPVIVEAFLASLSNRLYISQESDKDAHLIPDHTIRALGHIAVALRDTPKVMEPILQILQQKFCQPPSPLDVLIIDQLGCLVITGNQYIYQEVWNLFQQISVKASSVVYSATKDYKDHGYR

SEQ ID NO: 914794 - protein, 74 aa, Homo sapiens
SKYISLSEKQWKDNVNLAWSISPYLAVQLPARWAPGHHSLTQASPEVQRRVLASWVMSSQECPAAPFKDSQEVV

SEQ ID NO: 914795 - protein, 979 aa, Homo sapiens
GVPAPPPPVSLAFCQPLSLSLSPLLPLASSLAPERTHLPGPGSLLLSPPSFPARPREPRGCVTAAPPDKMDTAEEDICRVCRSEGTPEKPLYHPCVCTGSIKFIHQECLVQWLKHSRKEYCELCKHRFAFTPIYSPDMPSRLPIQDIFAGLVTSIGTAIRYWFHYTLVAFAWLGVVPLTACRIYKCLFTGSVSSLLTLPLDMLSTENLLADCLQGCFVVTCTLCAFISLVWLREQIVHGGAPIWLEHAAPPFNAAGHHQNEAPAGGNGAENVAADQPANPPAENAVVGENPDAQDDQAEEEEEDNEEEDDAGVEDAADANNGAQDDMNWNALEWDRAAEELTWERMLGLDGSLVFLEHVFWVVSLNTLFILVFAFCPYHIGHFSLVGLGFEEHVQASHFEGLITTIVGYILLAITLIICHGLATLVKFHRSRRLLGVCYIVVKVSLLVVVEIGVFPLICGWWLDICSLEMFDATLKDRELSFQSAPGTTMFLHWLVGMVYVFYFASFILLLREVLRPGVLWFLRNLNDPDFNPVQEMIHLPIYRHLRRFILSVIVFGSIVLLMLWLPIRIIKSVLPNFLPYNVMLYSDAPVSELSLELLLLQVVLPALLEQGHTRQWLKGLVRAWTVTAGYLLDLHSYLLGDQEENENSANQQVNNNQHARNNNAIPVVGEGLHAAHQAILQQGGPVGFQPYRRPLNFPLRIFLLIVFMCITLLIASLICLTLPVFAGRWLMSFWTGTAKIHELYTAACGLYVCWLTIRAVTVMVAWMPQGRRVIFQKVKEWSLMIMKTLIVAVLLAGVVPLLLGLLFELVIVAPLRVPLDQTPLFYPWQDWALGVLHAKIIAAITLMGPQWWLKTVIEQVYANGIRNIDLHYIVRKLAAPVISVLLLSLCVPYVIASGVVPLLGVTAEMQNLVHRRIYPFLLMVVVLMAILSFQVRQFKRLYEHIKNDKYLVGQRLVNYERKSGKQGSSPPPPQSSQE

SEQ ID NO: 914796 - protein, 678 aa, Homo sapiens
MTSSYCYKHAGMEERSYANNGAQDDMNWNALEWDRAAEELTWERMLGLDGSLVFLEHVFWVVSLNTLFILVFAFCPYHIGHFSLVGLGFEEHVQASHFEGLITTIVGYILLAITLIICHGLATLVKFHRSRRLLGVCYIVVKVSLLVVVEIGVFPLICGWWLDICSLEMFDATLKDRELSFQSAPGTTMFLHWLVGMVYVFYFASFILLLREVLRPGVLWFLRNLNDPDFNPVQEMIHLPIYRHLRRFILSVIVFGSIVLLMLWLPIRIIKSVLPNFLPYNVMLYSDAPVSELSLELLLLQVVLPALLEQGHTRQWLKGLVRAWTVTAGYLLDLHSYLLGDQEENENSANQQVNNNQHARNNNAIPVVGEGLHAAHQAILQQGGPVGFQPYRRPLNFPLRIFLLIVFMCITLLIASLICLTLPVFAGRWLMSFWTGTAKIHELYTAACGLYVCWLTIRAVTVMVAWMPQGRRVIFQKVKEWSLMIMKTLIVAVLLAGVVPLLLGLLFELVIVAPLRVPLDQTPLFYPWQDWALGVLHAKIIAAITLMGPQWWLKTVIEQVYANGIRNIDLHYIVRKLAAPVISVLLLSLCVPYVIASGVVPLLGVTAEMQNLVHRRIYPFLLMVVVLMAILSFQVRQFKRLYEHIKNDKYLVGQRLVNYERKSGKQGSSPPPPQSSQE

SEQ ID NO: 914797 - protein, 417 aa, Homo sapiens
GVPAPPPPVSLAFCQPLSLSLSPLLPLASSLAPERTHLPGPGSLLLSPPSFPARPREPRGCVTAAPPDKMDTAEEDICRVCRSEGTPEKPLYHPCVCTGSIKFIHQECLVQWLKHSRKEYCELCKHRFAFTPIYSPDMPSRLPIQDIFAGLVTSIGTAIRYWFHYTLVAFAWLGVVPLTACRIYKCLFTGSVSSLLTLPLDMLSTENLLADCLQGCFVVTCTLCAFISLVWLREQIVHGGAPIWLEHAAPPFNAAGHHQNEAPAGGNGAENVAADQPANPPAENAVVGENPDAQDDQAEEEEEDNEEEDDAGVEDAADANNGAQDDMNWNALEWDRAAEELTWERMLGLDGSLVFLEHVFWVVSLNTLFILVFAFCPYHIGHFSLVGLGFEEHVSIILLQSYFHSLLPNVIINKIVF

SEQ ID NO: 914798 - protein, 417 aa, Homo sapiens; identical to SEQ ID NO: 914797

SEQ ID NO: 914799 - protein, 417 aa, Homo sapiens; identical to SEQ ID NO: 914797

SEQ ID NO: 914800 - protein, 417 aa, Homo sapiens; identical to SEQ ID NO: 914797

SEQ ID NO: 914801 - protein, 417 aa, Homo sapiens; identical to SEQ ID NO: 914797

SEQ ID NO: 914802 - protein, 344 aa, Homo sapiens
GVPAPPPPVSLAFCQPLSLSLSPLLPLASSLAPERTHLPGPGSLLLSPPSFPARPREPRGCVTAAPPDKMDTAEEDICRVCRSEGTPEKPLYHPCVCTGSIKFIHQECLVQWLKHSRKEYCELCKHRFAFTPIYSPDMPSRLPIQDIFAGLVTSIGTAIRYWFHYTLVAFAWLGVVPLTACRIYKCLFTGSVSSLLTLPLDMLSTENLLADCLQGCFVVTCTLCAFISLVWLREQIVHGGAPIWLEHAAPPFNAAGHHQNEAPAGGNGAENVAADQPANPPAENAVVGENPDAQDDQAEEEEEDNEEEDDAGVEDAADANNGAQGNGCLCVLTLQHCKSVLNLH

SEQ ID NO: 914803 - protein, 417 aa, Homo sapiens; identical to SEQ ID NO: 914797

SEQ ID NO: 914804 - protein, 417 aa, Homo sapiens; identical to SEQ ID NO: 914797

SEQ ID NO: 914805 - protein, 417 aa, Homo sapiens; identical to SEQ ID NO: 914797

SEQ ID NO: 914806 - protein, 299 aa, Homo sapiens
GVPAPPPPVSLAFCQPLSLSLSPLLPLASSLAPERTHLPGPGSLLLSPPSFPARPREPRGCVTAAPPDKMDTAEEDICRVCRSEGTPEKPLYHPCVCTGSIKFIHQECLVQWLKHSRKEYCELCKHRFAFTPIYSPDMPSRLPIQDIFAGLVTSIGTAIRYWFHYTLVAFAWLGVVPLTACRIYKCLFTGSVSSLLTLPLDMLSTENLLADCLQGCFVVTCTLCAFISLVWLREQIVHGGAPIWLEHAAPPFNAAGHHQNEAPAGGNGAENVAADQPGHQGFPLITAFSAGGLAELIVD

SEQ ID NO: 914807 - protein, 186 aa, Homo sapiens
GVPAPPPPVSLAFCQPLSLSLSPLLPLASSLAPERTHLPGPGSLLLSPPSFPARPREPRGCVTAAPPDKMDTAEEDICRVCRSEGTPEKPLYHPCVCTGSIKFIHQECLVQWLKHSRKEYCELCKHRFAFTPIYSPDMPSRLPIQDIFAGLVTSIGTAIRYWFHYTLVAFAWLGVVPLTACEYSCL

SEQ ID NO: 914808 - protein, 417 aa, Homo sapiens; identical to SEQ ID NO: 914797

SEQ ID NO: 914809 - protein, 608 aa, Homo sapiens
MGKPGCRTCCKIKFYLLFSYFQVQASHFEGLITTIVGYILLAITLIICHGLATLVKFHRSRRLLGVCYIVVKVSLLVVVEIGVFPLICGWWLDICSLEMFDATLKDRELSFQSAPGTTMFLHWLVGMVYVFYFASFILLLREVLRPGVLWFLRNLNDPDFNPVQEMIHLPIYRHLRRFILSVIVFGSIVLLMLWLPIRIIKSVLPNFLPYNVMLYSDAPVSELSLELLLLQVVLPALLEQGHTRQWLKGLVRAWTVTAGYLLDLHSYLLGDQEENENSANQQVNNNQHARNNNAIPVVGEGLHAAHQAILQQGGPVGFQPYRRPLNFPLRIFLLIVFMCITLLIASLICLTLPVFAGRWLMSFWTGTAKIHELYTAACGLYVCWLTIRAVTVMVAWMPQGRRVIFQKVKEWSLMIMKTLIVAVLLAGVVPLLLGLLFELVIVAPLRVPLDQTPLFYPWQDWALGVLHAKIIAAITLMGPQWWLKTVIEQVYANGIRNIDLHYIVRKLAAPVISVLLLSLCVPYVIASGVVPLLGVTAEMQNLVHRRIYPFLLMVVVLMAILSFQVRQFKRLYEHIKNDKYLVGQRLVNYERKSGKQGSSPPPPQSSQE

SEQ ID NO: 914810 - protein, 417 aa, Homo sapiens; identical to SEQ ID NO: 914797

SEQ ID NO: 914811 - protein, 344 aa, Homo sapiens; identical to SEQ ID NO: 914802

SEQ ID NO: 914812 - protein, 105 aa, Homo sapiens
MCFGNRAKQTSGSKFLGFSVILAPAGGNGAENVAADQPANPPAENAVVGENPDAQDDQAEEEEEDNEEEDDAGVEDAADANNGAQGNGCLCVLTLQHCKSVLNLH

SEQ ID NO: 914813 - protein, 417 aa, Homo sapiens; identical to SEQ ID NO: 914797

SEQ ID NO: 914814 - protein, 417 aa, Homo sapiens; identical to SEQ ID NO: 914797

SEQ ID NO: 914815 - protein, 417 aa, Homo sapiens; identical to SEQ ID NO: 914797

SEQ ID NO: 914816 - protein, 344 aa, Homo sapiens; identical to SEQ ID NO: 914802

SEQ ID NO: 914817 - protein, 106 aa, Homo sapiens [sequence omitted]

SEQ ID NO: 914818 - protein, 715 aa, Homo sapiens
SQILTVQQPAASARESQPLSMEEKPGQPQPQHHHSHHHPHHHPQQQQQQPHHHHHYYFYNHSHNHHHHHHHQQPHQYLQHGAEGSPKAQPKPLKHEQKHTLQQHQETPKKKTGYGELNGNAGEREISLKNLSSDEATNPISRVLNGNQQVVDTSLKQTVKANTFGKAGIKTKNFIQKNSMDKKNGKSYENKSGENQSVDKSDTIPIPNGVVTNNSGYITNGYMGKGADNDGSGSESGYTTPKKRKARRNSAKGCENLNIVQDKIMQQETSVPTLKQGLETFKPDYSEQKGNRVDGSKPIWKYETGPGGTSRGKPAVGDMLRKSSDSKPGVSSKKFDDRPKGKHASAVASKEDSWTLFKPPPVFPVDNSSAKIVPKISYASKVKENLNKTIQNSSVSPTSSSSSSSSTGETQTQSSSRLSQVPMSALKSVTSANFSNGPVLAGTDGNVYPPGGQPLLTTAANTLTPISSGTDSVLQDMSLTSAAVEQIKTSLFIYPSNMQTMLLSTAQVDLPSQTDQQNLGDIFQNQWGLSFINEPSAGPETVTGKSSEHKVMEVTFQGEYPATLVSQGAEIIPSGTEHPVFPKAYELEKRTSPQVLGSILKSGTTSESGALSLEPSHIGDLQKADTSSQGALVFLSKDYEIESQNPLASPTNTLLGSAKEQRYQRGLERNDSWGSFDLRAAIVYHTKEMESIWNLQKQDPKRIITYNEAMDSPDQ

SEQ ID NO: 914819 - protein, 536 aa, Homo sapiens
MDKKNGKSYENKSGENQSVDKSDTIPIPNGVVTNNSGYITNGYMGKGADNDGSGSESGYTTPKKRKARRNSAKGCENLNIVQDKIMQQETSVPTLKQGLETFKPDYSEQKGNRVDGSKPIWKYETGPGGTSRGKPAVGDMLRKSSDSKPGVSSKKFDDRPKGKHASAVASKEDSWTLFKPPPVFPVDNSSAKIVPKISYASKVKENLNKTIQNSSVSPTSSSSSSSSTGETQTQSSSRLSQVPMSALKSVTSANFSNGPVLAGTDGNVYPPGGQPLLTTAANTLTPISSGTDSVLQDMSLTSAAVEQIKTSLFIYPSNMQTMLLSTAQVDLPSQTDQQNLGDIFQNQWGLSFINEPSAGPETVTGKSSEHKVMEVTFQGEYPATLVSQGAEIIPSGTEHPVFPKAYELEKRTSPQVLGSILKSGTTSESGALSLEPSHIGDLQKADTSSQGALVFLSKDYEIESQNPLASPTNTLLGSAKEQRYQRGLERNDSWGSFDLRAAIVYHTKEMESIWNLQKQDPKRIITYNEAMDSPDQ

SEQ ID NO: 914820 - protein, 715 aa, Homo sapiens; identical to SEQ ID NO: 914818

SEQ ID NO: 914821 - protein, 183 aa, Homo sapiens
MWLCPLALNLILMAASGAACEVKDVCVGSPGIPGTPGSHGLPGRDGRDGVKGDPGPPGPMGPPGETPCPPGNNGLPGAPGVPGERGEKGEAGERGPPGLPAHLDEELQATLHDFRHQILQTRGALSLQVLQYWTARQSNGLPRSQLAQFHSTVSWTGHNFPMGTGPLGSPNARAMGPGSRDIP

SEQ ID NO: 914822 - protein, 248 aa, Homo sapiens
MWLCPLALNLILMAASGAACEVKDVCVGSPGIPGTPGSHGLPGRDGRDGVKGDPGPPGPMGPPGETPCPPGNNGLPGAPGVPGERGEKGEAGERGPPGLPAHLDEELQATLHDFRHQILQTRGALSLQGSIMTVGEKVFSSNGQSITFDAIQEACARAGGRIAVPRNPEENEAIASFVKKYNTYAYVGLTEGPSPGDFRYSDGTPVNYTNWYRGEPAGRGKEQCVEMYTDGQWNDRNCLYSRLTICEF

SEQ ID NO: 914823 - protein, 296 aa, Homo sapiens
SELGGRDPSSWRLCVWVADFLEPEKKVTGHMRDRWSESVTGAATGPRAMWLCPLALNLILMAASGAACEVKDVCVGSPGIPGTPGSHGLPGRDGRDGVKGDPGPPGPMGPPGETPCPPGNNGLPGAPGVPGERGEKGEAGERGPPGLPAHLDEELQATLHDFRHQILQTRGALSLQGSIMTVGEKVFSSNGQSITFDAIQEACARAGGRIAVPRNPEENEAIASFVKKYNTYAYVGLTEGPSPGDFRYSDGTPVNYTNWYRGEPAGRGKEQCVEMYTDGQWNDRNCLYSRLTICEF

SEQ ID NO: 914824 - protein, 248 aa, Homo sapiens; identical to SEQ ID NO: 914822

SEQ ID NO: 914825 - protein, 248 aa, Homo sapiens; identical to SEQ ID NO: 914822

SEQ ID NO: 914826 - protein, 248 aa, Homo sapiens; identical to SEQ ID NO: 914822

SEQ ID NO: 914827 - protein, 248 aa, Homo sapiens; identical to SEQ ID NO: 914822

SEQ ID NO: 914828 - protein, 248 aa, Homo sapiens; identical to SEQ ID NO: 914822

SEQ ID NO: 914829 - protein, 248 aa, Homo sapiens; identical to SEQ ID NO: 914822

SEQ ID NO: 914830 - protein, 248 aa, Homo sapiens; identical to SEQ ID NO: 914822

SEQ ID NO: 914831 - protein, 248 aa, Homo sapiens; identical to SEQ ID NO: 914822

SEQ ID NO: 914832 - protein, 248 aa, Homo sapiens; identical to SEQ ID NO: 914822

SEQ ID NO: 914833 - protein, 248 aa, Homo sapiens; identical to SEQ ID NO: 914822

SEQ ID NO: 914834 - protein, 248 aa, Homo sapiens; identical to SEQ ID NO: 914822

SEQ ID NO: 914835 - protein, 182 aa, Homo sapiens
RQRTPIFVVLAIDEYTGKTSTGTVYVRVPDFNDNCPTAVLEKDAVCSSSPSGVVSARTLNNRYTGPYTFALEDQPVKLPAVWSITTLNATSALLRAQEQIPPGVYHISLVLTDSQNHKYRRNITAGHLLMHLIGSATLAISTINLPSTLIIFTILILLTILEIAVALIQAYVFTLLVSLYPP

SEQ ID NO: 914836 - protein, 90 aa, Homo sapiens
MMGLFPRTTGALAIFVVVILVHGELRIETKGQYDEEEMTMQQAKRRQKREWVKFAKPCREGEDNSKRNPIAKITSDYQATQKIYSGRGRA

SEQ ID NO: 914837 - protein, 999 aa, Homo sapiens
MMGLFPRTTGALAIFVVVILVHGELRIETKGQYDEEEMTMQQAKRRQKREWVKFAKPCREGEDNSKRNPIAKITSDYQATQKITYRISGVGIDQPPFGIFVVDKNTGDINITAIVDREETPSFLITCRALNAQGLDVEKPLILTVKILDINDNPPVFSQQIFMGEIEENSASNSLVMILNATDADEPNHLNSKIAFKIVSQEPAGTPMFLLSRNTGEVRTLTNSLDREQASSYRLVVSGADKDGEGLSTQCECNIKVKDVNDNFPMFRDSQYSARIEENILSSELLRFQVTDLDEEYTDNWLAVYFFTSGNEGNWFEIQTDPRTNEGILKVVKALDYEQLQSVKLSIAVKNKAEFHQSVISRYRVQSTPVTIQVINVREGIAFRPASKTFTVQKGISSKKLVDYILGTYQAIDEDTNKAASNVKYVMGRNDGGYLMIDSKTAEIKFVKNMNRDSTFIVNKTITAEVLAIDEYTGKTSTGTVYVRVPDFNDNCPTAVLEKDAVCSSSPSGVVSARTLNNRYTGPYTFALEDQPVKLPAVWSITTLNATSALLRAQEQIPPGVYHISLVLTDSQNNRCEMPRSLTLEVCQCDNRGICGTSYPTTSPGTRYGRPHSGRLGPAAIGLLLLGLLLLLLAPLLLLTCDCGAGSTGGVTGGFIPVPDGSEGTIHQWGIEGAHPEDKEITNICVPPVTANGADFMESSEVCTNTYARGTAVEGTSGMEMTTKLGAATESGGAAGFATGTVSGAASGFGAATGVGICSSGQSGTMRTRHSTGGTNKDYADGAISMNFLDSYFSQKAFACAEEDDGQEANDCLLIYDNEGADATGSPVGSVGCCSFIADDLDDSFLDSLGPKFKKLAEISLGVDGEGKEVQPPSKDSGYGIESCGHPIEVQQTGFVKCQTLSGSQGASALSASGSVQPAVSIPDPLQHGNYLVTETYSASGSLVQPSTAGFDPLLTQNVIVTERVICPISSVPGNLAGPTQLRGSHTMLCTEDPCSRLI

SEQ ID NO: 914838 - protein, 999 aa, Homo sapiens; identical to SEQ ID NO: 914837

SEQ ID NO: 914839 - protein, 459 aa, Homo sapiens
MCFNFTTSALLRAQEQIPPGVYHISLVLTDSQNNRCEMPRSLTLEVCQCDNRGICGTSYPTTSPGTRYGRPHSGRLGPAAIGLLLLGLLLLLLAPLLLLTCDCGAGSTGGVTGGFIPVPDGSEGTIHQWGIEGAHPEDKEITNICVPPVTANGADFMESSEVCTNTYARGTAVEGTSGMEMTTKLGAATESGGAAGFATGTVSGAASGFGAATGVGICSSGQSGTMRTRHSTGGTNKDYADGAISMNFLDSYFSQKAFACAEEDDGQEANDCLLIYDNEGADATGSPVGSVGCCSFIADDLDDSFLDSLGPKFKKLAEISLGVDGEGKEVQPPSKDSGYGIESCGHPIEVQQTGFVKCQTLSGSQGASALSASGSVQPAVSIPDPLQHGNYLVTETYSASGSLVQPSTAGFDPLLTQNVIVTERVICPISSVPGNLAGPTQLRGSHTMLCTEDPCSRLI

SEQ ID NO: 914840 - protein, 153 aa, Homo sapiens
RQRTPIFVVLAIDEYTGKTSTGTVYVRVPDFNDNCPTAVLEKDAVCSSSPSGVVSARTLNNRYTGPYTFALEDQPVKLPAVWSITTLNATSALLRAQEQIPPGVYHISLVLTDSQNTNIAAGDIFLLIFLLVLLILLILIFVLIILTMARPQI

SEQ ID NO: 914841 - protein, 542 aa, Homo sapiens
RQRTPIFVVLAIDEYTGKTSTGTVYVRVPDFNDNCPTAVLEKDAVCSSSPSGVVSARTLNNRYTGPYTFALEDQPVKLPAVWSITTLNATSALLRAQEQIPPGVYHISLVLTDSQNNRCEMPRSLTLEVCQCDNRGICGTSYPTTSPGTRYGRPHSGRLGPAAIGLLLLGLLLLLLAPLLLLTCDCGAGSTGGVTGGFIPVPDGSEGTIHQWGIEGAHPEDKEITNICVPPVTANGADFMESSEVCTNTYARGTAVEGTSGMEMTTKLGAATESGGAAGFATGTVSGAASGFGAATGVGICSSGQSGTMRTRHSTGGTNKDYADGAISMNFLDSYFSQKAFACAEEDDGQEANDCLLIYDNEGADATGSPVGSVGCCSFIADDLDDSFLDSLGPKFKKLAEISLGVDGEGKEVQPPSKDSGYGIESCGHPIEVQQTGFVKCQTLSGSQGASALSASGSVQPAVSIPDPLQHGNYLVTETYSASGSLVQPSTAGFDPLLTQNVIVTERVICPISSVPGNLAGPTQLRGSHTMLCTEDPCSRLI

SEQ ID NO: 914842 - protein, 894 aa, Homo sapiens
MMGLFPRTTGALAIFVVVILVHGELRIETKGQYDEEEMTMQQAKRRQKREWVKFAKPCREGEDNSKRNPIAKITSDYQATQKITYRISGVGIDQPPFGIFVVDKNTGDINITAIVDREETPSFLITCRALNAQGLDVEKPLILTVKILDINDNPPVFSQQIFMGEIEENSASNSLVMILNATDADEPNHLNSKIAFKIVSQEPAGTPMFLLSRNTGEVRTLTNSLDREQASSYRLVVSGADKDGEGLSTQCECNIKVKDVNDNFPMFRDSQYSARIEENILSSELLRFQVTDLDEEYTDNWLAVYFFTSGNEGNWFEIQTDPRTNEGILKVVKALDYEQLQSVKLSIAVKNKAEFHQSVISRYRVQSTPVTIQVINVREGIAFRPASKTFTVQKGISSKKLVDYILGTYQAIDEDTNKAASNVKYVMGRNDGGYLMIDSKTAEIKFVKNMNRDSTFIVNKTITAEVLAIDEYTGKTSTGTVYVRVPDFNDNCPTAVLEKDAVCSSSPSGVVSARTLNNRYTGPYTFALEDQPVKLPAVWSITTLNATSALLRAQEQIPPGVYHISLVLTDSQNNRCEMPRSLTLEVCQCDNRGICGTSYPTTSPGTRYGRPHSGRLGPAAIGLLLLGLLLLLLAPLLLLTCDCGAGSTGGVTGGFIPVPDGSEGTIHQWGIEGAHPEDKEITNICVPPVTANGADFMESSEVCTNTYARGTAVEGTSGMEMTTKLGAATESGGAAGFATGTVSGAASGFGAATGVGICSSGQSGTMRTRHSTGGTNKDYADGAISMNFLDSYFSQKAFACAEEDDGQEANDCLLIYDNEGADATGSPVGSVGCCSFIADDLDDSFLDSLGPKFKKLAEISLGVDGEGKEVQPPSKDSGYGIESCGHPIEVQQTL

SEQ ID NO: 914843 - protein, 445 aa, Homo sapiens
RLLQRPRWLRRPERSRWQRRRRDRQQQQQQQQQPLASCPAALPHEPHEPLTPPFSALPDPAGAPSRRQSRQRPQLSSDSPSAFRASRSHSRNATRSHSHSHSPRHSLRHSPGSGSCGSSSGHRPCADILEVGMLLSKINSLAHLRAAPCNDLHATKLAPGKEKEPLESQYQVGPLLGSGGFGSVYSGIRVSDNLPVAIKHVEKDRISDWGELPNGTRVPMEVVLLKKVSSGFSGVIRLLDWFERPDSFVLILERPEPVQDLFDFITERGALQEELARSFFWQVLEAVRHCHNCGVLHRDIKDENILIDLNRGELKLIDFGSGALLKDTVYTDFDGTRVYSPPEWIRYHRYHGRSAAVWSLGILLYDMVCGDIPFEHDEEIIRGQVFFRQRVSSECQHLIRWCLALRPSDRPTFEEIQNHPWMQDVLLPQETAEIHLHSLSPGPSK

SEQ ID NO: 914844 - protein, 179 aa, Homo sapiens
EERVWVSAPACIGWGGRPPKGHPDLGCCASILAWILSAMRISPGLLGSGECNLRIVYEIPFLVVQTCIPSSFAGGPASQGLKFWVCGQLCLFLGAVHKEFQFMVWASREGPECIALQSGSATIATMAGRRQSGPWGSCCMIWCVEIFLSSMTKRSSGARFSSGRGSLQNVSISLDGAWP

SEQ ID NO: 914845 - protein, 159 aa, Homo sapiens
EERVWVSAPACIGWGGRPPKGHPDLGCCASILAWILSAMRISPGLLGSGTRVYSPPEWIRYHRYHGRSAAVWSLGILLYDMVCGDIPFEHDEEIIRGQVFFRQRVSSECQHLIRWCLALRPSDRPTFEEIQNHPWMQDVLLPQETAEIHLHSLSPGPSK

SEQ ID NO: 914846 - protein, 445 aa, Homo sapiens; identical to SEQ ID NO: 914843

SEQ ID NO: 914847 - protein, 445 aa, Homo sapiens; identical to SEQ ID NO: 914843

SEQ ID NO: 914848 - protein, 453 aa, Homo sapiens
RLLQRPRWLRRPERSRWQRRRRDRQQQQQQQQQPLASCPAALPHEPHEPLTPPFSALPDPAGAPSRRQSRQRPQLSSDSPSAFRASRSHSRNATRSHSHSHSPRHSLRHSPGSGSCGSSSGHRPCADILEVGMLLSKINSLAHLRAAPCNDLHATKLAPGKEKEPLESQYQVGPLLGSGGFGSVYSGIRVSDNLPVAIKHVEKDRISDWGELPNGTRVPMEVVLLKKVSSGFSGVIRLLDWFERPDSFVLILERPEPVQDLFDFITERGALQEELARSFFWQVLEAVRHCHNCGVLHRDIKDENILIDLNRGELKLIDFGSGALLKDTVYTDFDGTRVYSPPEWIRYHRYHGRSAAVWSLGILLYDMVCGDIPFEHDEEIIRGQVFFRQRVSSECQHLLLLGLVAHIGILLTHAHHHALVPGAPHDGGEDGPGGIVAREAGLAHAGAVDDERD

SEQ ID NO: 914849 - protein, 119 aa, Homo sapiens
PPKGHPDLGCCASILAWILSAMRISPGLLGSGECNLRIVYEIPFLVVQTCIPSSFAGGPASQGLKFWVCGQLCLFLGAVHKEFQFMVWASREVGNALGWRDAVRCASTLLSPEGKMEFT

SEQ ID NO: 914850 - protein, 445 aa, Homo sapiens; identical to SEQ ID NO: 914843

SEQ ID NO: 914851 - protein, 445 aa, Homo sapiens; identical to SEQ ID NO: 914843

SEQ ID NO: 914852 - protein, 445 aa, Homo sapiens; identical to SEQ ID NO: 914843

SEQ ID NO: 914853 - protein, 445 aa, Homo sapiens; identical to SEQ ID NO: 914843

SEQ ID NO: 914854 - protein, 421 aa, Homo sapiens
MGLLLMILASAVLGSFLTLLAQFFLLYRRQPEPPADEAARAGEGFRYIKPVPGLLLREYLYGGGRDEEPSGAAPEGGATPTAAPETPAPPTRETCYFLNATILFLFRELRDTALTRRWVTKKIKVEFEELLQTKTAGRLLEGLSLRDVFLGETVPFIKTIRLVRPVVPSATGEPDGPEGEALPAACPEELAFEAEVEYNGGFHLAIDVDLVFGKSAYLFVKLSRVVGRLRLVFTRVPFTHWFFSFVEDPLIDFEVRSQFEGRPMPQLTSIIVNQLKKIIKRKHTLPNYKIRFKPFFPYQTLQGFEEDEEHIHIQQWALTEGRLKVTLLECSRLLIFGSYDREANVHCTLELSSSVWEEKQRSSIKTVELMEIYKVLDLHFVLSSQLMGMLGTSSLKLWLQTRLLQLQIFSGEIDLSPLEVV

SEQ ID NO: 914855 - protein, 421 aa, Homo sapiens; identical to SEQ ID NO: 914854

SEQ ID NO: 914856 - protein, 193 aa, Homo sapiens
MAHPENEILHPIGVTRRWVTKKIKVEFEELLQTKTAGRLLEGLSLRDVFLGETVPFIKTIRLVRPVVPSATGEPDGPEGEALPAACPEELAFEAEVEYNGGFHLAIDVDLVFGKSAYLFVKLSRVVGRLRLVFTRVPFTHWFFSFVEDPLIDFEVRSQFEGRPMPQLTSIIVNQLKKIIKRKHTLPNYKIRLN

SEQ ID NO: 914857 - protein, 427 aa, Homo sapiens
MGLLLMILASAVLGSFLTLLAQFFLLYRRQPEPPADEAARAGEGFRYIKPVPGLLLREYLYGGGRDEEPSGAAPEGGATPTAAPETPAPPTRETCYFLNATILFLFRELRDTALTRRWVTKKIKVEFEELLQTKTAGRLLEGLSLRDVFLGETVPFIKTIRLVRPVVPSATGEPDGPEGEALPAACPEELAFEAEVEYNGGFHLAIDVDLVFGKSAYLFVKLSRVVGRLRLVFTRVPFTHWFFSFVEDPLIDFEVRSQFEGRPMPQLTSIIVNQLKKIIKRKHTLPNYKIRFKPFFPYQTLQGFEEDEEHIHIQQWALTEGRLKVTLLECSRLLIFGSYDREANVHCTLELSSSVWEEKQRSSIKTVELMEIYKVLDLHFVLSSQLMGMLGTSSLKLWLQTRLLQLQIFSGEIDLSPLEVFKLRDVI

SEQ ID NO: 914858 - protein, 421 aa, Homo sapiens; identical to SEQ ID NO: 914854

SEQ ID NO: 914859 - protein, 421 aa, Homo sapiens; identical to SEQ ID NO: 914854

SEQ ID NO: 914860 - protein, 293 aa, Homo sapiens
MGLLLMILASAVLGSFLTLLAQFFLLYRRQPEPPADEAARAGEGFRYIKPVPGLLLREYLYGGGRDEEPSGAAPEGGATPTAAPETPAPPTRETCYFLNATILFLFRELRDTALTRRWVTKKIKVEFEELLQTKTAGRLLEGLSLRDVFLGETVPFIKTIRLVRPVVPSATGEPDGPEGEALPAACPEELAFEAEVEYNGGFHLAIDVDLVFGKSAYLFVKLSRVVGRLRLVFTRVPFTHWFFSFVEDPLIDFEVRSQFEGRPMPQLTSIIVNQLKKIIKRKHTLPNYKIRLN

SEQ ID NO: 914861 - protein, 164 aa, Homo sapiens
MHVIKRDGRQERVMFDKITSRIQKLCYGLNMDFVDPAQITMKVIQGLYSGVTTVELDTLAAETAATLTTKHPDYAILAARIAVSNLHKETKKVFSDVMEDLYNYINPHNGKHSPMVAKSTLDIVLANKDRLNSAIIYDRDFSYNYFGFKTLERSYLLKINGKVA

SEQ ID NO: 914862 - protein, 125 aa, Homo sapiens
MHVIKRDGRQERVMFDKITSRIQKLCYGLNMDFVDPAQITMKVIQGLYSGVTTVELDTLAAETAATLTTKHPDYAILAARIAVSNLHKETKKVFSEKKKKLFGRLGPWKKFLKPLVGPRGPMRVL

SEQ ID NO: 914863 - protein, 495 aa, Homo sapiens
MHVIKRDGRQERVMFDKITSRIQKLCYGLNMDFVDPAQITMKVIQGLYSGVTTVELDTLAAETAATLTTKHPDYAILAARIAVSNLHKETKKVFSDVMEDLYNYINPHNGKHSPMVAKSTLDIVLANKDRLNSAIIYDRDFSYNYFGFKTLERSYLLKINGKVAERPQHMLMRVSVGIHKEDIDAAIETYNLLSERWFTHASPTLFNAGTNRPQLSSCFLLSMKDDSIEGIYDTLKQCALISKSAGGIGVAVSCIRATGSYIAGTNGNSNGLVPMLRVYNNTARYVDQGGNKRPGAFAIYLEPWHLDIFEFLDLKKNTGKEEQRARDLFFALWIPDLFMKRVETNQDWSLMCPNECPGLDEVWGEEFEKLYASYEKQGRVRKVVKAQQLWYAIIESQTETGTPYMLYKDSCNRKSNQQNLGTIKCSNLCTEIVEYTSKDEVAVCNLASLALNMYVTSEHTYDFKKLAEVTKVVVRNLNKIIDINYYPVPEDEIPF

SEQ ID NO: 914864 - protein, 570 aa, Homo sapiens
MKDDSIEGIYDTLKQCALISKSAGGIGVAVSCIRATGSYIAGTNGNSNGLVPMLRVYNNTARYVDQGGNKRPGAFAIYLEPWHLDIFEFLDLKKNTGKEEQRARDLFFALWIPDLFMKRVETNQDWSLMCPNECPGLDEVWGEEFEKLYASYEKQGRVRKVVKAQQLWYAIIESQTETGTPYMLYKDSCNRKSNQQNLGTIKCSNLCTEIVEYTSKDEVAVCNLASLALNMYVTSEHTYDFKKLAEVTKVVVRNLNKIIDINYYPVPEACLSNKRHRPIGIGVQGLADAFILMRYPFESAEAQLLNKQIFETIYYGALEASCDLAKEQGPYETYEGSPVSKGILQYDMWNVTPTDLWDWKVLKEKIAKYGIRNSLLIAPMPTASTAQILGNNESIEPYTSNIYTRRVLSGEFQIVNPHLLKDLTERGLWHEEMKNQIIACNGSIQSIPEIPDDLKQLYKTVWEISQKTVLKMAAERGAFIDQSQSLNIHIAEPNYGKLTSMHFYGWKQGLKTGMYYLRTRPAANPIQFTLNKEKLKDKEKVSKEEEEKERNTAAMVCSLENRDECLMCGS

SEQ ID NO: 914865 - protein, 442 aa, Homo sapiens [sequence omitted]

SEQ ID NO: 914866 - protein, 181 aa, Homo sapiens
SCSRGSPEAHGNIYTRRVLSGEFQIVNPHLLKDLTERGLWHEEMKNQIIACNGSIQSIPEIPDDLKQLYKTVWEISQKTVLKMAAERGAFIDQSQSLNIHIAEPNYGKLTSMHFYGWKQGLKTGMYYLRTRPAANPIQFTLNKEKLKDKEKVSKEEEEKERNTAAMVCSLENRDECLMCGS

SEQ ID NO: 914867 - protein, 136 aa, Homo sapiens
MLQTLFNYHRYSIPEIPDDLKQLYKTVWEISQKTVLKMAAERGAFIDQSQSLNIHIAEPNYGKLTSMHFYGWKQGLKTGMYYLRTRPAANPIQFTLNKEKLKDKEKVSKEEEEKERNTAAMVCSLENRDECLMCGS

SEQ ID NO: 914868 - protein, 447 aa, Homo sapiens
MHVIKRDGRQERVMFDKITSRIQKLCYGLNMDFVDPAQITMKVIQGLYSGVTTVELDTLAAETAATLTTKHPDYAILAARIAVSNLHKETKKVFSDVMEDLYNYINPHNGKHSPMVAKSTLDIVLANKDRLNSAIIYDRDFSYNYFGFKTLERSYLLKINGKVAERPQHMLMRVSVGIHKEDIDAAIETYNLLSERWFTHASPTLFNAGTNRPQLSSCFLLSMKDDSIEGIYDTLKQCALISKSAGGIGVAVSCIRATGSYIAGTNGNSNGLVPMLRVYNNTARYVDQGGNKRPGAFAIYLEPWHLDIFEFLDLKKNTGKEEQRARDLFFALWIPDLFMKRVETNQDWSLMCPNECPGLDEVWGEEFEKLYASYEKQGRVRKVVKAQQLWYAIIESQTETGTPYMLYKDSCNRKSNQQNLGTIKCSNLCTEIVEYTSKDEVGRKNSS

SEQ ID NO: 914869 - protein, 792 aa, Homo sapiens
MHVIKRDGRQERVMFDKITSRIQKLCYGLNMDFVDPAQITMKVIQGLYSGVTTVELDTLAAETAATLTTKHPDYAILAARIAVSNLHKETKKVFSDVMEDLYNYINPHNGKHSPMVAKSTLDIVLANKDRLNSAIIYDRDFSYNYFGFKTLERSYLLKINGKVAERPQHMLMRVSVGIHKEDIDAAIETYNLLSERWFTHASPTLFNAGTNRPQLSSCFLLSMKDDSIEGIYDTLKQCALISKSAGGIGVAVSCIRATGSYIAGTNGNSNGLVPMLRVYNNTARYVDQGGNKRPGAFAIYLEPWHLDIFEFLDLKKNTGKEEQRARDLFFALWIPDLFMKRVETNQDWSLMCPNECPGLDEVWGEEFEKLYASYEKQGRVRKVVKAQQLWYAIIESQTETGTPYMLYKDSCNRKSNQQNLGTIKCSNLCTEIVEYTSKDEVAVCNLASLALNMYVTSEHTYDFKKLAEVTKVVVRNLNKIIDINYYPVPEACLSNKRHRPIGIGVQGLADAFILMRYPFESAEAQLLNKQIFETIYYGALEASCDLAKEQGPYETYEGSPVSKGILQYDMWNVTPTDLWDWKVLKEKIAKYGIRNSLLIAPMPTASTAQILGNNESIEPYTSNIYTRRVLSGEFQIVNPHLLKDLTERGLWHEEMKNQIIACNGSIQSIPEIPDDLKQLYKTVWEISQKTVLKMAAERGAFIDQSQSLNIHIAEPNYGKLTSMHFYGWKQGLKTGMYYLRTRPAANPIQFTLNKEKLKDKEKVSKEEEEKERNTAAMVCSLENRDECLMCGS

SEQ ID NO: 914870 - protein, 142 aa, Homo sapiens
MHVIKRDGRQERVMFDKITSRIQKLCYGLNMDFVDPAQITMKVIQGLYSGVTTVELDTLAAETAATLTTKHPDYAILAARIAVSNLHKETKKVFSDVMEDLYNYINPHNGKHSPMVAKSTLDIVLANKDPEFWLLTYDRISP

SEQ ID NO: 914871 - protein, 792 aa, Homo sapiens; identical to SEQ ID NO: 914869

SEQ ID NO: 914872 - protein, 695 aa, Homo sapiens
MEDLYNYINPHNGKHSPMVAKSTLDIVLANKDRLNSAIIYDRDFSYNYFGFKTLERSYLLKINGKVAERPQHMLMRVSVGIHKEDIDAAIETYNLLSERWFTHASPTLFNAGTNRPQLSSCFLLSMKDDSIEGIYDTLKQCALISKSAGGIGVAVSCIRATGSYIAGTNGNSNGLVPMLRVYNNTARYVDQGGNKRPGAFAIYLEPWHLDIFEFLDLKKNTGKEEQRARDLFFALWIPDLFMKRVETNQDWSLMCPNECPGLDEVWGEEFEKLYASYEKQGRVRKVVKAQQLWYAIIESQTETGTPYMLYKDSCNRKSNQQNLGTIKCSNLCTEIVEYTSKDEVAVCNLASLALNMYVTSEHTYDFKKLAEVTKVVVRNLNKIIDINYYPVPEACLSNKRHRPIGIGVQGLADAFILMRYPFESAEAQLLNKQIFETIYYGALEASCDLAKEQGPYETYEGSPVSKGILQYDMWNVTPTDLWDWKVLKEKIAKYGIRNSLLIAPMPTASTAQILGNNESIEPYTSNIYTRRVLSGEFQIVNPHLLKDLTERGLWHEEMKNQIIACNGSIQSIPEIPDDLKQLYKTVWEISQKTVLKMAAERGAFIDQSQSLNIHIAEPNYGKLTSMHFYGWKQGLKTGMYYLRTRPAANPIQFTLNKEKLKDKEKVSKEEEEKERNTAAMVCSLENRDECLMCGS

SEQ ID NO: 914873 - protein, 198 aa, Homo sapiens
SIGSPAEMPTASTAQILGNNESIEPYTSNIYTRRVLSGEFQIVNPHLLKDLTERGLWHEEMKNQIIACNGSIQSIPEIPDDLKQLYKTVWEISQKTVLKMAAERGAFIDQSQSLNIHIAEPNYGKLTSMHFYGWKQGLKTGMYYLRTRPAANPIQFTLNKEKLKDKEKVSKEEEEKERNTAAMVCSLENRDECLMCGS

SEQ ID NO: 914874 - protein, 182 aa, Homo sapiens
KTCVESENKAHCNIYTRRVLSGEFQIVNPHLLKDLTERGLWHEEMKNQIIACNGSIQSIPEIPDDLKQLYKTVWEISQKTVLKMAAERGAFIDQSQSLNIHIAEPNYGKLTSMHFYGWKQGLKTGMYYLRTRPAANPIQFTLNKEKLKDKEKVSKEEEEKERNTAAMVCSLENRDECLMCGS

SEQ ID NO: 914875 - protein, 109 aa, Homo sapiens
MFDKITSRIQKLCYGLNMDFVDPAQITMKVIQGLYSGVTTVELDTLAAETAATLTTKHPDYAILAARIAVSNLHKETKKVFSVSDVWILRKDLEETSMSSVAKLLLEHR

SEQ ID NO: 914876 - protein, 89 aa, Homo sapiens
SFCQVHQIHQVQAVLTTTTFPFVSIMSWKKALRIPGGLRVATVTLMLAMLSTPVAEGRDSPEDFVYQFKGMCYFTNGTERVRLCDQIHL

SEQ ID NO: 914877 - protein, 159 aa, Homo sapiens
SFCQVHQIHQVQAVLTTTTFPFVSIMSWKKALRIPGGLRVATVTLMLAMLSTPVAEGRDSPVEPTVTISPSRTEALNHHNLLVCSVTDFYPAQIKVRWFRNDQEETTGVVSTPLIRNGDWTFQILVMLEMTPQRGDVYTCHVEHPSLQNPITVEWRLLH

SEQ ID NO: 914878 - protein, 89 aa, Homo sapiens; identical to SEQ ID NO: 914876

SEQ ID NO: 914879 - protein, 72 aa, Homo sapiens
MRGANLWGDEDPHLSGGGRQKWGTKPPTKEIRGPQQGDIQTTHGCRPGGTPHSIMHGRRKNRPPKIRDEQLS

SEQ ID NO: 914880 - protein, 89 aa, Homo sapiens; identical to SEQ ID NO: 914876

SEQ ID NO: 914881 - protein, 256 aa, Homo sapiens
MALQIPGGFWAAAVTVMLVMLSTPVAEARDFPKDFLVQFKGMCYFTNGTERVRGVARYIYNREEYGRFDSDVGEFQAVTELGRSIEDWNNYKDFLEQERAAVDKVCRHNYEAELRGILQRRVEPTVTISPSRTEALNHHNLLVCSVTDFYPAQIKVRWFRNDQEETTGVVSTPLIRNGDWTFQILVMLEMTPQRGDVYTCHVEHPSLQNPITVEWRAQSESAQSKMLSGIGGFVLGLIFLGLGLIIHHRSQKGLLH

SEQ ID NO: 914882 - protein, 156 aa, Homo sapiens
PQAGNTDSTTRWRYAGFLQRRVEPTVTISPSRTEALNHHNLLVCSVTDFYPAQIKVRWFRNDQEETTGVVSTPLIRNGDWTFQILVMLEMTPQRGDVYTCHVEHPSLQNPITVEWRAQSESAQSKMLSGIGGFVLGLIFLGLGLIIHHRSQKGLLH

SEQ ID NO: 914883 - protein, 264 aa, Homo sapiens
MALQIPGGFWAAAVTVMLVMLSTPVAEARDFPKDFLVQFKGMCYFTNGTERVRGVARYIYNREEYGRFDSDVGEFQAVTELGRSIEDWNNYKDFLEQERAAVDKVCRHNYEAELRGILQRRVEPTVTISPSRTEALNHHNLLVCSVTDFYPGQIKVRWFRNDQEETAGVVSTPLIRNGDWTFQILVMLEMTPQRGDVYTCHVEHPSLQSPITVEWRAQSESAQSKMLSGVGGFVLGLIFLGLGLIIRHRGQKGPRGPPPAGLLH

SEQ ID NO: 914884 - protein, 89 aa, Homo sapiens; identical to SEQ ID NO: 914876

SEQ ID NO: 914885 - protein, 228 aa, Homo sapiens
MALQIPGGFWAAAVTVMLVMLSTPVAEARDFPKDFLVQFKGMCYFTNGTERVRGVARYIYNREEYGRFDSDVGEFQAVTELGRSIEDWNNYKDFLEQERAAVDKVCRHNYEAELRGILQRRVEPTVTISPSRTEALNHHNLLVCSVTDFYPGQIKVRWFRNDQEETAGVVSTPLIRNGDWTFQILVMLEMTPQRGDVYTCHVEHPSLQSPITVEWRLISLLQDSCTDS

SEQ ID NO: 914886 - protein, 256 aa, Homo sapiens
MALQIPGGFWAAAVTVMLVMLSTPVAEARDFPKDFLVQFKGMCYFTNGTERVRGVARYIYNREEYGRFDSDVGEFQAVTELGRSIEDWNNYKDFLEQERAAVDKVCRHNYEAELRGILQRRVEPTVTISPSRTEALNHHNLLVCSVTDFYPGQIKVRWFRNDQEETAGVVSTPLIRNGDWTFQILVMLEMTPQRGDVYTCHVEHPSLQSPITVEWRAQSESAQSKMLSGIGGFVLGLIFLGLGLIIHHRSQKGLLH

SEQ ID NO: 914887 - protein, 89 aa, Homo sapiens; identical to SEQ ID NO: 914876

SEQ ID NO: 914888 - protein, 89 aa, Homo sapiens; identical to SEQ ID NO: 914876

SEQ ID NO: 914889 - protein, 152 aa, Homo sapiens
AAANTTKFGAVFDGFARMESTEKCEAVIGHFNGKFIKTPPGVSAPTEPLLCKFADGGQKKRQNPNKYIPNGRPWHREGEVRLAGMTLTYDPTTAAIQNGFYPSPYSIATNRMITQTSITPYIASPVSAYQVQSPSWMQPQPYILQHPVSFLS

SEQ ID NO: 914890 - protein, 455 aa, Homo sapiens
GTRGGAAAAAAAAAAAAAAAAAGKGEAGEPETWKPQSVRDPARQLPSSFMGKVWKQQMYPQYATYYYPQYLQAKQSLVPAHPMAPPSPSTTSSNNNSSSSSNSGWDQLSKTNLYIRGLPPHTTDQDLVKLCQPYGKIVSTKAILDKTTNKCKGYGFVDFDSPAAAQKAVSALKASGVQAQMAKQQEQDPTNLYISNLPLSMDEQELENMLKPFGQVISTRILRDSSGTSRGVGFARMESTEKCEAVIGHFNGKFIKTPPGVSAPTEPLLCKFADGGQKKRQNPNKYIPNGRPWHREGEVRLAGMTLTYDPTTAAIQNGFYPSPYSIATNRMITQTSITPYIASPVSAYQVQSPSWMQPQPYILQHPGAVLTPSMEHTMSLQPASMISPLAQQMSHLSLGSTGTYMPATSAMQGAYLPQYAHMQTTAVPVEEASGQQQVAVETSNDHSPYTFQPNK

SEQ ID NO: 914891 - protein, 275 aa, Homo sapiens
MAKQQEQDPTNLYISNLPLSMDEQELENMLKPFGQVISTRILRDSSGTSRGVGFARMESTEKCEAVIGHFNGKFIKTPPGVSAPTEPLLCKFADGGQKKRQNPNKYIPNGRPWHREGEVRLAGMTLTYDPTTAAIQNGFYPSPYSIATNRMITQTSITPYIASPVSAYQVQSPSWMQPQPYILQHPGAVLTPSMEHTMSLQPASMISPLAQQMSHLSLGSTGTYMPATSAMQGAYLPQYAHMQTTAVPVEEASGQQQVAVETSNDHSPYTFQPNK

SEQ ID NO: 914892 - protein, 471 aa, Homo sapiens
GTRGGAAAAAAAAAAAAAAAAAGKGEAGEPETWKPQSVRDPARQLPSSFMGKVWKQQMYPQYATYYYPQYLQAKQSLVPAHPMAPPSPSTTSSNNNSSSSSNSGWDQLSKTNLYIRGLPPHTTDQDLVKLCQPYGKIVSTKAILDKTTNKCKGYGFVDFDSPAAAQKAVSALKASGVQAQMAKQQEQDPTNLYISNLPLSMDEQELENMLKPFGQVISTRILRDSSGTSRGVGFARMESTEKCEAVIGHFNGKFIKTPPGVSAPTEPLLCKFADGGQKKRQNPNKYIPNGRPWHREGEVRLAGMTLTYDPTTAAIQNGFYPSPYSIATNRMITQTSITPYIASPVSAYQVAKETRENKYRGSAIKVQSPSWMQPQPYILQHPGAVLTPSMEHTMSLQPASMISPLAQQMSHLSLGSTGTYMPATSAMQGAYLPQYAHMQTTAVPVEEASGQQQVAVETSNDHSPYTFQPNK

SEQ ID NO: 914893 - protein, 273 aa, Homo sapiens
VDSRHPPTNLYISNLPLSMDEQELENMLKPFGQVISTRILRDSSGTSRGVGFARMESTEKCEAVIGHFNGKFIKTPPGVSAPTEPLLCKFADGGQKKRQNPNKYIPNGRPWHREGEVRLAGMTLTYDPTTAAIQNGFYPSPYSIATNRMITQTSITPYIASPVSAYQVQSPSWMQPQPYILQHPGAVLTPSMEHTMSLQPASMISPLAQQMSHLSLGSTGTYMPATSAMQGAYLPQYAHMQTTAVPVEEASGQQQVAVETSNDHSPYTFQPNK

SEQ ID NO: 914894 - protein, 249 aa, Homo sapiens
MLSTISPTVLLARYYLIPVVNVLAWKGFARMESTEKCEAVIGHFNGKFIKTPPGVSAPTEPLLCKFADGGQKKRQNPNKYIPNGRPWHREGEVRLAGMTLTYDPTTAAIQNGFYPSPYSIATNRMITQTSITPYIASPVSAYQVQSPSWMQPQPYILQHPGAVLTPSMEHTMSLQPASMISPLAQQMSHLSLGSTGTYMPATSAMQGAYLPQYAHMQTTAVPVEEASGQQQVAVETSNDHSPYTFQPNK

SEQ ID NO: 914895 - protein, 491 aa, Homo sapiens
ARGVEQRQQQQPPPPPPLPPPPERERQESPRLGNPKVSATLHGSSLPASWAKCGNSRCTLSTPPTITPSICKPSLEGIREYQVKRKSEEQKNVSGMANTVNIAVSVGQKNQSLVPAHPMAPPSPSTTSSNNNSSSSSNSGWDQLSKTNLYIRGLPPHTTDQDLVKLCQPYGKIVSTKAILDKTTNKCKGYGFVDFDSPAAAQKAVSALKASGVQAQMAKQQEQDPTNLYISNLPLSMDEQELENMLKPFGQVISTRILRDSSGTSRGVGFARMESTEKCEAVIGHFNGKFIKTPPGVSAPTEPLLCKFADGGQKKRQNPNKYIPNGRPWHREGEVRLAGMTLTYDPTTAAIQNGFYPSPYSIATNRMITQTSITPYIASPVSAYQVQSPSWMQPQPYILQHPGAVLTPSMEHTMSLQPASMISPLAQQMSHLSLGSTGTYMPATSAMQGAYLPQYAHMQTTAVPVEEASGQQQVAVETSNDHSPYTFQPNK

SEQ ID NO: 914896 - protein, 367 aa, Homo sapiens
ARGVEQRQQQQPPPPPPLPPPPERERQESPRLGNPKVSATLHGSSLPASWAKCGNSRCTLSTPPTITPSICKPSLEGIREYQVKRKSEEQKNVSGMANTVNIAVSVGQKNQSLVPAHPMAPPSPSTTSSNNNSSSSSNSGWDQLSKTNLYIRGLPPHTTDQDLVKLCQPYGKIVSTKAILDKTTNKCKGYGFVDFDSPAAAQKAVSALKASGVQAQMAKQQEQDPTNLYISNLPLSMDEQELENMLKPFGQVISTRILRDSSGTSRGVGFARMESTEKCEAVIGHFNGKFIKTPPGVSAPTEPLLCKFADGGQKKRQNPNKYIPNGRPWHREGEVRLAGMTLTYDPTTAAIQNGFYPSPYVTHTWPV

SEQ ID NO: 914897 - protein, 455 aa, Homo sapiens; identical to SEQ ID NO: 914890

SEQ ID NO: 914898 - protein, 455 aa, Homo sapiens; identical to SEQ ID NO: 914890

SEQ ID NO: 914899 - protein, 507 aa, Homo sapiens
ARGVEQRQQQQPPPPPPLPPPPERERQESPRLGNPKVSATLHGSSLPASWAKCGNSRCTLSTPPTITPSICKPSLEGIREYQVKRKSEEQKNVSGMANTVNIAVSVGQKNQSLVPAHPMAPPSPSTTSSNNNSSSSSNSGWDQLSKTNLYIRGLPPHTTDQDLVKLCQPYGKIVSTKAILDKTTNKCKGYGFVDFDSPAAAQKAVSALKASGVQAQMAKQQEQDPTNLYISNLPLSMDEQELENMLKPFGQVISTRILRDSSGTSRGVGFARMESTEKCEAVIGHFNGKFIKTPPGVSAPTEPLLCKFADGGQKKRQNPNKYIPNGRPWHREGEVRLAGMTLTYDPTTAAIQNGFYPSPYSIATNRMITQTSITPYIASPVSAYQVAKETRENKYRGSAIKVQSPSWMQPQPYILQHPGAVLTPSMEHTMSLQPASMISPLAQQMSHLSLGSTGTYMPATSAMQGAYLPQYAHMQTTAVPVEEASGQQQVAVETSNDHSPYTFQPNK

SEQ ID NO: 914900 - protein, 455 aa, Homo sapiens; identical to SEQ ID NO: 914890

SEQ ID NO: 914901 - protein, 455 aa, Homo sapiens; identical to SEQ ID NO: 914890

SEQ ID NO: 914902 - protein, 407 aa, Homo sapiens
ARGVEQRQQQQPPPPPPLPPPPERERQESPRLGNPKVSATLHGSSLPASWAKCGNSRCTLSTPPTITPSICKPSLEGIREYQVKRKSEEQKNVSGMANTVNIAVSVGQKNQSLVPAHPMAPPSPSTTSSNNNSSSSSNSGWDQLSKTNLYIRGLPPHTTDQDLVKLCQPYGKIVSTKAILDKTTNKCKGYGFVDFDSPAAAQKAVSALKASGVQAQMAKQQEQDPTNLYISNLPLSMDEQELENMLKPFGQVISTRILRDSSGTSRGVGFARMESTEKCEAVIGHFNGKFIKTPPGVSAPTEPLLCKFADGGQKKRQNPNKYIPNGRPWHREGEVRLAGMTLTYDPTTAAIQNGFYPSPYSIATNRMITQTSITPYIASPVSAYQVQSPSWMQPQPYILQHPVSFLS

SEQ ID NO: 914903 - protein, 2725 aa, Homo sapiens
MMNNSGYSDAGLGLGDETDEMPSTEKDLAEDAPWKKIQQNTFTRWCNEHLKCVGKRLTDLQRDLSDGLRLIALLEVLSQKRMYRKFHPRPNFRQMKLENVSVALEFLEREHIKLVSIDSKAIVDGNLKLILGLIWTLILHYSISMPMWEDEDDEDARKQTPKQRLLGWIQNKVPQLPITNFNRDWQDGKALGALVDNCAPGLCPDWEAWDPNQPVENAREAMQQADDWLGVPQVIAPEEIVDPNVDEHSVMTYLSQFPKAKLKPGAPVRSKQLNPKKAIAYGPGIEPQGNTVLQPAHFTVQTVDAGVGEVLVYIEDPEGHTEEAKVVPNNDKDRTYAVSYVPKVAGLHKVTVLFAGQNIERSPFEVNVGMALGDANKVSARGPGLEPVGNVANKPTYFDIYTAGAGTGDVAVVIVDPQGRRDTVEVALEDKGDSTFRCTYRPAMEGPHTVHVAFAGAPITRSPFPVHVSEACNPNACRASGRGLQPKGVRVKEVADFKVFTKGAGSGELKVTVKGPKGTEEPVKVREAGDGVFECEYYPVVPGKYVVTITWGGYAIPRSPFEVQVSPEAGVQKVRAWGPGLETGQVGKSADFVVEAIGTEVGTLGFSIEGPSQAKIECDDKGDGSCDVRYWPTEPGEYAVHVICDDEDIRDSPFIAHILPAPPDCFPDKVKAFGPGLEPTGCIVDKPAEFTIDARAAGKGDLKLYAQDADGCPIDIKVIPNGDGTFRCSYVPTKPIKHTIIISWGGVNVPKSPFRVNVGEGSHPERVKVYGPGVEKTGLKANEPTYFTVDCSEAGQGDVSIGIKCAPGVVGPAEADIDFDIIKNDNDTFTVKYTPPGAGRYTIMVLFANQEIPASPFHIKVDPSHDASKVKAEGPGLNRTGVEVGKPTHFTVLTKGAGKAKLDVQFAGTAKGEVVRDFEIIDNHDYSYTVKYTAVQQGNMAVTVTYGGDPVPKSPFVVNVAPPLDLSKIKVQGLNSKVAVGQEQAFSVNTRGAGGQGQLDVRMTSPSRRPIPCKLEPGGGAEAQAVRYMPPEEGPYKVDITYDGHPVPGSPFAVEGVLPPDPSKVCAYGPGLKGGLVGTPAPFSIDTKGAGTGGLGLTVEGPCEAKIECQDNGDGSCAVSYLPTEPGEYTINILFAEAHIPGSPFKATIRPVFDPSKVRASGPGLERGKVGEAATFTVDCSEAGEAELTIEILSDAGVKAEVLIHNNADGTYHITYSPAFPGTYTITIKYGGHPVPKFPTRVHVQPAVDTSGVKVSGPGVEPHGVLREVTTEFTVDARSLTATGGNHVTARVLNPSGAKTDTYVTDNGDGTYRVQYTAYEEGVHLVEVLYDEVAVPKSPFRVGVTEGCDPTRVRAFGPGLEGGLVNKANRFTVETRGAGTGGLGLAIEGPSEAKMSCKDNKDGSCTVEYIPFTPGDYDVNITFGGRPIPGSPFRVPVKDVVDPGKVKCSGPGLGAGVRARVPQTFTVDCSQAGRAPLQVAVLGPTGVAEPVEVRDNGDGTHTVHYTPATDGPYTVAVKYADQEVPRSPFKIKVLPAHDASKVRASGPGLNASGIPASLPVEFTIDARDAGEGLLTVQILDPEGKPKKANIRDNGDGTYTVSYLPDMSGRYTITIKYGGDEIPYSPFRIHALPTGDASKCLVTVSIGGHGLGACLGPRIQIGQETVITVDAKAAGEGKVTCTVSTPDGAELDVDVVENHDGTFDIYYTAPEPGKYVITIRFGGEHIPNSPFHVLACDPLPHEEEPSEVPQLRQPYAPPRPGARPTHWATEEPVVPVEPMESMLRPFNLVIPFAVQKGELTGEVRMPSGKTARPNITDNKDGTITVRYAPTEKGLHQMGIKYDGNHIPGSPLQFYVDAINSRHVSAYGPGLSHGMVNKPATFTIVTKDAGEGGLSLAVEGPSKAEITCKDNKDGTCTVSYLPTAPGDYSIIVRFDDKHIPGSPFTAKITGDDSMRTSQLNVGTSTDVSLKITESDLSQLTASIRAPSGNEEPCLLKRLPNRHIGISFTPKEVGEHVVSVRKSGKHVTNSPFKILVGPSEIGDASKVRVWGKGLSEGHTFQVAEFIVDTRNAGYGGLGLSIEGPSKVDINCEDMEDGTCKVTYCPTEPGTYIINIKFADKHVPGSPFTVKVTGEGRMKESITRRRQAPSIATIGSTCDLNLKIPGNWFQMVSAQERLTRTFTRSSHTYTRTERTEISKTRGGETKREVRVEESTQVGGDPFPAVFGDFLGRERLGSFGSITRQQEGEASSQDMTAQVTSPSGKVEAAEIVEGEDSAYSVRFVPQEMGPHTVAVKYRGQHVPGSPFQFTVGPLGEGGAHKVRAGGTGLERGVAGVPAEFSIWTREAGAGGLSIAVEGPSKAEIAFEDRKDGSCGVSYVVQEPGDYEVSIKFNDEHIPDSPFVVPVASLSDDARRLTVTSLQETGLKVNQPASFAVQLNGARGVIDARVHTPSGAVEECYVSELDSDKHTIRFIPHENGVHSIDVKFNGAHIPGSPFKIRVGEQSQAGDPGLVSAYGPGLEGGTTGVSSEFIVNTLNAGSGALSVTIDGPSKVQLDCRECPEGHVVTYTPMAPGNYLIAIKYGGPQHIVGSPFKAKVTGPRLSGGHSLHETSTVLVETVTKSSSSRGSSYSSIPKFSSDASKVVTRGPGLSQAFVGQKNSFTVDCSKAGTNMMMVGVHGPKTPCEEVYVKHMGNRVYNVTYTVKEKGDYILIVKWGDESVPGSPFKVKVP

SEQ ID NO: 914904 - protein, 2692 aa, Homo sapiens
MMNNSGYSDAGLGLGDETDEMPSTEKDLAEDAPWKKIQQNTFTRWCNEHLKCVGKRLTDLQRDLSDGLRLIALLEVLSQKRMYRKFHPRPNFRQMKLENVSVALEFLEREHIKLVSIDSKAIVDGNLKLILGLIWTLILHYSISMPMWEDEDDEDARKQTPKQRLLGWIQNKVPQLPITNFNRDWQDGKALGALVDNCAPGLCPDWEAWDPNQPVENAREAMQQADDWLGVPQVIAPEEIVDPNVDEHSVMTYLSQFPKAKLKPGAPVRSKQLNPKKAIAYGPGIEPQGNTVLQPAHFTVQTVDAGVGEVLVYIEDPEGHTEEAKVVPNNDKDRTYAVSYVPKVAGLHKVTVLFAGQNIERSPFEVNVGMALGDANKVSARGPGLEPVGNVANKPTYFDIYTAGAGTGDVAVVIVDPQGRRDTVEVALEDKGDSTFRCTYRPAMEGPHTVHVAFAGAPITRSPFPVHVSEACNPNACRASGRGLQPKGVRVKEVADFKVFTKGAGSGELKVTVKGPKGTEEPVKVREAGDGVFECEYYPVVPGKYVVTITWGGYAIPRSPFEVQVSPEAGVQKVRAWGPGLETGQVGKSADFVVEAIGTEVGTLGFSIEGPSQAKIECDDKGDGSCDVRYWPTEPGEYAVHVICDDEDIRDSPFIAHILPAPPDCFPDKVKAFGPGLEPTGCIVDKPAEFTIDARAAGKGDLKLYAQDADGCPIDIKVIPNGDGTFRCSYVPTKPIKHTIIISWGGVNVPKSPFRVNVGEGSHPERVKVYGPGVEKTGLKANEPTYFTVDCSEAGQGDVSIGIKCAPGVVGPAEADIDFDIIKNDNDTFTVKYTPPGAGRYTIMVLFANQEIPASPFHIKVDPSHDASKVKAEGPGLNRTGVEVGKPTHFTVLTKGAGKAKLDVQFAGTAKGEVVRDFEIIDNHDYSYTVKYTAVQQGNMAVTVTYGGDPVPKSPFVVNVAPPLDLSKIKVQGLNSKVAVGQEQAFSVNTRGAGGQGQLDVRMTSPSRRPIPCKLEPGGGAEAQAVRYMPPEEGPYKVDITYDGHPVPGSPFAVEGVLPPDPSKVCAYGPGLKGGLVGTPAPFSIDTKGAGTGGLGLTVEGPCEAKIECQDNGDGSCAVSYLPTEPGEYTINILFAEAHIPGSPFKATIRPVFDPSKVRASGPGLERGKVGEAATFTVDCSEAGEAELTIEILSDAGVKAEVLIHNNADGTYHITYSPAFPGTYTITIKYGGHPVPKFPTRVHVQPAVDTSGVKVSGPGVEPHGVLREVTTEFTVDARSLTATGGNHVTARVLNPSGAKTDTYVTDNGDGTYRVQYTAYEEGVHLVEVLYDEVAVPKSPFRVGVTEGCDPTRVRAFGPGLEGGLVNKANRFTVETRGAGTGGLGLAIEGPSEAKMSCKDNKDGSCTVEYIPFTPGDYDVNITFGGRPIPGSPFRVPVKDVVDPGKVKCSGPGLGAGVRARVPQTFTVDCSQAGRAPLQVAVLGPTGVAEPVEVRDNGDGTHTVHYTPATDGPYTVAVKYADQEVPRSPFKIKVLPAHDASKVRASGPGLNASGIPASLPVEFTIDARDAGEGLLTVQILDPEGKPKKANIRDNGDGTYTVSYLPDMSGRYTITIKYGGDEIPYSPFRIHALPTGDASKCLVTVSIGGHGLGACLGPRIQIGQETVITVDAKAAGEGKVTCTVSTPDGAELDVDVVENHDGTFDIYYTAPEPGKYVITIRFGGEHIPNSPFHVLATEEPVVPVEPMESMLRPFNLVIPFAVQKGELTGEVRMPSGKTARPNITDNKDGTITVRYAPTEKGLHQMGIKYDGNHIPGSPLQFYVDAINSRHVSAYGPGLSHGMVNKPATFTIVTKDAGEGGLSLAVEGPSKAEITCKDNKDGTCTVSYLPTAPGDYSIIVRFDDKHIPGSPFTAKITGDDSMRTSQLNVGTSTDVSLKITESDLSQLTASIRAPSGNEEPCLLKRLPNRHIGISFTPKEVGEHVVSVRKSGKHVTNSPFKILVGPSEIGDASKVRVWGKGLSEGHTFQVAEFIVDTRNAGYGGLGLSIEGPSKVDINCEDMEDGTCKVTYCPTEPGTYIINIKFADKHVPGSPFTVKVTGEGRMKESITRRRQAPSIATIGSTCDLNLKIPGNWFQMVSAQERLTRTFTRSSHTYTRTERTEISKTRGGETKREVRVEESTQVGGDPFPAVFGDFLGRERLGSFGSITRQQEGEASSQDMTAQVTSPSGKVEAAEIVEGEDSAYSVRFVPQEMGPHTVAVKYRGQHVPGSPFQFTVGPLGEGGAHKVRAGGTGLERGVAGVPAEFSIWTREAGAGGLSIAVEGPSKAEIAFEDRKDGSCGVSYVVQEPGDYEVSIKFNDEHIPDSPFVVPVASLSDDARRLTVTSLQETGLKVNQPASFAVQLNGARGVIDARVHTPSGAVEECYVSELDSDKHTIRFIPHENGVHSIDVKFNGAHIPGSPFKIRVGEQSQAGDPGLVSAYGPGLEGGTTGVSSEFIVNTLNAGSGALSVTIDGPSKVQLDCRECPEGHVVTYTPMAPGNYLIAIKYGGPQHIVGSPFKAKVTGPRLSGGHSLHETSTVLVETVTKSSSSRGSSYSSIPKFSSDASKVVTRGPGLSQAFVGQKNSFTVDCSKAGTNMMMVGVHGPKTPCEEVYVKHMGNRVYNVTYTVKEKGDYILIVKWGDESVPGSPFKVKVP

SEQ ID NO: 914905 - protein, 2219 aa, Homo sapiens
MMNNSGYSDAGLGLGDETDEMPSTEKDLAEDAPWKKIQQNTFTRWCNEHLKCVGKRLTDLQRDLSDGLRLIALLEVLSQKRMYRKFHPRPNFRQMKLENVSVALEFLEREHIKLVSIDSKAIVDGNLKLILGLIWTLILHYSISMPMWEDEDDEDARKQTPKQRLLGWIQNKVPQLPITNFNRDWQDGKALGALVDNCAPGLCPDWEAWDPNQPVENAREAMQQADDWLGVPQVIAPEEIVDPNVDEHSVMTYLSQFPKAKLKPGAPVRSKQLNPKKAIAYGPGIEPQGNTVLQPAHFTVQTVDAGVGEVLVYIEDPEGHTEEAKVVPNNDKDRTYAVSYVPKVAGLHKVTVLFAGQNIERSPFEVNVGMALGDANKVSARGPGLEPVGNVANKPTYFDIYTAGAGTGDVAVVIVDPQGRRDTVEVALEDKGDSTFRCTYRPAMEGPHTVHVAFAGAPITRSPFPVHVSEACNPNACRASGRGLQPKGVRVKEVADFKVFTKGAGSGELKVTVKGPKGTEEPVKVREAGDGVFECEYYPVVPGKYVVTITWGGYAIPRSPFEVQVSPEAGVQKVRAWGPGLETGQVGKSADFVVEAIGTEVGTLGFSIEGPSQAKIECDDKGDGSCDVRYWPTEPGEYAVHVICDDEDIRDSPFIAHILPAPPDCFPDKVKAFGPGLEPTGCIVDKPAEFTIDARAAGKGDLKLYAQDADGCPIDIKVIPNGDGTFRCSYVPTKPIKHTIIISWGGVNVPKSPFRVNVGEGSHPERVKVYGPGVEKTGLKANEPTYFTVDCSEAGQGDVSIGIKCAPGVVGPAEADIDFDIIKNDNDTFTVKYTPPGAGRYTIMVLFANQEIPASPFHIKVDPSHDASKVKAEGPGLNRTGVEVGKPTHFTVLTKGAGKAKLDVQFAGTAKGEVVRDFEIIDNHDYSYTVKYTAVQQGNMAVTVTYGGDPVPKSPFVVNVAPPLDLSKIKVQGLNSKVAVGQEQAFSVNTRGAGGQGQLDVRMTSPSRRPIPCKLEPGGGAEAQAVRYMPPEEGPYKVDITYDGHPVPGSPFAVEGVLPPDPSKVCAYGPGLKGGLVGTPAPFSIDTKGAGTGGLGLTVEGPCEAKIECQDNGDGSCAVSYLPTEPGEYTINILFAEAHIPGSPFKATIRPVFDPSKVRASGPGLERGKVGEAATFTVDCSEAGEAELTIEILSDAGVKAEVLIHNNADGTYHITYSPAFPGTYTITIKYGGHPVPKFPTRVHVQPAVDTSGVKVSGPGVEPHGVLREVTTEFTVDARSLTATGGNHVTARVLNPSGAKTDTYVTDNGDGTYRVQYTAYEEGVHLVEVLYDEVAVPKSPFRVGVTEGCDPTRVRAFGPGLEGGLVNKANRFTVETRGAGTGGLGLAIEGPSEAKMSCKDNKDGSCTVEYIPFTPGDYDVNITFGGRPIPGSPFRVPVKDVVDPGKVKCSGPGLGAGVRARVPQTFTVDCSQAGRAPLQVAVLGPTGVAEPVEVRDNGDGTHTVHYTPATDGPYTVAVKYADQEVPRSPFKIKVLPAHDASKVRASGPGLNASGIPASLPVEFTIDARDAGEGLLTVQILDPEGKPKKANIRDNGDGTYTVSYLPDMSGRYTITIKYGGDEIPYSPFRMKESITRRRQAPSIATIGSTCDLNLKIPGNWFQMVSAQERLTRTFTRSSHTYTRTERTEISKTRGGETKREVRVEESTQVGGDPFPAVFGDFLGRERLGSFGSITRQQEGEASSQDMTAQVTSPSGKVEAAEIVEGEDSAYSVRFVPQEMGPHTVAVKYRGQHVPGSPFQFTVGPLGEGGAHKVRAGGTGLERGVAGVPAEFSIWTREAGAGGLSIAVEGPSKAEIAFEDRKDGSCGVSYVVQEPGDYEVSIKFNDEHIPDSPFVVPVASLSDDARRLTVTSLQETGLKVNQPASFAVQLNGARGVIDARVHTPSGAVEECYVSELDSDKHTIRFIPHENGVHSIDVKFNGAHIPGSPFKIRVGEQSQAGDPGLVSAYGPGLEGGTTGVSSEFIVNTLNAGSGALSVTIDGPSKVQLDCRECPEGHVVTYTPMAPGNYLIAIKYGGPQHIVGSPFKAKVTGPRLSGGHSLHETSTVLVETVTKSSSSRGSSYSSIPKFSSDASKVVTRGPGLSQAFVGQKNSFTVDCSKAGTNMMMVGVHGPKTPCEEVYVKHMGNRVYNVTYTVKEKGDYILIVKWGDESVPGSPFKVKVP

SEQ ID NO: 914906 - protein, 573 aa, Homo sapiens
DAWATHASEGNWFQMVSAQERLTRTFTRSSHTYTRTERTEISKTRGGETKREVRVEESTQVGGDPFPAVFGDFLGRERLGSFGSITRQQEGEASSQDMTAQVTSPSGKVEAAEIVEGEDSAYSVRFVPQEMGPHTVAVKYRGQHVPGSPFQFTVGPLGEGGAHKVRAGGTGLERGVAGVPAEFSIWTREAGAGGLSIAVEGPSKAEIAFEDRKDGSCGVSYVVQEPGDYEVSIKFNDEHIPDSPFVVPVASLSDDARRLTVTSLQETGLKVNQPASFAVQLNGARGVIDARVHTPSGAVEECYVSELDSDKHTIRFIPHENGVHSIDVKFNGAHIPGSPFKIRVGEQSQAGDPGLVSAYGPGLEGGTTGVSSEFIVNTLNAGSGALSVTIDGPSKVQLDCRECPEGHVVTYTPMAPGNYLIAIKYGGPQHIVGSPFKAKVTGPRLSGGHSLHETSTVLVETVTKSSSSRGSSYSSIPKFSSDASKVVTRGPGLSQAFVGQKNSFTVDCSKAGTNMMMVGVHGPKTPCEEVYVKHMGNRVYNVTYTVKEKGDYILIVKWGDESVPGSPFKVKVP

SEQ ID NO: 914907 - protein, 2658 aa, Homo sapiens
MMNNSGYSDAGLGLGDETDEMPSTEKDLAEDAPWKKIQQNTFTRWCNEHLKCVGKRLTDLQRDLSDGLRLIALLEVLSQKRMYRKFHPRPNFRQMKLENVSVALEFLEREHIKLVSIDSKAIVDGNLKLILGLIWTLILHYSISMPMWEDEDDEDARKQTPKQRLLGWIQNKVPQLPITNFNRDWQDGKALGALVDNCAPGLCPDWEAWDPNQPVENAREAMQQADDWLGVPQVIAPEEIVDPNVDEHSVMTYLSQFPKAKLKPGAPVRSKQLNPKKAIAYGPGIEPQGNTVLQPAHFTVQTVDAGVGEVLVYIEDPEGHTEEAKVVPNNDKDRTYAVSYVPKVAGLHKVTVLFAGQNIERSPFEVNVGMALGDANKVSARGPGLEPVGNVANKPTYFDIYTAGAGTGDVAVVIVDPQGRRDTVEVALEDKGDSTFRCTYRPAMEGPHTVHVAFAGAPITRSPFPVHVSEACNPNACRASGRGLQPKGVRVKEVADFKVFTKGAGSGELKVTVKGPKGTEEPVKVREAGDGVFECEYYPVVPGKYVVTITWGGYAIPRSPFEVQVSPEAGVQKVRAWGPGLETGQVGKSADFVVEAIGTEVGTLGFSIEGPSQAKIECDDKGDGSCDVRYWPTEPGEYAVHVICDDEDIRDSPFIAHILPAPPDCFPDKVKAFGPGLEPTGCIVDKPAEFTIDARAAGKGDLKLYAQDADGCPIDIKVIPNGDGTFRCSYVPTKPIKHTIIISWGGVNVPKSPFRVNVGEGSHPERVKVYGPGVEKTGLKANEPTYFTVDCSEAGQGDVSIGIKCAPGVVGPAEADIDFDIIKNDNDTFTVKYTPPGAGRYTIMVLFANQEIPASPFHIKVDPSHDASKVKAEGPGLNRTGVEVGKPTHFTVLTKGAGKAKLDVQFAGTAKGEVVRDFEIIDNHDYSYTVKYTAVQQGNMAVTVTYGGDPVPKSPFVVNVAPPLDLSKIKVQGLNSKVAVGQEQAFSVNTRGAGGQGQLDVRMTSPSRRPIPCKLEPGGGAEAQAVRYMPPEEGPYKVDITYDGHPVPGSPFAVEGVLPPDPSKVCAYGPGLKGGLVGTPAPFSIDTKGAGTGGLGLTVEGPCEAKIECQDNGDGSCAVSYLPTEPGEYTINILFAEAHIPGSPFKATIRPVFDPSKVRASGPGLERGKVGEAATFTVDCSEAGEAELTIEILSDAGVKAEVLIHNNADGTYHITYSPAFPGTYTITIKYGGHPVPKFPTRVHVQPAVDTSGVKVSGPGVEPHGVLREVTTEFTVDARSLTATGGNHVTARVLNPSGAKTDTYVTDNGDGTYRVQYTAYEEGVHLVEVLYDEVAVPKSPFRVGVTEGCDPTRVRAFGPGLEGGLVNKANRFTVETRGAGTGGLGLAIEGPSEAKMSCKDNKDGSCTVEYIPFTPGDYDVNITFGGRPIPGSPFRVPVKDVVDPGKVKCSGPGLGAGVRARVPQTFTVDCSQAGRAPLQVAVLGPTGVAEPVEVRDNGDGTHTVHYTPATDGPYTVAVKYADQEVPRSPFKIKVLPAHDASKVRASGPGLNASGIPASLPVEFTIDARDAGEGLLTVQILDPEGKPKKANIRDNGDGTYTVSYLPDMSGRYTITIKYGGDEIPYSPFRIHALPTGDASKCLVTVSIGGHGLGACLGPRIQIGQETVITVDAKAAGEGKVTCTVSTPDGAELDVDVVENHDGTFDIYYTAPEPGKYVITIRFGGEHIPNSPFHVLATEEPVVPVEPMESMLRPFNLVIPFAVQKGELTGEVRMPSGKTARPNITDNKDGTITVRYAPTEKGLHQMGIKYDGNHIPGSPLQFYVDAINSRHVSAYGPGLSHGMVNKPATFTIVTKDAGEGGLSLAVEGPSKAEITCKDNKDGTCTVSYLPTAPGDYSIIVRFDDKHIPGSPFTAKITGDDSMRTSQLNVGTSTDVSLKITESDLSQLTASIRAPSGNEEPCLLKRLPNRHIGISFTPKEVGEHVVSVRKSGKHVTNSPFKILVGPSEIGDASKVRVWGKGLSEGHTFQVAEFIVDTRNAGYGGLGLSIEGPSKVDINCEDMEDGTCKVTYCPTEPGTYIINIKFADKHVPGSPFTVKVTGEGRMKESITRRRQAPSIATIGSTCDLNLKIPGNWFQMVSAQERLTRTFTRSSHTYTRTERTEISKTRGGETKREVRVEESTQVGGDPFPAVFGDFLGRERLGSFGSITRQQEGEASSQDMTAQVTSPSGKVEAAEIVEGEDSAYSVRFVPQEMGPHTVAVKYRGQHVPGSPFQFTVGPLGEGGAHKVRAGGTGLERGVAGVPAEFSIWTREAGAGGLSIAVEGPSKAEIAFEDRKDGSCGVSYVVQEPGDYEVSIKFNDEHIPDSPFVVPVASLSDDARRLTVTSLQETGLKVNQPASFAVQLNGARGVIDARVHTPSGAVEECYVSELDSDKHTIRFIPHENGVHSIDVKFNGAHIPGSPFKIRVGEQSQAGDPGLVSAYGPGLEGGTTGVSSEFIVNTLNAGSGALSVTIDGPSKVQLDCRECPEGHVVTYTPMAPGNYLIAIKYGGPQHIVGSPFKAKVTGPRLSGGHSLHETSLVWSLWWLQPQSFKDLERKAQSEKKTAPEPAGVAWHMDRPERCALHPSQAPRGPDFSLTVSFFKMVARLCPMGGLFYTLRGPAF

SEQ ID NO: 914908 - protein, 2346 aa, Homo sapiens
MMNNSGYSDAGLGLGDETDEMPSTEKDLAEDAPWKKIQQNTFTRWCNEHLKCVGKRLTDLQRDLSDGLRLIALLEVLSQKRMYRKFHPRPNFRQMKLENVSVALEFLEREHIKLVSIDSKAIVDGNLKLILGLIWTLILHYSISMPMWEDEDDEDARKQTPKQRLLGWIQNKVPQLPITNFNRDWQDGKALGALVDNCAPGLCPDWEAWDPNQPVENAREAMQQADDWLGVPQVIAPEEIVDPNVDEHSVMTYLSQFPKAKLKPGAPVRSKQLNPKKAIAYGPGIEPQGNTVLQPAHFTVQTVDAGVGEVLVYIEDPEGHTEEAKVVPNNDKDRTYAVSYVPKVAGLHKVTVLFAGQNIERSPFEVNVGMALGDANKVSARGPGLEPVGNVANKPTYFDIYTAGAGTGDVAVVIVDPQGRRDTVEVALEDKGDSTFRCTYRPAMEGPHTVHVAFAGAPITRSPFPVHVSEACNPNACRASGRGLQPKGVRVKEVADFKVFTKGAGSGELKVTVKGPKGTEEPVKVREAGDGVFECEYYPVVPGKYVVTITWGGYAIPRSPFEVQVSPEAGVQKVRAWGPGLETGQVGKSADFVVEAIGTEVGTLGFSIEGPSQAKIECDDKGDGSCDVRYWPTEPGEYAVHVICDDEDIRDSPFIAHILPAPPDCFPDKVKAFGPGLEPTGCIVDKPAEFTIDARAAGKGDLKLYAQDADGCPIDIKVIPNGDGTFRCSYVPTKPIKHTIIISWGGVNVPKSPFRVNVGEGSHPERVKVYGPGVEKTGLKANEPTYFTVDCSEAGQGDVSIGIKCAPGVVGPAEADIDFDIIKNDNDTFTVKYTPPGAGRYTIMVLFANQEIPASPFHIKVDPSHDASKVKAEGPGLNRTGVEVGKPTHFTVLTKGAGKAKLDVQFAGTAKGEVVRDFEIIDNHDYSYTVKYTAVQQGNMAVTVTYGGDPVPKSPFVVNVAPPLDLSKIKVQGLNSKVAVGQEQAFSVNTRGAGGQGQLDVRMTSPSRRPIPCKLEPGGGAEAQAVRYMPPEEGPYKVDITYDGHPVPGSPFAVEGVLPPDPSKVCAYGPGLKGGLVGTPAPFSIDTKGAGTGGLGLTVEGPCEAKIECQDNGDGSCAVSYLPTEPGEYTINILFAEAHIPGSPFKATIRPVFDPSKVRASGPGLERGKVGEAATFTVDCSEAGEAELTIEILSDAGVKAEVLIHNNADGTYHITYSPAFPGTYTITIKYGGHPVPKFPTRVHVQPAVDTSGVKVSGPGVEPHGVLREVTTEFTVDARSLTATGGNHVTARVLNPSGAKTDTYVTDNGDGTYRVQYTAYEEGVHLVEVLYDEVAVPKSPFRVGVTEGCDPTRVRAFGPGLEGGLVNKANRFTVETRGAGTGGLGLAIEGPSEAKMSCKDNKDGSCTVEYIPFTPGDYDVNITFGGRPIPGSPFRVPVKDVVDPGKVKCSGPGLGAGVRARVPQTFTVDCSQAGRAPLQVAVLGPTGVAEPVEVRDNGDGTHTVHYTPATDGPYTVAVKYADQEVPRSPFKIKVLPAHDASKVRASGPGLNASGIPASLPVEFTIDARDAGEGLLTVQILDPEGKPKKANIRDNGDGTYTVSYLPDMSGRYTITIKYGGDEIPYSPFRIHALPTGDASKCLVTVSIGGHGLGACLGPRIQIGQETVITVDAKAAGEGKVTCTVSTPDGAELDVDVVENHDGTFDIYYTAPEPGKYVITIRFGGEHIPNSPFHVLATEEPVVPVEPMESMLRPFNLVIPFAVQKGELTGEVRMPSGKTARPNITDNKDGTITVRYAPTEKGLHQMGIKYDGNHIPGSPLQFYVDAINSRHVSAYGPGLSHGMVNKPATFTIVTKDAGEGGLSLAVEGPSKAEITCKDNKDGTCTVSYLPTAPGDYSIIVRFDDKHIPGSPFTAKITGDDSMRTSQLNVGTSTDVSLKITESDLSQLTASIRAPSGNEEPCLLKRLPNRHIGISFTPKEVGEHVVSVRKSGKHVTNSPFKILVGPSEIGDASKVRVWGKGLSEGHTFQVAEFIVDTRNAGYGGLGLSIEGPSKVDINCEDMEDGTCKVTYCPTEPGTYIINIKFADKHVPGSPFTVKVTGEGRMKESITRRRQAPSIATIGSTCDLNLKIPGNWFQMVSAQERLTRTFTRSSHTYTRTERTEISKTRGGETKREVRVEESTQVGGDPFPAVFGDFLGRERLGSFGSITRQQEGEASSQDMTAQVTSPSGKVEAAEIVEGEDSAYSVRFVPQEMGPHTVAVKYRGQHVPGSPFQFTVGPLGEGGAHKVRAGGTGLERGVAGVPAEFSIWTREAGAGGLSIAVEGPSKAEIAFEDSQRWLLRRLLCRPGTR

SEQ ID NO: 914909 - protein, 548 aa, Homo sapiens
MMNNSGYSDAGLGLGDETDEMPSTEKDLAEDAPWKKIQQNTFTRWCNEHLKCVGKRLTDLQRDLSDGLRLIALLEVLSQKRMYRKFHPRPNFRQMKLENVSVALEFLEREHIKLVSIDSKAIVDGNLKLILGLIWTLILHYSISMPMWEDEDDEDARKQTPKQRLLGWIQNKVPQLPITNFNRDWQDGKALGALVDNCAPGLCPDWEAWDPNQPVENAREAMQQADDWLGVPQVIAPEEIVDPNVDEHSVMTYLSQFPKAKLKPGAPVRSKQLNPKKAIAYGPGIEPQGNTVLQPAHFTVQTVDAGVGEVLVYIEDPEGHTEEAKVVPNNDKDRTYAVSYVPKVAGLHKVTVLFAGQNIERSPFEVNVGMALGDANKVSARGPGLEPVGNVANKPTYFDIYTAGAGTGDVAVVIVDPQGRRDTVEVALEDKGDSTFRCTYRPAMEGPHTVHVAFAGAPITRSPFPVHVSEACNPNACRASGRGLQPKGVRVKEVADFKVFTKGAGSGELKVTVKGPKGTEEPALLRPCPQTCTVPEEVGRWRPSIPRR

SEQ ID NO: 914910 - protein, 92 aa, Homo sapiens
GLSEGHTFQVAEFIVDTRNAGTSCPREPPFQRVPPTGTCPRPAQHPLGRTLSSLKLPDQSASGFAFWGPLRESEWPRISSLPFKRKLSCPEF

SEQ ID NO: 914911 - protein, 2692 aa, Homo sapiens; identical to SEQ ID NO: 914904

SEQ ID NO: 914912 - protein, 2722 aa, Homo sapiens
MMNNSGYSDAGLGLGDETDEMPSTEKDLAEDAPWKKIQQNTFTRWCNEHLKCVGKRLTDLQRDLSDGLRLIALLEVLSQKRMYRKFHPRPNFRQMKLENVSVALEFLEREHIKLVSIDSKAIVDGNLKLILGLIWTLILHYSISMPMWEDEDDEDARKQTPKQRLLGWIQNKVPQLPITNFNRDWQDGKALGALVDNCAPGLCPDWEAWDPNQPVENAREAMQQADDWLGVPQVIAPEEIVDPNVDEHSVMTYLSQFPKAKLKPGAPVRSKQLNPKKAIAYGPGIEPQGNTVLQPAHFTVQTVDAGVGEVLVYIEDPEGHTEEAKVVPNNDKDRTYAVSYVPKVAGLHKVTVLFAGQNIERSPFEVNVGMALGDANKVSARGPGLEPVGNVANKPTYFDIYTAGAGTGDVAVVIVDPQGRRDTVEVALEDKGDSTFRCTYRPAMEGPHTVHVAFAGAPITRSPFPVHVSEACNPNACRASGRGLQPKGVRVKEVADFKVFTKGAGSGELKVTVKGPKGTEEPVKVREAGDGVFECEYYPVVPGKYVVTITWGGYAIPRSPFEVQVSPEAGVQKVRAWGPGLETGQVGKSADFVVEAIGTEVGTLGFSIEGPSQAKIECDDKGDGSCDVRYWPTEPGEYAVHVICDDEDIRDSPFIAHILPAPPDCFPDKVWSQLTHTCPGGGASWFSSPPQLSLLPSAQVKAFGPGLEPTGCIVDKPAEFTIDARAAGKGDLKLYAQDADGCPIDIKVIPNGDGTFRCSYVPTKPIKHTIIISWGGVNVPKSPFRVNVGEGSHPERVKVYGPGVEKTGLKANEPTYFTVDCSEAGQGDVSIGIKCAPGVVGPAEADIDFDIIKNDNDTFTVKYTPPGAGRYTIMVLFANQEIPASPFHIKVDPSHDASKVKAEGPGLNRTGVEVGKPTHFTVLTKGAGKAKLDVQFAGTAKGEVVRDFEIIDNHDYSYTVKYTAVQQGNMAVTVTYGGDPVPKSPFVVNVAPPLDLSKIKVQGLNSKVAVGQEQAFSVNTRGAGGQGQLDVRMTSPSRRPIPCKLEPGGGAEAQAVRYMPPEEGPYKVDITYDGHPVPGSPFAVEGVLPPDPSKVCAYGPGLKGGLVGTPAPFSIDTKGAGTGGLGLTVEGPCEAKIECQDNGDGSCAVSYLPTEPGEYTINILFAEAHIPGSPFKATIRPVFDPSKVRASGPGLERGKVGEAATFTVDCSEAGEAELTIEILSDAGVKAEVLIHNNADGTYHITYSPAFPGTYTITIKYGGHPVPKFPTRVHVQPAVDTSGVKVSGPGVEPHGVLREVTTEFTVDARSLTATGGNHVTARVLNPSGAKTDTYVTDNGDGTYRVQYTAYEEGVHLVEVLYDEVAVPKSPFRVGVTEGCDPTRVRAFGPGLEGGLVNKANRFTVETRGAGTGGLGLAIEGPSEAKMSCKDNKDGSCTVEYIPFTPGDYDVNITFGGRPIPGSPFRVPVKDVVDPGKVKCSGPGLGAGVRARVPQTFTVDCSQAGRAPLQVAVLGPTGVAEPVEVRDNGDGTHTVHYTPATDGPYTVAVKYADQEVPRSPFKIKVLPAHDASKVRASGPGLNASGIPASLPVEFTIDARDAGEGLLTVQILDPEGKPKKANIRDNGDGTYTVSYLPDMSGRYTITIKYGGDEIPYSPFRIHALPTGDASKCLVTVSIGGHGLGACLGPRIQIGQETVITVDAKAAGEGKVTCTVSTPDGAELDVDVVENHDGTFDIYYTAPEPGKYVITIRFGGEHIPNSPFHVLATEEPVVPVEPMESMLRPFNLVIPFAVQKGELTGEVRMPSGKTARPNITDNKDGTITVRYAPTEKGLHQMGIKYDGNHIPGSPLQFYVDAINSRHVSAYGPGLSHGMVNKPATFTIVTKDAGEGGLSLAVEGPSKAEITCKDNKDGTCTVSYLPTAPGDYSIIVRFDDKHIPGSPFTAKITGDDSMRTSQLNVGTSTDVSLKITESDLSQLTASIRAPSGNEEPCLLKRLPNRHIGISFTPKEVGEHVVSVRKSGKHVTNSPFKILVGPSEIGDASKVRVWGKGLSEGHTFQVAEFIVDTRNAGYGGLGLSIEGPSKVDINCEDMEDGTCKVTYCPTEPGTYIINIKFADKHVPGSPFTVKVTGEGRMKESITRRRQAPSIATIGSTCDLNLKIPGNWFQMVSAQERLTRTFTRSSHTYTRTERTEISKTRGGETKREVRVEESTQVGGDPFPAVFGDFLGRERLGSFGSITRQQEGEASSQDMTAQVTSPSGKVEAAEIVEGEDSAYSVRFVPQEMGPHTVAVKYRGQHVPGSPFQFTVGPLGEGGAHKVRAGGTGLERGVAGVPAEFSIWTREAGAGGLSIAVEGPSKAEIAFEDRKDGSCGVSYVVQEPGDYEVSIKFNDEHIPDSPFVVPVASLSDDARRLTVTSLQETGLKVNQPASFAVQLNGARGVIDARVHTPSGAVEECYVSELDSDKHTIRFIPHENGVHSIDVKFNGAHIPGSPFKIRVGEQSQAGDPGLVSAYGPGLEGGTTGVSSEFIVNTLNAGSGALSVTIDGPSKVQLDCRECPEGHVVTYTPMAPGNYLIAIKYGGPQHIVGSPFKAKVTGPRLSGGHSLHETSTVLVETVTKSSSSRGSSYSSIPKFSSDASKVVTRGPGLSQAFVGQKNSFTVDCSKAGTNMMMVGVHGPKTPCEEVYVKHMGNRVYNVTYTVKEKGDYILIVKWGDESVPGSPFKVKVP

SEQ ID NO: 914913 - protein, 820 aa, Homo sapiens
KLNKTPIPQTKFETTGLEEGVEYEFRVAAENIVGIGKPVAKISDDSMRTSQLNVGTSTDVSLKITESDLSQLTASIRAPSGNEEPCLLKRLPNRHIGISFTPKEVGEHVVSVRKSGKHVTNSPFKILVGPSEIGDASKVRVWGKGLSEGHTFQVAEFIVDTRNAGYGGLGLSIEGPSKVDINCEDMEDGTCKVTYCPTEPGTYIINIKFADKHVPGSPFTVKVTGEGRMKESITRRRQAPSIATIGSTCDLNLKIPGNWFQMVSAQERLTRTFTRSSHTYTRTERTEISKTRGGETKREVRVEESTQVGGDPFPAVFGDFLGRERLGSFGSITRQQEGEASSQDMTAQVTSPSGKVEAAEIVEGEDSAYSVRFVPQEMGPHTVAVKYRGQHVPGSPFQFTVGPLGEGGAHKVRAGGTGLERGVAGVPAEFSIWTREAGAGGLSIAVEGPSKAEIAFEDRKDGSCGVSYVVQEPGDYEVSIKFNDEHIPDSPFVVPVASLSDDARRLTVTSLQETGLKVNQPASFAVQLNGARGVIDARVHTPSGAVEECYVSELDSDKHTIRFIPHENGVHSIDVKFNGAHIPGSPFKIRVGEQSQAGDPGLVSAYGPGLEGGTTGVSSEFIVNTLNAGSGALSVTIDGPSKVQLDCRECPEGHVVTYTPMAPGNYLIAIKYGGPQHIVGSPFKAKVTGPRLSGGHSLHETSTVLVETVTKSSSSRGSSYSSIPKFSSDASKVVTRGPGLSQAFVGQKNSFTVDCSKAGTNMMMVGVHGPKTPCEEVYVKHMGNRVYNVTYTVKEKGDYILIVKWGDESVPGSPFKVKVP

SEQ ID NO: 914914 - protein, 156 aa, Homo sapiens
GRVGRPTRPKPQHIVGSPFKAKVTGPRLSGGHSLHETSTVLVETVTKSSSSRGSSYSSIPKFSSDASKVVTRGPGLSQAFVGQKNSFTVDCSKAGTNMMMVGVHGPKTPCEEVYVKHMGNRVYNVTYTVKEKGDYILIVKWGDESVPGSPFKVKVP

SEQ ID NO: 914915 - protein, 99 aa, Homo sapiens
GGDLEDPFSDEVVTRGPGLSQAFVGQKNSFTVDCSKAGTNMMMVGVHGPKTPCEEVYVKHMGNRVYNVTYTVKEKGDYILIVKWGDESVPGSPFKVKVP

SEQ ID NO: 914916 - protein, 2465 aa, Homo sapiens
MMNNSGYSDAGLGLGDETDEMPSTEKDLAEDAPWKKIQQNTFTRWCNEHLKCVGKRLTDLQRDLSDGLRLIALLEVLSQKRMYRKFHPRPNFRQMKLENVSVALEFLEREHIKLVSIDSKAIVDGNLKLILGLIWTLILHYSISMPMWEDEDDEDARKQTPKQRLLGWIQNKVPQLPITNFNRDWQDGKALGALVDNCAPGLCPDWEAWDPNQPVENAREAMQQADDWLGVPQVIAPEEIVDPNVDEHSVMTYLSQFPKAKLKPGAPVRSKQLNPKKAIAYGPGIEPQGNTVLQPAHFTVQTVDAGVGEVLVYIEDPEGHTEEAKVVPNNDKDRTYAVSYVPKVAGLHKVTVLFAGQNIERSPFEVNVGMALGDANKVSARGPGLEPVGNVANKPTYFDIYTAGAGTGDVAVVIVDPQGRRDTVEVALEDKGDSTFRCTYRPAMEGPHTVHVAFAGAPITRSPFPVHVSEACNPNACRASGRGLQPKGVRVKEVADFKVFTKGAGSGELKVTVKGPKGTEEPVKVREAGDGVFECEYYPVVPGKYVVTITWGGYAIPRSPFEVQVSPEAGVQKVRAWGPGLETGQVGKSADFVVEAIGTEVGTLGFSIEGPSQAKIECDDKGDGSCDVRYWPTEPGEYAVHVICDDEDIRDSPFIAHILPAPPDCFPDKVKAFGPGLEPTGCIVDKPAEFTIDARAAGKGDLKLYAQDADGCPIDIKVIPNGDGTFRCSYVPTKPIKHTIIISWGGVNVPKSPFRVNVGEGSHPERVKVYGPGVEKTGLKANEPTYFTVDCSEAGQGDVSIGIKCAPGVVGPAEADIDFDIIKNDNDTFTVKYTPPGAGRYTIMVLFANQEIPASPFHIKVDPSHDASKVKAEGPGLNRTGVEVGKPTHFTVLTKGAGKAKLDVQFAGTAKGEVVRDFEIIDNHDYSYTVKYTAVQQGNMAVTVTYGGDPVPKSPFVVNVAPPLDLSKIKVQGLNSKVAVGQEQAFSVNTRGAGGQGQLDVRMTSPSRRPIPCKLEPGGGAEAQAVRYMPPEEGPYKVDITYDGHPVPGSPFAVEGVLPPDPSKVCAYGPGLKGGLVGTPAPFSIDTKGAGTGGLGLTVEGPCEAKIECQDNGDGSCAVSYLPTEPGEYTINILFAEAHIPGSPFKATIRPVFDPSKVRASGPGLERGKVGEAATFTVDCSEAGEAELTIEILSDAGVKAEVLIHNNADGTYHITYSPAFPGTYTITIKYGGHPVPKFPTRVHVQPAVDTSGVKVSGPGVEPHGVLREVTTEFTVDARSLTATGGNHVTARVLNPSGAKTDTYVTDNGDGTYRVQYTAYEEGVHLVEVLYDEVAVPKSPFRVGVTEGCDPTRVRAFGPGLEGGLVNKANRFTVETRGAGTGGLGLAIEGPSEAKMSCKDNKDGSCTVEYIPFTPGDYDVNITFGGRPIPGSPFRVPVKDVVDPGKVKCSGPGLGAGVRARVPQTFTVDCSQAGRAPLQVAVLGPTGVAEPVEVRDNGDGTHTVHYTPATDGPYTVAVKYADQEVPRSPFKIKVLPAHDASKVRASGPGLNASGIPASLPVEFTIDARDAGEGLLTVQILDPEGKPKKANIRDNGDGTYTVSYLPDMSGRYTITIKYGGDEIPYSPFRIHALPTGDASKCLVTVSIGGHGLGACLGPRIQIGQETVITVDAKAAGEGKVTCTVSTPDGAELDVDVVENHDGTFDIYYTAPEPGKYVITIRFGGEHIPNSPFHVLATEEPVVPVEPMESMLRPFNLVIPFAVQKGELTGEVRMPSGKTARPNITDNKDGTITVRYAPTEKGLHQMGIKYDGNHIPGSPLQFYVDAINSRHVSAYGPGLSHGMVNKPATFTIVTKDAGEGGLSLAVEGPSKAEITCKDNKDGTCTVSYLPTAPGDYSIIVRFDDKHIPGSPFTAKITGDDSMRTSQLNVGTSTDVSLKITESDLSQLTASIRAPSGNEEPCLLKRLPNRHIGISFTPKEVGEHVVSVRKSGKHVTNSPFKILVGPSEIGDASKVRVWGKGLSEGHTFQVAEFIVDTRNAGYGGLGLSIEGPSKVDINCEDMEDGTCKVTYCPTEPGTYIINIKFADKHVPGSPFTVKVTGEGRMKESITRRRQAPSIATIGSTCDLNLKIPGNWFQMVSAQERLTRTFTRSSHTYTRTERTEISKTRGGETKREVRVEESTQVGGDPFPAVFGDFLGRERLGSFGSITRQQEGEASSQDMTAQVTSPSGKVEAAEIVEGEDSAYSVRFVPQEMGPHTVAVKYRGQHVPGSPFQFTVGPLGEGGAHKVRAGGTGLERGVAGVPAEFSIWTREAGAGGLSIAVEGPSKAEIAFEDRKDGSCGVSYVVQEPGDYEVSIKFNDEHIPDSPFVVPVASLSDDARRLTVTSLQETGLKVNQPASFAVQLNGARGVIDARVHTPSGAVEECYVSELDSDKHTIRFIPHENGVHSIDVKFNGPMGGLFYTLRGPAF

SEQ ID NO: 914917 - protein, 561 aa, Homo sapiens
MCGIWALFGSDDCLSVQCLSAMKIAHRGPDAFRFENVNGYTNCCFGFHRLAVVDPLFGMQPIRVKKYPYLWLCYNGEIYNHKKMQQHFEFEYQTKVDGEIILHLYDKGGIEQTICMLDGVFAFVLLDTANKKVFLGRDTYGVRPLFKAMTEDGFLAVCSEAKGLVTLKHSATPFLKVEPFLPGHYEVLDLKPNGKVASVEMVKYHHCRDEPLHALYDNVEKLFPGFEIETVKNNLRILFNNAVKKRLMTDRRIGCLLSGGLDSSLVAATLLKQLKEAQVQYPLQTFAIGMEDSPDLLAARKVADHIGSEHYEVLFNSEEGIQALDEVIFSLETYDITTVRASVGMYLISKYIRKNTDSVVIFSGEGSDELTQGYIYFHKAPSPEKAEEESERLLRELYLFDVLRADRTTAAHGLELRVPFLDHRFSSYYLSLPPEMRIPKNGIEKHLLRETFEDSNLIPKEILWRPKEAFSDGITSVKNSWFKILQEYVEHQVDDAMMANAAQKFPFNTPKTKEGYYYRQVFERHYPGRADWLSHYWMPKWINATDPSARTLTHYKSAVKA

SEQ ID NO: 914918 - protein, 258 aa, Homo sapiens
MVKYHHCRDEPLHALYDNVEKLFPGFEIETVKNNLRILFNNAVKKRLMTDRRIGCLLSGGLDSSLVAATLLKQLKEAQVQYPLQTFAIGMEDSPDLLAARKVADHIGSEHYEVLFNSEEGIQALDEVIFSLETYDITTVRASVGMYLISKYIRKNTDSVVIFSGEGSDELTQGYIYFHKAPSPEKAEEESERLLRELYLFDVLRADRTTAAHGLELRVPFLDHRFSSYYLSLPPEMRIPKRNGILRWGEPLGGAWGAP

SEQ ID NO: 914919 - protein, 102 aa, Homo sapiens
RAEFGRTKEAFSDGITSVKNSWFKILQEYVEHQVDDAMMANAAQKFPFNTPKTKEGYYYRQVFERHYPGRADWLSHYWMPKWINATDPSARTLTHYKSAVKA

SEQ ID NO: 914920 - protein, 561 aa, Homo sapiens; identical to SEQ ID NO: 914917

SEQ ID NO: 914921 - protein, 561 aa, Homo sapiens; identical to SEQ ID NO: 914917

SEQ ID NO: 914922 - protein, 561 aa, Homo sapiens; identical to SEQ ID NO: 914917

SEQ ID NO: 914923 - protein, 540 aa, Homo sapiens
MKIAHRGPDAFRFENVNGYTNCCFGFHRLAVVDPLFGMQPIRVKKYPYLWLCYNGEIYNHKKMQQHFEFEYQTKVDGEIILHLYDKGGIEQTICMLDGVFAFVLLDTANKKVFLGRDTYGVRPLFKAMTEDGFLAVCSEAKGLVTLKHSATPFLKVEPFLPGHYEVLDLKPNGKVASVEMVKYHHCRDEPLHALYDNVEKLFPGFEIETVKNNLRILFNNAVKKRLMTDRRIGCLLSGGLDSSLVAATLLKQLKEAQVQYPLQTFAIGMEDSPDLLAARKVADHIGSEHYEVLFNSEEGIQALDEVIFSLETYDITTVRASVGMYLISKYIRKNTDSVVIFSGEGSDELTQGYIYFHKAPSPEKAEEESERLLRELYLFDVLRADRTTAAHGLELRVPFLDHRFSSYYLSLPPEMRIPKNGIEKHLLRETFEDSNLIPKEILWRPKEAFSDGITSVKNSWFKILQEYVEHQVDDAMMANAAQKFPFNTPKTKEGYYYRQVFERHYPGRADWLSHYWMPKWINATDPSARTLTHYKSAVKA

SEQ ID NO: 914924 - protein, 458 aa, Homo sapiens
MCGIWALFGSDDCLSVQCLSAMKIAHRGPDAFRFENVNGYTNCCFGFHRLAVVDPLFGMQPIRVKKYPYLWLCYNGEIYNHKKMQQHFEFEYQTKVDGEIILHLYDKGGIEQTICMLDGVFAFVLLDTANKKVFLGRDTYGVRPLFKAMTEDGFLAVCSEAKGLVTLKHSATPFLKVEPFLPGHYEVLDLKPNGKVASVEMVKYHHCRDEPLHALYDNVEKLFPGFEIETVKNNLRILFNNAVKKRLMTDRRIGCLLSGGLDSSLVAATLLKQLKEAQVQYPLQTFAIGMEDSPDLLAARKVADHIGSEHYEVLFNSEEGIQALDEVIFSLETYDITTVRASVGMYLISKYIRKNTDSVVIFSGEGSDELTQGYIYFHKAPSPEKAEEESERLLRELYLFDVLRADRTTAAHGLELRVPFLDHRFSSYYLSLPPEMRIPKRNGILRWGEPLGGAWGAP

SEQ ID NO: 914925 - protein, 493 aa, Homo sapiens
MRGYEEVVSYTDRKNMQQHFEFEYQTKVDGEIILHLYDKGGIEQTICMLDGVFAFVLLDTANKKVFLGRDTYGVRPLFKAMTEDGFLAVCSEAKGLVTLKHSATPFLKVEPFLPGHYEVLDLKPNGKVASVEMVKYHHCRDEPLHALYDNVEKLFPGFEIETVKNNLRILFNNAVKKRLMTDRRIGCLLSGGLDSSLVAATLLKQLKEAQVQYPLQTFAIGMEDSPDLLAARKVADHIGSEHYEVLFNSEEGIQALDEVIFSLETYDITTVRASVGMYLISKYIRKNTDSVVIFSGEGSDELTQGYIYFHKAPSPEKAEEESERLLRELYLFDVLRADRTTAAHGLELRVPFLDHRFSSYYLSLPPEMRIPKNGIEKHLLRETFEDSNLIPKEILWRPKEAFSDGITSVKNSWFKILQEYVEHQVDDAMMANAAQKFPFNTPKTKEGYYYRQVFERHYPGRADWLSHYWMPKWINATDPSARTLTHYKSAVKA

SEQ ID NO: 914926 - protein, 380 aa, Homo sapiens
KLTARYEAGVVKGKVASVEMVKYHHCRDEPLHALYDNVEKLFPGFEIETVKNNLRILFNNAVKKRLMTDRRIGCLLSGGLDSSLVAATLLKQLKEAQVQYPLQTFAIGMEDSPDLLAARKVADHIGSEHYEVLFNSEEGIQALDEVIFSLETYDITTVRASVGMYLISKYIRKNTDSVVIFSGEGSDELTQGYIYFHKAPSPEKAEEESERLLRELYLFDVLRADRTTAAHGLELRVPFLDHRFSSYYLSLPPEMRIPKNGIEKHLLRETFEDSNLIPKEILWRPKEAFSDGITSVKNSWFKILQEYVEHQVDDAMMANAAQKFPFNTPKTKEGYYYRQVFERHYPGRADWLSHYWMPKWINATDPSARTLTHYKSAVKA

SEQ ID NO: 914927 - protein, 361 aa, Homo sapiens
MVKYHHCRDEPLHALYDNVEKLFPGFEIETVKNNLRILFNNAVKKRLMTDRRIGCLLSGGLDSSLVAATLLKQLKEAQVQYPLQTFAIGMEDSPDLLAARKVADHIGSEHYEVLFNSEEGIQALDEVIFSLETYDITTVRASVGMYLISKYIRKNTDSVVIFSGEGSDELTQGYIYFHKAPSPEKAEEESERLLRELYLFDVLRADRTTAAHGLELRVPFLDHRFSSYYLSLPPEMRIPKNGIEKHLLRETFEDSNLIPKEILWRPKEAFSDGITSVKNSWFKILQEYVEHQVDDAMMANAAQKFPFNTPKTKEGYYYRQVFERHYPGRADWLSHYWMPKWINATDPSARTLTHYKSAVKA

SEQ ID NO: 914928 - protein, 281 aa, Homo sapiens
MCGIWALFGSDDCLSVQCLSAMKIAHRGPDAFRFENVNGYTNCCFGFHRLAVVDPLFGMQPIRVKKYPYLWLCYNGEIYNHKKMQQHFEFEYQTKVDGEIILHLYDKGGIEQTICMLDGVFAFVLLDTANKKVFLGRDTYGVRPLFKAMTEDGFLAVCSEAKGLVTLKHSATPFLKVEPFLPGHYEVLDLKPNGKVASVEMVKYHHCRDEPLHALYDNVEKLFPGFEIETVKNNLRILFNNAVKKRLMTDRRIGCLLSGGLDSSLVAATLLKQLKEAQERS

SEQ ID NO: 914929 - protein, 190 aa, Homo sapiens
IQSNGDSHAPSPEKAEEESERLLRELYLFDVLRADRTTAAHGLELRVPFLDHRFSSYYLSLPPEMRIPKNGIEKHLLRETFEDSNLIPKEILWRPKEAFSDGITSVKNSWFKILQEYVEHQVDDAMMANAAQKFPFNTPKTKEGYYYRQVFERHYPGRADWLSHYWMPKWINATDPSARTLTHYKSAVKA

SEQ ID NO: 914930 - protein, 163 aa, Homo sapiens
VRRRLSQDYVFAAHGLELRVPFLDHRFSSYYLSLPPEMRIPKNGIEKHLLRETFEDSNLIPKEILWRPKEAFSDGITSVKNSWFKILQEYVEHQVDDAMMANAAQKFPFNTPKTKEGYYYRQVFERHYPGRADWLSHYWMPKWINATDPSARTLTHYKSAVKA

SEQ ID NO: 914931 - protein, 331 aa, Homo sapiens
MQQHFEFEYQTKVDGEIILHLYDKGGIEQTICMLDGVFAFVLLDTANKKVFLGRDTYGVRPLFKAMTEDGFLAVCSEAKGLVTLKHSATPFLKVEPFLPGHYEVLDLKPNGKVASVEMVKYHHCRDEPLHALYDNVEKLFPGFEIETVKNNLRILFNNAVKKRLMTDRRIGCLLSGGLDSSLVAATLLKQLKEAQVQYPLQTFAIGMEDSPDLLAARKVADHIGSEHYEVLFNSEEGIQALDEVIFSLETYDITTVRASVGMYLISKYIRKNTDSVVIFSGEGSDELTQGYIYFHKAPSPEKAEEESERLLRELYLFDVLRADRTTAAHGL

SEQ ID NO: 914932 - protein, 561 aa, Homo sapiens; identical to SEQ ID NO: 914917

SEQ ID NO: 914933 - protein, 171 aa, Homo sapiens
CNDGKCSPENLFGYQIELTAAHGLELRVPFLDHRFSSYYLSLPPEMRIPKNGIEKHLLRETFEDSNLIPKEILWRPKEAFSDGITSVKNSWFKILQEYVEHQVDDAMMANAAQKFPFNTPKTKEGYYYRQVFERHYPGRADWLSHYWMPKWINATDPSARTLTHYKSAVKA

SEQ ID NO: 914934 - protein, 240 aa, Homo sapiens
MCGIWALFGSDDCLSVQCLSAMKIAHRGPDAFRFENVNGYTNCCFGFHRLAVVDPLFGMQPIRVKKYPYLWLCYNGEIYNHKKMQQHFEFEYQTKVDGEIILHLYDKGGIEQTICMLDGVFAFVLLDTANKKVFLGRDTYGVRPLFKAMTEDGFLAVCSEAKGLVTLKHSATPFLKVEPFLPGHYEVLDLKPNGKVASVEMVKYHHCRDEPLHALYDNVEKLFPGLGYKLCRATQDPLKA

SEQ ID NO: 914935 - protein, 401 aa, Homo sapiens [sequence omitted]

SEQ ID NO: 914936 - protein, 493 aa, Homo sapiens
MCGIWALFGSDDCLSVQCLSAMKIAHRGPDAFRFENVNGYTNCCFGFHRLAVVDPLFGMQPIRVKKYPYLWLCYNGEIYNHKKMQQHFEFEYQTKVDGEIILHLYDKGGIEQTICMLDGVFAFVLLDTANKKVFLGRDTYGVRPLFKAMTEDGFLAVCSEAKGLVTLKHSATPFLKVEPFLPGHYEVLDLKPNGKVASVEMVKYHHCRDEPLHALYDNVEKLFPGFEIETVKNNLRILFNNAVKKRLMTDRRIGCLLSGGLDSSLVAATLLKQLKEAQVQYPLQTFAIGMEDSPDLLAARKVADHIGSEHYEVLFNSEEGIQALDEVIFSLETYDITTVRASVGMYLISKYIRKNTDSVVIFSGEGSDELTQGYIYFHKAPSPEKAEEESERLLRELYLFDVLRADRTTAAHGLELRVPFLDHRFSSYYLSLPPEMRIPKNGIEKHLLRETFEDSNLIPKEILWRPKEAFSDGITSVKNSWFKILQEYVEHQV

SEQ ID NO: 914937 - protein, 540 aa, Homo sapiens; identical to SEQ ID NO: 914923

SEQ ID NO: 914938 - protein, 452 aa, Homo sapiens
MCGIWALFGSDDCLSVQCLSAMKIAHRGPDAFRFENVNGYTNCCFGFHRLAVVDPLFGMQPIRVKKYPYLWLCYNGEIYNHKKMQQHFEFEYQTKVDGEIILHLYDKGGIEQTICMLDGVFAFVLLDTANKKVFLGRDTYGVRPLFKAMTEDGFLAVCSEAKGLVTLKHSATPFLKVEPFLPGHYEVLDLKPNGKVASVEMVKYHHCRDEPLHALYDNVEKLFPGFEIETVKNNLRILFNNAVKKRLMTDRRIGCLLSGGLDSSLVAATLLKQLKEAQVQYPLQTFAIGMEDSPDLLAARKVADHIGSEHYEVLFNSEEGIQALDEVIFSLETYDITTVRASVGMYLISKYIRKNTDSVVIFSGEGSDELTQGYIYFHKAPSPEKAEEESERLLRELYLFDVLRADRTTAAHGLELRVPFLDHRFSSYYLSLPPEMRIPKVISSQDPVKMTT

SEQ ID NO: 914939 - protein, 395 aa, Homo sapiens [sequence omitted]

SEQ ID NO: 914940 - protein, 362 aa, Homo sapiens
RVYKLLYPTSFGRVGRPTRPGETLSRFEIETVKNNLRILFNNAVKKRLMTDRRIGCLLSGGLDSSLVAATLLKQLKEAQVQYPLQTFAIGMEDSPDLLAARKVADHIGSEHYEVLFNSEEGIQALDEVIFSLETYDITTVRASVGMYLISKYIRKNTDSVVIFSGEGSDELTQGYIYFHKAPSPEKAEEESERLLRELYLFDVLRADRTTAAHGLELRVPFLDHRFSSYYLSLPPEMRIPKNGIEKHLLRETFEDSNLIPKEILWRPKEAFSDGITSVKNSWFKILQEYVEHQVDDAMMANAAQKFPFNTPKTKEGYYYRQVFERHYPGRADWLSHYWMPKWINATDPSARTLTHYKSAVKA

SEQ ID NO: 914941 - protein, 274 aa, Homo sapiens
MCGIWALFGSDDCLSVQCLSAMKIAHRGPDAFRFENVNGYTNCCFGFHRLAVVDPLFGMQPIRVKKYPYLWLCYNGEIYNHKKMQQHFEFEYQTKVDGEIILHLYDKGGIEQTICMLDGVFAFVLLDTANKKVFLGRDTYGVRPLFKAMTEDGFLAVCSEAKGLVTLKHSATPFLKVEPFLPGHYEVLDLKPNGKVASVEMVKYHHCRDEPLHALYDNVEKLFPGLGLHRAEAPRGPFLLCRTLWCPTGGRSPGGTPRCGPVPLTAVLPSVDAL

SEQ ID NO: 914942 - protein, 161 aa, Homo sapiens
IRYSIDRTTAVHGLELRVPFLDHRFSSYYLSLPPEMRIPKNGIEKHLLRETFEDSNLIPKEILWRPKEAFSDGITSVKNSWFKILQEYVEHQVDDAMMANAAQKFPFNTPKTKEGYYYRQVFERHYPGRADWLSHYWMPKWINATDPSARTLTHYKSAVKA

SEQ ID NO: 914943 - protein, 435 aa, Homo sapiens
MEMEKEFEQIDKSGSWAAIYQDIRHEASDFPCRVAKLPKNKNRNRYRDVSPFDHSRIKLHQEDNDYINASLIKMEEAQRSYILTQGPLPNTCGHFWEMVWEQKSRGVVMLNRVMEKGSLKCAQYWPQKEEKEMIFEDTNLKLTLISEDIKSYYTVRQLELENLTTQETREILHFHYTTWPDFGVPESPASFLNFLFKVRESGSLSPEHGPVVVHCSAGIGRSGTFCLADTCLLLMDKRKDPSSVDIKKVLLEMRKFRMGLIQTADQLRFSYLAVIEGAKFIMGDSSVQDQWKELSHEDLEPPPEHIPPPPRPPKRILEPHNGKCREFFPNHQWVKEETQEDKDCPIKEEKGSPLNAAPYGIESMSQDTEVRSRVVGGSLRGAQAASPAKGEPSLPEKDEDHALSYWKPFLVNMCVATVLTAGAYLCYRFLFNSNT

SEQ ID NO: 914944 - protein, 432 aa, Homo sapiens
MEMEKEFEQIDKSGSWAAIYQDIRHEASDFPCRVAKLPKNKNRNRYRDVSPFDHSRIKLHQEDNDYINASLIKMEEAQRSYILTQGPLPNTCGHFWEMVWEQKSRGVVMLNRVMEKGSLKCAQYWPQKEEKEMIFEDTNLKLTLISEDIKSYYTVRQLELENLTTQETREILHFHYTTWPDFGVPESPASFLNFLFKVRESGSLSPEHGPVVVHCSAGIGRSGTFCLADTCLLLMDKRKDPSSVDIKKVLLEMRKFRMGLIQTADQLRFSYLAVIEGAKFIMGDSSVQDQWKELSHEDLEPPPEHIPPPPRPPKRILEPHNGKCREFFPNHQWVKEETQEDKDCPIKEEKGSPLNAAPYGIESMSQDTEVRSRVVGGSLRGAQAASPAKGEPSLPEKDEDHALSYWKPFLVNMCVATVLTAGAYLCYRVCFH

SEQ ID NO: 914945 - protein, 432 aa, Homo sapiens; identical to SEQ ID NO: 914944

SEQ ID NO: 914946 - protein, 435 aa, Homo sapiens; identical to SEQ ID NO: 914943

SEQ ID NO: 914947 - protein, 432 aa, Homo sapiens; identical to SEQ ID NO: 914944

SEQ ID NO: 914948 - protein, 426 aa, Homo sapiens
VDSEESQFDGDSDIRHEASDFPCRVAKLPKNKNRNRYRDVSPFDHSRIKLHQEDNDYINASLIKMEEAQRSYILTQGPLPNTCGHFWEMVWEQKSRGVVMLNRVMEKGSLKCAQYWPQKEEKEMIFEDTNLKLTLISEDIKSYYTVRQLELENLTTQETREILHFHYTTWPDFGVPESPASFLNFLFKVRESGSLSPEHGPVVVHCSAGIGRSGTFCLADTCLLLMDKRKDPSSVDIKKVLLEMRKFRMGLIQTADQLRFSYLAVIEGAKFIMGDSSVQDQWKELSHEDLEPPPEHIPPPPRPPKRILEPHNGKCREFFPNHQWVKEETQEDKDCPIKEEKGSPLNAAPYGIESMSQDTEVRSRVVGGSLRGAQAASPAKGEPSLPEKDEDHALSYWKPFLVNMCVATVLTAGAYLCYRFLFNSNT

SEQ ID NO: 914949 - protein, 117 aa, Homo sapiens [sequence omitted]

SEQ ID NO: 914950 - protein, 682 aa, Homo sapiens
HPYGYVARPGVDEGDRETTIRGKATPAEEEKTGKVKYSRLAKYFFNKEGDFNNLTAAAFHKKSHLLVTGFASGIFHLHELPEFNLIHSLSISDQSIASVAINSSGDWIAFGCSGLGQLLVWEWQSESYVLKQQGHFNSMVALAYSPDGQYIVTGGDDGKVKVWNTLSGFCFVTFTEHSSGVTGVTFTATGYVVVTSSMDGTVRAFDLHRYRNFRTFTSPRPTQFSCVAVDASGEIVSAGAQDSFEIFVWSMQTGRLLDVLSGHEGPISGLCFNPMKSVLASASWDKTVRLWDMFDSWRTKETLALTSDALAVTFRPDGAELAVATLNSQITFWDPENAVQTGSIEGRHDLKTGRKELDKITAKHAAKGKAFTALCYSADGHSILAGGMSKFVCIYHVREQILMKRFEISCNLSLDAMEEFLNRRKMTEFGNLALIDQDAGQEDGVAIPLPGVRKGDMSSRHFKPEIRVTSLRFSPTGRCWAATTTEGLLIYSLDTRVLFDPFELDTSVTPGRVREALRQQDFTRAILMALRLNESKLVQEALEAVPRGEIEVVTSSLPELYVEKVLEFLASSFEVSRHLEFYLLWTHKLLMLHGQKLKSRAGTLLPVIQFLQKSIQRHLDDLSKLCSWNHYNMQYALAVSKQRGTKRSLDPLGSEEEAEASEDDSLHLLGGGGRDSEEEMLA

SEQ ID NO: 914951 - protein, 529 aa, Homo sapiens
ACCGRCRADPREVSLWAAAGLSCGTRATAVMKFAYRFSNLLGTVYRRGNLNFTCNGNSVISPVGNRVTVFDLKNNKSDTLPLATRYNVKCVGLSPDGRLAIIVDEGGDALLVSLVCRSVLHHFHFKGSVHSVSFSPDGRKFVVTKGNIAQMYHAPGKKREFNAFVLDKTYFGPYDETTCIDWTDDSRCFVVGSKDMSTWVFGAERWDNLIYYALGGHKDAIVACFFESNSLDLYSLSQDGVLCMWQCDTPPEGLRLKPPAGWKADLLQREEEEEEEEDQEGDRETTIRGKATPAEEEKTGKVKYSRLAKYFFNKEGDFNNLTAAAFHKKSHLLVTGFASGIFHLHELPEFNLIHSLSISDQSIASVAINSSGDWIAFGCSGLGQLLVWEWQSESYVLKQQGHFNSMVALAYSPDGQYIVTGGDDGKVKVWNTLSGFCFVTFTEHSSGVTGVTFTATGYVVVTSSMDGTVRAFDLHRYRNFRTFTSPRPTQFSCVAVDASGEIVSAGAQDSFEIFVWSMQTGRLLDLLGP

SEQ ID NO: 914952 - protein, 625 aa, Homo sapiens
NVRLRYEAGCDGFASGIFHLHELPEFNLIHSLSISDQSIASVAINSSGDWIAFGCSGLGQLLVWEWQSESYVLKQQGHFNSMVALAYSPDGQYIVTGGDDGKVKVWNTLSGFCFVTFTEHSSGVTGVTFTATGYVVVTSSMDGTVRAFDLHRYRNFRTFTSPRPTQFSCVAVDASGEIVSAGAQDSFEIFVWSMQTGRLLDVLSGHEGPISGLCFNPMKSVLASASWDKTVRLWDMFDSWRTKETLALTSDALAVTFRPDGAELAVATLNSQITFWDPENAVQTGSIEGRHDLKTGRKELDKITAKHAAKGKAFTALCYSADGHSILAGGMSKFVCIYHVREQILMKRFEISCNLSLDAMEEFLNRRKMTEFGNLALIDQDAGQEDGVAIPLPGVRKGDMSSRHFKPEIRVTSLRFSPTGRCWAATTTEGLLIYSLDTRVLFDPFELDTSVTPGRVREALRQQDFTRAILMALRLNESKLVQEALEAVPRGEIEVVTSSLPELYVEKVLEFLASSFEVSRHLEFYLLWTHKLLMLHGQKLKSRAGTLLPVIQFLQKSIQRHLDDLSKLCSWNHYNMQYALAVSKQRGTKRSLDPLGSEEEAEASEDDSLHLLGGGGRDSEEEMLA

SEQ ID NO: 914953 - protein, 676 aa, Homo sapiens
ACCGRCRADPREVSLWAAAGLSCGTRATAVMKFAYRFSNLLGTVYRRGNLNFTCNGNSVISPVGNRVTVFDLKNNKSDTLPLATRYNVKCVGLSPDGRLAIIVDEGGDALLVSLVCRSVLHHFHFKGSVHSVSFSPDGRKFVVTKGNIAQMYHAPGKKREFNAFVLDKTYFGPYDETTCIDWTDDSRCFVVGSKDMSTWVFGAERWDNLIYYALGGHKDAIVACFFESNSLDLYSLSQDGVLCMWQCDTPPEGLRLKPPAGWKADLLQREEEEEEEEDQEGDRETTIRGKATPAEEEKTGKVKYSRLAKYFFNKEGDFNNLTAAAFHKKSHLLVTGFASGIFHLHELPEFNLIHSLSISDQSIASVAINSSGDWIAFGCSGLGQLLVWEWQSESYVLKQQGHFNSMVALAYSPDGQYIVTGGDDGKVKVWNTLSGFCFVTFTEHSSGVTGVTFTATGYVVVTSSMDGTVRAFDLHRYRNFRTFTSPRPTQFSCVAVDASGEIVSAGAQDSFEIFVWSMQTGRLLDVLSGHEGPISGLCFNPMKSVLASASWDKTVRLWDMFDSWRTKETLALTSDALAVTFRPDGAELAVATLNSQITFWDPENAVQTGSIEGRHDLKTGRKELDKITAKHAAKGKAFTALCYSADGHSILAGGMSKFVCIYHVREQILMKRFENS

SEQ ID NO: 914954 - protein, 949 aa, Homo sapiens
ACCGRCRADPREVSLWAAAGLSCGTRATAVMKFAYRFSNLLGTVYRRGNLNFTCNGNSVISPVGNRVTVFDLKNNKSDTLPLATRYNVKCVGLSPDGRLAIIVDEGGDALLVSLVCRSVLHHFHFKGSVHSVSFSPDGRKFVVTKGNIAQMYHAPGKKREFNAFVLDKTYFGPYDETTCIDWTDDSRCFVVGSKDMSTWVFGAERWDNLIYYALGGHKDAIVACFFESNSLDLYSLSQDGVLCMWQCDTPPEGLRLKPPAGWKADLLQREEEEEEEEDQEGDRETTIRGKATPAEEEKTGKVKYSRLAKYFFNKEGDFNNLTAAAFHKKSHLLVTGFASGIFHLHELPEFNLIHSLSISDQSIASVAINSSGDWIAFGCSGLGQLLVWEWQSESYVLKQQGHFNSMVALAYSPDGQYIVTGGDDGKVKVWNTLSGFCFVTFTEHSSGVTGVTFTATGYVVVTSSMDGTVRAFDLHRYRNFRTFTSPRPTQFSCVAVDASGEIVSAGAQDSFEIFVWSMQTGRLLDVLSGHEGPISGLCFNPMKSVLASASWDKTVRLWDMFDSWRTKETLALTSDALAVTFRPDGAELAVATLNSQITFWDPENAVQTGSIEGRHDLKTGRKELDKITAKHAAKGKAFTALCYSADGHSILAGGMSKFVCIYHVREQILMKRFEISCNLSLDAMEEFLNRRKMTEFGNLALIDQDAGQEDGVAIPLPGVRKGDMSSRHFKPEIRVTSLRFSPTGRCWAATTTEGLLIYSLDTRVLFDPFELDTSVTPGRVREALRQQDFTRAILMALRLNESKLVQEALEAVPRGEIEVVTSSLPELYVEKVLEFLASSFEVSRHLEFYLLWTHKLLMLHGQKLKSRAGTLLPVIQFLQKSIQRHLDDLSKLCSWNHYNMQYALAVSKQRGTKRSLDPLGSEEEAEASEDDSLHLLGGGGRDSEEEMLA

SEQ ID NO: 914955 - protein, 988 aa, Homo sapiens
ACCGRCRADPREVSLWAAAGLSCGTRATAVMKFAYRFSNLLGTVYRRGNLNFTCNGNSVISPVGNRVTVFDLKNNKSDTLPLATRYNVKCVGLSPDGRLAIIVDEGGDALLVSLVCRSVLHHFHFKGSVHSVSFSPDGRKFVVTKGNIAQMYHAPGKKREFNAFVLDKTYFGPYDETTCIDWTDDSRCFVVGSKDMSTWVFGAERWDNLIYYALGGHKDAIVACFFESNSLDLYSLSQDGVLCMWQCDTPPEGLRLKPPAGWKADLLQREEEEEEEEDQEGDRETTIRGKATPAEEEKTGKVKYSRLAKYFFNKEGDFNNLTAAAFHKKSHLLVTGFASGIFHLHELPEFNLIHSLSISDQSIASVAINSSGDWIAFGCSGLGQLLVWEWQSESYVLKQQGHFNSMVALAYSPDGQYIVTGGDDGKVKVWNTLSGFCFVTFTEHSSGVTGVTFTATGYVVVTSSMDGTVRAFDLHRYRNFRTFTSPRPTQFSCVAVDASGEIVSAGAQDSFEIFVWSMQTGRLLDVLSGHEGPISGLCFNPMKSVLASASWDKTVRLWDMFDSWRTKETLALTSDALAVTFRPDGAELAVATLNSQITFWDPENAVQTGSIEGRHDLKTGRKELDKITAKHAAKGKAFTALCYSADGHSILAGGMSKFVCIYHVREQILMKRFEISCNLSLDAMEEFLNRRKMTEFGNLALIDQDAGQEDGVAIPLPGVRKGDMSSRHFKPEIRVTSLRFSPTVIRAALSGAAETTGPAELKTPELDRRLGWLPASREETHAWRCWAATTTEGLLIYSLDTRVLFDPFELDTSVTPGRVREALRQQDFTRAILMALRLNESKLVQEALEAVPRGEIEVVTSSLPELYVEKVLEFLASSFEVSRHLEFYLLWTHKLLMLHGQKLKSRAGTLLPVIQFLQKSIQRHLDDLSKLCSWNHYNMQYALAVSKQRGTKRSLDPLGSEEEAEASEDDSLHLLGGGGRDSEEEMLA

SEQ ID NO: 914956 - protein, 721 aa, Homo sapiens
MEIQLSVPWAIESLYLTLKTTNLTRCPWPLGTTSSAWGCPRMAASLSSSMKEGDRETTIRGKATPAEEEKTGKVKYSRLAKYFFNKEGDFNNLTAAAFHKKSHLLVTGFASGIFHLHELPEFNLIHSLSISDQSIASVAINSSGDWIAFGCSGLGQLLVWEWQSESYVLKQQGHFNSMVALAYSPDGQYIVTGGDDGKVKVWNTLSGFCFVTFTEHSSGVTGVTFTATGYVVVTSSMDGTVRAFDLHRYRNFRTFTSPRPTQFSCVAVDASGEIVSAGAQDSFEIFVWSMQTGRLLDVLSGHEGPISGLCFNPMKSVLASASWDKTVRLWDMFDSWRTKETLALTSDALAVTFRPDGAELAVATLNSQITFWDPENAVQTGSIEGRHDLKTGRKELDKITAKHAAKGKAFTALCYSADGHSILAGGMSKFVCIYHVREQILMKRFEISCNLSLDAMEEFLNRRKMTEFGNLALIDQDAGQEDGVAIPLPGVRKGDMSSRHFKPEIRVTSLRFSPTGRCWAATTTEGLLIYSLDTRVLFDPFELDTSVTPGRVREALRQQDFTRAILMALRLNESKLVQEALEAVPRGEIEVVTSSLPELYVEKVLEFLASSFEVSRHLEFYLLWTHKLLMLHGQKLKSRAGTLLPVIQFLQKSIQRHLDDLSKLCSWNHYNMQYALAVSKQRGTKRSLDPLGSEEEAEASEDDSLHLLGGGGRDSEEEMLA

SEQ ID NO: 914957 - protein, 380 aa, Homo sapiens
MRAVRSSLQGRRTPLRFSCGPCRQAGSLIFWDPENAVQTGSIEGRHDLKTGRKELDKITAKHAAKGKAFTALCYSADGHSILAGGMSKFVCIYHVREQILMKRFEISCNLSLDAMEEFLNRRKMTEFGNLALIDQDAGQEDGVAIPLPGVRKGDMSSRHFKPEIRVTSLRFSPTGRCWAATTTEGLLIYSLDTRVLFDPFELDTSVTPGRVREALRQQDFTRAILMALRLNESKLVQEALEAVPRGEIEVVTSSLPELYVEKVLEFLASSFEVSRHLEFYLLWTHKLLMLHGQKLKSRAGTLLPVIQFLQKSIQRHLDDLSKLCSWNHYNMQYALAVSKQRGTKRSLDPLGSEEEAEASEDDSLHLLGGGGRDSEEEMLA

SEQ ID NO: 914958 - protein, 755 aa, Homo sapiens
QCCAGRHHHHSRRRWPGCWTRRARRPPRQLRHPLQPSLSPPRPVPMEEMEEELKCPVCGSFYREPIILPCSHNLCQACARNILVQTPESESPQSHRAAGSGVSDYDYLDLDKMSLYSEADSGYGSYGGFASAPTTPCQKSPNGVRVFPPAMPPPATHLSPALAPVPRNSCITCPQCHRSLILDDRGLRGFPKNRVLEGVIDRYQQSKAAALKCQLCEKAPKEATVMCEQCDVFYCDPCRLRCHPPRGPLAKHRLVPPAQGRVSRRLSPRKVSTCTDHELENHSMYCVQCKMPVCYQCLEEGKHSSHEVKALGAMWKLHKSQLSQALNGLSDRAKEAKEFLVQLRNMVQQIQENSVEFEACLVAQCDALIDALNRRKAQLLARVNKEHEHKLKVVRDQISHCTVKLRQTTGLMEYCLEVIKENDPSGFLQISDALIRRVHLTEDQWGKGTLTPRMTTDFDLSLDNSPLLQSIHQLDFVQVKASSPVPATPILQLEECCTHNNSATLSWKQPPLSTVPADGYILELDDGNGGQFREVYVGKETMCTVDGLHFNSTYNARVKAFNKTGVSPYSKTLVLQTSEVAWFAFDPGSAHSDIILSNDNLTVTCSSYDDRVVLGKTGFSKGIHYWELTVDRYDNHPDPAFGVARMDVMKDVMLGKDDKAWAMYVDNNRSWFMHNNSHTNRTEGGITKGATIGVLLDFNRKNLTFFINDEQQGPIAFDNVEGLFFPAVSLNRNVQVTLHTGLPVPDFYSSRASIA

SEQ ID NO: 914959 - protein, 177 aa, Homo sapiens
MEEMEEELKCPVCGSFYREPIILPCSHNLCQACARNILVQTPESESPQSHRAAGSGVSDYDYLDLDKMSLYSEADSGYGSYGGFASAPTTPCQKSPNGVRVFPPAMPPPATHLSPALAPVPRNSCITCPQCHRSLILDDRGLRGFPKNRVLEGVIDRYQQSKAAALKCQLCEKAPKE

SEQ ID NO: 914960 - protein, 595 aa, Homo sapiens
QCCAGRHHHHSRRRWPGCWTRRARRPPRQLRHPLQPSLSPPRPVPMEEMEEELKCPVCGSFYREPIILPCSHNLCQACARNILVQTPESESPQSHRAAGSGVSDYDYLDLDKMSLYSEADSGYGSYGGFASAPTTPCQKSPNGVRVFPPAMPPPATHLSPALAPVPRNSCITCPQCHRSLILDDRGLRGFPKNRVLEGVIDRYQQSKAAALKCQLCEKAPKEATVMCEQCDVFYCDPCRLRCHPPRGPLAKHRLVPPAQGRVSRRLSPRKVSTCTDHELENHSMYCVQCKMPVCYQCLEEGKHSSHEVKALGAMWKLHKSQLSQALNGLSDRAKEAKEFLVQLRNMVQQIQENSVEFEACLVAQCDALIDALNRRKAQLLARVNKEHEHKLKVVRDQISHCTVKLRQTTGLMEYCLEVIKENDPSGFLQISDALIRRVHLTEDQWGKGTLTPRMTTDFDLSLDNSPLLQSIHQLDFVQVKASSPVPATPILQLEECCTHNNSATLSWKQPPLSTVPADGYILELDDGNGGQFREVYVGKETMCTVDGLHFNSTYNARVKAFNKTGVSPYSKTLVLQTSEGKALQQYPSERELRGI

SEQ ID NO: 914961 - protein, 274 aa, Homo sapiens
MAAERGAGQQQSQEMMEEEHELPVDMETINLDRDAEDVDLNHYRIGKIEGFEVLKKVKTLCLRQNLIKCIENLEELQSLRELDLYDNQIKKIENLEALTELEILDISFNLLRNIEGVDKLTRLKKLFLVNNKISKIENLSNLHQLQMLELGSNRIRAIENIDTLTNLESLFLGKNKITKLQNLDALTNLTVLSMQSNRLTKIEGLQNLVNLRELYLSHNGIEVIEGLENNNKLTMLDIASNRIKKIENISHLTELQEFWMNDNLLDGRVAHGDP

SEQ ID NO: 914962 - protein, 262 aa, Homo sapiens
AHATPHTHPNTRQRTNWHVSEAAWAMERGEEDPEEEHELPVDMETINLDRDAEDVDLNHYRIGKIEGFEVLKKVKTLCLRQNLIKCIENLEELQSLRELDLYDNQIKKIENLEALTELEILDISFNLLRNIEGVDKLTRLKKLFLVNNKISKIENLSNLHQLQMLELGSNRIRAIENIDTLTNLESLFLGKNKITKLQNLDALTNLTVLSMQSNRLTKIEGLQNLVNLRELYLSHNGIEVIEGLENNNKLRMWDMGSNRSTD

SEQ ID NO: 914963 - protein, 99 aa, Homo sapiens
PPPHPQFLFKFFSSFAASAIENIDTLTNLESLFLGKNKITKLQNLDALTNLTVLSMQSNRLTKIEGLQNLVNLRELYLSHNGIEVIEGLENNVQDSLTY

SEQ ID NO: 914964 - protein, 360 aa, Homo sapiens
MAAERGAGQQQSQEMMEVDRRVESEESGDEEGKKHSSGIVADLSEQSLKDGEERGEEDPEEEHELPVDMETINLDRDAEDVDLNHYRIGKIEGFEVLKKVKTLCLRQNLIKCIENLEELQSLRELDLYDNQIKKIENLEALTELEILDISFNLLRNIEGVDKLTRLKKLFLVNNKISKIENLSNLHQLQMLELGSNRIRAIENIDTLTNLESLFLGKNKITKLQNLDALTNLTVLSMQSNRLTKIEGLQNLVNLRELYLSHNGIEVIEGLENNNKLTMLDIASNRIKKIENISHLTELQEFWMNDNLLESWSDLDELKGARSLETVYLERNPLQKDPQYRRKVMLALPSVRQIDATFVRF

SEQ ID NO: 914965 - protein, 371 aa, Homo sapiens
EYLEGNEVGDRVREKSKNHSRRRKLLSKVDRRVESEESGDEEGKKHSSGIVADLSEQSLKDGEERGEEDPEEEHELPVDMETINLDRDAEDVDLNHYRIGKIEGFEVLKKVKTLCLRQNLIKCIENLEELQSLRELDLYDNQIKKIENLEALTELEILDISFNLLRNIEGVDKLTRLKKLFLVNNKISKIENLSNLHQLQMLELGSNRIRAIENIDTLTNLESLFLGKNKITKLQNLDALTNLTVLSMQSNRLTKIEGLQNLVNLRELYLSHNGIEVIEGLENNNKLTMLDIASNRIKKIENISHLTELQEFWMNDNLLESWSDLDELKGARSLETVYLERNPLQKDPQYRRKVMLALPSVRQIDATFVRF

SEQ ID NO: 914966 - protein, 317 aa, Homo sapiens
MAAERGAGQQQSQEMMEEEHELPVDMETINLDRDAEDVDLNHYRIGKIEGFEVLKKVKTLCLRQNLIKCIENLEELQSLRELDLYDNQIKKIENLEALTELEILDISFNLLRNIEGVDKLTRLKKLFLVNNKISKIENLSNLHQLQMLELGSNRIRAIENIDTLTNLESLFLGKNKITKLQNLDALTNLTVLSMQSNRLTKIEGLQNLVNLRELYLSHNGIEVIEGLENNNKLTMLDIASNRIKKIENISHLTELQEFWMNDNLLESWSDLDELKGARSLETVYLERNPLQKDPQYRRKVMLALPSVRQIDATFVRF

SEQ ID NO: 914967 - protein, 292 aa, Homo sapiens
METINLDRDAEDVDLNHYRIGKIEGFEVLKKVKTLCLRQNLIKCIENLEELQSLRELDLYDNQIKKIENLEALTELEILDISFNLLRNIEGVDKLTRLKKLFLVNNKISKIENLSNLHQLQMLELGSNRIRAIENIDTLTNLESLFLGKNKITKLQNLDALTNLTVLSMQSNRLTKIEGLQNLVNLRELYLSHNGIEVIEGLENNNKLTMLDIASNRIKKIENISHLTELQEFWMNDNLLESWSDLDELKGARSLETVYLERNPLQKDPQYRRKVMLALPSVRQIDATFVRF

SEQ ID NO: 914968 - protein, 360 aa, Homo sapiens; identical to SEQ ID NO: 914964

SEQ ID NO: 914969 - protein, 280 aa, Homo sapiens
MAAERGAGQQQSQEMMEVDRRVESEESGDEEGKKHSSGIVADLSEQSLKDGEERGEEDPEEEHELPVDMETINLDRDAEDVDLNHYRIGKIEGFEVLKKVKTLCLRQNLIKCIENLEELQSLRELDLYDNQIKKIENLEALTELEILDISFNLLRNIEGVDKLTRLKKLFLVNNKISKIENLSNLHQLQMLELGSNRIRAIENIDTLTNLESLFLGKNKITKLQNLDALTNLTVLSMQSNRLTKIEGLQNLVNLRELYLSHNGIEVIEGLENNVQDSLTY

SEQ ID NO: 914970 - protein, 310 aa, Homo sapiens
MAAERGAGQQQSQEMMEVDRRVESEESGDEEGKKHSSGIVADLSEQSLKDGEERGEEDPEEEHELPVDMETINLDRDAEDVDLNHYRIGKIEGFEVLKKVKTLCLRQNLIKCIENLEELQSLRELDLYDNQIKKIENLEALTELEILDISFNLLRNIEGVDKLTRLKKLFLVNNKISKIENLSNLHQLQMLELGSNRIRAIENIDTLTNLESLFLGKNKITKLQNLDALTNLTVLSMQSNRLTKIEGLQNLVNLRELYLSHNGIEVIEGLENNNKLTMLDIASNRIKKIENISHLTELQEFWVSLIHAGV

SEQ ID NO: 914971 - protein, 317 aa, Homo sapiens
MAAERGAGQQQSQEMMEVDRRVESEESGDEEGKKHSSGIVADLSEQSLKDGEERGEEDPEEEHELPVDMETINLDRDAEDVDLNHYRIGKIEGFEVLKKVKTLCLRQNLIKCIENLEELQSLRELDLYDNQIKKIENLEALTELEILDISFNLLRNIEGVDKLTRLKKLFLVNNKISKIENLSNLHQLQMLELGSNRIRAIENIDTLTNLESLFLGKNKITKLQNLDALTNLTVLSMQSNRLTKIEGLQNLVNLRELYLSHNGIEVIEGLENNNKLTMLDIASNRIKKIENISHLTELQEFWMNDNLLDGRVAHGDP

SEQ ID NO: 914972 - protein, 140 aa, Homo sapiens
MKKGRNTAVASWPTSVNRSNRLTKIEGLQNLVNLRELYLSHNGIEVIEGLENNNKLTMLDIASNRIKKIENISHLTELQEFWMNDNLLESWSDLDELKGARSLETVYLERNPLQKDPQYRRKVMLALPSVRQIDATFVRF

SEQ ID NO: 914973 - protein, 237 aa, Homo sapiens
MAAERGAGQQQSQEMMEEEHELPVDMETINLDRDAEDVDLNHYRIGKIEGFEVLKKVKTLCLRQNLIKCIENLEELQSLRELDLYDNQIKKIENLEALTELEILDISFNLLRNIEGVDKLTRLKKLFLVNNKISKIENLSNLHQLQMLELGSNRIRAIENIDTLTNLESLFLGKNKITKLQNLDALTNLTVLSMQSNRLTKIEGLQNLVNLRELYLSHNGIEVIEGLENNVQDSLTY

SEQ ID NO: 914974 - protein, 104 aa, Homo sapiens
MAAERGAGQQQSQEMMEVDRRVESEESGDEEGKKHSSGIVADLSEQSLKDGEERGEEDPEEEHELPVDMEKSGGCVGSIHRIPGISVQPPLKPSSLVFINRSPV

SEQ ID NO: 914975 - protein, 280 aa, Homo sapiens; identical to SEQ ID NO: 914969

SEQ ID NO: 914976 - protein, 274 aa, Homo sapiens
MEEHELPVDMETINLDRDAEDVDLNHYRIGKIEGFEVLKKVKTLCLRQNLIKCIENLEELQSLRELDLYDNQIKKIENLEALTELEILDISFNLLRNIEGVDKLTRLKKLFLVNNKISKIENLSNLHQLQMLELGSNRIRAIENIDTLTNLESLFLGKNKITKLQNLDALTNLTVLSMQSNRLTKIEGLQNLVNLRELYLSHNGIEVIEGLENNNKLTMLDIASNRIKKIENISHLTELQEFWITKTLKGGRTRRVMEQNLTQARKETIRKPQY

SEQ ID NO: 914977 - protein, 127 aa, Homo sapiens
STRPALRVARDAPNTPTALRRSQRNNGRLRPRAGQMRFPPDSRSKWVSSAELASWRPLSEGGGRWGGSFMGRVAPQGRRRLQRPHWAGNDLQGEPSWRPGASQLASGPTSASAPHLPACSERQEKAA

SEQ ID NO: 914978 - protein, 360 aa, Homo sapiens; identical to SEQ ID NO: 914964

SEQ ID NO: 914979 - protein, 344 aa, Homo sapiens
MVDRRVESEESGDEEGKKHSSGIVADLSEQSLKDGEERGEEDPEEEHELPVDMETINLDRDAEDVDLNHYRIGKIEGFEVLKKVKTLCLRQNLIKCIENLEELQSLRELDLYDNQIKKIENLEALTELEILDISFNLLRNIEGVDKLTRLKKLFLVNNKISKIENLSNLHQLQMLELGSNRIRAIENIDTLTNLESLFLGKNKITKLQNLDALTNLTVLSMQSNRLTKIEGLQNLVNLRELYLSHNGIEVIEGLENNNKLTMLDIASNRIKKIENISHLTELQEFWMNDNLLESWSDLDELKGARSLETVYLERNPLQKDPQYRRKVMLALPSVRQIDATFVRF

SEQ ID NO: 914980 - protein, 334 aa, Homo sapiens
AHATPHTHPNTRQRTNWHVSEAAWAMERGEEDPEEEHELPVDMETINLDRDAEDVDLNHYRIGKIEGFEVLKKVKTLCLRQNLIKCIENLEELQSLRELDLYDNQIKKIENLEALTELEILDISFNLLRNIEGVDKLTRLKKLFLVNNKISKIENLSNLHQLQMLELGSNRIRAIENIDTLTNLESLFLGKNKITKLQNLDALTNLTVLSMQSNRLTKIEGLQNLVNLRELYLSHNGIEVIEGLENNNKLTMLDIASNRIKKIENISHLTELQEFWMNDNLLESWSDLDELKGARSLETVYLERNPLQKDPQYRRKVMLALPSVRQIDATFVRF

SEQ ID NO: 914981 - protein, 354 aa, Homo sapiens
MAAERGAGQQQSQEMMEVDRRVESEESGDEEGKKHSSGIVADLSEQSLKDGEERGEEDPEEEHELPVDMETINLDRDAEDVDLNHYRIGKIEGFETLCLRQNLIKCIENLEELQSLRELDLYDNQIKKIENLEALTELEILDISFNLLRNIEGVDKLTRLKKLFLVNNKISKIENLSNLHQLQMLELGSNRIRAIENIDTLTNLESLFLGKNKITKLQNLDALTNLTVLSMQSNRLTKIEGLQNLVNLRELYLSHNGIEVIEGLENNNKLTMLDIASNRIKKIENISHLTELQEFWMNDNLLESWSDLDELKGARSLETVYLERNPLQKDPQYRRKVMLALPSVRQIDATFVRF

SEQ ID NO: 914982 - protein, 171 aa, Homo sapiens
MLELGSNRIRAIENIDTLTNLESLFLGKNKITKLQNLDALTNLTVLSMQSNRLTKIEGLQNLVNLRELYLSHNGIEVIEGLENNNKLTMLDIASNRIKKIENISHLTELQEFWMNDNLLESWSDLDELKGARSLETVYLERNPLQKDPQYRRKVMLALPSVRQIDATFVRF

SEQ ID NO: 914983 - protein, 177 aa, Homo sapiens
MRDASIKLPLTFFTELEKNYFKFHMEPKKNPYSQDSPKQRTNLDALTNLTVLSMQSNRLTKIEGLQNLVNLRELYLSHNGIEVIEGLENNNKLTMLDIASNRIKKIENISHLTELQEFWMNDNLLESWSDLDELKGARSLETVYLERNPLQKDPQYRRKVMLALPSVRQIDATFVRF

SEQ ID NO: 914984 - protein, 358 aa, Homo sapiens
MAAERGAGQQQSQEMMEVDRRVESEESGDEEGKKHSSGIVADLSEQSLKDGEERGEEDPEEEHELPVDMETINLDRDAEDVDLNHYRIGKIEGFEVLKKVKTLCLRQNLIKCIENLEELQSLRELDLYDNQIKKIENLEALTELEILDISFNLLRNIEGVDKLTRLKKLFLVNNKISKIENLSNLHQLQMLELGSNRIRAIENIDTLTNLESLFLGKNKITKLQNLDALTNLTVLSMQPQPPHQHPPSPQPQLPHLYLTHNPIHLIHPLHNHTLTIFHIPSNTIKNILHLTLQHFSINHNLLLHLNPPTLHTLYLHPNPFHNHPHYPPNLILPLPPHIHPTFTFSLLLALLISSLSSP

SEQ ID NO: 914985 - protein, 274 aa, Homo sapiens
MAAERGAGQQQSQEMMEVDRRVESEESGDEEGKKHSSGIVADLSEQSLKDGEERGEEDPEEEHELPVDMETINLDRDAEDVDLNHYRIGKIEGFETLCLRQNLIKCIENLEELQSLRELDLYDNQIKKIENLEALTELEILDISFNLLRNIEGVDKLTRLKKLFLVNNKISKIENLSNLHQLQMLELGSNRIRAIENIDTLTNLESLFLGKNKITKLQNLDALTNLTVLSMQSNRLTKIEGLQNLVNLRELYLSHNGIEVIEGLENNVQDSLTY

SEQ ID NO: 914986 - protein, 207 aa, Homo sapiens
MQSGTHWRVLGLCLLSVGVWGQDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 914987 - protein, 187 aa, Homo sapiens
MGWVINNENIQIIKKPFPFLPGNTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 914988 - protein, 207 aa, Homo sapiens; identical to SEQ ID NO: 914986

SEQ ID NO: 914989 - protein, 207 aa, Homo sapiens; identical to SEQ ID NO: 914986

SEQ ID NO: 914990 - protein, 97 aa, Homo sapiens
GDLEDAFMCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 914991 - protein, 732 aa, Homo sapiens
MTENYTEAAFTLLLYCELLQWEDRPLREFLHYPSQTEWQRKEGLCRKIIHYFNKGKSWEFGIPLCRELACQYESLYDYQSLSWIRKMEASYYDNIMEQQRLEPEFFRVGFYGRKFPFFLRNKEYVCRGHDYERLEAFQQRMLSEFPQAVAMQHPNHPDDAILQCDAQYLQIYAVTPIPDYVDVLQMDRVPDRVKSFYRVNNVRKFRYDRPFHKGPKDKENEFKSLWIERTTLTLTHSLPGISRWFEVERRELVEVSPLENAIQVVENKNQELRSLISQYQHKQVHGNINLLSMCLNGVIDAAVNGGIARYQEAFFDKDYINKHPGDAEKITQLKELMQEQVHVLGVGLAVHEKFVHPEMRPLHKKLIDQFQMMRASLYHEFPGLDKLSPACSGTSTPRGNVLASHSPMSPESIKMTHRHSEAGNMVMLGDGSMGDAPEDLYHHMQLAYPNPRYQGSVTNVSVLSSSQASPSSSSLSSTHSAPSQMITSAPSSARGSPSLPDKYRHAREMMLLLPTYRDRPSSAMYPAAILENGQPPNFQRALFQQVVGACKPCSDPNLSVAEKVSSPPYPSLPHKPPVRSGRQQLYLSGSASSGVSSLSESNFGHSSEAPPRTDTMDSMPSQAWNADEDLEPPYLPVHYSLSESAVLDSIKAQPCRSHSAPGCVIPQDPMDPPALPPKPYHPRLPALEHDEGVLLREETERPRGLHRKAPLPPGSAKEEQARMAWEHGRGEQ

SEQ ID NO: 914992 - protein, 732 aa, Homo sapiens; identical to SEQ ID NO: 914991

SEQ ID NO: 914993 - protein, 181 aa, Homo sapiens
HRGSPYGYADKGCCCVKRLRGLEACTARLHCLLGALRRSRPAWPGSTAEGSSEGQRGGWDAALSKQLANHSRSEKQVPQPHPREPERLALRREPPPSLRSTAVNSCVAMYRGHSSMKGCGFPFYFFTFPFLWVFLSFLYAVDAFFLLQFWTMWSYMEKLHRQNHFATLQGPGVGAQALPPG

SEQ ID NO: 914994 - protein, 1907 aa, Homo sapiens
DLRRQLLSGHLTQDQVREVKRHITVRLDWGNEHLGLDLVPRKDFEVVDSDQISVSDLYKMHLSSRQSVQQSTSQVDTMRPRHGETCRMPVPHHFFLSLKSFTYNTIGEDTDVFFSLYDMREGKQISERFLVRLNKNGGPRNPEKIERMCALFTDLSSKDMKRDLYIVAHVIRIGRMLLNDSKKGPPHLHYRRPYGCAVLSILDVLQSLTEVKEEKDFVLKVYTCNNESEWSQIHENIIRKSSAKYSAPSASHGLIISLQLLRGDMEQIRRENPMIFNRGLAITRKLGFPDVIMPGDIRNDLYLTLEKGDFERGGKSVQKNIEVTMYVLYADGEILKDCISLGSGEPNRSSYHSFVLYHSNSPRWGEIIKLPIPIDRFRGSHLRFEFRHCSTKDKGEKKLFGFAFSTLMRDDGTTLSDDIHELYVYKCDENSTFNNHALYLGLPCCKEDYNGCPNIPSSLIFQRSTKESFFISTQLSSTKLTQNVDLLALLKWKAFPDRIMDVLGRLRHVSGEEIVKFLQDILDTLFVILDDNTEKYGLLVFQSLVFIINLLRDIKYFHFRPVMDTYIQKHFAGALAYKELIRCLKWYMDCSAELIRQDHIQEAMRALEYLFKFIVQSRILYSRATCGMEEEQFRSSIQELFQSIRFVLSLDSRNSETLLFTQAALLNSFPTIFDELLQMFTVQEVAEFVRGTLGSMPSTVHIGQSMDVVKLQSIARTVDSRLFSFSESRRILLPVVLHHIHLHLRQQKELLICSGILGSIFSIVKTSSLEADVMEEVEMMVESLLDVLLQTLLTIMSKSHAQEAVRGQRCPQCTAEITGEYVSCLLSLLRQMCDTHFQHLLDNFQSKDELKEFLLKIFCVFRNLMKMSVFPRDWMVMRLLTSNIIVTTVQYLSSALHKNFTETDFDFKVWNSYFSLAVLFINQPSLQLEIITSAKRKKILDKYGDMRVMMAYELFSMWQNLGEHKIHFIPGMIGPFLGVTLVPQPEVRNIMIPIFHDMMDWEQRKNGNFKQVEAELIDKLDSMVSEGKGDESYRELFSLLTQLFGPYPSLLEKVEQETWRETGISFVTSVTRLMERLLDYRDCMKGEETENKKIGCTVNLMNFYKSEINKEEMYIRYIHKLCDMHLQAENYTEAAFTLLLYCELLQWEDRPLREFLHYPSQTEWQRKEGLCRKIIHYFNKGKSWEFGIPLCRELACQYESLYDYQSLSWIRKMEASYYDNIMEQQRLEPEFFRVGFYGRKFPFFLRNKEYVCRGHDYERLEAFQQRMLSEFPQAVAMQHPNHPDDAILQCDAQYLQIYAVTPIPDYVDVLQMDRVPDRVKSFYRVNNVRKFRYDRPFHKGPKDKENEFKSLWIERTTLTLTHSLPGISRWFEVERRELVEVSPLENAIQVVENKNQELRSLISQYQHKQVHGNINLLSMCLNGVIDAAVNGGIARYQEAFFDKDYINKHPGDAEKITQLKELMQEQVHVLGVGLAVHEKFVHPEMRPLHKKLIDQFQMMRASLYHEFPGLDKLSPACSGTSTPRGNVLASHSPMSPESIKMTHRHSPMNLMGTGRHSSSSLSSHASSEAGNMVMLGDGSMGDAPEDLYHHMQLAYPNPRYQGSVTNVSVLSSSQASPSSSSLSSTHSAPSQMITSAPSSARGSPSLPDKYRHAREMMLLLPTYRDRPSSAMYPAAILENGQPPNFQRALFQQVVGACKPCSDPNLSVAEKGHYSLHFDAFHHPLGDTPPALPARTLRKSPLHPIPASPTSPQSGLDGSNSTLSGSASSGVSSLSESNFGHSSEAPPRTDTMDSMPSQAWNADEDLEPPYLPVHYSLSESAVLDSIKAQPCRSHSAPGCVIPQDPMDPPALPPKPYHPRLPALEHDEGVLLREETERPRGLHRKAPLPPGSAKEEQARMAWEHGRGEQ

SEQ ID NO: 914995 - protein, 1544 aa, Homo sapiens
MCNNESEWSQIHENIIRKSSAKYSAPSASHGLIISLQLLRGDMEQIRRENPMIFNRGLAITRKLGFPDVIMPGDIRNDLYLTLEKGDFERGGKSVQKNIEVTMYVLYADGEILKDCISLGSGEPNRSSYHSFVLYHSNSPRWGEIIKLPIPIDRFRGSHLRFEFRHCSTKDKGEKKLFGFAFSTLMRDDGTTLSDDIHELYVYKCDENSTFNNHALYLGLPCCKEDYNGCPNIPSSLIFQRSTKESFFISTQLSSTKLTQNVDLLALLKWKAFPDRIMDVLGRLRHVSGEEIVKFLQDILDTLFVILDDNTEKYGLLVFQSLVFIINLLRDIKYFHFRPVMDTYIQKHFAGALAYKELIRCLKWYMDCSAELIRQDHIQEAMRALEYLFKFIVQSRILYSRATCGMEEEQFRSSIQELFQSIRFVLSLDSRNSETLLFTQAALLNSFPTIFDELLQMFTVQEVAEFVRGTLGSMPSTVHIGQSMDVVKLQSIARTVDSRLFSFQGEYVSCLLSLLRQMCDTHFQHLLDNFQSKDELKEFLLKIFCVFRNLMKMSVFPRDWMVMRLLTSNIIVTTVQYLSSALHKNFTETDFDFKVWNSYFSLAVLFINQPSLQLEIITSAKRKKILDKYGDMRVMMAYELFSMWQNLGEHKIHFIPGMIGPFLGVTLVPQPEVRNIMIPIFHDMMDWEQRKNGNFKQVEAELIDKLDSMVSEGKGDESYRELFSLLTQLFGPYPSLLEKVEQETWRETGISFVTSVTRLMERLLDYRDCMKGEETENKKIGCTVNLMNFYKSEINKEEMYIRYIHKLCDMHLQAENYTEAAFTLLLYCELLQWEDRPLREFLHYPSQTEWQRKEGLCRKIIHYFNKGKSWEFGIPLCRELACQYESLYDYQSLSWIRKMEASYYDNIMEQQRLEPEFFRVGFYGRKFPFFLRNKEYVCRGHDYERLEAFQQRMLSEFPQAVAMQHPNHPDDAILQCDAQYLQIYAVTPIPDYVDVLQMDRVPDRVKSFYRVNNVRKFRYDRPFHKGPKDKENEFKSLWIERTTLTLTHSLPGISRWFEVERRELVEVSPLENAIQVVENKNQELRSLISQYQHKQVHGNINLLSMCLNGVIDAAVNGGIARYQEAFFDKDYINKHPGDAEKITQLKELMQEQVHVLGVGLAVHEKFVHPEMRPLHKKLIDQFQMMRASLYHEFPGLDKLSPACSGTSTPRGNVLASHSPMSPESIKMTHRHSEAGNMVMLGDGSMGDAPEDLYHHMQLAYPNPRYQGSVTNVSVLSSSQASPSSSSLSSTHSAPSQMITSAPSSARGSPSLPDKYRHAREMMLLLPTYRDRPSSAMYPAAILENGQPPNFQRALFQQVVGACKPCSDPNLSVAEKVSSPPYPSLPHKPPVRSGRQQLYLSGSASSGVSSLSESNFGHSSEAPPRTDTMDSMPSQAWNADEDLEPPYLPVHYSLSESAVLDSIKAQPCRSHSAPGCVIPQDPMDPPALPPKPYHPRLPALEHDEGVLLREETERPRGLHRKAPLPPGSAKEEQARMAWEHGRGEQ

SEQ ID NO: 914996 - protein, 33 aa, Homo sapiens
MYIRYIHKLCDMHLQAENYTGKWGEERAMPDHE

SEQ ID NO: 914997 - protein, 119 aa, Homo sapiens
ALGRVGSECIPEPGARRTAQAAGLRSVSGAANTKVRELKHFRFLGLLRSCRSEMEVDAPGVDGRDGLRERRGFSEGGRQNFDVRPQSGANGLPKHSYWLDLWLFILFDVVVFLFVYFLP

SEQ ID NO: 914998 - protein, 119 aa, Homo sapiens; identical to SEQ ID NO: 914997

SEQ ID NO: 914999 - protein, 119 aa, Homo sapiens; identical to SEQ ID NO: 914997

SEQ ID NO: 915000 - protein, 119 aa, Homo sapiens; identical to SEQ ID NO: 914997

SEQ ID NO: 915001 - protein, 119 aa, Homo sapiens; identical to SEQ ID NO: 914997

SEQ ID NO: 915002 - protein, 119 aa, Homo sapiens; identical to SEQ ID NO: 914997

SEQ ID NO: 915003 - protein, 119 aa, Homo sapiens; identical to SEQ ID NO: 914997

SEQ ID NO: 915004 - protein, 119 aa, Homo sapiens; identical to SEQ ID NO: 914997

SEQ ID NO: 915005 - protein, 119 aa, Homo sapiens; identical to SEQ ID NO: 914997

SEQ ID NO: 915006 - protein, 119 aa, Homo sapiens; identical to SEQ ID NO: 914997

SEQ ID NO: 915007 - protein, 119 aa, Homo sapiens; identical to SEQ ID NO: 914997

SEQ ID NO: 915008 - protein, 66 aa, Homo sapiens
ALRGSPEYTARDGLRERRGFSEGGRQNFDVRPQSGANGLPKHSYWLDLWLFILFDVVVFLFVYFLP

SEQ ID NO: 915009 - protein, 119 aa, Homo sapiens; identical to SEQ ID NO: 914997

SEQ ID NO: 915010 - protein, 261 aa, Homo sapiens
MAAACRSVKGLVAVITGGASGLGLATAERLVGQGASAVLLDLPNSGGEAQAKKLGNNCVFAPADVTSEKDVQTALALAKGKFGRVDVAVNCAGIAVASKTYNLKKGQTHTLEDFQRVLDVNLMGTFNVIRLVAGEMGQNEPDQGGQRGVIINTASVAAFEGQVGQAAYSASKGGIVGMTLPIARDLAPIGIRVMTIAPGLFGTPLLTSLPEKVCNFLASQVPFPSRLGDPAEYAHLVQAIIENPFLNGEVIRLDGAIRMQP

SEQ ID NO: 915011 - protein, 252 aa, Homo sapiens
MAAACRSVKGLVAVITGGASGLGLATAERLVGQGASAVLLDLPNSGGEAQAKKLGNNCVFAPADVTSEKDVQTALALAKGKFGRVDVAVNCAGIAVASKTYNLKKGQTHTLEDFQRVLDVNLMGTFNVIRLVAGEMGQNEPDQGGQRGVIINTASVAAFEGQVGQAAYSASKGGIVGMTLPIARDLAPIGLFGTPLLTSLPEKVCNFLASQVPFPSRLGDPAEYAHLVQAIIENPFLNGEVIRLDGAIRMQP

SEQ ID NO: 915012 - protein, 261 aa, Homo sapiens; identical to SEQ ID NO: 915010

SEQ ID NO: 915013 - protein, 163 aa, Homo sapiens
MAAACRSVKGLVAVITGGASGLGLATAERLVGQGASAVLLDLPNSGGEAQAKKLGNNCVFAPADVTSEKDVQTALALAKGKFGRVDVAVNCAGIAVASKTYNLKKGQTHTLEDFQRVLDVNLMGTFNVIRLVAGEMGQNEPDQGGPPKQQQPFIFGPQRSTKK

SEQ ID NO: 915014 - protein, 208 aa, Homo sapiens
MAAACRSVKGLVAVITGGASGLGLATAERLVGQGASAVLLDLPNSGGEAQAKKLGNNCVFAPADVTSEKDVQTALALAKGKFGRVDVAVNCAGIAVASKTYNLKKGQTHTLEDFQRVLDVNLMGTFNVIRLVAGEMGQNEPDQGGRLFGTPLLTSLPEKVCNFLASQVPFPSRLGDPAEYAHLVQAIIENPFLNGEVIRLDGAIRMQP

SEQ ID NO: 915015 - protein, 186 aa, Homo sapiens
MAAACRSVKGLVAVITGGASGLGLATAERLVGQGASAVLLDLPNSGGEAQAKKLGNNCVFAPADVTSEKDVQTALALAKGKFGRVDVAVNCAGIAVASKTYNLKKGQTHTLEDFQRVLDVNLMGTFNVIRLVAGEMGQNEPDQGGQRGVIINTASVAAFEGQTRSSALPFPGVLLSSLGGSPVAIL

SEQ ID NO: 915016 - protein, 115 aa, Homo sapiens
MAAACRSVKGLVAVITGGASGLGLATAERLVGQGASAVLLDLPNSGGEAQAKKLGNNCVFAPADVTSEKDVQTALALAKGKFGPAEYAHLVQAIIENPFLNGEVIRLDGAIRMQP

SEQ ID NO: 915017 - protein, 261 aa, Homo sapiens; identical to SEQ ID NO: 915010

SEQ ID NO: 915018 - protein, 130 aa, Homo sapiens
MAAACRSVKGLVAVITGGASGLGLATAERLVGQGASAVLLDLPNSGGEAQAKKLGNNCVFAPADVTSEKDVQTALALAKGKFGRVDVAVNCAGIAVASKTYNLKKGQTHTLEDFQRVLDVKSSMGPPFQW

SEQ ID NO: 915019 - protein, 253 aa, Homo sapiens
MGLVAVITGGASGLGLATAERLVGQGASAVLLDLPNSGGEAQAKKLGNNCVFAPADVTSEKDVQTALALAKGKFGRVDVAVNCAGIAVASKTYNLKKGQTHTLEDFQRVLDVNLMGTFNVIRLVAGEMGQNEPDQGGQRGVIINTASVAAFEGQVGQAAYSASKGGIVGMTLPIARDLAPIGIRVMTIAPGLFGTPLLTSLPEKVCNFLASQVPFPSRLGDPAEYAHLVQAIIENPFLNGEVIRLDGAIRMQP

SEQ ID NO: 915020 - protein, 217 aa, Homo sapiens
MAAACRSVKGLVAVITGGASGLGLATAERLVGQGASAVLLDLPNSGGEAQAKKLGNNCVFAPADVTSEKDVQTALALAKGKFGRVDVAVNCAGIAVASKTYNLKKGQTHTLEDFQRVLDVNLMGTFNVIRLVAGEMGQNEPDQGGQRGVIINTASVAAFEGQVGQAAYSASKGGIVGMTLPIARDLAPIGIRVMTIAPGRHIPSLHHTWDWVGSMDS

SEQ ID NO: 915021 - protein, 169 aa, Homo sapiens
MAAACRSVKGLVAVITGGASGLGLATAERLVGQGASAVLLDLPNSGGEAQAKKLGNNCVFAPADVTSEKDVQTALALAKGKFGRVDVAVNCAGIAVASKTYNLKKGQTHTLEDFQRVLDVNLMGTFNVIRLVAGEMGQNEPDQGGQRGVIINTASVAAFEGQVCLAPHC

SEQ ID NO: 915022 - protein, 137 aa, Homo sapiens
GSGSHRYPGDDHVPQVCLAKGKFGRVDVAVNCAGIAVASKTYNLKKGQTHTLEDFQRVLDVNLMGTFNVIRLVAGEMGQNEPDQGGQKVCNFLASQVPFPSRLGDPAEYAHLVQAIIENPFLNGEVIRLDGAIRMQP

SEQ ID NO: 915023 - protein, 138 aa, Homo sapiens
PSAFGLKDWDDDEIQASVLAVSQQENLDSRRRKGPGKRRGPTIKISGVQVNVKSIIQHEEEFEMLHKSIPVDPEEKKKYCLTCRVKAAHFDVEWGVEDDSRLLLGIYEHGYGNWELIKTDPELKLTDKLPRSPPLLKC

SEQ ID NO: 915024 - protein, 1738 aa, Homo sapiens
MRNKDKSQEEDSSLHSNASSHSASEEASGSDSGSQSESEQGSDPGSGHGSESNSSSESSESQSESESESAGSKSQPVLPEAKEKPASKKERIADVKKMWEEYPDVYGVRRSNRSRQEPSRFNIKEEASSGSESGSPKRRGQRQLKKQEKWKQEPSEDEQEQGTSAESEPEQKKVKARRPVPRRTVPKPRVKKQPKTQRGKRKKQDSSDEDDDDDEAPKRQTRRRAAKNVSYKEDDDFETDSDDLIEMTGEGVDEQQDNSETIEKVLDSRLGKKGATGASTTVYAIEANGDPSGDFDTEKDEGEIQYLIKWKGWSYIHSTWESEESLQQQKVKGLKKLENFKKKEDEIKQWLGKVSPEDVEYFNCQQELASELNKQYQIVERVIAVKTSKSTLGQTDFPAHSRKPAPSNEPEYLCKWMGLPYSECSWEDEALIGKKFQNCIDSFHSRNNSKTIPTRECKALKQRPRFVALKKQPAYLGGENLELRDYQLEGLNWLAHSWCKNNSVILADEMGLGKTIQTISFLSYLFHQHQLYGPFLIVVPLSTLTSWQREFEIWAPEINVVVYIGDLMSRNTIREYEWIHSQTKRLKFNALITTYEILLKDKTVLGSINWAFLGVDEAHRLKNDDSLLYKTLIDFKSNHRLLITGTPLQNSLKELWSLLHFIMPEKFEFWEDFEEDHGKGRENGYQSLHKVLEPFLLRRVKKDVEKSLPAKVEQILRVEMSALQKQYYKWILTRNYKALAKGTRGSTSGFLNIVMELKKCCNHCYLIKPPEENERENGQEILLSLIRSSGKLILLDKLLTRLRERGNRVLIFSQMVRMLDILAEYLTIKHYPFQRLDGSIKGEIRKQALDHFNADGSEDFCFLLSTRAGGLGINLASADTVVIFDSDWNPQNDLQAQARAHRIGQKKQVNIYRLVTKGTVEEEIIERAKKKMVLDHLVIQRMDTTGRTILENNSGRSNSNPFNKEELTAILKFGAEDLFKELEGEESEPQEMDIDEILRLAETRENEVSTSATDELLSQFKVANFATMEDEEELEERPHKDWDEIIPEEQRKKVEEEERQKELEEIYMLPRIRSSTKKAQTNDSDSDTESKRQAQRSSASESETEDSDDDKKPKRRGRPRSVRKDLVEGFTDAEIRRFIKAYKKFGLPLERLECIARDAELVDKSVADLKRLGELIHNSCVSAMQEYEEQLKENASEGKGPGKRRGPTIKISGVQVNVKSIIQHEEEFEMLHKSIPVDPEEKKKYCLTCRVKAAHFDVEWGVEDDSRLLLGIYEHGYGNWELIKTDPELKLTDKILPVETDKKPQGKQLQTRADYLLKLLRKGLEKKGAVTGGEEAKLKKRKPRVKKENKVPRLKEEHGIELSSPRHSDNPSEEGEVKDDGLEKSPMKKKQKKKENKENKEKQMSSRKDKEGDKERKKSKDKKEKPKSGDAKSSSKSKRSQGPVHITAGSEPVPIGEDEDDDLDQETFSICKERMRPVKKALKQLDKPDKGLNVQEQLEHTRNCLLKIGDRIAECLKAYSDQEHIKLWRRNLWIFVSKFTEFDARKLHKLYKMAHKKRSQEEEEQKKKDDVTGGKKPFRPEASGSSRDSLISQSHTSHNLHPQKPHLPASHGPQMHGHPRDNYNHPNKRHFSNADRGDWQRERKFNYGGGNNNPPWGSDRHHQYEQHWYKDHHYGDRRHMDAHRSGSYRPNNMSRKRPYDQYSSDRDHRGHRDYYDRYAKGCETPGANLCQELFLGRK

SEQ ID NO: 915025 - protein, 1445 aa, Homo sapiens
MRNKDKSQEEDSSLHSNASSHSASEEASGSDSGSQSESEQGSDPGSGHGSESNSSSESSESQSESESESAGSKSQPVLPEAKEKPASKKERIADVKKMWEEYPDVYGVRRSNRSRQEPSRFNIKEEASSGSESGSPKRRGQRQLKKQEKWKQEPSEDEQEQGTSAESEPEQKKVKARRPVPRRTVPKPRVKKQPKTQRGKRKKQDSSDEDDDDDEAPKRQTRRRAAKNVSYKEDDDFETDSDDLIEMTGEGVDEQQDNSETIEKVLDSRLGKKGATGASTTVYAIEANGDPSGDFDTEKDEGEIQYLIKWKGWSYIHSTWESEESLQQQKVKGLKKLENFKKKEDEIKQWLGKVSPEDVEYFNCQQELASELNKQYQIVERVIAVKTSKSTLGQTDFPAHSRKPAPSNEPEYLCKWMGLPYSECSWEDEALIGKKFQNCIDSFHSRNNSKTIPTRECKALKQRPRFVALKKQPAYLGGENLELRDYQLEGLNWLAHSWCKNNSVILADEMGLGKTIQTISFLSYLFHQHQLYGPFLIVVPLSTLTSWQREFEIWAPEINVVVYIGDLMSRNTIREYEWIHSQTKRLKFNALITTYEILLKDKTVLGSINWAFLGVDEAHRLKNDDSLLYKTLIDFKSNHRLLITGTPLQNSLKELWSLLHFIMPEKFEFWEDFEEDHGKGRENGYQSLHKVLEPFLLRRVKKDVEKSLPAKVEQILRVEMSALQKQYYKWILTRNYKALAKGTRGSTSGFLNIVMELKKCCNHCYLIKPPEENERENGQEILLSLIRSSGKLILLDKLLTRLRERGNRVLIFSQMVRMLDILAEYLTIKHYPFQRLDGSIKGEIRKQALDHFNADGSEDFCFLLSTRAGGLGINLASADTVVIFDSDWNPQNDLQAQARAHRIGQKKQVNIYRLVTKGTVEEEIIERAKKKMVLDHLVIQRMDTTGRTILENNSGRSNSNPFNKEELTAILKFGAEDLFKELEGEESEPQEMDIDEILRLAETRENEVSTSATDELLSQFKVANFATMEDEEELEERPHKDWDEIIPEEQRKKVEEEERQKELEEIYMLPRIRSSTKKAQTNDSDSDTESKRQAQRSSASESETEDSDDDKKPKRRGRPRSVRKDLVEGFTDAEIRRFIKAYKKFGLPLERLECIARDAELVDKSVADLKRLGELIHNSCVSAMQEYEEQLKENASEGKGPGKRRGPTIKISGVQVNVKSIIQHEEEFEMLHKSIPVDPEEKKKYCLTCRVKAAHFDVEWGVEDDSRLLLGIYEHGYGNWELIKTDPELKLTDKILPVETDKKPQGKQLQTRADYLLKLLRKGLEKKGAVTGGEEAKLKKRKPRVKKENKVPRLKEEHGIELSSPRHSDNPSEEGEVKDDGLEKSPMKKKQKKKENKENKEKQMSSRKDKEGDKERKKSKDKKEKVMMPFCSCRYPQPLQFAIWI

SEQ ID NO: 915026 - protein, 1602 aa, Homo sapiens
MRNKDKSQEEDSSLHSNASSHSASEEASGSDSGSQSESEQGSDPGSGHGSESNSSSESSESQSESESESAGSKSQPVLPEAKEKPASKKERIADVKKMWEEYPDVYGVRRSNRSRQEPSRFNIKEEASSGSESGSPKRRGQRQLKKQEKWKQEPSEDEQEQGTSAESEPEQKKVKARRPVPRRTVPKPRVKKQPKTQRGKRKKQDSSDEDDDDDEAPKRQTRRRAAKNVSYKEDDDFETDSDDLIEMTGEGVDEQQDNSETIEKVLDSRLGKKGATGASTTVYAIEANGDPSGDFDTEKDEGEIQYLIKWKGWSYIHSTWESEESLQQQKVKGLKKLENFKKKEDEIKQWLGKVSPEDVEYFNCQQELASELNKQYQIVERVIAVKTSKSTLGQTDFPAHSRKPAPSNEPEYLCKWMGLPYSECSWEDEALIGKKFQNCIDSFHSRNNSKTIPTRECKALKQRPRFVALKKQPAYLGGENLELRDYQLEGLNWLAHSWCKNNSVILADEMGLGKTIQTISFLSYLFHQHQLYGPFLIVVPLSTLTSWQREFEIWAPEINVVVYIGDLMSRNTIREYEWIHSQTKRLKFNALITTYEILLKDKTVLGSINWAFLGVDEAHRLKNDDSLLYKTLIDFKSNHRLLITGTPLQNSLKELWSLLHFIMPEKFEFWEDFEEDHGKGRENGYQSLHKVLEPFLLRRVKKDVEKSLPAKVEQILRVEMSALQKQYYKWILTRNYKALAKGTRGSTSGFLNIVMELKKCCNHCYLIKPPEENERENGQEILLSLIRSSGKLILLDKLLTRLRERGNRVLIFSQMVRMLDILAEYLTIKHYPFQRLDGSIKGEIRKQALDHFNADGSEDFCFLLSTRAGGLGINLASADTVVIFDSDWNPQNDLQAQARAHRIGQKKQVNIYRLVTKGTVEEEIIERAKKKMVLDHLVIQRMDTTGRTILENNSGRSNSNPFNKEELTAILKFGAEDLFKELEGEESEPQEMDIDEILRLAETRENEVSTSATDELLSQFKVANFATMEDEEELEERPHKDWDEIIPEEQRKKVEEEERQKELEEIYMLPRIRSSTKKAQTNDSDSDTESKRQAQRSSASESETEDSDDDKKPKRRGRPRSVRKDLVEGFTDAEIRRFIKAYKKFGLPLERLECIARDAELVDKSVADLKRLGELIHNSCVSAMQEYEEQLKENASEGKGPGKRRGPTIKISGVQVNVKSIIQHEEEFEMLHKSIPVDPEEKKKYCLTCRVKAAHFDVEWGVEDDSRLLLGIYEHGYGNWELIKTDPELKLTDKILPVETDKKPQGKQLQTRADYLLKLLRKGLEKKGAVTGGEEAKLKKRKPRVKKENKVPRLKEEHGIELSSPRHSDNPSEEGEVKDDGLEKSPMKKKQKKKENKENKEKQMSSRKDKEGDKERKKSKDKKEKPKSGDAKSSSKSKRSQGPVHITAGSEPVPIGEDEDDDLDQETFSICKERMRPVKKALKQLDKPDKGLNVQEQLEHTRNCLLKIGDRIAECLKAYSDQEHIKLWRRNLWIFVSKFTEFDARKLHKLYKMAHKKRSQEEEVKYKFSPNSYKQIPIPQKNLLIFVFPWGDDHRIMGYCWC

SEQ ID NO: 915027 - protein, 1738 aa, Homo sapiens; identical to SEQ ID NO: 915024

SEQ ID NO: 915028 - protein, 1445 aa, Homo sapiens
MRNKDKSQEEDSSLHSNASSHSASEEASGSDSGSQSESEQGSDPGSGHGSESNSSSESSESQSESESESAGSKSQPVLPEAKEKPASKKERIADVKKMWEEYPDVYGVRRSNRSRQEPSRFNIKEEASSGSESGSPKRRGQRQLKKQEKWKQEPSEDEQEQGTSAESEPEQKKVKARRPVPRRTVPKPRVKKQPKTQRGKRKKQDSSDEDDDDDEAPKRQTRRRAAKNVSYKEDDDFETDSDDLIEMTGEGVDEQQDNSETIEKVLDSRLGKKGATGASTTVYAIEANGDPSGDFDTEKDEGEIQYLIKWKGWSYIHSTWESEESLQQQKVKGLKKLENFKKKEDEIKQWLGKVSPEDVEYFNCQQELASELNKQYQIVERVIAVKTSKSTLGQTDFPAHSRKPAPSNEPEYLCKWMGLPYSECSWEDEALIGKKFQNCIDSFHSRNNSKTIPTRECKALKQRPRFVALKKQPAYLGGENLELRDYQLEGLNWLAHSWCKNNSVILADEMGLGKTIQTISFLSYLFHQHQLYGPFLIVVPLSTLTSWQREFEIWAPEINVVVYIGDLMSRNTIREYEWIHSQTKRLKFNALITTYEILLKDKTVLGSINWAFLGVDEAHRLKNDDSLLYKTLIDFKSNHRLLITGTPLQNSLKELWSLLHFIMPEKFEFWEDFEEDHGKGRENGYQSLHKVLEPFLLRRVKKDVEKSLPAKVEQILRVEMSALQKQYYKWILTRNYKALAKGTRGSTSGFLNIVMELKKCCNHCYLIKPPEENERENGQEILLSLIRSSGKLILLDKLLTRLRERGNRVLIFSQMVRMLDILAEYLTIKHYPFQRLDGSIKGEIRKQALDHFNADGSEDFCFLLSTRAGGLGINLASADTVVIFDSDWNPQNDLQAQARAHRIGQKKQVNIYRLVTKGTVEEEIIERAKKKMVLDHLVIQRMDTTGRTILENNSGRSNSNPFNKEELTAILKFGAEDLFKELEGEESEPQEMDIDEILRLAETRENEVSTSATDELLSQFKVANFATMEDEEELEERPHKDWDEIIPEEQRKKVEEEERQKELEEIYMLPRIRSSTKKAQTNDSDSDTESKRQAQRSSASESETEDSDDDKKPKRRGRPRSVRKDLVEGFTDAEIRRFIKAYKKFGLPLERLECIARDAELVDKSVADLKRLGELIHNSCVSAMQEYEEQLKENASEGKGPGKRRGPTIKISGVQVNVKSIIQHEEEFEMLHKSIPVDPEEKKKYCLTCRVKAAHFDVEWGVEDDSRLLLGIYEHGYGNWELIKTDPELKLTDKILPVETDKKPQGKQLQTRADYLLKLLRKGLEKKGAVTGGEEAKLKKRKPRVKKENKVPRLKEEHGIELSSPRHSDNPSEEGEVKDDGLEKSPMKKKQKKKENKENKEKQMSSRKDKEGDKERKKSKDKKEKEKDQGKGEVQQSRYPEFRLM

SEQ ID NO: 915029 - protein, 1425 aa, Homo sapiens
MRNKDKSQEEDSSLHSNASSHSASEEASGSDSGSQSESEQGSDPGSGHGSESNSSSESSESQSESESESAGSKSQPVLPEAKEKPASKKERIADVKKMWEEYPDVYGVRRSNRSRQEPSRFNIKEEASSGSESGSPKRRGQRQLKKQEKWKQEPSEDEQEQGTSAESEPEQKKVKARRPVPRRTVPKPRVKKQPKTQRGKRKKQDSSDEDDDDDEAPKRQTRRRAAKNVSYKEDDDFETDSDDLIEMTGEGVDEQQDNSETIEKVLDSRLGKKGATGASTTVYAIEANGDPSGDFDTEKDEGEIQYLIKWKGWSYIHSTWESEESLQQQKVKGLKKLENFKKKEDEIKQWLGKVSPEDVEYFNCQQELASELNKQYQIVERVIAVKTSKSTLGQTDFPAHSRKPAPSNEPEYLCKWMGLPYSECSWEDEALIGKKFQNCIDSFHSRNNSKTIPTRECKALKQRPRFVALKKQPAYLGGENLELRDYQLEGLNWLAHSWCKNNSVILADEMGLGKTIQTISFLSYLFHQHQLYGPFLIVVPLSTLTSWQREFEIWAPEINVVVYIGDLMSRNTIREYEWIHSQTKRLKFNALITTYEILLKDKTVLGSINWAFLGVDEAHRLKNDDSLLYKTLIDFKSNHRLLITGTPLQNSLKELWSLLHFIMPEKFEFWEDFEEDHGKGRENGYQSLHKVLEPFLLRRVKKDVEKSLPAKVEQILRVEMSALQKQYYKWILTRNYKALAKGTRGSTSGFLNIVMELKKCCNHCYLIKPPEENERENGQEILLSLIRSSGKLILLDKLLTRLRERGNRVLIFSQMVRMLDILAEYLTIKHYPFQRLDGSIKGEIRKQALDHFNADGSEDFCFLLSTRAGGLGINLASADTVVIFDSDWNPQNDLQAQARAHRIGQKKQVNIYRLVTKGTVEEEIIERAKKKMVLDHLVIQRMDTTGRTILENNSGRSNSNPFNKEELTAILKFGAEDLFKELEGEESEPQEMDIDEILRLAETRENEVSTSATDELLSQFKVANFATMEDEEELEERPHKDWDEIIPEEQRKKVEEEERQKELEEIYMLPRIRSSTKKAQTNDSDSDTESKRQAQRSSASESETEDSDDDKKPKRRGRPRSVRKDLVEGFTDAEIRRFIKAYKKFGLPLERLECIARDAELVDKSVADLKRLGELIHNSCVSAMQEYEEQLKENASEGKGPGKRRGPTIKISGVQVNVKSIIQHEEEFEMLHKSIPVDPEEKKKYCLTCRVKAAHFDVEWGVEDDSRLLLGIYEHGYGNWELIKTDPELKLTDKILPVETDKKPQGKQLQTRADYLLKLLRKGLEKKGAVTGGEEAKLKKRKPRVKKENKVPRLKEEHGIELSSPRHSDNPSEEGEVKDDGLEKSPMKKKQKKKENKEGGEGREGKGGRGRKGGEGKGGEGKEGK

SEQ ID NO: 915030 - protein, 1641 aa, Homo sapiens
MWEEYPDVYGVRRSNRSRQEPSRFNIKEEASSGSESGSPKRRGQRQLKKQEKWKQEPSEDEQEQGTSAESEPEQKKVKARRPVPRRTVPKPRVKKQPKTQRGKRKKQDSSDEDDDDDEAPKRQTRRRAAKNVSYKEDDDFETDSDDLIEMTGEGVDEQQDNSETIEKVLDSRLGKKGATGASTTVYAIEANGDPSGDFDTEKDEGEIQYLIKWKGWSYIHSTWESEESLQQQKVKGLKKLENFKKKEDEIKQWLGKVSPEDVEYFNCQQELASELNKQYQIVERVIAVKTSKSTLGQTDFPAHSRKPAPSNEPEYLCKWMGLPYSECSWEDEALIGKKFQNCIDSFHSRNNSKTIPTRECKALKQRPRFVALKKQPAYLGGENLELRDYQLEGLNWLAHSWCKNNSVILADEMGLGKTIQTISFLSYLFHQHQLYGPFLIVVPLSTLTSWQREFEIWAPEINVVVYIGDLMSRNTIREYEWIHSQTKRLKFNALITTYEILLKDKTVLGSINWAFLGVDEAHRLKNDDSLLYKTLIDFKSNHRLLITGTPLQNSLKELWSLLHFIMPEKFEFWEDFEEDHGKGRENGYQSLHKVLEPFLLRRVKKDVEKSLPAKVEQILRVEMSALQKQYYKWILTRNYKALAKGTRGSTSGFLNIVMELKKCCNHCYLIKPPEENERENGQEILLSLIRSSGKLILLDKLLTRLRERGNRVLIFSQMVRMLDILAEYLTIKHYPFQRLDGSIKGEIRKQALDHFNADGSEDFCFLLSTRAGGLGINLASADTVVIFDSDWNPQNDLQAQARAHRIGQKKQVNIYRLVTKGTVEEEIIERAKKKMVLDHLVIQRMDTTGRTILENNSGRSNSNPFNKEELTAILKFGAEDLFKELEGEESEPQEMDIDEILRLAETRENEVSTSATDELLSQFKVANFATMEDEEELEERPHKDWDEIIPEEQRKKVEEEERQKELEEIYMLPRIRSSTKKAQTNDSDSDTESKRQAQRSSASESETEDSDDDKKPKRRGRPRSVRKDLVEGFTDAEIRRFIKAYKKFGLPLERLECIARDAELVDKSVADLKRLGELIHNSCVSAMQEYEEQLKENASEGKGPGKRRGPTIKISGVQVNVKSIIQHEEEFEMLHKSIPVDPEEKKKYCLTCRVKAAHFDVEWGVEDDSRLLLGIYEHGYGNWELIKTDPELKLTDKILPVETDKKPQGKQLQTRADYLLKLLRKGLEKKGAVTGGEEAKLKKRKPRVKKENKVPRLKEEHGIELSSPRHSDNPSEEGEVKDDGLEKSPMKKKQKKKENKENKEKQMSSRKDKEGDKERKKSKDKKEKPKSGDAKSSSKSKRSQGPVHITAGSEPVPIGEDEDDDLDQETFSICKERMRPVKKALKQLDKPDKGLNVQEQLEHTRNCLLKIGDRIAECLKAYSDQEHIKLWRRNLWIFVSKFTEFDARKLHKLYKMAHKKRSQEEEEQKKKDDVTGGKKPFRPEASGSSRDSLISQSHTSHNLHPQKPHLPASHGPQMHGHPRDNYNHPNKRHFSNADRGDWQRERKFNYGGGNNNPPWGSDRHHQYEQHWYKDHHYGDRRHMDAHRSGSYRPNNMSRKRPYDQYSSDRDHRGHRDYYDRYAKGCETPGANLCQELFLGRK

SEQ ID NO: 915031 - protein, 1267 aa, Homo sapiens
MRNKDKSQEEDSSLHSNASSHSASEEASGSDSGSQSESEQGSDPGSGHGSESNSSSESSESQSESESESAGSKSQPVLPEAKEKPASKKERIADVKKMWEEYPDVYGVRRSNRSRQEPSRFNIKEEASSGSESGSPKRRGQRQLKKQEKWKQEPSEDEQEQGTSAESEPEQKKVKARRPVPRRTVPKPRVKKQPKTQRGKRKKQDSSDEDDDDDEAPKRQTRRRAAKNVSYKEDDDFETDSDDLIEMTGEGVDEQQDNSETIEKVLDSRLGKKGATGASTTVYAIEANGDPSGDFDTEKDEGEIQYLIKWKGWSYIHSTWESEESLQQQKVKGLKKLENFKKKEDEIKQWLGKVSPEDVEYFNCQQELASELNKQYQIVERVIAVKTSKSTLGQTDFPAHSRKPAPSNEPEYLCKWMGLPYSECSWEDEALIGKKFQNCIDSFHSRNNSKTIPTRECKALKQRPRFVALKKQPAYLGGENLELRDYQLEGLNWLAHSWCKNNSVILADEMGLGKTIQTISFLSYLFHQHQLYGPFLIVVPLSTLTSWQREFEIWAPEINVVVYIGDLMSRNTIREYEWIHSQTKRLKFNALITTYEILLKDKTVLGSINWAFLGVDEAHRLKNDDSLLYKTLIDFKSNHRLLITGTPLQNSLKELWSLLHFIMPEKFEFWEDFEEDHGKGRENGYQSLHKVLEPFLLRRVKKDVEKSLPAKVEQILRVEMSALQKQYYKWILTRNYKALAKGTRGSTSGFLNIVMELKKCCNHCYLIKPPEENERENGQEILLSLIRSSGKLILLDKLLTRLRERGNRVLIFSQMVRMLDILAEYLTIKHYPFQRLDGSIKGEIRKQALDHFNADGSEDFCFLLSTRAGGLGINLASADTVVIFDSDWNPQNDLQAQARAHRIGQKKQVNIYRLVTKGTVEEEIIERAKKKMVLDHLVIQRMDTTGRTILENNSGRSNSNPFNKEELTAILKFGAEDLFKELEGEESEPQEMDIDEILRLAETRENEVSTSATDELLSQFKVANFATMEDEEELEERPHKDWDEIIPEEQRKKVEEEERQKELEEIYMLPRIRSSTKKAQTNDSDSDTESKRQAQRSSASESETEDSDDDKKPKRRGRPRSVRKDLVEGFTDAEIRRFIKAYKKFGLPLERLECIARDAELVDKSVADLKRLGELIHNSCVSAMQEYEEQLKENASEGKGPGKRRGPTIKISGVQVNVKSIIQHEEEFEMLHKSIPVDPEEKKKYCLTCRVKAAHFDVEWGVEEVDC

SEQ ID NO: 915032 - protein, 1379 aa, Homo sapiens
MRNKDKSQEEDSSLHSNASSHSASEEASGSDSGSQSESEQGSDPGSGHGSESNSSSESSESQSESESESAGSKSQPVLPEAKEKPASKKERIADVKKMWEEYPDVYGVRRSNRSRQEPSRFNIKEEASSGSESGSPKRRGQRQLKKQEKWKQEPSEDEQEQGTSAESEPEQKKVKARRPVPRRTVPKPRVKKQPKTQRGKRKKQDSSDEDDDDDEAPKRQTRRRAAKNVSYKEDDDFETDSDDLIEMTGEGVDEQQDNSETIEKVLDSRLGKKGATGASTTVYAIEANGDPSGDFDTEKDEGEIQYLIKWKGWSYIHSTWESEESLQQQKVKGLKKLENFKKKEDEIKQWLGKVSPEDVEYFNCQQELASELNKQYQIVERVIAVKTSKSTLGQTDFPAHSRKPAPSNEPEYLCKWMGLPYSECSWEDEALIGKKFQNCIDSFHSRNNSKTIPTRECKALKQRPRFVALKKQPAYLGGENLELRDYQLEGLNWLAHSWCKNNSVILADEMGLGKTIQTISFLSYLFHQHQLYGPFLIVVPLSTLTSWQREFEIWAPEINVVVYIGDLMSRNTIREYEWIHSQTKRLKFNALITTYEILLKDKTVLGSINWAFLGVDEAHRLKNDDSLLYKTLIDFKSNHRLLITGTPLQNSLKELWSLLHFIMPEKFEFWEDFEEDHGKGRENGYQSLHKVLEPFLLRRVKKDVEKSLPAKVEQILRVEMSALQKQYYKWILTRNYKALAKGTRGSTSGFLNIVMELKKCCNHCYLIKPPEENERENGQEILLSLIRSSGKLILLDKLLTRLRERGNRVLIFSQMVRMLDILAEYLTIKHYPFQRLDGSIKGEIRKQALDHFNADGSEDFCFLLSTRAGGLGINLASADTVVIFDSDWNPQNDLQAQARAHRIGQKKQVNIYRLVTKGTVEEEIIERAKKKMVLDHLVIQRMDTTGRTILENNSGRSNSNPFNKEELTAILKFGAEDLFKELEGEESEPQEMDIDEILRLAETRENEVSTSATDELLSQFKVANFATMEDEEELEERPHKDWDEIIPEEQRKKVEEEERQKELEEIYMLPRIRSSTKKAQTNDSDSDTESKRQAQRSSASESETEDSDDDKKPKRRGRPRSVRKDLVEGFTDAEIRRFIKAYKKFGLPLERLECIARDAELVDKSVADLKRLGELIHNSCVSAMQEYEEQLKENASEGKGPGKRRGPTIKISGVQVNVKSIIQHEEEFEMLHKSIPVDPEEKKKYCLTCRVKAAHFDVEWGVEDDSRLLLGIYEHGYGNWELIKTDPELKLTDKILPVETDKKPQGKQLQTRADYLLKLLRKGLEKKGAVTGGEEAKLKKRKPRVKKENKVPRLKEEHGIELSSPRHSDNPSEEGEVKV

SEQ ID NO: 915033 - protein, 500 aa, Homo sapiens [sequence omitted]

SEQ ID NO: 915034 - protein, 458 aa, Homo sapiens
MRNKDKSQEEDSSLHSNASSHSASEEASGSDSGSQSESEQGSDPGSGHGSESNSSSESSESQSESESESAGSKSQPVLPEAKEKPASKKERIADVKKMWEEYPDVYGVRRSNRSRQEPSRFNIKEEASSGSESGSPKRRGQRQLKKQEKWKQEPSEDEQEQGTSAESEPEQKKVKARRPVPRRTVPKPRVKKQPKTQRGKRKKQDSSDEDDDDDEAPKRQTRRRAAKNVSYKEDDDFETDSDDLIEMTGEGVDEQQDNSETIEKVLDSRLGKKGATGASTTVYAIEANGDPSGDFDTEKDEGEIQYLIKWKGWSYIHSTWESEESLQQQKVKGLTTHTYENFTHTHEDAPQTNGSGTSFSLKTVELCTTWPNQRRSGFTDVRHLNHGSPIRYHTNVTSRDTHTSNPTLEVTPRYSSSHTPEPGTLNNKPTNTTVHYGMRTPIIQKSHPCDNNTHTNWH

SEQ ID NO: 915035 - protein, 352 aa, Homo sapiens
MKKKQKKKENKENKEKQMSSRKDKEGDKERKKSKDKKEKPKSGDAKSSSKSKRSQGPVHITAGSEPVPIGEDEDDDLDQETFSICKERMRPVKKALKQLDKPDKGLNVQEQLEHTRNCLLKIGDRIAECLKAYSDQEHIKLWRRNLWIFVSKFTEFDARKLHKLYKMAHKKRSQEEEEQKKKDDVTGGKKPFRPEASGSSRDSLISQSHTSHNLHPQKPHLPASHGPQMHGHPRDNYNHPNKRHFSNADRGDWQRERKFNYGGGNNNPPWGSDRHHQYEQHWYKDHHYGDRRHMDAHRSGSYRPNNMSRKRPYDQYSSDRDHRGHRDYYDRYAKGCETPGANLCQELFLGRK

SEQ ID NO: 915036 - protein, 124 aa, Homo sapiens
MHGHPRDNYNHPNKRHFSNADRGDWQRERKFNYGGGNNNPPWGSDRHHQYEQHWYKDHHYGDRRHMDAHRSGSYRPNNMSRKRPYDQYSSDRDHRGHRDYYDRYAKGCETPGANLCQELFLGRK

SEQ ID NO: 915037 - protein, 102 aa, Homo sapiens
LFQVEVFWCFIHKGSLQIIAFLGSFLISGVIYSLSSVLNPFAATGASTTVYAIEANGDPSGDFDTEKDEGEIQYLIKWKGWSYIHSTWESEESLQQQKVKGL

SEQ ID NO: 915038 - protein, 500 aa, Homo sapiens [sequence omitted]

SEQ ID NO: 915039 - protein, 1779 aa, Homo sapiens
MRNKDKSQEEDSSLHSNASSHSASEEASGSDSGSQSESEQGSDPGSGHGSESNSSSESSESQSESESESAGSKSQPVLPEAKEKPASKKERIADVKKMWEEYPDVYGVRRSNRSRQEPSRFNIKEEASSGSESGSPKRRGQRQLKKQEKWKQEPSEDEQEQGTSAESEPEQKKVKARRPVPRRTVPKPRVKKQPKTQRGKRKKQDSSDEDDDDDEAPKRQTRRRAAKNVSYKEDDDFETDSDDLIEMTGEGVDEQQDNSETIEKVLDSRLGKKGATGASTTVYAIEANGDPSGDFDTEKDEGEIQYLIKWKGWSYIHSTWESEESLQQQKVKGLKKLENFKKKEDEIKQWLGKVSPEDVEYFNCQQELASELNKQYQIVERVIAVKTSKSTLGQTDFPAHSRKPAPSNEPEYLCKWMGLPYSECSWEDEALIGKKFQNCIDSFHSRNNSKTIPTRECKALKQRPRFVALKKQPAYLGGENLELRDYQLEGLNWLAHSWCKNNSVILADEMGLGKTIQTISFLSYLFHQHQLYGPFLIVVPLSTLTSWQREFEIWAPEINVVVYIGDLMSRNTIREYEWIHSQTKRLKFNALITTYEILLKDKTVLGSINWAFLGVDEAHRLKNDDSLLYKTLIDFKSNHRLLITGTPLQNSLKELWSLLHFIMPEKFEFWEDFEEDHGKGRENGYQSLHKVLEPFLLRRVKKDVEKSLPAKVEQILRVEMSALQKQYYKWILTRNYKALAKGTRGSTSGFLNIVMELKKCCNHCYLIKPPEENERENGQEILLSLIRSSGKLILLDKLLTRLRERGNRVLIFSQMVRMLDILAEYLTIKHYPFQRLDGSIKGEIRKQALDHFNADGSEDFCFLLSTRAGGLGINLASADTVVIFDSDWNPQNDLQAQARAHRIGQKKQVNIYRLVTKGTVEEEIIERAKKKMVLDHLVIQRMDTTGRTILENNSGRSNSNPFNKEELTAILKFGAEDLFKELEGEESEPQEMDIDEILRLAETRENEVSTSATDELLSQFKVANFATMEDEEELEERPHKDWDEIIPEEQRKKVEEEERQKELEEIYMLPRIRSSTKKAQTNDSDSDTESKRQAQRSSASESETEDSDDDKKPKRRGRPRSVRKDLVEGFTDAEIRRFIKAYKKFGLPLERLECIARDAELVDKSVADLKRLGELIHNSCVSAMQEYEEQLKENASEGKGPGKRRGPTIKISGVQVNVKSIIQHEEEFEMLHKSIPVDPEEKKKYCLTCRVKAAHFDVEWGVEDDSRLLLGIYEHGYGNWELIKTDPELKLTDKLNLAPGIPCSWKEEIHDGWDALADEATSPSYLSCSTLLTAQILPVETDKKPQGKQLQTRADYLLKLLRKGLEKKGAVTGGEEAKLKKRKPRVKKENKVPRLKEEHGIELSSPRHSDNPSEEGEVKDDGLEKSPMKKKQKKKENKENKEKQMSSRKDKEGDKERKKSKDKKEKPKSGDAKSSSKSKRSQGPVHITAGSEPVPIGEDEDDDLDQETFSICKERMRPVKKALKQLDKPDKGLNVQEQLEHTRNCLLKIGDRIAECLKAYSDQEHIKLWRRNLWIFVSKFTEFDARKLHKLYKMAHKKRSQEEEEQKKKDDVTGGKKPFRPEASGSSRDSLISQSHTSHNLHPQKPHLPASHGPQMHGHPRDNYNHPNKRHFSNADRGDWQRERKFNYGGGNNNPPWGSDRHHQYEQHWYKDHHYGDRRHMDAHRSGSYRPNNMSRKRPYDQYSSDRDHRGHRDYYDRYAKGCETPGANLCQELFLGRK

SEQ ID NO: 915040 - protein, 1586 aa, Homo sapiens
MRNKDKSQEEDSSLHSNASSHSASEEASGSDSGSQSESEQGSDPGSGHGSESNSSSESSESQSESESESAGSKSQPVLPEAKEKPASKKERIADVKKMWEEYPDVYGVRRSNRSRQEPSRFNIKEEASSGSESGSPKRRGQRQLKKQEKWKQEPSEDEQEQGTSAESEPEQKKVKARRPVPRRTVPKPRVKKQPKTQRGKRKKQDSSDEDDDDDEAPKRQTRRRAAKNVSYKEDDDFETDSDDLIEMTGEGVDEQQDNSETIEKVLDSRLGKKGATGASTTVYAIEANGDPSGDFDTEKDEGEIQYLIKWKGWSYIHSTWESEESLQQQKVKGLKKLENFKKKEDEIKQWLGKVSPEDVEYFNCQQELASELNKQYQIVERVIAVKTSKSTLGQTDFPAHSRKPAPSNEPEYLCKWMGLPYSECSWEDEALIGKKFQNCIDSFHSRNNSKTIPTRECKALKQRPRFVALKKQPAYLGGENLELRDYQLEGLNWLAHSWCKNNSVILADEMGLGKTIQTISFLSYLFHQHQLYGPFLIVVPLSTLTSWQREFEIWAPEINVVVYIGDLMSRNTIREYEWIHSQTKRLKFNALITTYEILLKDKTVLGSINWAFLGVDEAHRLKNDDSLLYKTLIDFKSNHRLLITGTPLQNSLKELWSLLHFIMPEKFEFWEDFEEDHGKGRENGYQSLHKVLEPFLLRRVKKDVEKSLPAKVEQILRVEMSALQKQYYKWILTRNYKALAKGTRGSTSGFLNIVMELKKCCNHCYLIKPPEENERENGQEILLSLIRSSGKLILLDKLLTRLRERGNRVLIFSQMVRMLDILAEYLTIKHYPFQRLDGSIKGEIRKQALDHFNADGSEDFCFLLSTRAGGLGINLASADTVVIFDSDWNPQNDLQAQARAHRIGQKKQVNIYRLVTKGTVEEEIIERAKKKMVLDHLVIQRMDTTGRTILENNSGRSNSNPFNKEELTAILKFGAEDLFKELEGEESEPQEMDIDEILRLAETRENEVSTSATDELLSQFKVANFATMEDEEELEERPHKDWDEIIPEEQRKKVEEEERQKELEEIYMLPRIRSSTKKAQTNDSDSDTESKRQAQRSSASESETEDSDDDKKPKRRGRPRSVRKDLVEGFTDAEIRRFIKAYKKFGLPLERLECIARDAELVDKSVADLKRLGELIHNSCVSAMQEYEEQLKENASEGKGPGKRRGPTIKISGVQVNVKSIIQHEEEFEMLHKSIPVDPEEKKKYCLTCRVKAAHFDVEWGVEDDSRLLLGIYEHGYGNWELIKTDPELKLTDKILPVETDKKPQGKQLQTRADYLLKLLRKGLEKKGAVTGGEEAKLKKRKPRVKKENKVPRLKEEHGIELSSPRHSDNPSEEGEVKDDGLEKSPMKKKQKKKENKENKEKQMSSRKDKEGDKERKKSKDKKEKPKSGDAKSSSKSKRSQGPVHITAGSEPVPIGEDEDDDLDQETFSICKERMRPVKKALKQLDKPDKGLNVQEQLEHTRNCLLKIGDRIAECLKAYSDQEHIKLWRRNLWIFVSKFTEFDARKLHKLYKMAHKKRSQEEEEQKKKDTPISGFTGILCTTMPTN

SEQ ID NO: 915041 - protein, 1530 aa, Homo sapiens
MRNKDKSQEEDSSLHSNASSHSASEEASGSDSGSQSESEQGSDPGSGHGSESNSSSESSESQSESESESAGSKSQPVLPEAKEKPASKKERIADVKKMWEEYPDVYGVRRSNRSRQEPSRFNIKEEASSGSESGSPKRRGQRQLKKQEKWKQEPSEDEQEQGTSAESEPEQKKVKARRPVPRRTVPKPRVKKQPKTQRGKRKKQDSSDEDDDDDEAPKRQTRRRAAKNVSYKEDDDFETDSDDLIEMTGEGVDEQQDNSETIEKVLDSRLGKKGATGASTTVYAIEANGDPSGDFDTEKDEGEIQYLIKWKGWSYIHSTWESEESLQQQKVKGLKKLENFKKKEDEIKQWLGKVSPEDVEYFNCQQELASELNKQYQIVERVIAVKTSKSTLGQTDFPAHSRKPAPSNEPEYLCKWMGLPYSECSWEDEALIGKKFQNCIDSFHSRNNSKTIPTRECKALKQRPRFVALKKQPAYLGGENLELRDYQLEGLNWLAHSWCKNNSVILADEMGLGKTIQTISFLSYLFHQHQLYGPFLIVVPLSTLTSWQREFEIWAPEINVVVYIGDLMSRNTIREYEWIHSQTKRLKFNALITTYEILLKDKTVLGSINWAFLGVDEAHRLKNDDSLLYKTLIDFKSNHRLLITGTPLQNSLKELWSLLHFIMPEKFEFWEDFEEDHGKGRENGYQSLHKVLEPFLLRRVKKDVEKSLPAKVEQILRVEMSALQKQYYKWILTRNYKALAKGTRGSTSGFLNIVMELKKCCNHCYLIKPPEENERENGQEILLSLIRSSGKLILLDKLLTRLRERGNRVLIFSQMVRMLDILAEYLTIKHYPFQRLDGSIKGEIRKQALDHFNADGSEDFCFLLSTRAGGLGINLASADTVVIFDSDWNPQNDLQAQARAHRIGQKKQVNIYRLVTKGTVEEEIIERAKKKMVLDHLVIQRMDTTGRTILENNSGRSNSNPFNKEELTAILKFGAEDLFKELEGEESEPQEMDIDEILRLAETRENEVSTSATDELLSQFKVANFATMEDEEELEERPHKDWDEIIPEEQRKKVEEEERQKELEEIYMLPRIRSSTKKAQTNDSDSDTESKRQAQRSSASESETEDSDDDKKPKRRGRPRSVRKDLVEGFTDAEIRRFIKAYKKFGLPLERLECIARDAELVDKSVADLKRLGELIHNSCVSAMQEYEEQLKENASEGKGPGKRRGPTIKISGVQVNVKSIIQHEEEFEMLHKSIPVDPEEKKKYCLTCRVKAAHFDVEWGVEDDSRLLLGIYEHGYGNWELIKTDPELKLTDKILPVETDKKPQGKQLQTRADYLLKLLRKGLEKKGAVTGGEEAKLKKRKPRVKKENKVPRLKEEHGIELSSPRHSDNPSEEGEVKDDGLEKSPMKKKQKKKENKENKEKQMSSRKDKEGDKERKKSKDKKEKPKSGDAKSSSKSKRSQGPVHITAGSEPVPIGEDEDDDLDQETFSICKERMRPVKKALKQLDKPDKGLNVQEQLEHTRNCLLKIGDRIAECLKAYSDQEHIKLWRR

SEQ ID NO: 915042 - protein, 1414 aa, Homo sapiens
MRNKDKSQEEDSSLHSNASSHSASEEASGSDSGSQSESEQGSDPGSGHGSESNSSSESSESQSESESESAGSKSQPVLPEAKEKPASKKERIADVKKMWEEYPDVYGVRRSNRSRQEPSRFNIKEEASSGSESGSPKRRGQRQLKKQEKWKQEPSEDEQEQGTSAESEPEQKKVKARRPVPRRTVPKPRVKKQPKTQRGKRKKQDSSDEDDDDDEAPKRQTRRRAAKNVSYKEDDDFETDSDDLIEMTGEGVDEQQDNSETIEKVLDSRLGKKGATGASTTVYAIEANGDPSGDFDTEKDEGEIQYLIKWKGWSYIHSTWESEESLQQQKVKGLKKLENFKKKEDEIKQWLGKVSPEDVEYFNCQQELASELNKQYQIVERVIAVKTSKSTLGQTDFPAHSRKPAPSNEPEYLCKWMGLPYSECSWEDEALIGKKFQNCIDSFHSRNNSKTIPTRECKALKQRPRFVALKKQPAYLGGENLELRDYQLEGLNWLAHSWCKNNSVILADEMGLGKTIQTISFLSYLFHQHQLYGPFLIVVPLSTLTSWQREFEIWAPEINVVVYIGDLMSRNTIREYEWIHSQTKRLKFNALITTYEILLKDKTVLGSINWAFLGVDEAHRLKNDDSLLYKTLIDFKSNHRLLITGTPLQNSLKELWSLLHFIMPEKFEFWEDFEEDHGKGRENGYQSLHKVLEPFLLRRVKKDVEKSLPAKVEQILRVEMSALQKQYYKWILTRNYKALAKGTRGSTSGFLNIVMELKKCCNHCYLIKPPEENERENGQEILLSLIRSSGKLILLDKLLTRLRERGNRVLIFSQMVRMLDILAEYLTIKHYPFQRLDGSIKGEIRKQALDHFNADGSEDFCFLLSTRAGGLGINLASADTVVIFDSDWNPQNDLQAQARAHRIGQKKQVNIYRLVTKGTVEEEIIERAKKKMVLDHLVIQRMDTTGRTILENNSGRSNSNPFNKEELTAILKFGAEDLFKELEGEESEPQEMDIDEILRLAETRENEVSTSATDELLSQFKVANFATMEDEEELEERPHKDWDEIIPEEQRKKVEEEERQKELEEIYMLPRIRSSTKKAQTNDSDSDTESKRQAQRSSASESETEDSDDDKKPKRRGRPRSVRKDLVEGFTDAEIRRFIKAYKKFGLPLERLECIARDAELVDKSVADLKRLGELIHNSCVSAMQEYEEQLKENASEGKGPGKRRGPTIKISGVQVNVKSIIQHEEEFEMLHKSIPVDPEEKKKYCLTCRVKAAHFDVEWGVEDDSRLLLGIYEHGYGNWELIKTDPELKLTDKILPVETDKKPQGKQLQTRADYLLKLLRKGLEKKGAVTGGEEAKLKKRKPRVKKENKVPRLKEEHGIELSSPRHSDNPSEEGEVKDDGLEKSPMKKKQKKKENKENKEKQMSSRKDKRLKN

SEQ ID NO: 915043 - protein, 1482 aa, Homo sapiens
MRNKDKSQEEDSSLHSNASSHSASEEASGSDSGSQSESEQGSDPGSGHGSESNSSSESSESQSESESESAGSKSQPVLPEAKEKPASKKERIADVKKMWEEYPDVYGVRRSNRSRQEPSRFNIKEEASSGSESGSPKRRGQRQLKKQEKWKQEPSEDEQEQGTSAESEPEQKKVKARRPVPRRTVPKPRVKKQPKTQRGKRKKQDSSDEDDDDDEAPKRQTRRRAAKNVSYKEDDDFETDSDDLIEMTGEGVDEQQDNSETIEKVLDSRLGKKGATGASTTVYAIEANGDPSGDFDTEKDEGEIQYLIKWKGWSYIHSTWESEESLQQQKVKGLKKLENFKKKEDEIKQWLGKVSPEDVEYFNCQQELASELNKQYQIVERVIAVKTSKSTLGQTDFPAHSRKPAPSNEPEYLCKWMGLPYSECSWEDEALIGKKFQNCIDSFHSRNNSKTIPTRECKALKQRPRFVALKKQPAYLGGENLELRDYQLEGLNWLAHSWCKNNSVILADEMGLGKTIQTISFLSYLFHQHQLYGPFLIVVPLSTLTSWQREFEIWAPEINVVVYIGDLMSRNTIREYEWIHSQTKRLKFNALITTYEILLKDKTVLGSINWAFLGVDEAHRLKNDDSLLYKTLIDFKSNHRLLITGTPLQNSLKELWSLLHFIMPEKFEFWEDFEEDHGKGRENGYQSLHKVLEPFLLRRVKKDVEKSLPAKVEQILRVEMSALQKQYYKWILTRNYKALAKGTRGSTSGFLNIVMELKKCCNHCYLIKPPEENERENGQEILLSLIRSSGKLILLDKLLTRLRERGNRVLIFSQMVRMLDILAEYLTIKHYPFQRLDGSIKGEIRKQALDHFNADGSEDFCFLLSTRAGGLGINLASADTVVIFDSDWNPQNDLQAQARAHRIGQKKQVNIYRLVTKGTVEEEIIERAKKKMVLDHLVIQRMDTTGRTILENNSGRSNSNPFNKEELTAILKFGAEDLFKELEGEESEPQEMDIDEILRLAETRENEVSTSATDELLSQFKVANFATMEDEEELEERPHKDWDEIIPEEQRKKVEEEERQKELEEIYMLPRIRSSTKKAQTNDSDSDTESKRQAQRSSASESETEDSDDDKKPKRRGRPRSVRKDLVEGFTDAEIRRFIKAYKKFGLPLERLECIARDAELVDKSVADLKRLGELIHNSCVSAMQEYEEQLKENASEGKGPGKRRGPTIKISGVQVNVKSIIQHEEEFEMLHKSIPVDPEEKKKYCLTCRVKAAHFDVEWGVEDDSRLLLGIYEHGYGNWELIKTDPELKLTDKLNLAPGIPCSWKEEIHDGWDALADEATSPSYLSCSTLLTAQILPVETDKKPQGKQLQTRADYLLKLLRKGLEKKGAVTGGEEAKLKKRKPRVKKENKVPRLKEEHGIELSSPRHSDNPSEEGEVKDDGLEKSPMKKKQKKKENKENKEKQMSSRKDKEGDKERKKSKDKKEKPKVVMPNLRFDAFGIL

SEQ ID NO: 915044 - protein, 1299 aa, Homo sapiens
MRNKDKSQEEDSSLHSNASSHSASEEASGSDSGSQSESEQGSDPGSGHGSESNSSSESSESQSESESESAGSKSQPVLPEAKEKPASKKERIADVKKMWEEYPDVYGVRRSNRSRQEPSRFNIKEEASSGSESGSPKRRGQRQLKKQEKWKQEPSEDEQEQGTSAESEPEQKKVKARRPVPRRTVPKPRVKKQPKTQRGKRKKQDSSDEDDDDDEAPKRQTRRRAAKNVSYKEDDDFETDSDDLIEMTGEGVDEQQDNSETIEKVLDSRLGKKGATGASTTVYAIEANGDPSGDFDTEKDEGEIQYLIKWKGWSYIHSTWESEESLQQQKVKGLKKLENFKKKEDEIKQWLGKVSPEDVEYFNCQQELASELNKQYQIVERVIAVKTSKSTLGQTDFPAHSRKPAPSNEPEYLCKWMGLPYSECSWEDEALIGKKFQNCIDSFHSRNNSKTIPTRECKALKQRPRFVALKKQPAYLGGENLELRDYQLEGLNWLAHSWCKNNSVILADEMGLGKTIQTISFLSYLFHQHQLYGPFLIVVPLSTLTSWQREFEIWAPEINVVVYIGDLMSRNTIREYEWIHSQTKRLKFNALITTYEILLKDKTVLGSINWAFLGVDEAHRLKNDDSLLYKTLIDFKSNHRLLITGTPLQNSLKELWSLLHFIMPEKFEFWEDFEEDHGKGRENGYQSLHKVLEPFLLRRVKKDVEKSLPAKVEQILRVEMSALQKQYYKWILTRNYKALAKGTRGSTSGFLNIVMELKKCCNHCYLIKPPEENERENGQEILLSLIRSSGKLILLDKLLTRLRERGNRVLIFSQMVRMLDILAEYLTIKHYPFQRLDGSIKGEIRKQALDHFNADGSEDFCFLLSTRAGGLGINLASADTVVIFDSDWNPQNDLQAQARAHRIGQKKQVNIYRLVTKGTVEEEIIERAKKKMVLDHLVIQRMDTTGRTILENNSGRSNSNPFNKEELTAILKFGAEDLFKELEGEESEPQEMDIDEILRLAETRENEVSTSATDELLSQFKVANFATMEDEEELEERPHKDWDEIIPEEQRKKVEEEERQKELEEIYMLPRIRSSTKKAQTNDSDSDTESKRQAQRSSASESETEDSDDDKKPKRRGRPRSVRKDLVEGFTDAEIRRFIKAYKKFGLPLERLECIARDAELVDKSVADLKRLGELIHNSCVSAMQEYEEQLKENASEGKGPGKRRGPTIKISGVQVNVKSIIQHEEEFEMLHKSIPVDPEEKKKYCLTCRVKAAHFDVEWGVEDDSRLLLGIYEHGYGNWELIKTDPELKLTDKVTLPC

SEQ ID NO: 915045 - protein, 1738 aa, Homo sapiens; identical to SEQ ID NO: 915024

SEQ ID NO: 915046 - protein, 1036 aa, Homo sapiens
MRNKDKSQEEDSSLHSNASSHSASEEASGSDSGSQSESEQGSDPGSGHGSESNSSSESSESQSESESESAGSKSQPVLPEAKEKPASKKERIADVKKMWEEYPDVYGVRRSNRSRQEPSRFNIKEEASSGSESGSPKRRGQRQLKKQEKWKQEPSEDEQEQGTSAESEPEQKKVKARRPVPRRTVPKPRVKKQPKTQRGKRKKQDSSDEDDDDDEAPKRQTRRRAAKNVSYKEDDDFETDSDDLIEMTGEGVDEQQDNSETIEKVLDSRLGKKGATGASTTVYAIEANGDPSGDFDTEKDEGEIQYLIKWKGWSYIHSTWESEESLQQQKVKGLKKLENFKKKEDEIKQWLGKVSPEDVEYFNCQQELASELNKQYQIVERVIAVKTSKSTLGQTDFPAHSRKPAPSNEPEYLCKWMGLPYSECSWEDEALIGKKFQNCIDSFHSRNNSKTIPTRECKALKQRPRFVALKKQPAYLGGENLELRDYQLEGLNWLAHSWCKNNSVILADEMGLGKTIQTISFLSYLFHQHQLYGPFLIVVPLSTLTSWQREFEIWAPEINVVVYIGDLMSRNTIREYEWIHSQTKRLKFNALITTYEILLKDKTVLGSINWAFLGVDEAHRLKNDDSLLYKTLIDFKSNHRLLITGTPLQNSLKELWSLLHFIMPEKFEFWEDFEEDHGKGRENGYQSLHKVLEPFLLRRVKKDVEKSLPAKVEQILRVEMSALQKQYYKWILTRNYKALAKGTRGSTSGFLNIVMELKKCCNHCYLIKPPEENERENGQEILLSLIRSSGKLILLDKLLTRLRERGNRVLIFSQMVRMLDILAEYLTIKHYPFQRLDGSIKGEIRKQALDHFNADGSEDFCFLLSTRAGGLGINLASADTVVIFDSDWNPQNDLQAQARAHRIGQKKQVNIYRLVTKGTVEEEIIERAKKKMVLDHLVIQRMDTTGRTILENNSGRSNSNPFNKEELTAILKFGAEDLFKELEGEESEPQEMDIDEILRLAETRENEVSTSATDELLSQFKVANFATWIQKRRRDP

SEQ ID NO: 915047 - protein, 466 aa, Homo sapiens
GFSVTGSHGHEIGSEALSIFWVILPVETDKKPQGKQLQTRADYLLKLLRKGLEKKGAVTGGEEAKLKKRKPRVKKENKVPRLKEEHGIELSSPRHSDNPSEEGEVKDDGLEKSPMKKKQKKKENKENKEKQMSSRKDKEGDKERKKSKDKKEKPKSGDAKSSSKSKRSQGPVHITAGSEPVPIGEDEDDDLDQETFSICKERMRPVKKALKQLDKPDKGLNVQEQLEHTRNCLLKIGDRIAECLKAYSDQEHIKLWRRNLWIFVSKFTEFDARKLHKLYKMAHKKRSQEEEEQKKKDDVTGGKKPFRPEASGSSRDSLISQSHTSHNLHPQKPHLPASHGPQMHGHPRDNYNHPNKRHFSNADRGDWQRERKFNYGGGNNNPPWGSDRHHQYEQHWYKDHHYGDRRHMDAHRSGSYRPNNMSRKRPYDQYSSDRDHRGHRDYYDRYAKGCETPGANLCQELFLGRK

SEQ ID NO: 915048 - protein, 42 aa, Homo sapiens
DKKPQGKQLQTRADYLLKLLRKGLEKKGAVTGGEEVSTLPAG

SEQ ID NO: 915049 - protein, 248 aa, Homo sapiens
VIPGSSPYNSARPRPPAPPAPQQNSAQRSRAPGSERPAAQSGGETDRSADRDSGRDSGETRVCERAGPSGPRSGSAAQRAPSANMSVDPLSSKALKIKRELSENTPHLSDEALMGLSVRELNRHLRGLSAEEVTRLKQRRRTLKNRGYAASCRVKRVCQKEELQKQKSELEREVDKLARENAAMRLELDALRGKCEALQGFARSVAAARGPATLVAPASVITIVKSTPGSGSGPAHGPDPAHGPASCS

SEQ ID NO: 915050 - protein, 248 aa, Homo sapiens; identical to SEQ ID NO: 915049

SEQ ID NO: 915051 - protein, 541 aa, Homo sapiens
MVINLCLPQFRPRIHCNKISADGYEVENLISEDLTKRSHGFRTEYFIKPPVYVTVSFPFNVEICRINIDLTAGGGQNVTGLEMYTSASSSRVSWNTPQCRTLGPAEPSVPDKEAFTLVGKVLLKNQSQVVFSHRGFKARPPFGAMEATLPSPAVVAQELWNKGALSLSHVAHLRICITHVTGGGIPCIKRLEVWGQPAKTCSQEVIDSILLVTSENLPQDVALQAPALPMESDCDPGDQPESQQAPSSLQKLAEIIQDVPEEFLDPITLEIMPCPMLLPSGKVIDQSTLEKCNRSEATWGRVPSDPFTGVAFTPHSQPLPHPSLKARIDHFLLQHSIPGCHLLGRAQTALAVIPSSIVLPSQKRKIEQAEHVPDSNFGVNASCFSATSPLVLPTTSEHTAKKMKATNEPSLTHMDCSTGPLSHEQKLSQSLEIALASTLGSMPSFTARLTRGQLQHLGTRGSNTSWRPGTGSEQPGSILGPECASCKRVFSPYFKKEPVYQLPCGHLLCRPCLGEKQRSLPMTCTACQRPVASQDVLRVHF

SEQ ID NO: 915052 - protein, 521 aa, Homo sapiens
MVINLCLPQFRPRIHCNKISADGYEVENLISEDLTKRSHGFRTEYFIKPPVYVTVSFPFNVEICRINIDLTAGGGQNVTGLEMYTSASSSRVSWNTPQCRTLGPAEPSVPDKEAFTLVGKVLLKNQSQVVFSHRGFKARPPFGAMEATLPSPAVVAQELWNKGALSLSHVAHLRICITHVTGGGIPCIKRLEVWGQPAKTCSQEVIDSILLVTSENLPQDVALQAPALPMESDCDPGDQPESQQAPSSLQKLAEIIQDVPEEFLDPITLEIMPCPMLLPSGKVIDQSTLEKCNRSEATWGRVPSDPFTGVAFTPHSQPLPHPSLKARIDHFLLQHSIPGCHLLGRAQTALAVIPSSIVLPSQKRKIEQAEHVPDSNFGVNASCFSATSPLVLPTTSEHTAKKMKATNEPSLTHMDCSTGPLSHEQKLSQSLEIALASTLGSMPSFTARLTRGQLQHLGTRGSNTSWRPGTGSEQPGSILGPECASCKRVFSPYFKKEPVYQLPAATSCADPAWVRSNAPCP

SEQ ID NO: 915053 - protein, 650 aa, Homo sapiens
MRVFLQLRPEYRVHSYNASETSQLLSVSEGELILHKVRVNQNNLQAQVIVDYLCKLSSLPAEQHPVLLGSTSFALLCQLSVKKIQLFDTQDLINVLKAFVILGIPHSHSMLDVYETKCCHQVWEMNMDQLLLVADLWRYLGRKVPRFLNIFSSYLNLHWKDLSLSQLVHLIYVIGENRQVSQDLMQKLESLILKYIDLINLEEVGTICLGFFKSSTNLSEFVMRKIGDLACANIQHLSSRSLVNIVKMFRFTHVDHINFMKQIGEIAPQRIPSLGVQGVMHLTLYCSALRFLNEGVMNAVAASLPPRVAHCRSKDVAKILWSFGTLNYKPPNAEEFYSSLISEIHRKMPEFNQYPEHLPTCLLGLAFLEYFPVELIDFALSPGFVRLAQERTKFDLLKELYTLDGTVGIECPDYRGNRLSTHLQQEGSELLWYLAEKDMNSKPEFLETVFLLETMLGGPQYVKHHMILPHTRSSDLEVQLDVNLKPLPFNREATPAENVAKLRLEHVGVSLTDDLMNKLLKGKARGHFQGKTESEPGQQPMELENKAAVPLGGFLCNVADKSGAMEMAGLCPAACMQTPRMKLAVQFTNRNQYCYGSRDLLGLHNMKRRQLARLGYRVVELSYWEWLPLLKRTRLEKLAFLHEKVFTSAL

SEQ ID NO: 915054 - protein, 764 aa, Homo sapiens
MAATLKSLKLVRYRAFCSPSAFGAVRSVSYWNVSSTQHGGQDPPEHISLCHSAKKVKNICSTFSSRRILTTSSAHPGLEFSKTSSSKASTLQLGSPRATGVDEEDVEVFDSFENMRVFLQLRPEYRVHSYNASETSQLLSVSEGELILHKVRVNQNNLQAQVIVDYLCKLSSLPAEQHPVLLGSTSFALLCQLSVKKIQLFDTQDLINVLKAFVILGIPHSHSMLDVYETKCCHQVWEMNMDQLLLVADLWRYLGRKVPRFLNIFSSYLNLHWKDLSLSQLVHLIYVIGENRQVSQDLMQKLESLILKYIDLINLEEVGTICLGFFKSSTNLSEFVMRKIGDLACANIQHLSSRSLVNIVKMFRFTHVDHINFMKQIGEIAPQRIPSLGVQGVMHLTLYCSALRFLNEGVMNAVAASLPPRVAHCRSKDVAKILWSFGTLNYKPPNAEEFYSSLISEIHRKMPEFNQYPEHLPTCLLGLAFLEYFPVELIDFALSPGFVRLAQERTKFDLLKELYTLDGTVGIECPDYRGNRLSTHLQQEGSELLWYLAEKDMNSKPEFLETVFLLETMLGGPQYVKHHMILPHTRSSDLEVQLDVNLKPLPFNREATPAENVAKLRLEHVGVSLTDDLMNKLLKGKARGHFQGKTESEPGQQPMELENKAAVPLGGFLCNVADKSGAMEMAGLCPAACMQTPRMKLAVQFTNRNQYCYGSRDLLGLHNMKRRQLARLGYRVVELSYWEWLPLLKRTRLEKLAFLHEKVFTSAL

SEQ ID NO: 915055 - protein, 764 aa, Homo sapiens; identical to SEQ ID NO: 915054

SEQ ID NO: 915056 - protein, 487 aa, Homo sapiens
MVINLCLPQFRPRIHCNKISADGYEVENLISEDLTKRSHGFRTEYFIKPPVYVTVSFPFNVEICRINIDLTAGGGQNVTGLEMYTSASSSRVSWNTPQCRTLGPAEPSVPDKEAFTLVGKVLLKNQSQVVFSHRGFKARPPFGAMEATLPSPAVVAQELWNKGALSLSHVAHLRICITHVTGGGIPCIKRLEVWGQPAKTCSQEVIDSILLVTSENLPQDVALQAPALPMESDCDPGDQPESQQAPSSLQKLAEIIQDVPEEFLDPITLEIMPCPMLLPSGKVIDQSTLEKCNRSEATWGRVPSDPFTGVAFTPHSQPLPHPSLKARIDHFLLQHSIPGCHLLGRAQTALAVIPSSIVLPSQKRKIEQAEHVPDSNFGVNASCFSATSPLVLPTTSEHTAKKMKATNEPSLTHMDCSTEQPGSILGPECASCKRVFSPYFKKEPVYQLPCGHLLCRPCLGEKQRSLPMTCTACQRPVASQDVLRVHF

SEQ ID NO: 915057 - protein, 82 aa, Homo sapiens
MATFPPATSAPQQPPGPEDEDSSLDESDLYSLAHSYLGGGGRKGRTKREAAANTNRPSPGGHERKLVTKLQNSERKKRGARR

SEQ ID NO: 915058 - protein, 82 aa, Homo sapiens; identical to SEQ ID NO: 915057

SEQ ID NO: 915059 - protein, 172 aa, Homo sapiens [sequence omitted]

SEQ ID NO: 915060 - protein, 82 aa, Homo sapiens; identical to SEQ ID NO: 915057

SEQ ID NO: 915061 - protein, 67 aa, Homo sapiens
SRGSRLPSNFPSDLYSLAHSYLGGGGRKGRTKREAAANTNRPSPGGHERKLVTKLQNSERKKRGARR

SEQ ID NO: 915062 - protein, 82 aa, Homo sapiens; identical to SEQ ID NO: 915057

SEQ ID NO: 915063 - protein, 82 aa, Homo sapiens; identical to SEQ ID NO: 915057

SEQ ID NO: 915064 - protein, 82 aa, Homo sapiens; identical to SEQ ID NO: 915057

SEQ ID NO: 915065 - protein, 190 aa, Homo sapiens
MNPQIRNPMKAMYPGTFYFQFKNLWEANDRNETWLCFTVEGIKRRSVVSWKTGVFRNQVDSETHCHAERCFLSWFCDDILSPNTKYQVTWYTSWSPCPDCAGEVAEFLARHSNVNLTIFTARLYYFQYPCYQEGLRSLSQEGVAVEIMDYEDFKYCWENFVYNDNEPFKPWKGLKTNFRLLKRRLRESLQ

SEQ ID NO: 915066 - protein, 190 aa, Homo sapiens; identical to SEQ ID NO: 915065

SEQ ID NO: 915067 - protein, 190 aa, Homo sapiens; identical to SEQ ID NO: 915065

SEQ ID NO: 915068 - protein, 189 aa, Homo sapiens
MNPQIRNPMKAMYPGTFYFQFKNLWEANDRNETWLCFTVEGIKRRSVVSWKTGVFRNQVDSETHCHAERCFLSWFCDDILSPNTKYQVTWYTSWSPCPDCAGEVAEFLARHSNVNLTIFTARLYYFQYPCYQEGLRSLSQEGVAVEIMDYEDFKYCWENFVYNDNEPFKPWKGLKTNFRLLLLNVCLWC

SEQ ID NO: 915069 - protein, 172 aa, Homo sapiens
MNPQIRNPMKAMYPGTFYFQFKNLWEANDRNETWLCFTVEGIKRRSVVSWKTGVFRNQVDSETHCHAERCFLSWFCDDILSPNTKYQVTWYTSWSPCPDCAGEVAEFLARHSNVNLTIFTARLYYFQYPCYQEGLRSLSQEGVAVEIMDYEAGWDHMFHTCLFNKHGLQPPT

SEQ ID NO: 915070 - protein, 172 aa, Homo sapiens
MNPQIRNPMKAMYPGTFYFQFKSIKRRSVVSWKTGVFRNQVDSETHCHAERCFLSWFCDDILSPNTKYQVTWYTSWSPCPDCAGEVAEFLARHSNVNLTIFTARLYYFQYPCYQEGLRSLSQEGVAVEIMDYEDFKYCWENFVYNDNEPFKPWKGLKTNFRLLKRRLRESLQ

SEQ ID NO: 915071 - protein, 125 aa, Homo sapiens
MEKVEEEGEEENEEENKQGGERYREEGEEYGKGGAEKIQRKGVSGPQSGILKARENKAQSRRGSRDRIWMCQVIVVPLMAKGPWHSARVPQSADRSCELFLQRLLSASMAIHPPPQTPFLQPACP

SEQ ID NO: 915072 - protein, 177 aa, Homo sapiens
MNPQIRNPMKAMYPGTFYFQFKNLWEANDRNETWLCFTVEGIKRRSVVSWKTGVFRNQVDSETHCHAERCFLSWFCDDILSPNTKYQVTWYTSWSPCPDCAGEVAEFLARHSNVNLTIFTARLYYFQYPCYQEGLRSLSQEGVAVEIMDYEDFKYCWENFVYNDNELLDGYLAGCHP

SEQ ID NO: 915073 - protein, 206 aa, Homo sapiens
MLPCAAGARGRGAMVVLRAGKKTFLPALCRAFACRGCQLAPERGAERRDTAPSGVSRFCPPRKSCHDWIGPPDKYSNLRPVHFYIPENESPLEQKLRKLRQETQEWNQQFWANQNLTFSKEKEEFIHSRLKTKGLGLRTESGQKATLNAEEMADFYKEFLSKNFQKHMYYNRDWYKRNFAITFFMGKVALERIWNKLKQKQKKRSN

SEQ ID NO: 915074 - protein, 120 aa, Homo sapiens
RNAAVRRGSQGAWGHGGLAGGEEDLSPRSLPRLRLPRLSTRSGARRRAQGYGAQRGQKATLNAEEMADFYKEFLSKNFQKHMYYNRDWYKRNFAITFFMGKVALERIWNKLKQKQKKRSN

SEQ ID NO: 915075 - protein, 161 aa, Homo sapiens [sequence omitted]

SEQ ID NO: 915076 - protein, 201 aa, Homo sapiens
MLPCAAGARGRGAMVVLRAGKKTFLPALCRAFACRGCQLAPERGAERRDTAPSGVSRFCPPRKSCHDWIGPPDKYSNLRPVHFYIPENESPLEQKLRKLRQETQEWNQQFWANQNLTFSKEKEEFIHSRLKTKGLGLRTESDGVSLCHPGWSAVARSRLTANSASWFKRFSCLSLLSSWDYRSESNIECRRNGGLLQGIFK

SEQ ID NO: 915077 - protein, 89 aa, Homo sapiens
GRQTRASGPLPVLHSRLRPLSRCSRVLSRTVPQPRGSRINALSRMGLRVPPPPRRGLLTARTFKRNRVTWSESNIECRRNGGLLQGIFK

SEQ ID NO: 915078 - protein, 102 aa, Homo sapiens
MLPCAAGARGRGAMVVLRAGKKTFLPALCRAFACRGCQLAPERGAERRDTAPSGPPQAFVQVLSRPIPNSPAAPRLPHQRPQSDGTEGAAATTPGTVDSQNL

SEQ ID NO: 915079 - protein, 125 aa, Homo sapiens
MLPCAAGARGRGAMVVLRAGKKTFLPALCRAFACRGCQLAPERGAERRDTAPSGVSRFCPPRKSCHDWIGPPDKYSNLRPVHFYIPENESPLEQKLRKLRQETQEWNQQFWANQNLTFSKVRKQH

SEQ ID NO: 915080 - protein, 102 aa, Homo sapiens; identical to SEQ ID NO: 915078

SEQ ID NO: 915081 - protein, 84 aa, Homo sapiens
GRQTRASGPLPVLHSRLRPLSRCSRVLSRTVPQPRGSRINALSRMGLRVPPPPRRGLLTARTFKRNRVTWSQDSALQESLAMIG

SEQ ID NO: 915082 - protein, 201 aa, Homo sapiens; identical to SEQ ID NO: 915076

SEQ ID NO: 915083 - protein, 146 aa, Homo sapiens
MLPCAAGARGRGAMVVLRAGKKTFLPALCRAFACRGCQLAPERGAERRDTAPSGVSRFCPPRKSCHDWIGPPDKYSNLRPVHFYIPENESPLEQKLRKLRQETQEWNQQFWANQNLTFSKEKEEFIHSRLKTKGLGLRTESGGYDG

SEQ ID NO: 915084 - protein, 217 aa, Homo sapiens
MSSDFEGYEQDFAVLTAEITSKIARVPRLPPDEKKQMVANVEKQLEEAKELLEQMDLEVREIPPQSRGMYSNRMRSYKQEMGKLETDFKRSRIAYSDEVRNELLGDDGNSSENQRAHLLDNTERLERSSRRLEAGYQIAVETEQIGQEMLENLSHDREKIQRARERLRETDANLGKSSRILTGMLRRIIQNRILLVILGIIVVITILMAITFSVRRH

SEQ ID NO: 915085 - protein, 215 aa, Homo sapiens
MSSDFEGYEQDFAVLTAEITSKIARVPRLPPDEKKQMVANVEKQLEEAKELLEQMDLEVREIPPQSRGMYSNRMRSYKQEMGKLETDFKRSRIAYSDEVRNELLGDDGNSSENQRAHLLDNTERLERSSRRLEAGYQIAVETEQIGQEMLENLSHDREKIQRARERLRETDANLGKSSRILTGMLRRCCIQQGIYIQIRFDYRKDRKPNTTCSHS

SEQ ID NO: 915086 - protein, 191 aa, Homo sapiens
MSSDFEGYEQDFAVLTAEITSKIARVPRLPPDEKKQMVANVEKQLEEAKELLEQMDLEVREIPPQSRGMYSNRMRSYKQEMGKLETDFKRSRIAYSDEVRNELLGDDGNSSENQRAHLLDNTERLERSSRRLEAGYQIAVETEQIGQEMLENLSHDREKIQRARERLRETDANLGKSSRILTGMLRRGVVL

SEQ ID NO: 915087 - protein, 94 aa, Homo sapiens
GTVWSVAVLNRRRSQKKIVEQIGQEMLENLSHDREKIQRARERLRETDANLGKSSRILTGMLRRIIQNRILLVILGIIVVITILMAITFSVRRH

SEQ ID NO: 915088 - protein, 224 aa, Homo sapiens
MSSDFEGYEQDFAVLTAEITSKIARVPRLPPDEKKQMVANVEKQLEEAKELLEQMDLEVREIPPQSRGMYSNRMRSYKQEMGKLETDFKRSRIAYSDEVRNELLGDDGNSSENQLIKLREERAHLLDNTERLERSSRRLEAGYQIAVETEQIGQEMLENLSHDREKIQRARERLRETDANLGKSSRILTGMLRRIIQNRILLVILGIIVVITILMAITFSVRRH

SEQ ID NO: 915089 - protein, 201 aa, Homo sapiens
MSSDFEGYEQDFAVLTAEITSKIARVPRLPPDEKKQMVANVEKQLEEAKELLEQMDLEVREIPPQSRGMYSNRMRSYKQEMGKLETDFKRSRIAYSDEVRNELLGDDGNSSENQRAHLLDNTERLERSSRRLEAGYQIAVETEQIGQEMLENLSHDREKIQRARERLRETDANLGKSSRILTGMLRSKSKVGTYLSLCVFF

SEQ ID NO: 915090 - protein, 143 aa, Homo sapiens
VQNEKLQQRTRTDFKRSRIAYSDEVRNELLGDDGNSSENQRAHLLDNTERLERSSRRLEAGYQIAVETEQIGQEMLENLSHDREKIQRARERLRETDANLGKSSRILTGMLRRIIQNRILLVILGIIVVITILMAITFSVRRH

SEQ ID NO: 915091 - protein, 198 aa, Homo sapiens
MSSDFEGYEQDFAVLTAEITSKIARVPRLPPDEKKQMVANVEKQLEEAKELLEQMDLEVREIPPQSRGMYSNRMRSYKQEMGKLETDFKRSRIAYSDEVRNELLGDDGNSSENQRAHLLDNTERLERSSRRLEAGYQIAVETEQIGQEMLENLSHDREKIQRARERLRETDANLGKSSRILTGMLRRLASAGKISSAI

SEQ ID NO: 915092 - protein, 151 aa, Homo sapiens
MSSDFEGYEQDFAVLTAEITSKIARVPRLPPDEKKQMVANVEKQLEEAKELLEQMDLEVREIPPQSRGMYSNRMRSYKQEMGKLETDFKRSRIAYSDEVRNELLGDDGNSSENQRAHLLDNTERLERSSRRLEAGYQIAVETGKNSESEQI

SEQ ID NO: 915093 - protein, 881 aa, Homo sapiens
MAAPGAPAEYGYIRTVLGQQILGQLDSSSLALPSEAKLKLAGSSGRGGQTVKSLRIQEQVQQTLARKGRSSVGNGNLHRTSSVPEYVYNLHLVENDFVGGRSPVPKTYDMLKAGTTATYEGRWGRGTAQYSSQKSVEERSLRHPLRRLEISPDSSPERAHYTHSDYQYSQRSQAGHTLHHQESRRAALLVPPRYARSEIVGVSRAGTTSRQRHFDTYHRQYQHGSVSDTVFDSIPANPALLTYPRPGTSRSMGNLLEKENYLTAGLTVGQVRPLVPLQPVTQNRASRSSWHQSSFHSTRTLREAGPSVAVDSSGRRAHLTVGQAAAGGSGNLLTERSTFTDSQLGNADMEMTLERAVSMLEADHMLPSRISAAATFIQHECFQKSEARKRVNQLRGILKLLQLLKVQNEDVQRAVCGALRNLVFEDNDNKLEVAELNGVPRLLQVLKQTRDLETKKQITDHTVNLRSRNGWPGAVAHACNPSTLGGQGGRITRSGVRDQPDQHGLLWNLSSNDKLKNLMITEALLTLTENIIIPFSGWPEGDYPKANGLLDFDIFYNVTGCLRNMSSAGADGRKAMRRCDGLIDSLVHYVRGTIADYQPDDKATENCVCILHNLSYQLEAELPEKYSQNIYIQNRNIQTDNNKSIGCFGSRSRKVKEQYQDVPMPEEKSNPKGVEWLWHSIVIRMYLSLIAKSVRNYTQEASLGALQNLTAGSGPMPTSVAQTVVQKESGLQHTRKMLHVGDPSVKKTAISLLRNLSRNLSLQNEIAKETLPDLVSIIPDTVPSTDLLIETTASACYTLNNIIQNSYQNARDLLNTGGIQKIMAISAGDAYASNKASKAASVLLYSLWAHTELHHAYKKAQFKKTDFVNSRTAKAYHSLKD

SEQ ID NO: 915094 - protein, 117 aa, Homo sapiens
GAGPDSSGAGLAPAPPAPWRLRPRVQRQASSSVAPTGPMAAPGAPAEYGYIRTVLGQQILGQLDSSSLALPSEAKLKLAGSSGRGGQTVKSLRIQEQVQQTLARKGRSSVGNGPVLN

SEQ ID NO: 915095 - protein, 818 aa, Homo sapiens
MAAPGAPAEYGYIRTVLGQQILGQLDSSSLALPSEAKLKLAGSSGRGGQTVKSLRIQEQVQQTLARKGRSSVGNGNLHRTSSVPEYVYNLHLVENDFVGGRSPVPKTYDMLKAGTTATYEGRWGRGTAQYSSQKSVEERSLRHPLRRLEISPDSSPERAHYTHSDYQYSQRSQAGHTLHHQESRRAALLVPPRYARSEIVGVSRAGTTSRQRHFDTYHRQYQHGSVSDTVFDSIPANPALLTYPRPGTSRSMGNLLEKENYLTAGLTVGQVRPLVPLQPVTQNRASRSSWHQSSFHSTRTLREAGPSVAVDSSGRRAHLTVGQAAAGGSGNLLTERSTFTDSQLGNADMEMTLERAVSMLEADHMLPSRISAAATFIQHECFQKSEARKRVNQLRGILKLLQLLKVQNEDVQRAVCGALRNLVFEDNDNKLEVAELNGVPRLLQVLKQTRDLETKKQITGLLWNLSSNDKLKNLMITEALLTLTENIIIPFSGWPEGDYPKANGLLDFDIFYNVTGCLRNMSSAGADGRKAMRRCDGLIDSLVHYVRGTIADYQPDDKATENCVCILHNLSYQLEAELPEKYSQNIYIQNRNIQTDNNKSIGCFGSRSRKVKEQYQDVPMPEEKSNPKGVEWLWHSIVIRMYLSLIAKSVRNYTQEASLGALQNLTAGSGPMPTSVAQTVVQKESGLQHTRKMLHVGDPSVKKTAISLLRNLSRNLSLQNEIAKETLPDLVSIIPDTVPSTDLLIETTASACYTLNNIIQNSYQNARDLLNTGGIQKIMAISAGDAYASNKASKAASVLLYSLWAHTELHHAYKKVRT

SEQ ID NO: 915096 - protein, 887 aa, Homo sapiens
MAAPGAPAEYGYIRTVLGQQILGQLDSSSLALPSEAKLKLAGSSGRGGQTVKSLRIQEQVQQTLARKGRSSVGNGNLHRTSSVPEYVYNLHLVENDFVGGRSPVPKTYDMLKAGTTATYEGRWGRGTAQYSSQKSVEERSLRHPLRRLEISPDSSPERAHYTHSDYQYSQRSQAGHTLHHQESRRAALLVPPRYARSEIVGVSRAGTTSRQRHFDTYHRQYQHGSVSDTVFDSIPANPALLTYPRPGTSRSMGNLLEKENYLTAGLTVGQVRPLVPLQPVTQNRASRSSWHQSSFHSTRTLREAGPSVAVDSSGRRAHLTVGQAAAGGSGNLLTERSTFTDSQLGNADMEMTLERAVSMLEADHMLPSRISAAATFIQHECFQKSEARKRVNQLRGILKLLQLLKVQNEDVQRAVCGALRNLVFEDNDNKLEVAELNGVPRLLQVLKQTRDLETKKQITGLLWNLSSNDKLKNLMITEALLTLTENIIIPFSGWPEGDYPKANGLLDFDIFYNVTGCLRNMSSAGADGRKAMRRCDGLIDSLVHYVRGTIADYQPDDKATENCVCILHNLSYQLEAELPEKYSQNIYIQNRNIQTDNNKSIGCFGSRSRKVKEQYQDVPMPEEKSNPKGVEWLWHSIVIRMYLSLIAKSVRNYTQEASLGALQNLTAGSGPMPTSVAQTVVQKESGLQHTRKMLHVGDPSVKKTAISLLRNLSRNLSLQNEIAKETLPDLVSIIPDTVPSTDLLIETTASACYTLNNIIQNSYQNARDLLNTGGIQKIMAISAGDAYASNKASKETFFSVFAIFFPAATGILAGANISGDLADPQSAIPKGTLLAILITTLVYVGIAVSVGSCVVRDATGNVNDTIVTELTNCTFAARQIKLGFFIL

SEQ ID NO: 915097 - protein, 837 aa, Homo sapiens
MAAPGAPAEYGYIRTVLGQQILGQLDSSSLALPSEAKLKLAGSSGRGGQTVKSLRIQEQVQQTLARKGRSSVGNGNLHRTSSVPEYVYNLHLVENDFVGGRSPVPKTYDMLKAGTTATYEGRWGRGTAQYSSQKSVEERSLRHPLRRLEISPDSSPERAHYTHSDYQYSQRSQAGHTLHHQESRRAALLVPPRYARSEIVGVSRAGTTSRQRHFDTYHRQYQHGSVSDTVFDSIPANPALLTYPRPGTSRSMGNLLEKENYLTAGLTVGQVRPLVPLQPVTQNRASRSSWHQSSFHSTRTLREAGPSVAVDSSGRRAHLTVGQAAAGGSGNLLTERSTFTDSQLGNADMEMTLERAVSMLEADHMLPSRISAAATFIQHECFQKSEARKRVNQLRGILKLLQLLKVQNEDVQRAVCGALRNLVFEDNDNKLEVAELNGVPRLLQVLKQTRDLETKKQITGLLWNLSSNDKLKNLMITEALLTLTENIIIPFSGWPEGDYPKANGLLDFDIFYNVTGCLRNMSSAGADGRKAMRRCDGLIDSLVHYVRGTIADYQPDDKATENCVCILHNLSYQLEAELPEKYSQNIYIQNRNIQTDNNKSIGCFGSRSRKVKEQYQDVPMPEEKSNPKGVEWLWHSIVIRMYLSLIAKSVRNYTQEASLGALQNLTAGSGPMPTSVAQTVVQKESGLQHTRKMLHVGDPSVKKTAISLLRNLSRNLSLQNEIAKETLPDLVSIIPDTVPSTDLLIETTASACYTLNNIIQNSYQNARDLLNTGGIQKIMAISAGDAYASNKASKAASVLLYSLWAHTELHHAYKKAQFKKTDFVNSRTAKAYHSLKD

SEQ ID NO: 915098 - protein, 218 aa, Homo sapiens
MPEEKSNPKGVEWLWHSIVIRMYLSLIAKSVRNYTQEASLGALQNLTAGSGPMPTSVAQTVVQKESGLQHTRKMLHVGDPSVKKTAISLLRNLSRNLSLQNEIAKETLPDLVSIIPDTVPSTDLLIETTASACYTLNNIIQNSYQNARDLLNTGGIQKIMAISAGDAYASNKASKAASVLLYSLWAHTELHHAYKKAQFKKTDFVNSRTAKAYHSLKD

SEQ ID NO: 915099 - protein, 686 aa, Homo sapiens
MAAPGAPAEYGYIRTVLGQQILGQLDSSSLALPSEAKLKLAGSSGRGGQTVKSLRIQEQVQQTLARKGRSSVGNGNLHRTSSVPEYVYNLHLVENDFVGGRSPVPKTYDMLKAGTTATYEGRWGRGTAQYSSQKSVEERSLRHPLRRLEISPDSSPERAHYTHSDYQYSQRSQAGHTLHHQESRRAALLVPPRYARSEIVGVSRAGTTSRQRHFDTYHRQYQHGSVSDTVFDSIPANPALLTYPRPGTSRSMGNLLEKENYLTAGLTVGQVRPLVPLQPVTQNRASRSSWHQSSFHSTRTLREAGPSVAVDSSGRRAHLTVGQAAAGGSGNLLTERSTFTDSQLGNADMEMTLERAVSMLEADHMLPSRISAAATFIQHECFQKSEARKRVNQLRGILKLLQLLKVQNEDVQRAVCGALRNLVFEDNDNKLEVAELNGVPRLLQVLKQTRDLETKKQITGLLWNLSSNDKLKNLMITEALLTLTENIIIPFSGWPEGDYPKANGLLDFDIFYNVTGCLRNMSSAGADGRKAMRRCDGLIDSLVHYVRGTIADYQPDDKATENCVCILHNLSYQLEAELPEKYSQNIYIQNRNIQTDNNKSIGCFGSRSRKVKEQYQDVPMPEEKSNPKGVEWLWHSIVIRMYLSLIAKSVRNYTQEASLGALQNLTAGSGPVSIGPDFLLFKIMIL

SEQ ID NO: 915100 - protein, 127 aa, Homo sapiens
MSDNEDNFDGDDFDDVEEDEGLDDLENAEEEGQENVEILPSGERPQANQKRITTPYMTKYERARVLGTRALQIAMCAPVMVELEGETDPLLIAMKELKARKIPIIIRRYLPDGSYEDWGVDELIITD

SEQ ID NO: 915101 - protein, 127 aa, Homo sapiens; identical to SEQ ID NO: 915100

SEQ ID NO: 915102 - protein, 127 aa, Homo sapiens; identical to SEQ ID NO: 915100

SEQ ID NO: 915103 - protein, 127 aa, Homo sapiens; identical to SEQ ID NO: 915100

SEQ ID NO: 915104 - protein, 142 aa, Homo sapiens
MSFDGDDFDDVEEDEGLDDLENAEEVSIQPQAPTSAAQAAKSSDREGQENVEILPSGERPQANQKRITTPYMTKYERARVLGTRALQIAMCAPVMVELEGETDPLLIAMKELKARKIPIIIRRYLPDGSYEDWGVDELIITD

SEQ ID NO: 915105 - protein, 167 aa, Homo sapiens
MGAMKTGGWTSSSSPTELESSSCPCPMPNFHSHFICVNNKIFNFPTTPFPSAYLQCHHLLLPRYRHAAWSMHLFQWPCDCQLLKKHQGPLAPLDPPHPSLHLPVPQSKGCCRGDTSAAFQADRQVFVPRELVATETPNFLSSGDWLQGLLPSQEYHRAGLIKPPIVS

SEQ ID NO: 915106 - protein, 109 aa, Homo sapiens
MSFDGDDFDDVEEDEGLDDLENAEEVSIQPQVPPLQPKLPNRLTGRPGECRALQIAMCAPVMVELEGETDPLLIAMKELKARKIPIIIRRYLPDGSYEDWGVDELIITD

SEQ ID NO: 915107 - protein, 127 aa, Homo sapiens; identical to SEQ ID NO: 915100

SEQ ID NO: 915108 - protein, 122 aa, Homo sapiens
MSFDGDDFDDVEEDEGLDDLENAEEEGQENVEILPSGERPQANQKRITTPYMTKYERARVLGTRALQIAMCAPVMVELEGETDPLLIAMKELKARKIPIIIRRYLPDGSYEDWGVDELIITD

SEQ ID NO: 915109 - protein, 109 aa, Homo sapiens; identical to SEQ ID NO: 915106

SEQ ID NO: 915110 - protein, 283 aa, Homo sapiens
MAGNFWQSSHYLQWILDKQDLLKERQKDLKFLSEEEYWKLQIFFTNVIQALGEHLKLRQQVIATATVYFKRFYARYSLKSIDPVLMAPTCVFLASKVEEFGVVSNTRLIAAATSVLKTRFSYAFPKEFPYRMNHILECEFYLLELMDCCLIVYHPYRPLLQYVQDMGQEDMLLPLAWRIVNDTYRTDLCLLYPPFMIALACLHVACVVQQKDARQWFAELSVDMEKILEIIRVILKLYEQWKNFDERKEMATILSKMPKPKPPPNSEGEQGPNGSQNSSYSQS

SEQ ID NO: 915111 - protein, 283 aa, Homo sapiens; identical to SEQ ID NO: 915110

SEQ ID NO: 915112 - protein, 283 aa, Homo sapiens; identical to SEQ ID NO: 915110

SEQ ID NO: 915113 - protein, 283 aa, Homo sapiens; identical to SEQ ID NO: 915110

SEQ ID NO: 915114 - protein, 198 aa, Homo sapiens
MAPTCVFLASKVEEFGVVSNTRLIAAATSVLKTRFSYAFPKEFPYRMNHILECEFYLLELMDCCLIVYHPYRPLLQYVQDMGQEDMLLPLAWRIVNDTYRTDLCLLYPPFMIALACLHVACVVQQKDARQWFAELSVDMEKILEIIRVILKLYEQWKNFDERKEMATILSKMPKPKPPPNSEGEQGPNGSQNSSYSQS

SEQ ID NO: 915115 - protein, 119 aa, Homo sapiens
MAGNFWQSSHYLQWILDKQDLLKERQKDLKFLSEEEYWKLQIFFTNVIQALGEHLKLRQQVIATATVYFKRFYARYSLKSIDPVLMAPTCVFLASKVEEFGVVSNTRLIAAATSVYIRM

SEQ ID NO: 915116 - protein, 137 aa, Homo sapiens
MAGNFWQSSHYLQWILDKQDLLKERQKDLKFLSEEEYWKLQIFFTNVIQALGEHLKLRQQVIATATVYFKRFYARYSLKSIDPVLMAPTCVFLASKVEEFGVVSNTRLIAAATSVLKTRFSYAFPKEFPYRMNHVSI

SEQ ID NO: 915117 - protein, 283 aa, Homo sapiens; identical to SEQ ID NO: 915110

SEQ ID NO: 915118 - protein, 282 aa, Homo sapiens
MAGNFWQSSHYLQWILDKQDLLKERQKDLKFLSEEEYWKLQIFFTNVIQALGEHLKLRQQVIATATVYFKRFYARYSLKSIDPVLMAPTCVFLASKVEEFGVVSNTRLIAAATSVLKTRFSYAFPKEFPYRMNHILECEFYLLELMDCCLIVYHPYRPLLQYVQDMGQEDMLLPLAWRIVNDTYRTDLCLLYPPFMIALACLHVACVVQQKDARQWFAELSVDMEKILEIIRVILKLYEQWKNFDERKEMATILSKMPKPKPPPNRNSLSDSPLVAGPEAAR

SEQ ID NO: 915119 - protein, 330 aa, Homo sapiens
MAGNFWQSSHYPKRRDHFALLKSLEQSWSFLSGKGNECGRQDNSGKTNEKIMKGHCLSLQWILDKQDLLKERQKDLKFLSEEEYWKLQIFFTNVIQALGEHLKLRQQVIATATVYFKRFYARYSLKSIDPVLMAPTCVFLASKVEEFGVVSNTRLIAAATSVLKTRFSYAFPKEFPYRMNHILECEFYLLELMDCCLIVYHPYRPLLQYVQDMGQEDMLLPLAWRIVNDTYRTDLCLLYPPFMIALACLHVACVVQQKDARQWFAELSVDMEKILEIIRVILKLYEQWKNFDERKEMATILSKMPKPKPPPNSEGEQGPNGSQNSSYSQS

SEQ ID NO: 915120 - protein, 198 aa, Homo sapiens; identical to SEQ ID NO: 915114

SEQ ID NO: 915121 - protein, 282 aa, Homo sapiens; identical to SEQ ID NO: 915118

SEQ ID NO: 915122 - protein, 159 aa, Homo sapiens
MAGNFWQSSHYLQWILDKQDLLKERQKDLKFLSEEEYWKLQIFFTNVIQALGEHLKLRQQVIATATVYFKRFYARYSLKSIDPVLMAPTCVFLASKVEEFGVVSNTRLIAAATSVLKTRFSYAFPKEFPYRMNHILECEFYLLELMVSKSSVINRLKHF

SEQ ID NO: 915123 - protein, 88 aa, Homo sapiens
MAGNFWQSSHYLQWILDKQDLLKERQKDLKFLSEEEYWKLQIFFTNVIQALGEHLKNDNKNNKINDNKKHKFPVNVQLHIINIIELSP

SEQ ID NO: 915124 - protein, 395 aa, Homo sapiens
MGVKTFTHSSSSHSQEMLGKLNMLRNDGHFCDITIRVQDKIFRAHKVVLAACSDFFRTKLVGQAEDENKNVLDLHHVTVTGFIPLLEYAYTATLSINTENIIDVLAAASYMQMFSVASTCSEFMKSSILWNTPNSQPEKGLDAGQENNSNCNFTSRDGSISPVSSECSVVERTIPVCRESRRKRKSYIVMSPESPVKCGTQTSSPQVLNSSASYSENRNQPVDSSLAFPWTFPFGIDRRIQPEKVKQAENTRTLELPGPSETGRRMADYVTCESTKTTLPLGTEEDVRVKVERLSDEEVHEEVSQPVSASQSSLSDQQTVPGSEQVQEDLLISPQSSSIGSVDEGVSEGLPTLQSTSSTNAPPDDDDRVSTNIAFRYLLRVEFTTPNSSISSQEL

SEQ ID NO: 915125 - protein, 453 aa, Homo sapiens
MGVKTFTHSSSSHSQEMLGKLNMLRNDGHFCDITIRVQDKIFRAHKVVLAACSDFFRTKLVGQAEDENKNVLDLHHVTVTGFIPLLEYAYTATLSINTENIIDVLAAASYMQMFSVASTCSEFMKSSILWNTPNSQPEKGLDAGQENNSNCNFTSRDGSISPVSSECSVVERTIPVCRESRRKRKSYIVMSPESPVKCGTQTSSPQVLNSSASYSENRNQPVDSSLAFPWTFPFGIDRRIQPEKVKQAENTRTLELPGPSETGRRMADYVTCESTKTTLPLGTEEDVRVKVERLSDEEVHEEVSQPVSASQSSLSDQQTVPGSEQVQEDLLISPQSSSIGSVDEGVSEGLPTLQSTSSTNAPPDDDDRLENVQYPYQLYIAPSTSSTERPSPNGPDRPFQCPTCGVRFTRIQNLKQHMLIHSGIKPFQCDRCGKKFTRAYSLKMHRLKHEVIS

SEQ ID NO: 915126 - protein, 616 aa, Homo sapiens
MGVKTFTHSSSSHSQEMLGKLNMLRNDGHFCDITIRVQDKIFRAHKVVLAACSDFFRTKLVGQAEDENKNVLDLHHVTVTGFIPLLEYAYTATLSINTENIIDVLAAASYMQMFSVASTCSEFMKSSILWNTPNSQPEKGLDAGQENNSNCNFTSRDGSISPVSSECSVVERTIPVCRESRRKRKSYIVMSPESPVKCGTQTSSPQVLNSSASYSENRNQPVDSSLAFPWTFPFGIDRRIQPEKVKQAENTRTLELPGPSETGRRMADYVTCESTKTTLPLGTEEDVRVKVERLSDEEVHEEVSQPVSASQSSLSDQQTVPGSEQVQEDLLISPQSSSIGSVDEGVSEGLPTLQSTSSTNAPPDDDDRLENVQYPYQLYIAPSTSSTERPSPNGPDRPFQCPTCGVRFTRIQNLKQHMLIHSGIKPFQCDRCGKKFTRAYSLKMHRLKHEGKRCFRCQICSATFTSFGEYKHHMRVSRHIIRKPRIYECKTCGAMFTNSGNLIVHLRSLNHEASELANYFQSSDFLVPDYLNQEQEETLVQYDLGEHGFESNSSVQMPVISQVSSTQNCESTFPLGSLGGLAEKEEEVPEQPKSSACAEATRDDPPKSELSSITIE

SEQ ID NO: 915127 - protein, 453 aa, Homo sapiens; identical to SEQ ID NO: 915125

SEQ ID NO: 915128 - protein, 474 aa, Homo sapiens
MGVKTFTHSSSSHSQEMLGKLNMLRNDGHFCDITIRVQDKIFRAHKVVLAACSDFFRTKLVGQAEDENKNVLDLHHVTVTGFIPLLEYAYTATLSINTENIIDVLAAASYMQMFSVASTCSEFMKSSILWNTPNSQPEKGLDAGQENNSNCNFTSRDGSISPVSSECSVVERTIPVCRESRRKRKSYIVMSPESPVKCGTQTSSPQVLNSSASYSENRNQPVDSSLAFPWTFPFGIDRRIQPEKVKQAENTRTLELPGPSETGRRMADYVTCESTKTTLPLGTEEDVRVKVERLSDEEVHEEVSQPVSASQSSLSDQQTVPGSEQVQEDLLISPQSSSIGSVDEGVSEGLPTLQSTSSTNAPPDDDDRLENVQYPYQLYIAPSTSSTERPSPNGPDRPFQCPTCGVRFTRIQNLKQHMLIHSGIKPFQCDRCGKKFTRAYSLKMHRLKHEVPLQRQGTMIDNSQAVDEMTRNGE

SEQ ID NO: 915129 - protein, 383 aa, Homo sapiens
MGVKTFTHSSSSHSQEMLGKLNMLRNDGHFCDITIRVQDKIFRAHKVVLAACSDFFRTKLVGQAEDENKNVLDLHHVTVTGFIPLLEYAYTATLSINTENIIDVLAAASYMQMFSVASTCSEFMKSSILWNTPNSQPEKGLDAGQENNSNCNFTSRDGSISPVSSECSVVERTIPVCRESRRKRKSYIVMSPESPVKCGTQTSSPQVLNSSASYSENRNQPVDSSLAFPWTFPFGIDRRIQPEKVKQAENTRTLELPGPSETGRRMADYVTCESTKTTLPLGTEEDVRVKVERLSDEEVHEEVSQPVSASQSSLSDQQTVPGSEQVQEDLLISPQSSSIGSVDEGVSEGLPTLQSTSSTNAPPDDDDRLENVQYPQERLSLQC

SEQ ID NO: 915130 - protein, 82 aa, Homo sapiens
LKMHRLKHEGKRCFRCQICSATFTSFGEYKHHMRVSRHIIRKPRIYECKTCGAMFTNSGNLIVHLRSLNHEASELANYFQSR

SEQ ID NO: 915131 - protein, 474 aa, Homo sapiens; identical to SEQ ID NO: 915128

SEQ ID NO: 915132 - protein, 436 aa, Homo sapiens
MGVKTFTHSSSSHSQEMLGKLNMLRNDGHFCDITIRVQDKIFRAHKVVLAACSDFFRTKLVGQAEDENKNVLDLHHVTVTGFIPLLEYAYTATLSINTENIIDVLAAASYMQMFSVASTCSEFMKSSILWNTPNSQPEKGLDAGQENNSNCNFTSRDGSISPVSSECSVVERTIPVCRESRRKRKSYIVMSPESPVKCGTQTSSPQVLNSSASYSENRNQPVDSSLAFPWTFPFGIDRRIQPEKVKQAENTRTLELPGPSETGRRMADYVTCESTKTTLPLGTEEDVRVKVERLSDEEVHEEVSQPVSASQSSLSDQQTVPGSEQVQEDLLISPQSSSIGSVDEGVSEGLPTLQSTSSTNAPPDDDDRSTERPSPNGPDRPFQCPTCGVRFTRIQNLKQHMLIHSGIKPFQCDRCGKKFTRAYSLKMHRLKHEVIS

SEQ ID NO: 915133 - protein, 467 aa, Homo sapiens
MGVKTFTHSSSSHSQEMLGKLNMLRNDGHFCDITIRVQDKIFRAHKVVLAACSDFFRTKLVGQAEDENKNVLDLHHVTVTGFIPLLEYAYTATLSINTENIIDVLAAASYMQMFSVASTCSEFMKSSILWNTPNSQPEKGLDAGQENNSNCNFTSRDGSISPVSSECSVVERTIPVCRESRRKRKSYIVMSPESPVKCGTQTSSPQVLNSSASYSENRNQPVDSSLAFPWTFPFGIDRRIQPEKVKQAENTRTLELPGPSETGRRMADYVTCESTKTTLPLGTEEDVRVKVERLSDEEVHEEVSQPVSASQSSLSDQQTVPGSEQVQEDLLISPQSSSIGSVDEGVSEGLPTLQSTSSTNAPPDDDDRLENVQYPYQLYIAPSTSSTERPSPNGPDRPFQCPTCGVRFTRIQNLKQHMLIHSGIKPFQCDRCGKKFTRAYSLKMHRLKHEGHPRKSASRSSSATNCC

SEQ ID NO: 915134 - protein, 453 aa, Homo sapiens; identical to SEQ ID NO: 915125

SEQ ID NO: 915135 - protein, 100 aa, Homo sapiens
MKKIRIVYRNSLQNRNALLNTSFVRSHCPAGKDSPSLVYQKTIVHFSSSDTFVSVTLTSTVFTAESFESCRRDTSPLRVSCSSEAFSSPGPLDILFPDWK

SEQ ID NO: 915136 - protein, 465 aa, Homo sapiens
DKPTRHKTYLSSSWAKMAAAEGPVGDGELWQTWLPNHVVFLRLREGLKNQSPTEAEKPASSSLPSSPPPQLLTRNVVFGLGGELFLWDGEDSSFLVVRLRGPSGGGEEPALSQYQRLLCINPPLFEIYQVLLSPTQHHVALIGIKGLMVLELPKRWGKNSEFEGGKSTVNCSTTPVAERFFTSSTSLTLKHAAWYPSEILDPHVVLLTSDNVIRIYSLREPQTPTNVIILSEAEEESLVLNKGRAYTASLGETAVAFDFGPLAAVPKTLFGQNGKDEVVAYPLYILYENGETFLTYISLLHSPGNIGKLLGPLPMHPAAEDNYGYDACAVLCLPCVPNILVIATESGMLYHCVVLEGEEEDDHTSEKSWDSRIDLIPSLYVFECVELELALKLASGEDDPFDSDFSCPVKLHRDPKCPSRYHCTHEAGVHSVGLTWIHKLHKFLGSGSQLQFEDFGLYLTFWDPR

SEQ ID NO: 915137 - protein, 443 aa, Homo sapiens
MHPAAEDNYGYDACAVLCLPCVPNILVIATESGMLYHCVVLEGEEEDDHTSEKSWDSRIDLIPSLYVFECVELELALKLASGEDDPFDSDFSCPVKLHRDPKCPSRYHCTHEAGVHSVGLTWIHKLHKFLGSDEEDKDSLQELSTEQKCFVEHILCTKPLPCRQPAPIRGFWIVPDILGPTMICITSTYECLIWPLLSTVHPASPPLLCTREDVEVAESPLRVLAETPDSFEKHIRSILQRSVANPAFLKASEKDIAPPPEECLQLLSRATQVFREQYILKQDLAKEEIQRRVKLLCDQKKKQLEDLSYCREERKSLREMAERLADKYEEAKEKQEDIMNRMKKLLHSFHSELPVLSDSERDMKKELQLIPDQLRHLGNAIKQVTMKKDYQQQKMEKVLSLPKPTIILSAYQRKCIQSILKEEGEHIREMVKQINDIRNHVNF

SEQ ID NO: 915138 - protein, 610 aa, Homo sapiens
MVLELPKRWGKNSEFEGGKSTVNCSTTPVAERFFTSSTSLTLKHAAWYPSEILDPHVVLLTSDNVIRIYSLREPQTPTNVIILSEAEEESLVLNKGRAYTASLGETAVAFDFGPLAAVPKTLFGQNGKDEVVAYPLYILYENGETFLTYISLLHSPGNIGKLLGPLPMHPAAEDNYGYDACAVLCLPCVPNILVIATESGMLYHCVVLEGEEEDDHTSEKSWDSRIDLIPSLYVFECVELELALKLASGEDDPFDSDFSCPVKLHRDPKCPSRYHCTHEAGVHSVGLTWIHKLHKFLGSDEEDKDSLQELSTEQKCFVEHILCTKPLPCRQPAPIRGFWIVPDILGPTMICITSTYECLIWPLLSTVHPASPPLLCTREDVEVAESPLRVLAETPDSFEKHIRSILQRSVANPAFLKASEKDIAPPPEECLQLLSRATQVFREQYILKQDLAKEEIQRRVKLLCDQKKKQLEDLSYCREERKSLREMAERLADKYEEAKEKQEDIMNRMKKLLHSFHSELPVLSDSERDMKKELQLIPDQLRHLGNAIKQVTMKKDYQQQKMEKVLSLPKPTIILSAYQRKCIQSILKEEGEHIREMVKQINDIRNHVNF

SEQ ID NO: 915139 - protein, 757 aa, Homo sapiens
DKPTRHKTYLSSSWAKMAAAEGPVGDGELWQTWLPNHVVFLRLREGLKNQSPTEAEKPASSSLPSSPPPQLLTRNVVFGLGGELFLWDGEDSSFLVVRLRGPSGGGEEPALSQYQRLLCINPPLFEIYQVLLSPTQHHVALIGIKGLMVLELPKRWGKNSEFEGGKSTVNCSTTPVAERFFTSSTSLTLKHAAWYPSEILDPHVVLLTSDNVIRIYSLREPQTPTNVIILSEAEEESLVLNKGRAYTASLGETAVAFDFGPLAAVPKTLFGQNGKDEVVAYPLYILYENGETFLTYISLLHSPGNIGKLLGPLPMHPAAEDNYGYDACAVLCLPCVPNILVIATESGMLYHCVVLEGEEEDDHTSEKSWDSRIDLIPSLYVFECVELELALKLASGEDDPFDSDFSCPVKLHRDPKCPSRYHCTHEAGVHSVGLTWIHKLHKFLGSDEEDKDSLQELSTEQKCFVEHILCTKPLPCRQPAPIRGFWIVPDILGPTMICITSTYECLIWPLLSTVHPASPPLLCTREDVEVAESPLRVLAETPDSFEKHIRSILQRSVANPAFLKASEKDIAPPPEECLQLLSRATQVFREQYILKQDLAKEEIQRRVKLLCDQKKKQLEDLSYCREERKSLREMAERLADKYEEAKEKQEDIMNRMKKLLHSFHSELPVLSDSERDMKKELQLIPDQLRHLGNAIKQVTMKKDYQQQKMEKVLSLPKPTIILSAYQRKCIQSILKEEGEHIREMVKQINDIRNHVNF

SEQ ID NO: 915140 - protein, 739 aa, Homo sapiens
DKPTRHKTYLSSSWAKMAAAEGPVGDGELWQTWLPNHVVFLRLREGLKNQSPTEAEKPASSSLPSSPPPQLLTRNVVFGLGGELFLWDGEDSSFLVVRLRGPSGGGEEPALSQYQRLLCINPPLFEIYQVLLSPTQHHVALIGIKGLMVLELPKRWGKNSEFEGGSTSLTLKHAAWYPSEILDPHVVLLTSDNVIRIYSLREPQTPTNVIILSEAEEESLVLNKGRAYTASLGETAVAFDFGPLAAVPKTLFGQNGKDEVVAYPLYILYENGETFLTYISLLHSPGNIGKLLGPLPMHPAAEDNYGYDACAVLCLPCVPNILVIATESGMLYHCVVLEGEEEDDHTSEKSWDSRIDLIPSLYVFECVELELALKLASGEDDPFDSDFSCPVKLHRDPKCPSRYHCTHEAGVHSVGLTWIHKLHKFLGSDEEDKDSLQELSTEQKCFVEHILCTKPLPCRQPAPIRGFWIVPDILGPTMICITSTYECLIWPLLSTVHPASPPLLCTREDVEVAESPLRVLAETPDSFEKHIRSILQRSVANPAFLKASEKDIAPPPEECLQLLSRATQVFREQYILKQDLAKEEIQRRVKLLCDQKKKQLEDLSYCREERKSLREMAERLADKYEEAKEKQEDIMNRMKKLLHSFHSELPVLSDSERDMKKELQLIPDQLRHLGNAIKQVTMKKDYQQQKMEKVLSLPKPTIILSAYQRKCIQSILKEEGEHIREMVKQINDIRNHVNF

SEQ ID NO: 915141 - protein, 757 aa, Homo sapiens; identical to SEQ ID NO: 915139

SEQ ID NO: 915142 - protein, 262 aa, Homo sapiens [sequence omitted]

SEQ ID NO: 915143 - protein, 657 aa, Homo sapiens
DKPTRHKTYLSSSWAKMAAAEGPVGDGELWQTWLPNHVVFLRLREGLKNQSPTEAEKPASSSLPSSPPPQLLTRNVVFGLGGELFLWDGEDSSFLVVRLRGPSGGGEEPALSQYQRLLCINPPLFEIYQVLLSPTQHHVALIGIKGLMVLELPKRWGKNSEFEGGKSTVNCSTTPVAERFFTSSTSLTLKHAAWYPSEILDPHVVLLTSDNVIRIYSLREPQTPTNVIILSEAEEESLVLNKGRAYTASLGETAVAFDFGPLAAVPKTLFGQNGKDEVVAYPLYILYENGETFLTYISLLHSPGNIGKLLGPLPMHPAAEDNYGYDACAVLCLPCVPNILVIATESGMLYHCVVLEGEEEDDHTSEKSWDSRIDLIPSLYVFECVELELALKLASGEDDPFDSDFSCPVKLHRDPKCPSRYHCTHEAGVHSVGLTWIHKLHKFLGSDEEDKDSLQELSTEQKCFVEHILCTKPLPCRQPAPIRGFWIVPDILGPTMICITSTYECLIWPLLSTVHPASPPLLCTREDVEVAESPLRVLAETPDSFEKHIRSILQRSVANPAFLKASEKDIAPPPEECLQLLSRATQVFREQYILKQDLAKEEIQRRVKLLCDQKKKQLEDLSYCREERKSLREMAERLADKYEEAKEKQEDIMNSSL

SEQ ID NO: 915144 - protein, 753 aa, Homo sapiens
DKPTRHKTYLSSSWAKMAAAEGPVGDGELWQTWLPNHVVFLRLREGLKNQSPTEAEKPASSSLPSSPPPQLLTRNVVFGLGGELFLWDGEDSSFLVVRLRGPSGGGEEPALSQYQRLLCINPPLFEIYQVLLSPTQHHVALIGIKGLMVLELPKRWGKNSEFEGGKSTVNCSTTPVAERFFTSSTSLTLKHAAWYPSEILDPHVVLLTSDNVIRIYSLREPQTPTNVIILSEAEEESLVLNKGRAYTASLGETAVAFDFGPLAAVPKTLFGQNGKDEVVAYPLYILYENGETFLTYISLLHSPGNIGKLLGPLPMHPAAEDNYGYDACAVLCLPCVPNILVIATESGMLYHCVVLEGEEEDDHTSEKSWDSRIDLIPSLYVFECVELELALKLASGEDDPFDSDFSCPVKLHRDPKCPSRYHCTHEAGVHSVGLTWIHKLHKFLGSDEEDKDSLQELSTEQKCFVEHILCTKPLPCRQPAPIRGFWIVPDILGPTMICITSTYECLIWPLLSTVHPASPPLLCTREDVEVAESPLRVLAETPDSFEKHIRSILQRSVANPAFLNCFTQLRKIKVETLFLASEKDIAPPPEECLQLLSRATQVFREQYILKQDLAKEEIQRRVKLLCDQKKKQLEDLSYCREERKSLREMAERLADKYEEAKEKQEDIMNRMKKLLHSFHSELPVLSDSERDMKKELQLIPDQLRHLGNAIKQVTMKKDYQQQKMEKVLSLPKPTIILSAYQRKCIQSILKEDE

SEQ ID NO: 915145 - protein, 573 aa, Homo sapiens
DKPTRHKTYLSSSWAKMAAAEGPVGDGELWQTWLPNHVVFLRLREGLKNQSPTEAEKPASSSLPSSPPPQLLTRNVVFGLGGELFLWDGEDSSFLVVRLRGPSGGGEEPALSQYQRLLCINPPLFEIYQVLLSPTQHHVALIGIKGLMVLELPKRWGKNSEFEGGKSTVNCSTTPVAERFFTSSTSLTLKHAAWYPSEILDPHVVLLTSDNVIRIYSLREPQTPTNVIILSEAEEESLVLNKGRAYTASLGETAVAFDFGPLAAVPKTLFGQNGKDEVVAYPLYILYENGETFLTYISLLHSPGNIGKLLGPLPMHPAAEDNYGYDACAVLCLPCVPNILVIATESGMLYHCVVLEGEEEDDHTSEKSWDSRIDLIPSLYVFECVELELALKLASGEDDPFDSDFSCPVKLHRDPKCPSRYHCTHEAGVHSVGLTWIHKLHKFLGSDEEDKDSLQELSTEQKCFVEHILCTKPLPCRQPAPIRGFWIVPDILGPTMICITSTYECLIWPLLSTVHPASPPLLCTREDVEVAESPLRVLAETPDSFEKHIRSILQRSVANPAFLKYATLGIAVL

SEQ ID NO: 915146 - protein, 535 aa, Homo sapiens
DKPTRHKTYLSSSWAKMAAAEGPVGDGELWQTWLPNHVVFLRLREGLKNQSPTEAEKPASSSLPSSPPPQLLTRNVVFGLGGELFLWDGEDSSFLVVRLRGPSGGGEEPALSQYQRLLCINPPLFEIYQVLLSPTQHHVALIGIKGLMVLELPKRWGKNSEFEGGKSTVNCSTTPVAERFFTSSTSLTLKHAAWYPSEILDPHVVLLTSDNVIRIYSLREPQTPTNVIILSEAEEESLVLNKGRAYTASLGETAVAFDFGPLAAVPKTLFGQNGKDEVVAYPLYILYENGETFLTYISLLHSPGNIGKLLGPLPMHPAAEDNYGYDACAVLCLPCVPNILVIATESGMLYHCVVLEGEEEDDHTSEKSWDSRIDLIPSLYVFECVELELALKLASGEDDPFDSDFSCPVKLHRDPKCPSRYHCTHEAGVHSVGLTWIHKLHKFLGSDEEDKDSLQELSTEQKCFVEHILCTKPLPCRQPAPIRGFWIVPDILGPTMICITSTYECLIWPLLYVPFYILHTALVNSAISKLGKCTQ

SEQ ID NO: 915147 - protein, 420 aa, Homo sapiens
DKPTRHKTYLSSSWAKMAAAEGPVGDGELWQTWLPNHVVFLRLREGLKNQSPTEAEKPASSSLPSSPPPQLLTRNVVFGLGGELFLWDGEDSSFLVVRLRGPSGGGEEPALSQYQRLLCINPPLFEIYQVLLSPTQHHVALIGIKGLMVLELPKRWGKNSEFEGGKSTVNCSTTPVAERFFTSSTSLTLKHAAWYPSEILDPHVVLLTSDNVIRIYSLREPQTPTNVIILSEAEEESLVLNKGRAYTASLGETAVAFDFGPLAAVPKTLFGQNGKDEVVAYPLYILYENGETFLTYISLLHSPGNIGKLLGPLPMHPAAEDNYGYDACAVLCLPCVPNILVIATESGMLYHCVVLEGEEEDDHTSEKSWDSRIDLIPSLYVFECVELELALKLASGEDDPFDSDFSCPVKLHRGKLFNKC

SEQ ID NO: 915148 - protein, 123 aa, Homo sapiens
DKPTRHKTYLSSSWAKMAAAEGPVGDGELWQTWLPNHVVFLRLREGLKNQSPTEAEKPASSSLPSSPPPQLLTRNVVFGLGGELFLWDGEDSSFLVVRLRGPSGGGEEPALSQYQVMPGRSWK

SEQ ID NO: 915149 - protein, 757 aa, Homo sapiens; identical to SEQ ID NO: 915139

SEQ ID NO: 915150 - protein, 757 aa, Homo sapiens; identical to SEQ ID NO: 915139

SEQ ID NO: 915151 - protein, 724 aa, Homo sapiens
DKPTRHKTYLSSSWAKMAAAEGPVGDGELWQTWLPNHVVFLRLREGLKNQSPTEAEKPASSSLPSSPPPQLLTRNVVFGLGGELFLWDGEDSSFLVVRLRGPSGGGEEPALSQYQRLLCINPPLFEIYQVLLSPTQHHVALIGIKGLMVLELPKRWGKNSEFEGGKSTVNCSTTPVAERFFTSSTSLTLKHAAWYPSEILDPHVVLLTSDNVIRIYSLREPQTPTNVIILSEAEEESLVLNKGRAYTASLGETAVAFDFGPLAAVPKTLFGQNGKDEVVAYPLYILYENGETFLTYISLLHSPGNIGKLLGPLPMHPAAEDNYGYDACAVLCLPCVPNILVIATESGMLYHCVVLEGEEEDDHTSEKSWDSRIDLIPSLYVFECVELELALKLASGEDDPFDSDFSCPVKLHRDEEDKDSLQELSTEQKCFVEHILCTKPLPCRQPAPIRGFWIVPDILGPTMICITSTYECLIWPLLSTVHPASPPLLCTREDVEVAESPLRVLAETPDSFEKHIRSILQRSVANPAFLKASEKDIAPPPEECLQLLSRATQVFREQYILKQDLAKEEIQRRVKLLCDQKKKQLEDLSYCREERKSLREMAERLADKYEEAKEKQEDIMNRMKKLLHSFHSELPVLSDSERDMKKELQLIPDQLRHLGNAIKQVTMKKDYQQQKMEKVLSLPKPTIILSAYQRKCIQSILKEEGEHIREMVKQINDIRNHVNF

SEQ ID NO: 915152 - protein, 757 aa, Homo sapiens; identical to SEQ ID NO: 915139

SEQ ID NO: 915153 - protein, 799 aa, Homo sapiens
DKPTRHKTYLSSSWAKMAAAEGPVGDGELWQTWLPNHVVFLRLREGLKNQSPTEAEKPASSSLPSSPPPQLLTRNVVFGLGGELFLWDGEDSSFLVVRLRGPSGGGEEPALSQYQMEFRSCCPGWSAMAPSRLTATSTFQFQAILLPQPPRRELGLQRLLCINPPLFEIYQVLLSPTQHHVALIGIKGLMVLELPKRWGKNSEFEGGKSTVNCSTTPVAERFFTSSTSLTLKHAAWYPSEILDPHVVLLTSDNVIRIYSLREPQTPTNVIILSEAEEESLVLNKGRAYTASLGETAVAFDFGPLAAVPKTLFGQNGKDEVVAYPLYILYENGETFLTYISLLHSPGNIGKLLGPLPMHPAAEDNYGYDACAVLCLPCVPNILVIATESGMLYHCVVLEGEEEDDHTSEKSWDSRIDLIPSLYVFECVELELALKLASGEDDPFDSDFSCPVKLHRDPKCPSRYHCTHEAGVHSVGLTWIHKLHKFLGSDEEDKDSLQELSTEQKCFVEHILCTKPLPCRQPAPIRGFWIVPDILGPTMICITSTYECLIWPLLSTVHPASPPLLCTREDVEVAESPLRVLAETPDSFEKHIRSILQRSVANPAFLKASEKDIAPPPEECLQLLSRATQVFREQYILKQDLAKEEIQRRVKLLCDQKKKQLEDLSYCREERKSLREMAERLADKYEEAKEKQEDIMNRMKKLLHSFHSELPVLSDSERDMKKELQLIPDQLRHLGNAIKQVTMKKDYQQQKMEKVLSLPKPTIILSAYQRKCIQSILKEEGEHIREMVKQINDIRNHVNF

SEQ ID NO: 915154 - protein, 757 aa, Homo sapiens; identical to SEQ ID NO: 915139

SEQ ID NO: 915155 - protein, 737 aa, Homo sapiens
DKPTRHKTYLSSSWAKMAAAEGPVGDGELWQTWLPNHVVFLRLREGLKNQSPTEAEKPASSSLPSSPPPQLLTRNVVFGLGGELFLWDGEDSSFLVVRLRGPSGGGEEPALSQYQRLLCINPPLFEIYQVLLSPTQHHVALIGIKGLMVLELPKRWGKNSEFEGGKSTVNCSTTPVAERFFTSSTSLTLKHAAWYPSEILDPHVVLLTSDNVIRIYSLREPQTPTNVIILSEAEEESLVLNKGRAYTASLGETAVAFDFGPLAAVPKTLFGQNGKDEVVAYPLYILYENGETFLTYISLLHSPGNIGKLLGPLPMHPAAEDNYGYDACAVLCLPCVPNILVIATESGMLYHCVVLEGEEEDDHTSEKSWDSRIDLIPSLYVFECVELELALKLASGEDDPFDSDFSCPVKLHRDPKCPSRYHCTHEAGVHSVGLTWIHKLHKFLGSDEEDKDSLQELSTEQKCFVEHILCTKPLPCRQPAPIRGFWIVPDILGPTMICITSTYECLIWPLLSTVHPASPPLLCTREDVEVAESPLRVLAETPDSFEKHIRSILQRSVANPAFLKASEKDIAPPPEECLQLLSRATQVFREQYILKQDLAKEEIQRRVKLLCDQKKKQLEDLSYCREERKSLREMAERLADKYEEAKEKQEDIMNRMKKLLHSFHSELPVLSDSERDMKKELQLIPDQLRHLGNAIKQVTMKKDYQQQKMEKVLSLPKPTIILSAYQRKCIQSILKEE

SEQ ID NO: 915156 - protein, 248 aa, Homo sapiens
PSSRVQSRGGDAGWTREDVEVAESPLRVLAETPDSFEKHIRSILQRSVANPAFLKASEKDIAPPPEECLQLLSRATQVFREQYILKQDLAKEEIQRRVKLLCDQKKKQLEDLSYCREERKSLREMAERLADKYEEAKEKQEDIMNRMKKLLHSFHSELPVLSDSERDMKKELQLIPDQLRHLGNAIKQVTMKKDYQQQKMEKVLSLPKPTIILSAYQRKCIQSILKEEGEHIREMVKQINDIRNHVNF

SEQ ID NO: 915157 - protein, 277 aa, Homo sapiens
MICITSTYECLIWPLLSTVHPASPPLLCTREDVEVAESPLRVLAETPDSFEKHIRSILQRSVANPAFLNCFTQLRKIKVETLFLASEKDIAPPPEECLQLLSRATQVFREQYILKQDLAKEEIQRRVKLLCDQKKKQLEDLSYCREERKSLREMAERLADKYEEAKEKQEDIMNRMKKLLHSFHSELPVLSDSERDMKKELQLIPDQLRHLGNAIKQVTMKKDYQQQKMEKVLSLPKPTIILSAYQRKCIQSILKEEGEHIREMVKQINDIRNHVNF

SEQ ID NO: 915158 - protein, 557 aa, Homo sapiens
DKPTRHKTYLSSSWAKMAAAEGPVGDGELWQTWLPNHVVFLRLREGLKNQSPTEAEKPASSSLPSSPPPQLLTRNVVFGLGGELFLWDGEDSSFLVVRLRGPSGGGEEPALSQYQRLLCINPPLFEIYQVLLSPTQHHVALIGIKGLMVLELPKRWGKNSEFEGGKSTVNCSTTPVAERFFTSSTSLTLKHAAWYPSEILDPHVVLLTSDNVIRIYSLREPQTPTNVIILSEAEEESLVLNKGRAYTASLGETAVAFDFGPLAAVPKTLFGQNGKDEVVAYPLYILYENGETFLTYISLLHSPGNIGKLLGPLPMHPAAEDNYGYDACAVLCLPCVPNILVIATESGMLYHCVVLEGEEEDDHTSEKSWDSRIDLIPSLYVFECVELELALKLASGEDDPFDSDFSCPVKLHRDEEDKDSLQELSTEQKCFVEHILCTKPLPCRQPAPIRGFWIVPDILGPTMICITSTYECLIWPLLSTVHPASPPLLCTREDVEVAESPLRVLAETPDSFEKHIRSILQRSVANPAFLKASEKDIAPPLEDTRVFLQDVTRRREI

SEQ ID NO: 915159 - protein, 395 aa, Homo sapiens
DKPTRHKTYLSSSWAKMAAAEGPVGDGELWQTWLPNHVVFLRLREGLKNQSPTEAEKPASSSLPSSPPPQLLTRNVVFGLGGELFLWDGEDSSFLVVRLRGPSGGGEEPALSQYQRLLCINPPLFEIYQVLLSPTQHHVALIGIKGLMVLELPKRWGKNSEFEGGKSTVNCSTTPVAERFFTSSTSLTLKHAAWYPSEILDPHVVLLTSDNVIRIYSLREPQTPTNVIILSEAEEESLVLNKGRAYTASLGETAVAFDFGPLAAVPKTLFGQNGKDEVVAYPLYILYENGETFLTYISLLHSPGNIGKLLGPLPMHPAAEDNYGYDACAVLCLPCVPNILVIATESGMLYHCVVLEGEEEDDHTNETPTHTHMHTHTHTAHTQKIYCKEREKIKS

SEQ ID NO: 915160 - protein, 471 aa, Homo sapiens
MVLDSGAQAYDQAPPSPPTSPPSLRHRLKPSDRDGPPLYPWSQSLALPLALAVPPALQPQPEQQPFSQMLLGHRGHMRRSESTYSVNSTGRRGRGTLGRPPPGRGRNPGGGTLRPAASLPHIAKTQRDAGHIASKSPCMLVALRPTNMDRERDKFFQSHYTYNPQFEYQEPMPTAVLEKYCEASGQFIHQAVGIIEAVLEKFGTYEHFEAATGGQLLTKCQIWSIVRKYMQKEGCAGEVVVQLSEDLLSQAVMMVENSRPTLAINLTGARQYWLEGMLRHEIGTHYLRGVNNARQPWHNAEGRLRYGLRPANPTEEGLASLHSVLFRKQPFLWRAALLYYTIHRAARMSFRQLFQDLERYVQDADVRWEYCVRAKRGQTDTSLPGCFSKDQVYLDGIVRILRHRQTIDFPLLTSLGKVSYEDVDHLRPHGVLDNTRVPHFMQDLARYRQQLEHIMATNRLDEAELGRLLPD

SEQ ID NO: 915161 - protein, 471 aa, Homo sapiens; identical to SEQ ID NO: 915160

SEQ ID NO: 915162 - protein, 333 aa, Homo sapiens [sequence omitted]

SEQ ID NO: 915163 - protein, 471 aa, Homo sapiens; identical to SEQ ID NO: 915160

SEQ ID NO: 915164 - protein, 471 aa, Homo sapiens; identical to SEQ ID NO: 915160

SEQ ID NO: 915165 - protein, 488 aa, Homo sapiens
MPGTRSAESRCSRSLPSNTCPTRWRRRVWTTEGHAGLGLGPEAVVLLGPAPQCLSCSWTGRLQGPWLQWKLRWTSCRGGSTAWCWRRCRRSSSPCSRICPRANGCRALSSCKVCVNRTGRFCRDFWRVRNPTVQLLLAEAERAVVLQYLSALMQGRLVCRGADERTQAAERLRHDAAQLQQLFLSLVRASWAGRRARVSVAGWERGAGARPYPDVLQGLEENAHCAPVLLALRELLNLRDPALLGLEVAGLRQQFPDVSEDHVSALLGLRGDLSREQHLAALSSLQAALPPSPRASRRVLFSLVPAPALRRPPACPRGPAPEPCCSQNKPRLPDARVCVCWGRWDGIKVPRGLREFLQSDTLKVSWLPSWYTGCAPPMQASALCADCVPEAAGYAPTSPRPGREQESPPPWPPGAPEAQQLAVALGRGRAQDHEHRPLNPAWLRSQWPRGRAAAETDAKPHAFVRACARPRTYVIGDGSRRLGVRWPV

SEQ ID NO: 915166 - protein, 488 aa, Homo sapiens; identical to SEQ ID NO: 915165

SEQ ID NO: 915167 - protein, 471 aa, Homo sapiens; identical to SEQ ID NO: 915160

SEQ ID NO: 915168 - protein, 471 aa, Homo sapiens; identical to SEQ ID NO: 915160

SEQ ID NO: 915169 - protein, 205 aa, Homo sapiens
GPRTPRPAPPPLAFPAGTHYLRGVNNARQPWHNAEGRLRYGLRPANPTEEGLASLHSVLFRKQPFLWRAALLYYTIHRAARMSFRQLFQDLERYVQDADVRWEYCVRAKRGQTDTSLPGCFSKDQVYLDGIVRILRHRQTIDFPLLTSLGKVSYEDVDHLRPHGVLDNTRVPHFMQDLARYRQQLEHIMATNRLDEAELGRLLPD

SEQ ID NO: 915170 - protein, 471 aa, Homo sapiens; identical to SEQ ID NO: 915160

SEQ ID NO: 915171 - protein, 105 aa, Homo sapiens
LRKTNLGWVRGSVFNRPRGCFSKDQVYLDGIVRILRHRQTIDFPLLTSLGKVSYEDVDHLRPHGVLDNTRVPHFMQDLARYRQQLEHIMATNRLDEAELGRLLPD

SEQ ID NO: 915172 - protein, 183 aa, Homo sapiens
MLDRLSGKILHIDFGDCFEVAMTREKFPEKIPFRLTRMLTNAMEVTGLDGNYRITCHTVMEVLREHKDSVMAVLEAFVYDPLLNWRLMDTNTKGNKRSRTRTDSYSAGQSVGVQKENVRYSGRLKKHRKHYRIDHNLREIVREQETLPWSLRVLSCGVGLWRFRKGDFTVNRSCEESTWVGGI

SEQ ID NO: 915173 - protein, 2549 aa, Homo sapiens
MLGTGPAAATTAATTSSNVSVLQQFASGLKSRNEETRAKAAKELQHYVTMELREMSQEESTRFYDQLNHHIFELVSSSDANERKGGILAIASLIGVEGGNATRIGRFANYLRNLLPSNDPVVMEMASKAIGRLAMAGDTFTAEYVEFEVKRALEWLGADRNEGRRHAAVLVLRELAISVPTFFFQQVQPFFDNIFVAVWDPKQAIREGAVAALRACLILTTQREPKEMQKPQWYRHTFEEAEKGFDETLAKEKGMNRDDRIHGALLILNELVRISSMEGERLREEMEEITQQQLVHDKYCKDLMGFGTKPRHITPFTSFQAVQPQQSNALVGLLGYSSHQGLMGFGTSPSPAKSTLVESRCCRDLMEEKFDQVCQWVLKCRNSKNSLIQMTILNLLPRLAAFRPSAFTDTQYLQDTMNHVLSCVKKEKERTAAFQALGLLSVAVRSEFKVYLPRVLDIIRAALPPKDFAHKRQKAMQVDATVFTCISMLARAMGPGIQQDIKELLEPMLAVGLSPALTAVLYDLSRQIPQLKKDIQDGLLKMLSLVLMHKPLRHPGMPKGLAHQLASPGLTTLPEASDVGSITLALRTLGSFEFEGHSLTQFVRHCADHFLNSEHKEIRMEAARTCSRLLTPSIHLISGHAHVVSQTAVQVVADVLSKLLVVGITDPDPDIRYCVLASLDERFDAHLAQAENLQALFVALNDQVFEIRELAICTVGRLSSMNPAFVMPFLRKMLIQILTELEHSGIGRIKEQSARMLGHLVSNAPRLIRPYMEPILKALILKLKDPDPDPNPGVINNVLATIGELAQVSGLEMRKWVDELFIIIMDMLQDSSLLAKRQVALWTLGQLVASTGYVVEPYRKYPTLLEVLLNFLKTEQNQGTRREAIRVLGLLGALDPYKHKVNIGMIDQSRDASAVSLSESKSSQDSSDYSTSEMLVNMGNLPLDEFYPAVSMVALMRIFRDQSLSHHHTMVVQAITFIFKSLGLKCVQFLPQVMPTFLNVIRVCDGAIREFLFQQLGMLVSFVKSHIRPYMDEIVTLMREFWVMNTSIQSTIILLIEQIVVALGGEFKLYLPQLIPHMLRVFMHDNSPGRIVSIKLLAAIQLFGANLDDYLHLLLPPIVKLFDAPEAPLPSRKAALETVDRLTESLDFTDYASRIIHPIVRTLDQSPELRSTAMDTLSSLVFQLGKKYQIFIPMVNKVLVRHRINHQRYDVLICRIVKGYTLADEEEDPLIYQHRMLRSGQGDALASGPVETGPMKKLHVSTINLQKAWGAARRVSKDDWLEWLRRLSLELLKDSSSPSLRSCWALAQAYNPMARDLFNAAFVSCWSELNEDQQDELIRSIELALTSQDIAEVTQTLLNLAEFMEHSDKGPLPLRDDNGIVLLGERAAKCRAYAKALHYKELEFQKGPTPAILESLISINNKLQQPEAAAGVLEYAMKHFGELEIQATWYEKLHEWEDALVAYDKKMDTNKDDPELMLGRMRCLEALGEWGQLHQQCCEKWTLVNDETQAKMARMAAAAAWGLGQWDSMEEYTCMIPRDTHDGAFYRAVLALHQDLFSLAQQCIDKARDLLDAELTAMAGESYSRAYGAMVSCHMLSELEEVIQYKLVPERREIIRQIWWERLQGCQRIVEDWQKILMVRSLVVSPHEDMRTWLKYASLCGKSGRLALAHKTLVLLLGVDPSRQLDHPLPTVHPQVTYAYMKNMWKSARKIDAFQHMQHFVQTMQQQAQHAIATEDQQHKQELHKLMARCFLKLGEWQLNLQGINESTIPKVLQYYSAATEHDRSWYKAWHAWAVMNFEAVLHYKHQNQARDEKKKLRHASGANITNATTAATTAATATTTASTEGSNSESEAESTENSPTPSPLQKKVTEDLSKTLLMYTVPAVQGFFRSISLSRGNNLQDTLRVLTLWFDYGHWPDVNEALVEGVKAIQIDTWLQVIPQLIARIDTPRPLVGRLIHQLLTDIGRYHPQALIYPLTVASKSTTTARHNAANKILKNMCEHSNTLVQQAMMVSEELIRVAILWHEMWHEGLEEASRLYFGERNVKGMFEVLEPLHAMMERGPQTLKETSFNQAYGRDLMEAQEWCRKYMKSGNVKDLTQAWDLYYHVFRRISKQLPQLTSLELQYVSPKLLMCRDLELAVPGTYDPNQPIIRIQSIAPSLQVITSKQRPRKLTLMGSNGHEFVFLLKGHEDLRQDERVMQLFGLVNTLLANDPTSLRKNLSIQRYAVIPLSTNSGLIGWVPHCDTLHALIRDYREKKKILLNIEHRIMLRMAPDYDHLTLMQKVEVFEHAVNNTAGDDLAKLLWLKSPSSEVWFDRRTNYTRSLAVMSMVGYILGLGDRHPSNLMLDRLSGKILHIDFGDCFEVAMTREKFPEKIPFRLTRMLTNAMEVTGLDGNYRITCHTVMEVLREHKDSVMAVLEAFVYDPLLNWRLMDTNTKGNKRSRTRTDSYSAGQSVEILDGVELGEPAHKKTGTTVPESIHSFIGDGLVKPEALNKKAIQIINRVRDKLTGRDFSHDDTLDVPTQVELLIKQATSHENLCQCYIGWCPFW

SEQ ID NO: 915174 - protein, 205 aa, Homo sapiens
MLDRLSGKILHIDFGDCFEVAMTREKFPEKIPFRLTRMLTNAMEVTGLDGNYRITCHTVMEVLREHKDSVMAVLEAFVYDPLLNWRLMDTNTKGNKRSRTRTDSYSAGQSVEILDGVELGEPAHKKTGTTVPESIHSFIGDGLVKPEALNKKAIQIINRVRDKLTGRDFSHDDTLDVPTQVELLIKQATSHENLCQCYIGWCPFW

SEQ ID NO: 915175 - protein, 2278 aa, Homo sapiens
MLGTGPAAATTAATTSSNVSVLQQFASGLKSRNEETRAKAAKELQHYVTMELREMSQEESTRFYDQLNHHIFELVSSSDANERKGGILAIASLIGVEGGNATRIGRFANYLRNLLPSNDPVVMEMASKAIGRLAMAGDTFTAEYVEFEVKRALEWLGADRNEGRRHAAVLVLRELAISVPTFFFQQVQPFFDNIFVAVWDPKQAIREGAVAALRACLILTTQREPKEMQKPQWYRHTFEEAEKGFDETLAKEKGMNRDDRIHGALLILNELVRISSMEGERLREEMEEITQQQLVHDKYCKDLMGFGTKPRHITPFTSFQAVQPQQSNALVGLLGYSSHQGLMGFGTSPSPAKSTLVESRCCRDLMEEKFDQVCQWVLKCRNSKNSLIQMTILNLLPRLAAFRPSAFTDTQYLQDTMNHVLSCVKKEKERTAAFQALGLLSVAVRSEFKVYLPRVLDIIRAALPPKDFAHKRQKAMQVDATVFTCISMLARAMGPGIQQDIKELLEPMLAVGLSPALTAVLYDLSRQIPQLKKDIQDGLLKMLSLVLMHKPLRHPGMPKGLAHQLASPGLTTLPEASDVGSITLALRTLGSFEFEGHSLTQFVRHCADHFLNSEHKEIRMEAARTCSRLLTPSIHLISGHAHVVSQTAVQVVADVLSKLLVVGITDPDPDIRYCVLASLDERFDAHLAQAENLQALFVALNDQVFEIRELAICTVGRLSSMNPAFVMPFLRKMLIQILTELEHSGIGRIKEQSARMLGHLVSNAPRLIRPYMEPILKALILKLKDPDPDPNPGVINNVLATIGELAQVSGLEMRKWVDELFIIIMDMLQDSSLLAKRQVALWTLGQLVASTGYVVEPYRKYPTLLEVLLNFLKTEQNQGTRREAIRVLGLLGALDPYKHKVNIGMIDQSRDASAVSLSESKSSQDSSDYSTSEMLVNMGNLPLDEFYPAVSMVALMRIFRDQSLSHHHTMVVQAITFIFKSLGLKCVQFLPQVMPTFLNVIRVCDGAIREFLFQQLGMLVSFVKSHIRPYMDEIVTLMREFWVMNTSIQSTIILLIEQIVVALGGEFKLYLPQLIPHMLRVFMHDNSPGRIVSIKLLAAIQLFGANLDDYLHLLLPPIVKLFDAPEAPLPSRKAALETVDRLTESLDFTDYASRIIHPIVRTLDQSPELRSTAMDTLSSLVFQLGKKYQIFIPMVNKVLVRHRINHQRYDVLICRIVKGYTLADEEEDPLIYQHRMLRSGQGDALASGPVETGPMKKLHVSTINLQKAWGAARRVSKDDWLEWLRRLSLELLKDSSSPSLRSCWALAQAYNPMARDLFNAAFVSCWSELNEDQQDELIRSIELALTSQDIAEVTQTLLNLAEFMEHSDKGPLPLRDDNGIVLLGERAAKCRAYAKALHYKELEFQKGPTPAILESLISINNKLQQPEAAAGVLEYAMKHFGELEIQATWYEKLHEWEDALVAYDKKMDTNKDDPELMLGRMRCLEALGEWGQLHQQCCEKWTLVNDETQAKMARMAAAAAWGLGQWDSMEEYTCMIPRDTHDGAFYRAVLALHQDLFSLAQQCIDKARDLLDAELTAMAGESYSRAYGAMVSCHMLSELEEVIQYKLVPERREIIRQIWWERLQGCQRIVEDWQKILMVRSLVVSPHEDMRTWLKYASLCGKSGRLALAHKTLVLLLGVDPSRQLDHPLPTVHPQVTYAYMKNMWKSARKIDAFQHMQHFVQTMQQQAQHAIATEDQQHKQELHKLMARCFLKLGEWQLNLQGINESTIPKVLQYYSAATEHDRSWYKAWHAWAVMNFEAVLHYKHQNQARDEKKKLRHASGANITNATTAATTAATATTTASTEGSNSESEAESTENSPTPSPLQKKVTEDLSKTLLMYTVPAVQGFFRSISLSRGNNLQDTLRVLTLWFDYGHWPDVNEALVEGVKAIQIDTWLQVIPQLIARIDTPRPLVGRLIHQLLTDIGRYHPQALIYPLTVASKSTTTARHNAANKILKNMCEHSNTLVQQAMMVSEELIRVAILWHEMWHEGLEEASRLYFGERNVKGMFEVLEPLHAMMERGPQTLKETSFNQAYGRDLMEAQEWCRKYMKSGNVKDLTQAWDLYYHVFRRISKQLPQLTSLELQYVSPKLLMCRDLELAVPGTYDPNQPIIRIQSIAPSLQVITSKQRPRKLTLMGSNGHEFVFLLKGHEDLRQDERVMQLFGLVNTLLANDPTSLRKNLSIQRYAVIPLSTNSGLIGWLGYMFLAQPIQGPGTSEVLGKHIAALRCELGSCFEIRRH

SEQ ID NO: 915176 - protein, 1949 aa, Homo sapiens
MLGTGPAAATTAATTSSNVSVLQQFASGLKSRNEETRAKAAKELQHYVTMELREMSQEESTRFYDQLNHHIFELVSSSDANERKGGILAIASLIGVEGGNATRIGRFANYLRNLLPSNDPVVMEMASKAIGRLAMAGDTFTAEYVEFEVKRALEWLGADRNEGRRHAAVLVLRELAISVPTFFFQQVQPFFDNIFVAVWDPKQAIREGAVAALRACLILTTQREPKEMQKPQWYRHTFEEAEKGFDETLAKEKGMNRDDRIHGALLILNELVRISSMEGERLREEMEEITQQQLVHDKYCKDLMGFGTKPRHITPFTSFQAVQPQQSNALVGLLGYSSHQGLMGFGTSPSPAKSTLVESRCCRDLMEEKFDQVCQWVLKCRNSKNSLIQMTILNLLPRLAAFRPSAFTDTQYLQDTMNHVLSCVKKEKERTAAFQALGLLSVAVRSEFKVYLPRVLDIIRAALPPKDFAHKRQKAMQVDATVFTCISMLARAMGPGIQQDIKELLEPMLAVGLSPALTAVLYDLSRQIPQLKKDIQDGLLKMLSLVLMHKPLRHPGMPKGLAHQLASPGLTTLPEASDVGSITLALRTLGSFEFEGHSLTQFVRHCADHFLNSEHKEIRMEAARTCSRLLTPSIHLISGHAHVVSQTAVQVVADVLSKLLVVGITDPDPDIRYCVLASLDERFDAHLAQAENLQALFVALNDQVFEIRELAICTVGRLSSMNPAFVMPFLRKMLIQILTELEHSGIGRIKEQSARMLGHLVSNAPRLIRPYMEPILKALILKLKDPDPDPNPGVINNVLATIGELAQVSGLEMRKWVDELFIIIMDMLQDSSLLAKRQVALWTLGQLVASTGYVVEPYRKYPTLLEVLLNFLKTEQNQGTRREAIRVLGLLGALDPYKHKVNIGMIDQSRDASAVSLSESKSSQDSSDYSTSEMLVNMGNLPLDEFYPAVSMVALMRIFRDQSLSHHHTMVVQAITFIFKSLGLKCVQFLPQVMPTFLNVIRVCDGAIREFLFQQLGMLVSFVKSHIRPYMDEIVTLMREFWVMNTSIQSTIILLIEQIVVALGGEFKLYLPQLIPHMLRVFMHDNSPGRIVSIKLLAAIQLFGANLDDYLHLLLPPIVKLFDAPEAPLPSRKAALETVDRLTESLDFTDYASRIIHPIVRTLDQSPELRSTAMDTLSSLVFQLGKKYQIFIPMVNKVLVRHRINHQRYDVLICRIVKGYTLADEEEDPLIYQHRMLRSGQGDALASGPVETGPMKKLHVSTINLQKAWGAARRVSKDDWLEWLRRLSLELLKDSSSPSLRSCWALAQAYNPMARDLFNAAFVSCWSELNEDQQDELIRSIELALTSQDIAEVTQTLLNLAEFMEHSDKGPLPLRDDNGIVLLGERAAKCRAYAKALHYKELEFQKGPTPAILESLISINNKLQQPEAAAGVLEYAMKHFGELEIQATWYEKLHEWEDALVAYDKKMDTNKDDPELMLGRMRCLEALGEWGQLHQQCCEKWTLVNDETQAKMARMAAAAAWGLGQWDSMEEYTCMIPRDTHDGAFYRAVLALHQDLFSLAQQCIDKARDLLDAELTAMAGESYSRAYGAMVSCHMLSELEEVIQYKLVPERREIIRQIWWERLQGCQRIVEDWQKILMVRSLVVSPHEDMRTWLKYASLCGKSGRLALAHKTLVLLLGVDPSRQLDHPLPTVHPQVTYAYMKNMWKSARKIDAFQHMQHFVQTMQQQAQHAIATEDQQHKQELHKLMARCFLKLGEWQLNLQGINESTIPKVLQYYSAATEHDRSWYKAWHAWAVMNFEAVLHYKHQNQARDEKKKLRHASGANITNATTAATTAATATTTASTEGSNSESEAESTENSPTPSPLQKKVTEDLSKTLLMYTVPAVQGFFRSISLSRGNNLQDTLRVLTLWFDYGHWPDVNEALVEGVKAIQIDTWLQVIHQLIARIDVL

SEQ ID NO: 915177 - protein, 1707 aa, Homo sapiens
MLGTGPAAATTAATTSSNVSVLQQFASGLKSRNEETRAKAAKELQHYVTMELREMSQEESTRFYDQLNHHIFELVSSSDANERKGGILAIASLIGVEGGNATRIGRFANYLRNLLPSNDPVVMEMASKAIGRLAMAGDTFTAEYVEFEVKRALEWLGADRNEGRRHAAVLVLRELAISVPTFFFQQVQPFFDNIFVAVWDPKQAIREGAVAALRACLILTTQREPKEMQKPQWYRHTFEEAEKGFDETLAKEKGMNRDDRIHGALLILNELVRISSMEGERLREEMEEITQQQLVHDKYCKDLMGFGTKPRHITPFTSFQAVQPQQSNALVGLLGYSSHQGLMGFGTSPSPAKSTLVESRCCRDLMEEKFDQVCQWVLKCRNSKNSLIQMTILNLLPRLAAFRPSAFTDTQYLQDTMNHVLSCVKKEKERTAAFQALGLLSVAVRSEFKVYLPRVLDIIRAALPPKDFAHKRQKAMQVDATVFTCISMLARAMGPGIQQDIKELLEPMLAVGLSPALTAVLYDLSRQIPQLKKDIQDGLLKMLSLVLMHKPLRHPGMPKGLAHQLASPGLTTLPEASDVGSITLALRTLGSFEFEGHSLTQFVRHCADHFLNSEHKEIRMEAARTCSRLLTPSIHLISGHAHVVSQTAVQVVADVLSKLLVVGITDPDPDIRYCVLASLDERFDAHLAQAENLQALFVALNDQVFEIRELAICTVGRLSSMNPAFVMPFLRKMLIQILTELEHSGIGRIKEQSARMLGHLVSNAPRLIRPYMEPILKALILKLKDPDPDPNPGVINNVLATIGELAQVSGLEMRKWVDELFIIIMDMLQDSSLLAKRQVALWTLGQLVASTGYVVEPYRKYPTLLEVLLNFLKTEQNQGTRREAIRVLGLLGALDPYKHKVNIGMIDQSRDASAVSLSESKSSQDSSDYSTSEMLVNMGNLPLDEFYPAVSMVALMRIFRDQSLSHHHTMVVQAITFIFKSLGLKCVQFLPQVMPTFLNVIRVCDGAIREFLFQQLGMLVSFVKSHIRPYMDEIVTLMREFWVMNTSIQSTIILLIEQIVVALGGEFKLYLPQLIPHMLRVFMHDNSPGRIVSIKLLAAIQLFGANLDDYLHLLLPPIVKLFDAPEAPLPSRKAALETVDRLTESLDFTDYASRIIHPIVRTLDQSPELRSTAMDTLSSLVFQLGKKYQIFIPMVNKVLVRHRINHQRYDVLICRIVKGYTLADEEEDPLIYQHRMLRSGQGDALASGPVETGPMKKLHVSTINLQKAWGAARRVSKDDWLEWLRRLSLELLKDSSSPSLRSCWALAQAYNPMARDLFNAAFVSCWSELNEDQQDELIRSIELALTSQDIAEVTQTLLNLAEFMEHSDKGPLPLRDDNGIVLLGERAAKCRAYAKALHYKELEFQKGPTPAILESLISINNKLQQPEAAAGVLEYAMKHFGELEIQATWYEKLHEWEDALVAYDKKMDTNKDDPELMLGRMRCLEALGEWGQLHQQCCEKWTLVNDETQAKMARMAAAAAWGLGQWDSMEEYTCMIPRDTHDGAFYRAVLALHQDLFSLAQQCIDKARDLLDAELTAMAGESYSRAYGAMVSCHMLSELEEVIQYKLVPERREIIRQIWWERLQGCQRIVEDWQKILMVRSLVVSPHEDMRTWLKYASLCGKSGRLGSENRNTVMEVLNTGKVWYILEIMSRTNTQLNAQSIKCSHV

SEQ ID NO: 915178 - protein, 2549 aa, Homo sapiens; identical to SEQ ID NO: 915173

SEQ ID NO: 915179 - protein, 754 aa, Homo sapiens
MNFEAVLHYKHQNQARDEKKKLRHASGANITNATTAATTAATATTTASTEGSNSESEAESTENSPTPSPLQKKVTEDLSKTLLMYTVPAVQGFFRSISLSRGNNLQDTLRVLTLWFDYGHWPDVNEALVEGVKAIQIDTWLQVIPQLIARIDTPRPLVGRLIHQLLTDIGRYHPQALIYPLTVASKSTTTARHNAANKILKNMCEHSNTLVQQAMMVSEELIRVAILWHEMWHEGLEEASRLYFGERNVKGMFEVLEPLHAMMERGPQTLKETSFNQAYGRDLMEAQEWCRKYMKSGNVKDLTQAWDLYYHVFRRISKQLPQLTSLELQYVSPKLLMCRDLELAVPGTYDPNQPIIRIQSIAPSLQVITSKQRPRKLTLMGSNGHEFVFLLKGHEDLRQDERVMQLFGLVNTLLANDPTSLRKNLSIQRYAVIPLSTNSGLIGWVPHCDTLHALIRDYREKKKILLNIEHRIMLRMAPDYDHLTLMQKVEVFEHAVNNTAGDDLAKLLWLKSPSSEVWFDRRTNYTRSLAVMSMVGYILGLGDRHPSNLMLDRLSGKILHIDFGDCFEVAMTREKFPEKIPFRLTRMLTNAMEVTGLDGNYRITCHTVMEVLREHKDSVMAVLEAFVYDPLLNWRLMDTNTKGNKRSRTRTDSYSAGQSVEILDGVELGEPAHKKTGTTVPESIHSFIGDGLVKPEALNKKAIQIINRVRDKLTGRDFSHDDTLDVPTQVELLIKQATSHENLCQCYIGWCPFW

SEQ ID NO: 915180 - protein, 146 aa, Homo sapiens
MEVLREHKDSVMAVLEAFVYDPLLNWRLMDTNTKGNKRSRTRTDSYSAGQSVEILDGVELGEPAHKKTGTTVPESIHSFIGDGLVKPEALNKKAIQIINRVRDKLTGRDFSHDDTLDVPTQVELLIKQATSHENLCQCYIGWCPFW

SEQ ID NO: 915181 - protein, 1944 aa, Homo sapiens
MLGTGPAAATTAATTSSNVSVLQQFASGLKSRNEETRAKAAKELQHYVTMELREMSQEESTRFYDQLNHHIFELVSSSDANERKGGILAIASLIGVEGGNATRIGRFANYLRNLLPSNDPVVMEMASKAIGRLAMAGDTFTAEYVEFEVKRALEWLGADRNEGRRHAAVLVLRELAISVPTFFFQQVQPFFDNIFVAVWDPKQAIREGAVAALRACLILTTQREPKEMQKPQWYRHTFEEAEKGFDETLAKEKGMNRDDRIHGALLILNELVRISSMEGERLREEMEEITQQQLVHDKYCKDLMGFGTKPRHITPFTSFQAVQPQQSNALVGLLGYSSHQGLMGFGTSPSPAKSTLVESRCCRDLMEEKFDQVCQWVLKCRNSKNSLIQMTILNLLPRLAAFRPSAFTDTQYLQDTMNHVLSCVKKEKERTAAFQALGLLSVAVRSEFKVYLPRVLDIIRAALPPKDFAHKRQKAMQVDATVFTCISMLARAMGPGIQQDIKELLEPMLAVGLSPALTAVLYDLSRQIPQLKKDIQDGLLKMLSLVLMHKPLRHPGMPKGLAHQLASPGLTTLPEASDVGSITLALRTLGSFEFEGHSLTQFVRHCADHFLNSEHKEIRMEAARTCSRLLTPSIHLISGHAHVVSQTAVQVVADVLSKLLVVGITDPDPDIRYCVLASLDERFDAHLAQAENLQALFVALNDQVFEIRELAICTVGRLSSMNPAFVMPFLRKMLIQILTELEHSGIGRIKEQSARMLGHLVSNAPRLIRPYMEPILKALILKLKDPDPDPNPGVINNVLATIGELAQVSGLEMRKWVDELFIIIMDMLQDSSLLAKRQVALWTLGQLVASTGYVVEPYRKYPTLLEVLLNFLKTEQNQGTRREAIRVLGLLGALDPYKHKVNIGMIDQSRDASAVSLSESKSSQDSSDYSTSEMLVNMGNLPLDEFYPAVSMVALMRIFRDQSLSHHHTMVVQAITFIFKSLGLKCVQFLPQVMPTFLNVIRVCDGAIREFLFQQLGMLVSFVKSHIRPYMDEIVTLMREFWVMNTSIQSTIILLIEQIVVALGGEFKLYLPQLIPHMLRVFMHDNSPGRIVSIKLLAAIQLFGANLDDYLHLLLPPIVKLFDAPEAPLPSRKAALETVDRLTESLDFTDYASRIIHPIVRTLDQSPELRSTAMDTLSSLVFQLGKKYQIFIPMVNKVLVRHRINHQRYDVLICRIVKGYTLADEEEDPLIYQHRMLRSGQGDALASGPVETGPMKKLHVSTINLQKAWGAARRVSKDDWLEWLRRLSLELLKDSSSPSLRSCWALAQAYNPMARDLFNAAFVSCWSELNEDQQDELIRSIELALTSQDIAEVTQTLLNLAEFMEHSDKGPLPLRDDNGIVLLGERAAKCRAYAKALHYKELEFQKGPTPAILESLISINNKLQQPEAAAGVLEYAMKHFGELEIQATWYEKLHEWEDALVAYDKKMDTNKDDPELMLGRMRCLEALGEWGQLHQQCCEKWTLVNDETQAKMARMAAAAAWGLGQWDSMEEYTCMIPRDTHDGAFYRAVLALHQDLFSLAQQCIDKARDLLDAELTAMAGESYSRAYGAMVSCHMLSELEEVIQYKLVPERREIIRQIWWERLQGCQRIVEDWQKILMVRSLVVSPHEDMRTWLKYASLCGKSGRLALAHKTLVLLLGVDPSRQLDHPLPTVHPQVTYAYMKNMWKSARKIDAFQHMQHFVQTMQQQAQHAIATEDQQHKQELHKLMARCFLKLGEWQLNLQGINESTIPKVLQYYSAATEHDRSWYKAWHAWAVMNFEAVLHYKHQNQARDEKKKLRHASGANITNATTAATTAATATTTASTEGSNSESEAESTENSPTPSPLQKKVTEDLSKTLLMYTVPAVQGFFRSISLSRGNNLQDTLRVLTLWFDYGHWPDVNEALVEGVKAIQIDTWLQVRILGYR

SEQ ID NO: 915182 - protein, 101 aa, Homo sapiens
MLCLKSRHAMCSSNTLCCFVLADYSTSEMLVNMGNLPLDEFYPAVSMVALMRIFRDQSLSHHHTMVVQAITFIFKSLGLKCVQFLPQVMPTFLNVIRVCDG

SEQ ID NO: 915183 - protein, 338 aa, Homo sapiens
MDPETRGQEIIKVTPLQQMLASCTGAILTSVIVTPLDVVKIRLQAQNNPLPKGKCFVYSNGLMDHLCVCEEGGNKLWYKKPGNFQGTLDAFFKIIRNEGIKSLWSGLPPTLVMAVPATVIYFTCYDQLSALLRSKLGENETCIPIVAGIVARFGAVTVISPLELIRTKMQSKKFSYVELHRFVSKKVSEDGWISLWRGWAPTVLRDVPFSAMYWYNYEILKKWLCEKSGLYEPTFMINFTSGALSGSFAAVATLPFDVVKTQKQTQLWTYESHKISMPLHMSTWIIMKNIVAKNGFSGLFSGLIPRLIKIAPACAIMISTYEFGKAFFQKQNVRRQQY

SEQ ID NO: 915184 - protein, 248 aa, Homo sapiens
MDPETRGQEIIKVTPLQQMLASCTGAILTSVIVTPLDVVKIRLQAQNNPLPKGKCFVYSNGLMDHLCVCEEGGNKLWYKKPGNFQGTLDAFFKIIRNEGIKSLWSGLPPTLVMAVPATVIYFTCYDQLSALLRSKLGENETCIPIVAGIVARFGAVTVISPLELIRTKMQSKKFSYVELHRFVSKKVSEDGWISLWRGWAPTVLRDVPFSAMYWYNYEILKKWLCEKSGLYEPTFMINFTSGALSGSE

SEQ ID NO: 915185 - protein, 338 aa, Homo sapiens; identical to SEQ ID NO: 915183

SEQ ID NO: 915186 - protein, 338 aa, Homo sapiens; identical to SEQ ID NO: 915183

SEQ ID NO: 915187 - protein, 167 aa, Homo sapiens
MDPETRGQEIIKVTPLQQMLASCTGAILTSVIVTPLDVVKIRLQAQNNPLPKGKCFVYSNGLMDHLCVCEEGGNKLWYKKPGNFQGTLDAFFKIIRNEGIKSLWSGLPPTLVMAVPATVIYFTCYDQLSALLRSKLGENETCIPIVAGIVARFFLRGTASICQQESI

SEQ ID NO: 915188 - protein, 338 aa, Homo sapiens; identical to SEQ ID NO: 915183

SEQ ID NO: 915189 - protein, 323 aa, Homo sapiens
MDPETRGQEIIKVTPLQQMLASCTGAILTSVIVTPLDVVKIRLQAQNNPLPKGKCFVYSNGLMDHLCVCEEGGNKLWYKKPGNFQGTLDAFFKIIRNEGIKSLWSGLPPTLVMAVPATVIYFTCYDQLSALLRSKLGVGAVTVISPLELIRTKMQSKKFSYVELHRFVSKKVSEDGWISLWRGWAPTVLRDVPFSAMYWYNYEILKKWLCEKSGLYEPTFMINFTSGALSGSFAAVATLPFDVVKTQKQTQLWTYESHKISMPLHMSTWIIMKNIVAKNGFSGLFSGLIPRLIKIAPACAIMISTYEFGKAFFQKQNVRRQQY

SEQ ID NO: 915190 - protein, 534 aa, Homo sapiens
MFSWVSKDARRKKEPELFQTVAEGLRQLYAQKLLPLEEHYRFHEFHSPALEDADFDNKPMVLLVGQYSTGKTTFIRHLIEQDFPGMRIGPEPTTDSFIAVMHGPTEGVVPGNALVVDPRRPFRKLNAFGNAFLNRFMCAQLPNPVLDSISIIDTPGILSGEKQRISRGYDFAAVLEWFAERVDRIILLFDAHKLDISDEFSEVIKALKNHEDKIRVVLNKADQIETQQLMRVYGALMWSLGKIINTPEVVRVYIGSFWSHPLLIPDNRKLFEAEEQDLFKDIQSLPRNAALRKLNDLIKRARLAKVHAYIISSLKKEMPNVFGKESKKKELVNNLGEIYQKIEREHQISPGDFPSLRKMQELLQTQDFSKFQALKPKLLDTVDDMLANDIARLMVMVRQEESLMPSQVVKGGAFDGTMNGPFGHGYGEGAGEGIDDVEWVVGKDKPTYDEIFYTLSPVNGKITGANAKKEMVKSKLPNTVLGKIWKLADVDKDGLLDDEEFALANHLIKVKLEGHELPADLPPHLVPPSKRRHE

SEQ ID NO: 915191 - protein, 535 aa, Homo sapiens
MFSWVSKDARRKKEPELFQTVAEGLRQLYAQKLLPLEEHYRFHEFHSPALEDADFDNKPMVLLVGQYSTGKTTFIRHLIEQDFPGMRIGPEPTTDSFIAVMHGPTEGVVPGNALVVDPRRPFRKLNAFGNAFLNRFMCAQLPNPVLDSISIIDTPGILSGEKQRISRGYDFAAVLEWFAERVDRIILLFDAHKLDISDEFSEVIKALKNHEDKIRVVLNKADQIETQQLMRVYGALMWSLGKIINTPEVVRVYIGSFWSHPLLIPDNRKLFEAEEQDLFKDIQSLPRNAALRKLNDLIKRARLAKVHAYIISSLKKEMPNVFGKESKKKELVNNLGEIYQKIEREHQISPGDFPSLRKMQELLQTQDFSKFQALKPKLLDTVDDMLANDIARLMVMVRQEESLMPSQVVKGGAFDGTMNGPFGHGYGEGAGEGIDDVEWVVGKDKPTYDEIFYTLSPVNGKITGANAKKEMVKSKLPNTVLGKIWKLADVDKDGLLDDEEFALANHLIKVKLEGHELPADLPPHLVPPPSSAWGH

SEQ ID NO: 915192 - protein, 534 aa, Homo sapiens; identical to SEQ ID NO: 915190

SEQ ID NO: 915193 - protein, 407 aa, Homo sapiens
MFSWVSKDARRKKEPELFQTVAEGLRQLYAQKLLPLEEHYRFHEFHSPALEDADFDNKPMVLLVGQYSTGKTTFIRHLIEQDFPGMRIGPEPTTDSFIAVMHGPTEGVVPGNALVVDPRRPFRKLNAFGNAFLNRFMCAQLPNPVLDSISIIDTPGILSGEKQRISRGYDFAAVLEWFAERVDRIILLFDAHKLDISDEFSEVIKALKNHEDKIRVVLNKADQIETQQLMRVYGALMWSLGKIINTPEVVRVYIGSFWSHPLLIPDNRKLFEAEEQDLFKDIQSLPRNAALRKLNDLIKRARLAKVHAYIISSLKKEMPNVFGKESKKKELVNNLGEIYQKIEREHQISPGDFPSLRKMQELLQTQDFSKFQALKPKLLDTVDDMLANARPGGRDGGRGSLTISQGP

SEQ ID NO: 915194 - protein, 534 aa, Homo sapiens; identical to SEQ ID NO: 915190

SEQ ID NO: 915195 - protein, 534 aa, Homo sapiens; identical to SEQ ID NO: 915190

SEQ ID NO: 915196 - protein, 274 aa, Homo sapiens
LPLPASRYPVSVHIDSLLWLLPSSLPRNAALRKLNDLIKRARLAKVHAYIISSLKKEMPNVFGKESKKKELVNNLGEIYQKIEREHQISPGDFPSLRKMQELLQTQDFSKFQALKPKLLDTVDDMLANDIARLMVMVRQEESLMPSQVVKGGAFDGTMNGPFGHGYGEGAGEGIDDVEWVVGKDKPTYDEIFYTLSPVNGKITGANAKKEMVKSKLPNTVLGKIWKLADVDKDGLLDDEEFALANHLIKVKLEGHELPADLPPHLVPPSKRRHE

SEQ ID NO: 915197 - protein, 534 aa, Homo sapiens; identical to SEQ ID NO: 915190

SEQ ID NO: 915198 - protein, 534 aa, Homo sapiens; identical to SEQ ID NO: 915190

SEQ ID NO: 915199 - protein, 534 aa, Homo sapiens; identical to SEQ ID NO: 915190

SEQ ID NO: 915200 - protein, 367 aa, Homo sapiens
MFSWVSKDARRKKEPELFQTVAEGLRQLYAQKLLPLEEHYRFHEFHSPALEDADFDNKPMVLLVGQYSTGKTTFIRHLIEQDFPGMRIGPEPTTDSFIAVMHGPTEGVVPGNALVVDPRRPFRKLNAFGNAFLNRFMCAQLPNPVLDSISIIDTPGILSGEKQRISRGYDFAAVLEWFAERVDRIILLFDAHKLDISDEFSEVIKALKNHEDKIRVVLNKADQIETQQLMRVYGALMWSLGKIINTPEVVRVYIGSFWSHPLLIPDNRKLFEAEEQDLFKDIQSLPRNAALRKLNDLIKRARLAKVDPGVRGAAYCQAGPWGSETGTQGPRIARDPSQLTSQADLHCAVSLYRNQSLVSTRVQPALN

SEQ ID NO: 915201 - protein, 141 aa, Homo sapiens
MFSWVSKDARRKKEPELFQTVAEGLRQLYAQKLLPLEEHYRFHEFHSPALEDADFDNKPMVLLVGQYSTGKTTFIRHLIEQDFPGMRIGPEPTTDSFIAVMHGPTEGVVPGNALVVDPRRPFRKLNALLALFSLARHSIQY

SEQ ID NO: 915202 - protein, 152 aa, Homo sapiens
MLSFPLILASKLAGVSSCTEYLSVVFGANLPQVVQCLLTDVDSFRLGTDFNDLFHFLWSIQHGPDYHHSVQKVKRDAVRGCDVLSASDDTVASVGCKDDDGSDRRLQGAVQVGEALNVQHVDLINKQHTRDQLSNALVDVLVHHLNVFQKNT

SEQ ID NO: 915203 - protein, 548 aa, Homo sapiens
MEQPGTAASPVSGSMFSWVSKDARRKKEPELFQTVAEGLRQLYAQKLLPLEEHYRFHEFHSPALEDADFDNKPMVLLVGQYSTGKTTFIRHLIEQDFPGMRIGPEPTTDSFIAVMHGPTEGVVPGNALVVDPRRPFRKLNAFGNAFLNRFMCAQLPNPVLDSISIIDTPGILSGEKQRISRGYDFAAVLEWFAERVDRIILLFDAHKLDISDEFSEVIKALKNHEDKIRVVLNKADQIETQQLMRVYGALMWSLGKIINTPEVVRVYIGSFWSHPLLIPDNRKLFEAEEQDLFKDIQSLPRNAALRKLNDLIKRARLAKVHAYIISSLKKEMPNVFGKESKKKELVNNLGEIYQKIEREHQISPGDFPSLRKMQELLQTQDFSKFQALKPKLLDTVDDMLANDIARLMVMVRQEESLMPSQVVKGGAFDGTMNGPFGHGYGEGAGEGIDDVEWVVGKDKPTYDEIFYTLSPVNGKITGANAKKEMVKSKLPNTVLGKIWKLADVDKDGLLDDEEFALANHLIKVKLEGHELPADLPPHLVPPSKRRHE

SEQ ID NO: 915204 - protein, 398 aa, Homo sapiens [sequence omitted]

SEQ ID NO: 915205 - protein, 534 aa, Homo sapiens; identical to SEQ ID NO: 915190

SEQ ID NO: 915206 - protein, 236 aa, Homo sapiens [sequence omitted]

SEQ ID NO: 915207 - protein, 216 aa, Homo sapiens
SCHPEHGSADGLVSDSRKASTSQIYREHHISPVALTEPPEDAELLQTQDFSKFQALKPKLLDTVDDMLANDIARLMVMVRQEESLMPSQVVKGGAFDGTMNGPFGHGYGEGAGEGIDDVEWVVGKDKPTYDEIFYTLSPVNGKITGANAKKEMVKSKLPNTVLGKIWKLADVDKDGLLDDEEFALANHLIKVKLEGHELPADLPPHLVPPSKRRHE

SEQ ID NO: 915208 - protein, 534 aa, Homo sapiens; identical to SEQ ID NO: 915190

SEQ ID NO: 915209 - protein, 332 aa, Homo sapiens
MFSWVSKDARRKKEPELFQTVAEGLRQLYAQKLLPLEEHYRFHEFHSPALEDADFDNKPMVLLVGQYSTGKTTFIRHLIEQDFPGMRIGPEPTTDSFIAVMHGPTEGVVPGNALVVDPRRPFRKLNAFGNAFLNRFMCAQLPNPVLDSISIIDTPGILSGEKQRISRGYDFAAVLEWFAERVDRIILLFDAHKLDISDEFSEVIKALKNHEDKIRVVLNKADQIETQQLMRVYGALMWSLGKIINTPEVVRVYIGSFWSHPLLIPDNRKLFEAEEQDLFKDIQRCSESAGTGLVLLSPSLHTVLGEDGCGRCPCREVTVEVAVACSHLWEEK

SEQ ID NO: 915210 - protein, 542 aa, Homo sapiens
MDLGAITKYSALHAKPNGLILQYGTAGFRTKAEHLDHVMFRMGLLAVLRSKQTKSTIGVMVTASHNPEEDNGVKLVDPLGEMLAPSWEEHATCLANAEEQDMQRVLIDISEKEAVNLQQDAFVVIGRDTRPSSEKLSQSVIDGVTVLGGQFHDYGLLTTPQLHYMVYCRNTGGRYGKATIEGYYQKLSKAFVELTKQASCSGDEYRSLKVDCANGIGALKLREMEHYFSQGLSVQLFNDGSKGKLNHLCGADFVKSHQKPPQGMEIKSNERCCSFDGDADRIVYYYHDADGHFHLIDGDKIATLISSFLKELLVEIGESLNIGVVQTAYANGSSTRYLEEVMKVPVYCTKTGVKHLHHKAQEFDIGVYFEANGHGTALFSTAVEMKIKQSAEQLEDKKRKAAKMLENIIDLFNQAAGDAISDMLVIEAILALKGLTVQQWDALYTDLPNRQLKVQVADRRVISTTDAERQAVTPPGLQEAINDLVKKYKLSRAFVRPSGTEDVVRVYAEADSQESADHLAHEVSLAVFQLAGGIGERPQPGF

SEQ ID NO: 915211 - protein, 542 aa, Homo sapiens; identical to SEQ ID NO: 915210

SEQ ID NO: 915212 - protein, 542 aa, Homo sapiens; identical to SEQ ID NO: 915210

SEQ ID NO: 915213 - protein, 542 aa, Homo sapiens; identical to SEQ ID NO: 915210

SEQ ID NO: 915214 - protein, 510 aa, Homo sapiens
KPRRATSAVLRTGFGCRRCCLGASPLRVGEGGFLTEEDNGVKLVDPLGEMLAPSWEEHATCLANAEEQDMQRVLIDISEKEAVNLQQDAFVVIGRDTRPSSEKLSQSVIDGVTVLGGQFHDYGLLTTPQLHYMVYCRNTGGRYGKATIEGYYQKLSKAFVELTKQASCSGDEYRSLKVDCANGIGALKLREMEHYFSQGLSVQLFNDGSKGKLNHLCGADFVKSHQKPPQGMEIKSNERCCSFDGDADRIVYYYHDADGHFHLIDGDKIATLISSFLKELLVEIGESLNIGVVQTAYANGSSTRYLEEVMKVPVYCTKTGVKHLHHKAQEFDIGVYFEANGHGTALFSTAVEMKIKQSAEQLEDKKRKAAKMLENIIDLFNQAAGDAISDMLVIEAILALKGLTVQQWDALYTDLPNRQLKVQVADRRVISTTDAERQAVTPPGLQEAINDLVKKYKLSRAFVRPSGTEDVVRVYAEADSQESADHLAHEVSLAVFQLAGGIGERPQPGF

SEQ ID NO: 915215 - protein, 566 aa, Homo sapiens
MDLGAITKYSALHAKPNGLILQYGTAGFRTKAEHLDHVMFRMGLLAVLRSKQTKSTIGVMVTASHNPEEDNGVKLVDPLGEMLAPSWEEHATCLANAEEQDMQRVLIDISEKEAVNLQQDAFVVIGRDTRPSSEKLSQSVIDGVTVLGGQFHDYGLLTTPQLHYMVYCRNTGGRYGKATIEGYYQKLSKAFVELTKQASCSGDEYRSLKVDCANGIGALKLREMEHYFSQGLSVQLFNDGSKGKLNHLCGADFVKSHQKPPQGMEIKSNERCCSFDGDADRIVYYYHDADGHFHLIDGDKIATLISSFLKELLVEIGESLNIGVVQTAYANGSSTRYLEEVMKVPVYCTKTGVKHLHHKAQEFDIGVYFEANGHGTALFSTAVEMKIKQSAEQLEDKKRKAAKMLENIIDLFNQAAGDAISDMLVIEAILALKGLTVQQWDALYTDLPNRQLKVQVADRRVISTTDAERQAVTPPGLQEAINDLVKKYKLSRAFVRPSGTEDVVRVYAEADSQGSRLVVWIFIIWPLHILLKVCAKPGQSTVSALNRESGGDIWQLSCRSLSHLRV

SEQ ID NO: 915216 - protein, 204 aa, Homo sapiens
MHVLQVPVYCTKTGVKHLHHKAQEFDIGVYFEANGHGTALFSTAVEMKIKQSAEQLEDKKRKAAKMLENIIDLFNQAAGDAISDMLVIEAILALKGLTVQQWDALYTDLPNRQLKVQVADRRVISTTDAERQAVTPPGLQEAINDLVKKYKLSRAFVRPSGTEDVVRVYAEADSQESADHLAHEVSLAVFQLAGGIGERPQPGF

SEQ ID NO: 915217 - protein, 149 aa, Homo sapiens
MDLGAITKYSALHAKPNGLILQYGTAGFRTKAEHLDHVMFRMGLLAVLRSKQTKSTIGVMVTASHNPEEDNGVKLVDPLGEMLAPSWEEHATCLANAEEQDMQRVLIDISEKEAVNLQQDAFVVIGRDTSPTVEKLSQTCKNGGDGPWK

SEQ ID NO: 915218 - protein, 542 aa, Homo sapiens; identical to SEQ ID NO: 915210

SEQ ID NO: 915219 - protein, 542 aa, Homo sapiens; identical to SEQ ID NO: 915210

SEQ ID NO: 915220 - protein, 542 aa, Homo sapiens; identical to SEQ ID NO: 915210

SEQ ID NO: 915221 - protein, 515 aa, Homo sapiens
MDLGAITKYSALHAKPNGLILQYGTAGFRTKAEHLDHVMFRMGLLAVLRSKQTKSTIGVMVTASHNPEEDNGVKLVDPLGEMLAPSWEEHATCLANAEEQDMQRVLIDISEKEAVNLQQDAFVVIGRDTRPSSEKLSQSVIDGVTVLGGQFHDYGLLTTPQLHYMVYCRNTGGRYGKATIEGYYQKLSKAFVELTKQASCSGDEYRSLKVDCANGIGALKLREMEHYFSQGLSVQLFNDGSKGKLNHLCGADFVKSHQKPPQGMEIKSNERCCSFDGDADRIVYYYHDADGHFHLIDGDKIATLISSFLKELLVEIGESLNIGVVQTAYANGSSTRYLEEVMKVPVYCTKTGVKHLHHKAQEFDIGVYFEANGHGTALFSTAVEMKIKQSAEQLEDKKRKAAKMLENIIDLFNQAAGDAISDMLVIEAILALKGLTVQQWDALYTDLPNRQLKVQVADRRVISTTDAERQAVTPPGLQEAINDLVKKYKLSRAFVRPSGTEDVVRVYAEADSQLI

SEQ ID NO: 915222 - protein, 120 aa, Homo sapiens
MLVIEAILALKGLTVQQWDALYTDLPNRQLKVQVADRRVISTTDAERQAVTPPGLQEAINDLVKKYKLSRAFVRPSGTEDVVRVYAEADSQESADHLAHEVSLAVFQLAGGIGERPQPGF

SEQ ID NO: 915223 - protein, 943 aa, Homo sapiens
MGLTKQYLRYVASAVFGVIGSQKGNIVFVTLRGEKGRYVAVPACEHVFIWDLRKGEKILILQGLKQEVTCLCPSPDGLHLAVGYEDGSIRIFSLLSGEGNVTFNGHKAAITTLKYDQLGGRLASGSKDTDIIVWDVINESGLYRLKGHKDAITQALFLREKNLLVTSGKDTMVKWWDLDTQHCFKTMVGHRTEVWGLVLLSEEKRLITGASDSELRVWDIAYLQEIEDPEEPDPKKIKGSSPGIQDTLEAEDGAFETDEAPEDRILSCRKAGSIMREGRDRVVNLAVDKTGRILACHGTDSVLELFCILSKKEIQKKMDKKMKKARKKAKLHSSKGEEEDPEVNVEMSLQDEIQRVTNIKTSAKIKSFDLIHSPHGELKAVFLLQNNLVELYSLNPSLPTPQPVRTSRITIGGHRSDVRTLSFSSDNIAVLSAAADSIKIWNRSTLQCIRTMTCEYALCSFFVPGDRQVVIGTKTGKLQLYDLASGNLLETIDAHDGALWSMSLSPDQRGFVTGGADKSVKFWDFELVKDENSTQKRLSVKQTRTLQLDEDVLCVSYSPNQKLLAVSLLDCTVKIFYVDTLKFFLSLYGHKLPVICMDISHDGALIATGSADRNVKIWGLDFGDCHKSLFAHDDSVMYLQFVPKSHLFFTAGKDHKIKQWDADKFEHIQTLEGHHQEIWCLAVSPSGDYVVSSSHDKSLRLWERTREPLILEEEREMEREAEYEESVAKEDQPAVPGETQGDSYFTGKKTIETVKAAERIMEAIELYREETAKMKEHKAICKAAGKEVPLPSNPILMAYGSISPSAYVLEIFKGIKSSELEESLLVLPFSYVPDILKLFNEFIQLGSDVELICRCLFFLLRIHFGQITSNQMLVPVIEKLRETTISKVSQVRDVIGFNMAGLDYLKRECEAKSEVMFFADATSHLEEKKRKRKKREKLILTLT

SEQ ID NO: 915224 - protein, 925 aa, Homo sapiens
MGLTKQYLRYVASAVFGVIGSQKGNIVFVTLRGEKGRYVAVPACEHVFIWDLRKGEKILILQGLKQEVTCLCPSPDGLHLAVGYEDGSIRIFSLLSGEGNVTFNGHKAAITTLKYDQLGGRLASGSKDTDIIVWDVINESGLYRLKGHKDAITQALFLREKNLLVTSGKDTMVKWWDLDTQHCFKTMVGHRTEVWGLVLLSEEKRLITGASDSELRVWDIAYLQEIEDPEEPDPKKIKGSSPGIQDTLEAEDGAFETDEAPEDRILSCRKAGSIMREGRDRVVNLAVDKTGRILACHGTDSVLELFCILSKKEIQKKMDKKMKKARKKAKLHSSKGEEEDPEVNVEMSLQDEIQRVTNIKTSAKIKSFDLIHSPHGELKAVFLLQNNLVELYSLNPSLPTPQPVRTSRITIGGHRSDVRTLSFSSDNIAVLSAAADSIKIWNRSTLQCIRTMTCEYALCSFFVPGDRQVVIGTKTGKLQLYDLASGNLLETIDAHDGALWSMSLSPDQRGFVTGGADKSVKFWDFELVKDENSTQKRLSVKQTRTLQLDEDVLCVSYSPNQKLLAVSLLDCTVKIFYVDTLKFFLSLYGHKLPVICMDISHDGALIATGSADRNVKIWGLDFGDCHKSLFAHDDSVMYLQFVPKSHLFFTAGKDHKIKQWDADKFEHIQTLEGHHQEIWCLAVSPSGDYVVSSSHDKSLRLWERTREPLILEEEREMEREAEYEESVAKEDQPAVPGETQGDSYFTGKKTIETVKAAERIMEAIELYREETAKMKEHKAICKAAGKEVPLPSNPILMAYGSISPSAYVLEIFKGIKSSELEESLLVLPFSYVPDILKLFNEFIQLGSDVELICRCLFFLLRIHFGQITSNQMLVPVIEKLRETTISLKRECEAKSEVMFFADATSHLEEKKRKRKKREKLILTLT

SEQ ID NO: 915225 - protein, 894 aa, Homo sapiens
MGLTKQYLRYVASAVFGVIGSQKGNIVFVTLRGEKGRYVAVPACEHVFIWDLRKGEKILILQGLKQEVTCLCPSPDGLHLAVGYEDGSIRIFSLLSGEGNVTFNGHKAAITTLKYDQLGGRLASGSKDTDIIVWDVINESGLYRLKGHKDAITQALFLREKNLLVTSGKDTMVKWWDLDTQHCFKTMVGHRTEVWGLVLLSEEKRLITGASDSELRVWDIAYLQEIEDPEEPDPKKIKGSSPGIQDTLEAEDGAFETDEAPEDRILSCRKAGSIMREGRDRVVNLAVDKTGRILACHGTDSVLELFCILSKKEIQKKMDKKMKKARKKAKLHSSKGEEEDPEVNVEMSLQDEIQRVTNIKTSAKIKSFDLIHSPHGELKAVFLLQNNLVELYSLNPSLPTPQPVRTSRITIGGHRSDVRTLSFSSDNIAVLSAAADSIKIWNRSTLQCIRTMTCEYALCSFFVPGDRQVVIGTKTGKLQLYDLASGNLLETIDAHDGALWSMSLSPDQRGFVTGGADKSVKFWDFELVKDENSTQKRLSVKQTRTLQLDEDVLCVSYSPNQKLLAVSLLDCTVKIFYVDTLKFFLSLYGHKLPVICMDISHDGALIATGSADRNVKIWGLDFGDCHKSLFAHDDSVMYLQFVPKSHLFFTAGKDHKIKQWDADKFEHIQTLEGHHQEIWCLAVSPSGDYVVSSSHDKSLRLWERTREPLILEEEREMEREAEYEESVAKEDQPAVPGETQGDSYFTGKKTIETVKAAERIMEAIELYREETAKMKEHKAICKAAGKEVPLPSNPILMAYGSISPSAYVLEIFKGIKSSELEESLLVLPFSYVPDILKLFNEFIQLGSDVELICRCLFFLLRIHFGQITSNQMLVPVIEKLRETTISKVSQVRDS

SEQ ID NO: 915226 - protein, 553 aa, Homo sapiens
MGLTKQYLRYVASAVFGVIGSQKGNIVFVTLRGEKGRYVAVPACEHVFIWDLRKGEKILILQGLKQEVTCLCPSPDGLHLAVGYEDGSIRIFSLLSGEGNVTFNGHKAAITTLKYDQLGGRLASGSKDTDIIVWDVINESGLYRLKGHKDAITQALFLREKNLLVTSGKDTMVKWWDLDTQHCFKTMVGHRTEVWGLVLLSEEKRLITGASDSELRVWDIAYLQEIEDPEEPDPKKIKGSSPGIQDTLEAEDGAFETDEAPEDRILSCRKAGSIMREGRDRVVNLAVDKTGRILACHGTDSVLELFCILSKKEIQKKMDKKMKKARKKAKLHSSKGEEEDPEVNVEMSLQDEIQRVTNIKTSAKIKSFDLIHSPHGELKAVFLLQNNLVELYSLNPSLPTPQPVRTSRITIGGHRSDVRTLSFSSDNIAVLSAAADSIKIWNRSTLQCIRTMTCEYALCSFFVPGDRQVVIGTKTGKLQLYDLASGNLLETIDAHDGALWSMSLSPDQRGFVTGGADKSVKFWDFELVKDENSTQKRTFCLSQPTLALKKIFC

SEQ ID NO: 915227 - protein, 192 aa, Homo sapiens
MGLTKQYLRYVASAVFGVIGSQKGNIVFVTLRGEKGRYVAVPACEHVFIWDLRKGEKILILQGLKQEVTCLCPSPDGLHLAVGYEDGSIRIFSLLSGEGNVTFNGHKAAITTLKYDQLGGRLASGSKDTDIIVWDVINESGLYRLKGHKDAITQALFLREKNLLVTSGKDTMVRMVGPCYSPAANRSGSTSI

SEQ ID NO: 915228 - protein, 943 aa, Homo sapiens; identical to SEQ ID NO: 915223

SEQ ID NO: 915229 - protein, 803 aa, Homo sapiens
MGLTKQYLRYVASAVFGVIGSQKGNIVFVTLRGEKGRYVAVPACEHVFIWDLRKGEKILILQGLKQEVTCLCPSPDGLHLAVGYEDGSIRIFSLLSGEGNVTFNGHKAAITTLKYDQLGGRLASGSKDTDIIVWDVINESGLYRLKGHKDAITQALFLREKNLLVTSGKDTMVKWWDLDTQHCFKTMVGHRTEVWGLVLLSEEKRLITGASDSELRVWDIAYLQEIEDPEEPDPKKIKGSSPGIQDTLEAEDGAFETDEAPEDRILSCRKAGSIMREGRDRVVNLAVDKTGRILACHGTDSVLELFCILSKKEIQKKMDKKMKKARKKAKLHSSKGEEEDPEVNVEMSLQDEIQRVTNIKTSAKIKSFDLIHSPHGELKAVFLLQNNLVELYSLNPSLPTPQPVRTSRITIGGHRSDVRTLSFSSDNIAVLSAAADSIKIWNRSTLQCIRTMTCEYALCSFFVPGDRQVVIGTKTGKLQLYDLASGNLLETIDAHDGALWSMSLSPDQRGFVTGGADKSVKFWDFELVKDENSTQKRLSVKQTRTLQLDEDVLCVSYSPNQKLLAVSLLDCTVKIFYVDTLKFFLSLYGHKLPVICMDISHDGALIATGSADRNVKIWGLDFGDCHKSLFAHDDSVMYLQFVPKSHLFFTAGKDHKIKQWDADKFEHIQTLEGHHQEIWCLAVSPSGDYVVSSSHDKSLRLWERTREPLILEEEREMEREAEYEESVAKEDQPAVPGETQGDSYFTGKKTIETVKAAERIMEAIELYREETAKMKEHKAICKAAGKEVPLPQRQTVLLSTFIF

SEQ ID NO: 915230 - protein, 95 aa, Homo sapiens
GSGRWERRLQNGSDGVGRQAAFSALLTRWREALHFPTALTAAPSCLPPTHREACCSSAAVTESGASAAATVSLGLGCFAEGSGPESEGDCGVQGR

SEQ ID NO: 915231 - protein, 67 aa, Homo sapiens
GSGRWERRLQNGSDGLPQPPELVRVLQGPAPRHRHLLSSEFPSDETTGVFTHHPHHFFFPNLMEGST

SEQ ID NO: 915232 - protein, 77 aa, Homo sapiens
ICIICILLLPESRDQNLPENISNGEHYTRQPLLPHKKGEQPLLLTNAELKDYSGLHDAAAAGDTLPEGATANGMKAM

SEQ ID NO: 915233 - protein, 77 aa, Homo sapiens; identical to SEQ ID NO: 915232

SEQ ID NO: 915234 - protein, 77 aa, Homo sapiens; identical to SEQ ID NO: 915232

SEQ ID NO: 915235 - protein, 152 aa, Homo sapiens
MTRKFVKRSIFLEILDVIEPSEFVKIMEPLFRQLAKCVSSPHFQVAERALYYWNNEYIMSLISDNAAKILPIMFPSLYRNSKTHWNKTIHGLIYNALKLFMEMNQKLFDDCTQQFKAEKLKEKLKMKEREEAWVKIENLAKANPQVLKKRIT

SEQ ID NO: 915236 - protein, 524 aa, Homo sapiens
MLTCNKAGSRMVVDAANSNGPFQPVVLLHIRDVPPADQEKLFIQKLRQCCVLFDFVSDPLSDLKWKEVKRAALSEMVEYITHNRNVITEPIYPEVVHMFAVNMFRTLPPSSNPTGAEFDPEEDEPTLEAAWPHLQLVYEFFLRFLESPDFQPNIAKKYIDQKFVLQLLELFDSEDPRERDFLKTTLHRIYGKFLGLRAYIRKQINNIFYRFIYETEHHNGIAELLEILGSIINGFALPLKEEHKIFLLKVLLPLHKVKSLSVYHPQLAYCVVQFLEKDSTLTEPVVMALLKYWPKTHSPKEVMFLNELEEILDVIEPSEFVKIMEPLFRQLAKCVSSPHFQVAERALYYWNNEYIMSLISDNAAKILPIMFPSLYRNSKTHWNKTIHGLIYNALKLFMEMNQKLFDDCTQQFKAEKLKEKLKMKEREEAWVKIENLAKANPQYTVYSQASTMSIPVAMETDGPLFEDVQMLRKTVKDEAHQAQKDPKKDRPLARRKSELPQDPHTKKALEAHCRADELASQDGR

SEQ ID NO: 915237 - protein, 449 aa, Homo sapiens
MLTCNKAGSRMVVDAANSNGPFQPVVLLHIRDVPPADQEKLFIQKLRQCCVLFDFVSDPLSDLKWKEVKRAALSEMVEYITHNRNVITEPIYPEVVHMFAVNMFRTLPPSSNPTGAEFDPEEDEPTLEAAWPHLQLVYEFFLRFLESPDFQPNIAKKYIDQKFVLQLLELFDSEDPRERDFLKTTLHRIYGKFLGLRAYIRKQINNIFYRFIYETEHHNGIAELLEILGSIINGFALPLKEEHKIFLLKVLLPLHKVKSLSVYHPQLAYCVVQFLEKDSTLTEPVVMALLKYWPKTHSPKEVMFLNELEEILDVIEPSEFVKIMEPLFRQLAKCVSSPHFQVAERALYYWNNEYIMSLISDNAAKILPIMFPSLYRNSKTHWNKTIHGLIYNALKLFMEMNQKLFDDCTQQFKAEKLKEKLKMKEREEAWVKIENLAKANPQVLKKRIT

SEQ ID NO: 915238 - protein, 118 aa, Homo sapiens
LLLQYWSLYTVLHTRFFSGYMSFLSKLCGSHEETSNQGKGEGLRHKTYLYKISFKNSNLGHVKFFYIFSCLNLSSFFMLCSARKCGEMEQGGCGRSRWLGSTCLCLFPFSVFLCLMHL

SEQ ID NO: 915239 - protein, 118 aa, Homo sapiens
SSKPSTCVFQVAERALYYWNNEYIMSLISDNAAKILPIMFPSLYRNSKTHWNKTIHGLIYNALKLFMEMNQKLFDDCTQQFKAEKLKEKLKMKEREEAWVKIENLAKANPQVLKKRIT

SEQ ID NO: 915240 - protein, 100 aa, Homo sapiens
AAAGARRPGRGRCCCGGRRRQGRRRRRRPAPAMPNKNKKEKESPKAGKSGKSSKEGQDTVESECYCLRAGATELEITTENTEMLGPSLLPHKDTRGNLAY

SEQ ID NO: 915241 - protein, 485 aa, Homo sapiens
MLTCNKAGSRMVVDAANSNGPFQPVVLLHIRDVPPADQEKLFIQKLRQCCVLFDFVSDPLSDLKWKEVKRAALSEMVEYITHNRNVITEPIYPEVVHMFAVNMFRTLPPSSNPTGAEFDPEEDEPTLEAAWPHLQLVYEFFLRFLESPDFQPNIAKKYIDQKFVLQLLELFDSEDPRERDFLKTTLHRIYGKFLGLRAYIRKQINNIFYRFIYETEHHNGIAELLEILGSIINGFALPLKEEHKIFLLKVLLPLHKVKSLSVYHPQLAYCVVQFLEKDSTLTEPVVMALLKYWPKTHSPKEVMFLNELEEILDVIEPSEFVKIMEPLFRQLAKCVSSPHFQVAERALYYWNNEYIMSLISDNAAKILPIMFPSLYRNSKTHWNKTIHGLIYNALKLFMEMNQKLFDDCTQQFKAEKLKEKLKMKEREEAWVKIENLAKANPQAQKDPKKDRPLARRKSELPQDPHTKKALEAHCRADELASQDGR

SEQ ID NO: 915242 - protein, 540 aa, Homo sapiens
MPNKNKKEKESPKAGKSGKSSKEGQDTVESEQISVRKNSLVAVPSTVSAKIKVPVSQPIVKKDKRQNSSRFSASNNRELQKLPSLKDVPPADQEKLFIQKLRQCCVLFDFVSDPLSDLKWKEVKRAALSEMVEYITHNRNVITEPIYPEVVHMFAVNMFRTLPPSSNPTGAEFDPEEDEPTLEAAWPHLQLVYEFFLRFLESPDFQPNIAKKYIDQKFVLQLLELFDSEDPRERDFLKTTLHRIYGKFLGLRAYIRKQINNIFYRFIYETEHHNGIAELLEILGSIINGFALPLKEEHKIFLLKVLLPLHKVKSLSVYHPQLAYCVVQFLEKDSTLTEPVVMALLKYWPKTHSPKEVMFLNELEEILDVIEPSEFVKIMEPLFRQLAKCVSSPHFQVAERALYYWNNEYIMSLISDNAAKILPIMFPSLYRNSKTHWNKTIHGLIYNALKLFMEMNQKLFDDCTQQFKAEKLKEKLKMKEREEAWVKIENLAKANPQAQKDPKKDRPLARRKSELPQDPHTKKALEAHCRADELASQDGR

SEQ ID NO: 915243 - protein, 544 aa, Homo sapiens
RRAGPTRKGRDCRESPKAGKSGKSSKEGQDTVESEQISVRKNSLVAVPSTVSAKIKVPVSQPIVKKDKRQNSSRFSASNNRELQKLPSLKDVPPADQEKLFIQKLRQCCVLFDFVSDPLSDLKWKEVKRAALSEMVEYITHNRNVITEPIYPEVVHMFAVNMFRTLPPSSNPTGAEFDPEEDEPTLEAAWPHLQLVYEFFLRFLESPDFQPNIAKKYIDQKFVLQLLELFDSEDPRERDFLKTTLHRIYGKFLGLRAYIRKQINNIFYRFIYETEHHNGIAELLEILGSIINGFALPLKEEHKIFLLKVLLPLHKVKSLSVYHPQLAYCVVQFLEKDSTLTEPVVMALLKYWPKTHSPKEVMFLNELEEILDVIEPSEFVKIMEPLFRQLAKCVSSPHFQVAERALYYWNNEYIMSLISDNAAKILPIMFPSLYRNSKTHWNKTIHGLIYNALKLFMEMNQKLFDDCTQQFKAEKLKEKLKMKEREEAWVKIENLAKANPQAQKDPKKDRPLARRKSELPQDPHTKKALEAHCRADELASQDGR

SEQ ID NO: 915244 - protein, 449 aa, Homo sapiens; identical to SEQ ID NO: 915237

SEQ ID NO: 915245 - protein, 466 aa, Homo sapiens
MQLGRWDDSACWDVPPADQEKLFIQKLRQCCVLFDFVSDPLSDLKWKEVKRAALSEMVEYITHNRNVITEPIYPEVVHMFAVNMFRTLPPSSNPTGAEFDPEEDEPTLEAAWPHLQLVYEFFLRFLESPDFQPNIAKKYIDQKFVLQLLELFDSEDPRERDFLKTTLHRIYGKFLGLRAYIRKQINNIFYRFIYETEHHNGIAELLEILGSIINGFALPLKEEHKIFLLKVLLPLHKVKSLSVYHPQLAYCVVQFLEKDSTLTEPVVMALLKYWPKTHSPKEVMFLNELEEILDVIEPSEFVKIMEPLFRQLAKCVSSPHFQVAERALYYWNNEYIMSLISDNAAKILPIMFPSLYRNSKTHWNKTIHGLIYNALKLFMEMNQKLFDDCTQQFKAEKLKEKLKMKEREEAWVKIENLAKANPQAQKDPKKDRPLARRKSELPQDPHTKKALEAHCRADELASQDGR

SEQ ID NO: 915246 - protein, 383 aa, Homo sapiens
MFRTLPPSSNPTGAEFDPEEDEPTLEAAWPHLQLVYEFFLRFLESPDFQPNIAKKYIDQKFVLQLLELFDSEDPRERDFLKTTLHRIYGKFLGLRAYIRKQINNIFYRFIYETEHHNGIAELLEILGSIINGFALPLKEEHKIFLLKVLLPLHKVKSLSVYHPQLAYCVVQFLEKDSTLTEPVVMALLKYWPKTHSPKEVMFLNELEEILDVIEPSEFVKIMEPLFRQLAKCVSSPHFQVAERALYYWNNEYIMSLISDNAAKILPIMFPSLYRNSKTHWNKTIHGLIYNALKLFMEMNQKLFDDCTQQFKAEKLKEKLKMKEREEAWVKIENLAKANPQAQKDPKKDRPLARRKSELPQDPHTKKALEAHCRADELASQDGR

SEQ ID NO: 915247 - protein, 526 aa, Homo sapiens
MLTCNKAGSRMVVDAANSNGPFQPVVLLHIRDVPPADQEKLFIQKLRQCCVLFDFVSDPLSDLKWKEVKRAALSEMVEYITHNRNVITEPIYPEVVHMFAVNMFRTLPPSSNPTGAEFDPEEDEPTLEAAWPHLQLVYEFFLRFLESPDFQPNIAKKYIDQKFVLQLLELFDSEDPRERDFLKTTLHRIYGKFLGLRAYIRKQINNIFYRFIYETEHHNGIAELLEILGSIINGFALPLKEEHKIFLLKVLLPLHKVKSLSVYHPQLAYCVVQFLEKDSTLTEPVVMALLKYWPKTHSPKEVMFLNELEEILDVIEPSEFVKIMEPLFRQLAKCVSSPHFQVAERALYYWNNEYIMSLISDNAAKILPIMFPSLYRNSKTHWNKTIHGLIYNALKLFMEMNQKLFDDCTQQFKAEKLKEKLKMKEREEAWVKIENLAKANPQYTVYSQASTMSIPVAMETDGPLFEDVQMLRKTVKDEAHQGLALIPRLECSGTILAHCSLGLLDSSNPPTSASQAAVTTGTTTLS

SEQ ID NO: 915248 - protein, 485 aa, Homo sapiens
MLTCNKAGSRMVVDAANSNGPFQPVVLLHIRDVPPADQEKLFIQKLRQCCVLFDFVSDPLSDLKWKEVKRAALSEMVEYITHNRNVITEPIYPEVVHMFAVNMFRTLPPSSNPTGAEFDPEEDEPTLEAAWPHLQLVYEFFLRFLESPDFQPNIAKKYIDQKFVLQLLELFDSEDPRERDFLKTTLHRIYGKFLGLRAYIRKQINNIFYRFIYETEHHNGIAELLEILGSIINGFALPLKEEHKIFLLKVLLPLHKVKSLSVYHPQLAYCVVQFLEKDSTLTEPVVMALLKYWPKTHSPKEVMFLNELEEILDVIEPSEFVKIMEPLFRQLAKCVSSPHFQVAERALYYWNNEYIMSLISDNAAKILPIMFPSLYRNSKTHWNKTIHGLIYNALKLFMEMNQKLFDDCTQQFKAEKLKEKLKMKEREEAWVKIENLAKANPQHRKIRRRTILFDFLQNLRHFHFPMMYSGSLLHQIPTHHLLCLC

SEQ ID NO: 915249 - protein, 227 aa, Homo sapiens
MTRKFVKRSIFLEILDVIEPSEFVKIMEPLFRQLAKCVSSPHFQVAERALYYWNNEYIMSLISDNAAKILPIMFPSLYRNSKTHWNKTIHGLIYNALKLFMEMNQKLFDDCTQQFKAEKLKEKLKMKEREEAWVKIENLAKANPQYTVYSQASTMSIPVAMETDGPLFEDVQMLRKTVKDEAHQAQKDPKKDRPLARRKSELPQDPHTKKALEAHCRADELASQDGR

SEQ ID NO: 915250 - protein, 384 aa, Homo sapiens
MLTCNKAGSRMVVDAANSNGPFQPVVLLHIRDVPPADQEKLFIQKLRQCCVLFDFVSDPLSDLKWKEVKRAALSEMVEYITHNRNVITEPIYPEVVHMFAVNMFRTLPPSSNPTGAEFDPEEDEPTLEAAWPHLQLVYEFFLRFLESPDFQPNIAKKYIDQKFVLQLLELFDSEDPRERDFLKTTLHRIYGKFLGLRAYIRKQINNIFYRFIYETEHHNGIAELLEILGSIINGFALPLKEEHKIFLLKVLLPLHKVKSLSVYHPQLAYCVVQFLEKDSTLTEPVVMALLKYWPKTHSPKEVMFLNELEEILDVIEPSEFVKIMEPLFRQLAKCVSSPHFQVAERALYYWNNEYIMSLISDNAAKILPIMFPSLYRNSKTHWNK

SEQ ID NO: 915251 - protein, 448 aa, Homo sapiens
MLTCNKAGSRMVVDAANSNGPFQPVVLLHIRDVPPADQEKLFIQKLRQCCVLFDFVSDPLSDLKWKEVKRAALSEMVEYITHNRNVITEPIYPEVVHMFAVNMFRTLPPSSNPTGAEFDPEEDEPTLEAAWPHLQLVYEFFLRFLESPDFQPNIAKKYIDQKFVLQLLELFDSEDPRERDFLKTTLHRIYGKFLGLRAYIRKQINNIFYSHSMKESIIWNKQSYWKYWDIINGFALPLKEEHKIFLLKVLLPLHKVKSLSVYHPQLAYCVVQFLEKDSTLTEPVVMALLKYWPKTHSPKEVMFLNELEEILDVIEPSEFVKIMEPLFRQLAKCVSSPHFQVAERALYYWNNEYIMSLISDNAAKILPIMFPSLYRNSKTHWNKTIHGLIYNALKLFMEMNQKLFDDCTQQFKAEKLKEKLKMKEREEAWVKIENLAKANPQVLKKRIT

SEQ ID NO: 915252 - protein, 367 aa, Homo sapiens
MLTCNKAGSRMVVDAANSNGPFQPVVLLHIRDVPPADQEKLFIQKLRQCCVLFDFVSDPLSDLKWKEVKRAALSEMVEYITHNRNVITEPIYPEVVHMFAVNMFRTLPPSSNPTGAEFDPEEDEPTLEAAWPHLQLVYEFFLRFLESPDFQPNIAKKYIDQKFVLQLLELFDSEDPRERDFLKTTLHRIYGKFLGLRAYIRKQINNIFYRFIYETEHHNGIAELLEILGSIINGFALPLKEEHKIFLLKVLLPLHKVKSLSVYHPQVAYCVCSFRAGPHLMNQGCCDFSNTGQDSLSKRSKVFTDSTRLDGLHLRDCEVWNPLRSGQLFPATSMWEDLYTGRTSPHAHEIASLVRQPGLMVTGLDPE

SEQ ID NO: 915253 - protein, 166 aa, Homo sapiens
RRAGPTRKGRDCRESPKAGKSGKSSKEGQDTVESEQISVRKNSLVAVPSTVSAKIKVPVSQPIVKKDKRQNSSRFSASNNRELQKLPSLKVEAVKLGRVSAELRLEVPDLQLWPPTEQQGEQTHGEPRGPQSMDGAASLLPCPSSSTPDLPAFSPALLPLLPTCQP

SEQ ID NO: 915254 - protein, 485 aa, Homo sapiens; identical to SEQ ID NO: 915241

SEQ ID NO: 915255 - protein, 107 aa, Homo sapiens
MLTCNKAGSRMVVDAANSNGPFQPVVLLHIRVEAVKLGRVSAELRLEVPDLQLWPPTEQQGEQTHGEPRGPQSMDGAASLLPCPSSSTPDLPAFSPALLPLLPTCQP

SEQ ID NO: 915256 - protein, 185 aa, Homo sapiens
MPNKNKKEKESPKAGKSGKSSKEGQDTVESEQISVRKNSLVAVPSTVSAKIKVPVSQPIVKKDKRQNSSRFSASNNRELQKLPSLKDVPPADQEKLFIQKLRQCCVLFDFVSDPLSDLKWKEVKRAALSEMVEYITHNRNVITEPIYPEVVHMCQLTGFRNIYPLFFQSFGEREFGPGGKKEPNR

SEQ ID NO: 915257 - protein, 485 aa, Homo sapiens; identical to SEQ ID NO: 915241

SEQ ID NO: 915258 - protein, 485 aa, Homo sapiens; identical to SEQ ID NO: 915241

SEQ ID NO: 915259 - protein, 554 aa, Homo sapiens
TNQGGAGCRMGGTSREELRKAELESPKAGKSGKSSKEGQDTVESEQISVRKNSLVAVPSTVSAKIKVPVSQPIVKKDKRQNSSRFSASNNRELQKLPSLKDVPPADQEKLFIQKLRQCCVLFDFVSDPLSDLKWKEVKRAALSEMVEYITHNRNVITEPIYPEVVHMFAVNMFRTLPPSSNPTGAEFDPEEDEPTLEAAWPHLQLVYEFFLRFLESPDFQPNIAKKYIDQKFVLQLLELFDSEDPRERDFLKTTLHRIYGKFLGLRAYIRKQINNIFYRFIYETEHHNGIAELLEILGSIINGFALPLKEEHKIFLLKVLLPLHKVKSLSVYHPQLAYCVVQFLEKDSTLTEPVVMALLKYWPKTHSPKEVMFLNELEEILDVIEPSEFVKIMEPLFRQLAKCVSSPHFQVAERALYYWNNEYIMSLISDNAAKILPIMFPSLYRNSKTHWNKTIHGLIYNALKLFMEMNQKLFDDCTQQFKAEKLKEKLKMKEREEAWVKIENLAKANPQAQKDPKKDRPLARRKSELPQDPHTKKALEAHCRADELASQDGR

SEQ ID NO: 915260 - protein, 469 aa, Homo sapiens
MFKLHFRHSWQEYFRDVPPADQEKLFIQKLRQCCVLFDFVSDPLSDLKWKEVKRAALSEMVEYITHNRNVITEPIYPEVVHMFAVNMFRTLPPSSNPTGAEFDPEEDEPTLEAAWPHLQLVYEFFLRFLESPDFQPNIAKKYIDQKFVLQLLELFDSEDPRERDFLKTTLHRIYGKFLGLRAYIRKQINNIFYRFIYETEHHNGIAELLEILGSIINGFALPLKEEHKIFLLKVLLPLHKVKSLSVYHPQLAYCVVQFLEKDSTLTEPVVMALLKYWPKTHSPKEVMFLNELEEILDVIEPSEFVKIMEPLFRQLAKCVSSPHFQVAERALYYWNNEYIMSLISDNAAKILPIMFPSLYRNSKTHWNKTIHGLIYNALKLFMEMNQKLFDDCTQQFKAEKLKEKLKMKEREEAWVKIENLAKANPQAQKDPKKDRPLARRKSELPQDPHTKKALEAHCRADELASQDGR

SEQ ID NO: 915261 - protein, 410 aa, Homo sapiens
MVEYITHNRNVITEPIYPEVVHMFAVNMFRTLPPSSNPTGAEFDPEEDEPTLEAAWPHLQLVYEFFLRFLESPDFQPNIAKKYIDQKFVLQLLELFDSEDPRERDFLKTTLHRIYGKFLGLRAYIRKQINNIFYRFIYETEHHNGIAELLEILGSIINGFALPLKEEHKIFLLKVLLPLHKVKSLSVYHPQLAYCVVQFLEKDSTLTEPVVMALLKYWPKTHSPKEVMFLNELEEILDVIEPSEFVKIMEPLFRQLAKCVSSPHFQVAERALYYWNNEYIMSLISDNAAKILPIMFPSLYRNSKTHWNKTIHGLIYNALKLFMEMNQKLFDDCTQQFKAEKLKEKLKMKEREEAWVKIENLAKANPQAQKDPKKDRPLARRKSELPQDPHTKKALEAHCRADELASQDGR

SEQ ID NO: 915262 - protein, 513 aa, Homo sapiens
HEAVLACWSVMAVSKKSAHVMYVPPADQEKLFIQKLRQCCVLFDFVSDPLSDLKWKEVKRAALSEMVEYITHNRNVITEPIYPEVVHMFAVNMFRTLPPSSNPTGAEFDPEEDEPTLEAAWPHLQLVYEFFLRFLESPDFQPNIAKKYIDQKFVLQLLELFDSEDPRERDFLKTTLHRIYGKFLGLRAYIRKQINNIFYSHSMKESIIWNKQSYWKYWDIINGFALPLKEEHKIFLLKVLLPLHKVKSLSVYHPQLAYCVVQFLEKDSTLTEPVVMALLKYWPKTHSPKEVMFLNELEEILDVIEPSEFVKIMEPLFRQLAKCVSSPHFQVAERALYYWNNEYIMSLISDNAAKILPIMFPSLYRNSKTHWNKTIHGLIYNALKLFMEMNQKLFDDCTQQFKAEKLKEKLKMKEREEAWVKIENLAKANPQYTVYSQASTMSIPVAMETDGPLFEDVQMLRKTVKDEAHQAQKDPKKDRPLARRKSELPQDPHTKKALEAHCRADELASQDGR

SEQ ID NO: 915263 - protein, 418 aa, Homo sapiens
MLTCNKAGSRMVVDAANSNGPFQPVVLLHIRDVPPADQEKLFIQKLRQCCVLFDFVSDPLSDLKWKEVKRAALSEMVEYITHNRNVITEPIYPEVVHMFAVNMFRTLPPSSNPTGAEFDPEEDEPTLEAAWPHLQLVYEFFLRFLESPDFQPNIAKKYIDQKFVLQLLELFDSEDPRERDFLKTTLHRIYGKFLGLRAYIRKQINNIFYRFIYETEHHNGIAELLEILGSIINGFALPLKEEHKIFLLKVLLPLHKVKSLSVYHPQLAYCVVQFLEKDSTLTEPVVMALLKYWPKTHSPKEVMFLNELEEILDVIEPSEFVKIMEPLFRQLAKCVSSPHFQVAERALYYWNNEYIMSLISDNAAKILPIMFPSLYRNSKTHWNKTIHGLIYNALKLFMEMNQKLFDDCTQQFKAEKLK

SEQ ID NO: 915264 - protein, 362 aa, Homo sapiens
MLTCNKAGSRMVVDAANSNGPFQPVVLLHIRDVPPADQEKLFIQKLRQCCVLFDFVSDPLSDLKWKEVKRAALSEMVEYITHNRNVITEPIYPEVVHMFAVNMFRTLPPSSNPTGAEFDPEEDEPTLEAAWPHLQLVYEFFLRFLESPDFQPNIAKKYIDQKFVLQLLELFDSEDPRERDFLKTTLHRIYGKFLGLRAYIRKQINNIFYRFIYETEHHNGIAELLEILGSIINGFALPLKEEHKIFLLKVLLPLHKVKSLSVYHPQLAYCVVQFLEKDSTLTEPVVMALLKYWPKTHSPKEVMFLNELEEILDVIEPSEFVKIMEPLFRQLAKCVSSPHFQDNTWLDIQRPEALHGDEPKAI

SEQ ID NO: 915265 - protein, 234 aa, Homo sapiens
LLLQYWSLYTVLHTRFFSGYMSFLSKLCGSHEETSNQGKGEGLRHKTYLYKISFKNSNLGHVKFFYIFSCLNLSSFFMLCSARKCGEMEQGGCGRSRWLGSTCLCLFPFSVFLCLMHLNTDDILLFFREKLKMKEREEAWVKIENLAKANPQYTVYSQASTMSIPVAMETDGPLFEDVQMLRKTVKDEAHQAQKDPKKDRPLARRKSELPQDPHTKKALEAHCRADELASQDGR

SEQ ID NO: 915266 - protein, 161 aa, Homo sapiens
MLTCNKAGSRMVVDAANSNGPFQPVVLLHIRDVPPADQEKLFIQKLRQCCVLFDFVSDPLSDLKWKEVKRAALSEMVEYITHNRNVITEPIYPEVVHMFAVNMFRTLPPSSNPTGAEFDPEEDEPTLEAAWPHLQPCLCIFLEIFRFSHDIPPHIAESQYS

SEQ ID NO: 915267 - protein, 150 aa, Homo sapiens
GAIIVIVVIYHHQYHYKGSAGRPEVPIIHIGKLRPREGSRLAQSCPWGKEAGLGLWPQFPHLRNRPHNSSDLLGEGQSGPWVGLRLDHWPPEVPWNSGPECLAILCLLCVTVPHECLQCPSVFPPSTTLFPICVFRVLACPPPSALCPIS

SEQ ID NO: 915268 - protein, 2051 aa, Homo sapiens
DARTMAASERRAFAHKINRTVAAEVRKQVSRERSGSPHSSRRCSSSLGVPLTEVVEPLDFEDVLLSRPPDAEPGPLRDLVEFPADDLELLLQPRECRTTEPGIPKDEKLDAQVRAAVEMYIEDWVIVHRRYQYLSAAYSPVTTDTQRERQKGLPRQVFEQDASGDERSGPEDSNDSRRGSGSPEDTPRSSGASSIFDLRNLAADSLLPSLLERAAPEDVDRRNETLRRQHRPPALLTLYPAPDEDEAVERCSRPEPPREHFGQRILVKCLSLKFEIEIEPIFGILALYDVREKKKISENFYFDLNSDSMKGLLRAHGTHPAISTLARSAIFSVTYPSPDIFLVIKLEKVLQQGDISECCEPYMVLKEVDTAKNKEKLEKLRLAAEQFCTRLGRYRMPFAWTAVHLANIVSSAGQLDRDSDSEGERRPAWTDRRRRGPQDRASSGDDACSFSGFRPATLTVTNFFKQEAERLSDEDLFKFLADMRRPSSLLRRLRPVTAQLKIDISPAPENPHFCLSPELLHIKPYPDPRGRPTKEILEFPAREVYAPHTSYRNLLYVYPHSLNFSSRQGSVRNLAVRVQYMTGEDPSQALPVIFGKSSCSEFTREAFTPVVYHNKSPEFYEEFKLHLPACVTENHHLLFTFYHVSCQPRPGTALETPVGFTWIPLLQHGRLRTGPFCLPVSVDQPPPSYSVLTPDVALPGMRWVDGHKGVFSVELTAVSSVHPQDPYLDKFFTLVHVLEEGAFPFRLKDTVLSEGNVEQELRASLAALRLASPEPLVAFSHHVLDKLVRLVIRPPIISGQIVNLGRGAFEAMAHVVSLVHRSLEAAQDARGHCPQLAAYVHYAFRLPGTEPSLPDGAPPVTVQAATLARGSGRPASLYLARSKSISSSNPDLAVAPGSVDDEVSRILASKLLHEELALQWVVSSSAVREAILQHAWFFFQLMVKSMALHLLLGQRLDTPRKLRFPGRFLDDITALVGSVGLEVITRVHKDVELAEHLNASLAFFLSDLLSLVDRGFVFSLVRAHYKQVATRLQSSPNPAALLTLRMEFTRILCSHEHYVTLNLPCCPLSPPASPSPSVSSTTSQSSTFSSQAPDPKVTSMFELSGPFRQQHFLAGLLLTELALALEPEAEGAFLLHKKAISAVHSLLCGHDTDPRYAEATVKARVAELYLPLLSIARDTLPRLHDFAEGPGQRSRLASMLDSDTEGEGDIAGTINPSVAMAIAGGPLAPGSRASISQGPPTASRAGCALSAESSRTLLACVLWVLKNTEPALLQRWATDLTLPQLGRLLDLLYLCLAAFEYKGKKAFERINSLTFKKSLDMKARLEEAILGTIGARQEMVRRSRERSPFGNPENVRWRKSVTHWKQTSDRVDKTKDEMEHEALVEGNLATEASLVVLDTLEIIVQTVMLSEARESVLGAVLKVVLYSLGSAQSALFLQHGLATQRALVSKFPELLFEEDTELCADLCLRLLRHCGSRISTIRTHASASLYLLMRQNFEIGHNFARVKMQVTMSLSSLVGTTQNFSEEHLRRSLKTILTYAEEDMGLRDSTFAEQVQDLMFNLHMILTDTVKMKEHQEDPEMLIDLMYRIARGYQGSPDLRLTWLQNMAGKHAELGNHAEAAQCMVHAAALVAEYLALLEDHRHLPVGCVSFQNISSNVLEESAISDDILSPDEEGFCSGKHFTELGLVGLLEQAAGYFTMGGLYEAVNEVYKNLIPILEAHRDYKKLAAVHGKLQEAFTKIMHQSSGWERVFGTYFRVGFYGAHFGDLDEQEFVYKEPSITKLAEISHRLEEFYTERFGDDVVEIIKDSNPVDKSKLDSQKAYIQITYVEPYFDTYELKDRVTYFDRNYGLRTFLFCTPFTPDGRAHGELPEQHKRKTLLSTDHAFPYIKTRIRVCHREETVLTPVEVAIEDMQKKTRELAFATEQDPPDAKMLQMVLQGSVGPTVNQGPLEVAQVFLAEIPEDPKLFRHHNKLRLCFKDFCKKCEDALRKNKALIGPDQKEYHRELERNYCRLREALQPLLTQRLPQLMAPTPPGLRNSLNRASFRKADL

SEQ ID NO: 915269 - protein, 2550 aa, Homo sapiens
MASDPTGGSILISCSVLDGERVGGTGELWALKASALLVLLALGLFISFHNLDFPHRKNLSAPLPEFSRPQWPPPYLSRTVAAEVRKQVSRERSGSPHSSRRCSSSLGVPLTEVVEPLDFEDVLLSRPPDAEPGPLRDLVEFPADDLELLLQPRECRTTEPGIPKDEKLDAQVRAAVEMYIEDWVIVHRRYQYLSAAYSPVTTDTQRERQKGLPRQVFEQDASGDERSGPEDSNDSRRGSGSPEDTPRSSGASSIFDLRNLAADSLLPSLLERAAPEDVDRRNETLRRQHRPPALLTLYPAPDEDEAVERCSRPEPPREHFGQRILVKCLSLKFEIEIEPIFGILALYDVREKKKISENFYFDLNSDSMKGLLRAHGTHPAISTLARSAIFSVTYPSPDIFLVIKLEKVLQQGDISECCEPYMVLKEVDTAKNKEKLEKLRLAAEQFCTRLGRYRMPFAWTAVHLANIVSSAGQLDRDSDSEGERRPAWTDRRRRGPQDRASSGDDACSFSGFRPATLTVTNFFKQEAERLSDEDLFKFLADMRRPSSLLRRLRPVTAQLKIDISPAPENPHFCLSPELLHIKPYPDPRGRPTKEILEFPAREVYAPHTSYRNLLYVYPHSLNFSSRQGSVRNLAVRVQYMTGEDPSQALPVSGCAPGKGGEGIPHGSLMNPLSQVIFGKSSCSEFTREAFTPVVYHNKYVGGHVRNLGALMGVGGCPLYIHIRQHRWEDGGQEEEEVEAPRVLMREAEADSRDSGAYAAIRAWHGRGDGADSGDPSPQQIPQPDSARSPEFYEEFKLHLPACVTENHHLLFTFYHVSCQPRPGTALETPVGFTVSLPSLPPPEPSSSPNLAADLTSSLSPVDPTAAARAPEDRPLLSPSVCGPAAAQLFRAHTRCMCPGAPACQCTVPRSTPESPAFLPVNPGRLVILYWCLQGPRVAHYSPINASLCPTCPPQRFPLPLCSIPTLATLTAFLITVPCPRSTLSFPMNAPLLMTLGLKSSYPVFLTYSMNIHSPCVSILCPRLGMWISSLPSGPSQSTGTRAGGRVLGCTPRPGYTHAAVSQWLGPLGDLISQGGLTSAHLVPPSHRWRFRACAGWTVTRACSVWSSQPCPLCTPRYGVGREPRVPPCSPLACPTIEYTVADGRGGLASGLGRDFGQLDPALREAADSGRGGASFPEAPPCSLHIPTQDPYLDKFFTLVHVLEEGAFPFRLKDTVLSEGNVEQELRASLAALRLASPEPLVAFSHHVLDKLVRLVIRPPIISGQIVNLGRGAFEAMAHVVSLVHRSLEAAQDARGHCPQLAAYVHYAFRLPGTEPSLPDGAPPVTVQAATLARGSGRPASLYLARSKSISSSNPDLAVAPGSVDDEVSRILASKGIDRSHSWVNSAYAPGGSKAVLRRAPPYCGADPRQLLHEELALQWVVSSSAVREAILQHAWFFFQLMVKSMALHLLLGQRLDTPRKLRFPGRFLDDITALVGSVGLEVITRVHKDVELAEHLNASLAFFLSDLLSLVDRGFVFSLVRAHYKQVATRLQSSPNPAALLTLRMEFTRILCSHEHYVTLNLPCCPLSPPASPSPSVSSTTSQSSTFSSQAPDPKVTSMFELSGPFRQQHFLAGLLLTELALALEPEAEGAFLLHKKAISAVHSLLCGHDTDPRYAEATVKARVAELYLPLLSIARDTLPRLHDFAEGPGQRSRLASMLDSDTEGEGDIAGTINPSVAMAIAGGPLAPGSRASISQGPPTASRAGCALSAESSRTLLACVLWVLKNTEPALLQRWATDLTLPQLGRLLDLLYLCLAAFEYKGKKAFERINSLTFKKSLDMKARLEEAILGTIGARQEMVRRSRERSPFGNPENVRWRKSVTHWKQTSDRVDKTKDEMEHEALVEGNLATEASLVVLDTLEIIVQTVMLSEARESVLGAVLKVVLYSLGSAQSALFLQHGLATQRALVSKFPELLFEEDTELCADLCLRLLRHCGSRISTIRTHASASLYLLMRQNFEIGHNFARVKMQVTMSLSSLVGTTQNFSEEHLRRSLKTILTYAEEDMGLRDSTFAEQVQDLMFNLHMILTDTVKMKEHQEDPEMLIDLMYRIARGYQGSPDLRLTWLQNMAGKHAELGNHAEAAQCMVHAAALVAEYLALLEDHRHLPVGCVSFQNISSNVLEESAISDDILSPDEEGFCSGKHFTELGLVGLLEQAAGYFTMGGLYEAVNEVYKNLIPILEAHRDYKKLAAVHGKLQEAFTKIMHQSSGWERVFGTYFRVGFYGAHFGDLDEQEFVYKEPSITKLAEISHRLEEFYTERFGDDVVEIIKDSNPVDKSKLDSQKAYIQITYVEPYFDTYELKDRVTYFDRNYGLRTFLFCTPFTPDGRAHGELPEQHKRKTLLSTDHAFPYIKTRIRVCHREETVLTPVEVAIEDMQKKTRELAFATEQDPPDAKMLQMVLQGSVGPTVNQGPLEVAQVFLAEIPEDPKLFRHHNKLRLCFKDFCKKCEDALRKNKALIGPDQKEYHRELERNYCRLREALQPLLTQRLPQLMAPTPPGLRNSLNRASFRKADL

SEQ ID NO: 915270 - protein, 1043 aa, Homo sapiens
GLGVSLVDFRISFSPFFSTSKPTFLSRDASASPCSSIFAISSCSALKSVRMPGLLPCCPLSPPASPSPSVSSTTSQSSTFSSQAPDPKVTSMFELSGPFRQQHFLAGLLLTELALALEPEAEGAFLLHKKAISAVHSLLCGHDTDPRYAEATVKARVAELYLPLLSIARDTLPRLHDFAEGPGQRSRLASMLDSDTEGEGDIAGTINPSVAMAIAGGPLAPGSRASISQGPPTASRAGCALSAESSRTLLACVLWVLKNTEPALLQRWATDLTLPQLGRLLDLLYLCLAAFEYKGKKAFERINSLTFKKSLDMKARLEEAILGTIGARQEMVRRSRERSPFGNPENVRWRKSVTHWKQTSDRVDKTKDEMEHEALVEGNLATEASLVVLDTLEIIVQTVMLSEARESVLGAVLKVVLYSLGSAQSALFLQHGLATQRALVSKFPELLFEEDTELCADLCLRLLRHCGSRISTIRTHASASLYLLMRQNFEIGHNFARVKMQVTMSLSSLVGTTQNFSEEHLRRSLKTILTYAEEDMGLRDSTFAEQVQDLMFNLHMILTDTVKMKEHQEDPEMLIDLMYRIARGYQGSPDLRLTWLQNMAGKHAELGNHAEAAQCMVHAAALVAEYLALLEDHRHLPVGCVSFQNISSNVLEESAISDDILSPDEEGFCSGKHFTELGLVGLLEQAAGYFTMGGLYEAVNEVYKNLIPILEAHRDYKKLAAVHGKLQEAFTKIMHQSSGWERVFGTYFRVGFYGAHFGDLDEQEFVYKEPSITKLAEISHRLEEFYTERFGDDVVEIIKDSNPVDKSKLDSQKAYIQITYVEPYFDTYELKDRVTYFDRNYGLRTFLFCTPFTPDGRAHGELPEQHKRKTLLSTDHAFPYIKTRIRVCHREETVLTPVEVAIEDMQKKTRELAFATEQDPPDAKMLQMVLQGSVGPTVNQGPLEVAQVFLAEIPEDPKLFRHHNKLRLCFKDFCKKCEDALRKNKALIGPDQKEYHRELERNYCRLREALQPLLTQRLPQLMAPTPPGLRNSLNRASFRKADL

SEQ ID NO: 915271 - protein, 2059 aa, Homo sapiens
DARTMAASERRAFAHKINRTVAAEVRKQVSRERSGSPHSSRRCSSSLGVPLTEVVEPLDFEDVLLSRPPDAEPGPLRDLVEFPADDLELLLQPRECRTTEPGIPKDEKLDAQVRAAVEMYIEDWVIVHRRYQYLSAAYSPVTTDTQRERQKGLPRQVFEQDASGDERSGPEDSNDSRRGSGSPEDTPRSSGASSIFDLRNLAADSLLPSLLERAAPEDVDRRNETLRRQHRPPALLTLYPAPDEDEAVERCSRPEPPREHFGQRILVKCLSLKFEIEIEPIFGILALYDVREKKKISENFYFDLNSDSMKGLLRAHGTHPAISTLARSAIFSVTYPSPDIFLVIKLEKVLQQGDISECCEPYMVLKEVDTAKNKEKLEKLRLAAEQFCTRLGRYRMPFAWTAVHLANIVSSAGQLDRDSDSEGERRPAWTDRRRRGPQDRASSGDDACSFSGFRPATLTVTNFFKQEAERLSDEDLFKFLADMRRPSSLLRRLRPVTAQLKIDISPAPENPHFCLSPELLHIKPYPDPRGRPTKEILEFPAREVYAPHTSYRNLLYVYPHSLNFSSRQGSVRNLAVRVQYMTGEDPSQALPVIFGKSSCSEFTREAFTPVVYHNKSPEFYEEFKLHLPACVTENHHLLFTFYHVSCQPRPGTALETPVGFTWIPLLQHGRLRTGPFCLPVSVDQPPPSYSVLTPDVALPGMRWVDGHKGVFSVELTAVSSVHPQDPYLDKFFTLVHVLEEGAFPFRLKDTVLSEGNVEQELRASLAALRLASPEPLVAFSHHVLDKLVRLVIRPPIISGQIVNLGRGAFEAMAHVVSLVHRSLEAAQDARGHCPQLAAYVHYAFRLPGTEPSLPDGAPPVTVQAATLARGSGRPASLYLARSKSISSSNPDLAVAPGSVDDEVSRILASKLLHEELALQWVVSSSAVREAILQHAWFFFQLMVKSMALHLLLGQRLDTPRKLRFPGRFLDDITALVGSVGLEVITRVHKDVELAEHLNASLAFFLSDLLSLVDRGFVFSLVRAHYKQVATRLQSSPNPAALLTLRMEFTRILCSHEHYVTLNLPCCPLSPPASPSPSVSSTTSQSSTFSSQAPDPKVTSMFELSGPFRQQHFLAGLLLTELALALEPEAEGAFLLHKKAISAVHSLLCGHDTDPRYAEATVKARVAELYLPLLSIARDTLPRLHDFAEGPGQRSRLASMLDSDTEGEGDIAGTINPSVAMAIAGGPLAPGSRASISQGPPTASRAGCALSAESSRTLLACVLWVLKNTEPALLQRWATDLTLPQLGRLLDLLYLCLAAFEYKGKKAFERINSLTFKKSLDMKARLEEAILGTIGARQEMVRRSRERSPFGNPENVRWRKSVTHWKQTSDRVDKTKDEMEHEALVEGNLATEASLVVLDTLEIIVQTVMLSEARESVLGAVLKVVLYSLGSAQSALFLQHGLATQRALVSKFPELLFEEDTELCADLCLRLLRHCGSRISTIRTHASASLYLLMRQNFEIGHNFARVKMQVTMSLSSLVGTTQNFSEEHLRRSLKTILTYAEEDMGLRDSTFAEQVQDLMFNLHMILTDTVKMKEHQEDPEMLIDLMYRIARGYQGSPDLRLTWLQNMAGKHAELGNHAEAAQCMVHAAALVAEYLALLEDHRHLPVGCVSFQNISSNVLEESAISDDILSPDEEGFCSGKHFTELGLVGLLEQAAGYFTMGGLYEAVNEVYKNLIPILEAHRDYKKLAAVHGKLQEAFTKIMHQSSGWERVFGTYFRVGFYGAHFGDLDEQEFVYKEPSITKLAEISHRLEEFYTERFGDDVVEIIKDSNPVDKSKLDSQKAYIQITYVEPYFDTYELKDRVTYFDRNYGLRTFLFCTPFTPDGRAHGELPEQHKRKTLLSTDHAFPYIKTRIRVCHREETVLTPVEVAIEDMQKKTRELAFATEQDPPDAKMLQMVLQGSVGPTVNQGPLEVAQVFLAEIPEDPKLFRHHNKLRLCFKDFCKKCEDALRKNKALIGPDQKEYHRELERNYCRLRDSTFAEQVQDLMFNLHMILTDTVKMKEHQDEPEMFIDLITALPR

SEQ ID NO: 915272 - protein, 351 aa, Homo sapiens
HVCPILPGSALSSGWERVFGTYFRVGFYGAHFGDLDEQEFVYKEPSITKLAEISHRLEARPCGWGWNGAWGCLGAGEGLSLGGPESALCLQEFYTERFGDDVVEIIKDSNPVDKSKLDSQKAYIQITYVEPYFDTYELKDRVTYFDRNYGLRTFLFCTPFTPDGRAHGELPEQHKRKTLLSTDHAFPYIKTRIRVCHREETVLTPVEVAIEDMQKKTRELAFATEQDPPDAKMLQMVLQGSVGPTVNQGPLEVAQVFLAEIPEDPKLFRHHNKLRLCFKDFCKKCEDALRKNKALIGPDQKEYHRELERNYCRLREALQPLLTQRLPQLMAPTPPGLRNSLNRASFRKADL

SEQ ID NO: 915273 - protein, 2546 aa, Homo sapiens
MASDPTGGSILISCSVLDGERVGGTGELWALKASALLVLLALGLFISFHNLDFPHRKNLSAPLPEFSRPQWPPPYLSRTVAAEVRKQVSRERSGSPHSSRRCSSSLGVPLTEVVEPLDFEDVLLSRPPDAEPGPLRDLVEFPADDLELLLQPRECRTTEPGIPKDEKLDAQVRAAVEMYIEDWVIVHRRYQYLSAAYSPVTTDTQRERQKGLPRQVFEQDASGDERSGPEDSNDSRRGSGSPEDTPRSSGASSIFDLRNLAADSLLPSLLERAAPEDVDRRNETLRRQHRPPALLTLYPAPDEDEAVERCSRPEPPREHFGQRILVKCLSLKFEIEIEPIFGILALYDVREKKKISENFYFDLNSDSMKGLLRAHGTHPAISTLARSAIFSVTYPSPDIFLVIKLEKVLQQGDISECCEPYMVLKEVDTAKNKEKLEKLRLAAEQFCTRLGRYRMPFAWTAVHLANIVSSAGQLDRDSDSEGERRPAWTDRRRRGPQDRASSGDDACSFSGFRPATLTVTNFFKQEAERLSDEDLFKFLADMRRPSSLLRRLRPVTAQLKIDISPAPENPHFCLSPELLHIKPYPDPRGRPTKEILEFPAREVYAPHTSYRNLLYVYPHSLNFSSRQGSVRNLAVRVQYMTGEDPSQALPVSGCAPGKGGEGIPHGSLMNPLSQVIFGKSSCSEFTREAFTPVVYHNKYVGGHVRNLGALMGVGGCPLYIHIRQHRWEDGGQEEEEVEAPRVLMREAEADSRDSGAYAAIRAWHGRGDGADSGDPSPQQIPQPDSARSPEFYEEFKLHLPACVTENHHLLFTFYHVSCQPRPGTALETPVGFTVSLPSLPPPEPSSSPNLAADLTSSLSPVDPTAAARAPEDRPLLSPSVCGPAAAQLFRAHTRCMCPGAPACQCTVPRSTPESPAFLPVNPGRLVILYWCLQGPRVAHYSPINASLCPTCPPQRFPLPLCSIPTLATLTAFLITVPCPRSTLSFPMNAPLLMTLGLKSSYPVFLTYSMNIHSPCVSILCPRLGMWISSLPSGPSQSTGTRAGGRVLGCTPRPGYTHAAVSQWLGPLGDLISQGGLTSAHLVPPSHRWRFRACAGWTVTRACSVWSSQPCPLCTPRYGVGREPRVPPCSPLACPTIEYTVADGRGGLASGLGRDFGQLDPALREAADSGRGGASFPEAPPCSLHIPTQDPYLDKFFTLVHVLEEGAFPFRLKDTVLSEGNVEQELRASLAALRLASPEPLVAFSHHVLDKLVRLVIRPPIISGQIVNLGRGAFEAMAHVVSLVHRSLEAAQDARGHCPQLAAYVHYAFRLPGTEPSLPDGAPPVTVQAATLARGSGRPASLYLARSKSISSSNPDLAVAPGSVDDEVSRILASKAIDCNSSRASSYLEGSSSAPPATQLRPTVQKLLHEELALQWVVSSSAVREAILQHAWFFFQLMVKSMALHLLLGQRLDTPRKLRFPGRFLDDITALVGSVGLEVITRVHKDVELAEHLNASLAFFLSDLLSLVDRGFVFSLVRAHYKQVATRLQSSPNPAALLTLRMEFTRILCSHEHYVTLNLPCCPLSPPASPSPSVSSTTSQSSTFSSQAPDPKVTSMFELSGPFRQQHFLAGLLLTELALALEPEAEGAFLLHKKAISAVHSLLCGHDTDPRYAEATVKARVAELYLPLLSIARDTLPRLHDFAEGPGQRSRLASMLDSDTEGEGDIAGTINPSVAMAIAGGPLAPGSRASISQGPPTASRAGCALSAESSRTLLACVLWVLKNTEPALLQRWATDLTLPQLGRLLDLLYLCLAAFEYKGKKAFERINSLTFKKSLDMKARLEEAILGTIGARQEMVRRSRERSPFGNPENVRWRKSVTHWKQTSDRVDKTKDEMEHEALVEGNLATEASLVVLDTLEIIVQTVMLSEARESVLGAVLKVVLYSLGSAQSALFLQHGLATQRALVSKFPELLFEEDTELCADLCLRLLRHCGSRISTIRTHASASLYLLMRQNFEIGHNFARVKMQVTMSLSSLVGTTQNFSEEHLRRSLKTILTYAEEDMGLRDSTFAEQVQDLMFNLHMILTDTVKMKEHQEDPEMLIDLMYRIARGYQGSPDLRLTWLQNMAGKHAELGNHAEAAQCMVHAAALVAEYLALLEDHRHLPVGCVSFQNISSNVLEESAISDDILSPDEEGFCSGKHFTELGLVGLLEQAAGYFTMGGLYEAVNEVYKNLIPILEAHRDYKKLAAVHGKLQEAFTKIMHQSSGWERVFGTYFRVGFYGAHFGDLDEQEFVYKEPSITKLAEISHRLEEFYTERFGDDVVEIIKDSNPVDKSKLDSQKAYIQITYVEPYFDTYELKDRVTYFDRNYGLRTFLFCTPFTPDGRAHGELPEQHKRKTLLSTDHAFPYIKTRIRVCHREETVLTPVEVAIEDMQKKTRELAFATEQDPPDAKMLQMVLQGSVGPTVNQGPLEVAQVFLAEIPEDPKLFRHHNKLRLCFKDFCKKCEDALRKNKALIGPDQKEYHRELERNYCRLREALQPLLTQRLPQLMAPTPPGLRNSLNRASFRKADL

SEQ ID NO: 915274 - protein, 1651 aa, Homo sapiens
MCPGAPACQCTVPRSTPESPAFLPVNPGRLVILYWCLQGPRVAHYSPINASLCPTCPPQRFPLPLCSIPTLATLTAFLITVPCPRSTLSFPMNAPLLMTLGLKSSYPVFLTYSMNIHSPCVSILCPRLGMWISSLPSGPSQSTGTRAGGRVLGCTPRPGYTHAAVSQWLGPLGDLISQGGLTSAHLVPPSHRWRFRACAGWTVTRACSVWSSQPCPLCTPRYGVGREPRVPPCSPLACPTIEYTVADGRGGLASGLGRDFGQLDPALREAADSGRGGLQFPEAPPCSLHIPTQDPYLDKFFTLVHVLEEGAFPFRLKDTVLSEGNVEQELRASLAALRLASPEPLVAFSHHVLDKLVRLVIRPPIISGQIVNLGRGAFEAMAHVVSLVHRSLEAAQDARGHCPQLAAYVHYAFRLPGTEPSLPDGAPPVTVQAATLARGSGRPASLYLARSKSISSSNPDLAVAPGSVDDEVSRILASKAIDCNSSRASSYLEGSSSAPPATQLRPTVQKLLHEELALQWVVSSSAVREAILQHAWFFFQLMVKSMALHLLLGQRLDTPRKLRFPGRFLDDITALVGSVGLEVITRVHKDVELAEHLNASLAFFLSDLLSLVDRGFVFSLVRAHYKQVATRLQSSPNPAALLTLRMEFTRILCSHEHYVTLNLPCCPLSPPASPSPSVSSTTSQSSTFSSQAPDPKVTSMFELSGPFRQQHFLAGLLLTELALALEPEAEGAFLLHKKAISAVHSLLCGHDTDPRYAEATVKARVAELYLPLLSIARDTLPRLHDFAEGPGQRSRLASMLDSDTEGEGDIAGTINPSVAMAIAGGPLAPGSRASISQGPPTASRAGCALSAESSRTLLACVLWVLKNTEPALLQRWATDLTLPQLGRLLDLLYLCLAAFEYKGKKAFERINSLTFKKSLDMKARLEEAILGTIGARQEMVRRSRERSPFGNPENVRWRKSVTHWKQTSDRVDKTKDEMEHEALVEGNLATEASLVVLDTLEIIVQTVMLSEARESVLGAVLKVVLYSLGSAQSALFLQHGLATQRALVSKFPELLFEEDTELCADLCLRLLRHCGSRISTIRTHASASLYLLMRQNFEIGHNFARVKMQVTMSLSSLVGTTQNFSEEHLRRSLKTILTYAEEDMGLRDSTFAEQVQDLMFNLHMILTDTVKMKEHQEDPEMLIDLMYRIARGYQGSPDLRLTWLQNMAGKHAELGNHAEAAQCMVHAAALVAEYLALLEDHRHLPVGCVSFQNISSNVLEESAISDDILSPDEEGFCSGKHFTELGLVGLLEQAAGYFTMGGLYEAVNEVYKNLIPILEAHRDYKKLAAVHGKLQEAFTKIMHQSSGWERVFGTYFRVGFYGAHFGDLDEQEFVYKEPSITKLAEISHRLEEFYTERFGDDVVEIIKDSNPVDKSKLDSQKAYIQITYVEPYFDTYELKDRVTYFDRNYGLRTFLFCTPFTPDGRAHGELPEQHKRKTLLSTDHAFPYIKTRIRVCHREETVLTPVEVAIEDMQKKTRELAFATEQDPPDAKMLQMVLQGSVGPTVNQGPLEVAQVFLAEIPEDPKLFRHHNKLRLCFKDFCKKCEDALRKNKALIGPDQKEYHRELERNYCRLREALQPLLTQRLPQLMAPTPPGLRNSLNRASFRKADL

SEQ ID NO: 915275 - protein, 952 aa, Homo sapiens
MFELSGPFRQQHFLAGLLLTELALALEPEAEGAFLLHKKAISAVHSLLCGHDTDPRYAEATVKARVAELYLPLLSIARDTLPRLHDFAEGPGQRSRLASMLDSDTEGEGDIAGTINPSVAMAIAGGPLAPGSRASISQGPPTASRAGCALSAESSRTLLACVLWVLKNTEPALLQRWATDLTLPQLGRLLDLLYLCLAAFEYKGKKAFERINSLTFKKSLDMKARLEEAILGTIGARQEMVRRSRERSPFGNPENVRWRKSVTHWKQTSDRVDKTKDEMEHEALVEGNLATEASLVVLDTLEIIVQTVMLSEARESVLGAVLKVVLYSLGSAQSALFLQHGLATQRALVSKFPELLFEEDTELCADLCLRLLRHCGSRISTIRTHASASLYLLMRQNFEIGHNFARVKMQVTMSLSSLVGTTQNFSEEHLRRSLKTILTYAEEDMGLRDSTFAEQVQDLMFNLHMILTDTVKMKEHQEDPEMLIDLMYRIARGYQGSPDLRLTWLQNMAGKHAELGNHAEAAQCMVHAAALVAEYLALLEDHRHLPVGCVSFQNISSNVLEESAISDDILSPDEEGFCSGKHFTELGLVGLLEQAAGYFTMGGLYEAVNEVYKNLIPILEAHRDYKKLAAVHGKLQEAFTKIMHQSSGWERVFGTYFRVGFYGAHFGDLDEQEFVYKEPSITKLAEISHRLEEFYTERFGDDVVEIIKDSNPVDKSKLDSQKAYIQITYVEPYFDTYELKDRVTYFDRNYGLRTFLFCTPFTPDGRAHGELPEQHKRKTLLSTDHAFPYIKTRIRVCHREETVLTPVEVAIEDMQKKTRELAFATEQDPPDAKMLQMVLQGSVGPTVNQGPLEVAQVFLAEIPEDPKLFRHHNKLRLCFKDFCKKCEDALRKNKALIGPDQKEYHRELERNYCRLREALQPLLTQRLPQLMAPTPPGLRNSLNRASFRKADL

SEQ ID NO: 915276 - protein, 119 aa, Homo sapiens
MAPPYLSRTVAAEVRKQVSRERSGSPHSSRRCSSSLGVPLTEVVEPLDFEDVLLSRPPDAEPGPLRDLVEFPADDLELLLQPRECRTTEPGIPKDEKLDAQVRAAVEMYIEDWVIVHRR

SEQ ID NO: 915277 - protein, 1227 aa, Homo sapiens
MGDTSEDASIHRLEGTDLDCQVGGLICKSKSAASEQHVFKAPAPRPSLLGLDLLASLKRREREEKDDGEDKKKSKVSSYKDWEESKDDQKDAEEEGGDQAGQNIRKDRHYRSARVETPSHPGGVSEEFWERSRQRERERREHGVYASSKEEKDWKKEKSRDRDYDRKRDRDERDRSRHSSRSERDGGSERSSRRNEPESPRHRPKDAATPSRSTWEEEDSGYGSSRRSQWESPSPTPSYRDSERSHRLSTRDRDRSVRGKYSDDTPLPTPSYKYNEWADDRRHLGSTPRLSRGRGRREEGEEGISFDTEEERQQWEDDQRQADRDWYMMDEGYDEFHNPLAYSSEDYVRRREQHLHKQKQKRISAQRRQINEDNERWETNRMLTSGVVHRLEVDEDFEEDNAAKVHLMVHNLVPPFLDGRIVFTKQPEPVIPVKDATSDLAIIARKGSQTVRKHREQKERKKAQHKHWELAGTKLGDIMGVKKEEEPDKAVTEDGKVDYRTEQKFADHMKRKSEASSEFAKKKSILEQRQYLPIFAVQQELLTIIRDNSIVIVVGETGSGKTTQLTQYLHEDGYTDYGMIGCTQPRRVAAMSVAKRVSEEMGGNLGEEVGYAIRFEDCTSENTLIKYMTDGILLRESLREADLDHYSAIIMDEAHERSLNTDVLFGLLREVVARRSDLKLIVTSATMDAEKFAAFFGNVPIFHIPGRTFPVDILFSKTPQEDYVEAAVKQSLQVHLSGAPGDILIFMPGQEDIEVTSDQIVEHLEELENAPALAVLPIYSQLPSDLQAKIFQKAPDGVRKCIVATNIAETSLTVDGIMFVIDSGYCKLKVFNPRIGMDALQIYPISQANANQRSGRAGRTGPGQCFRLYTQSAYKNELLTTTVPEIQRTNLANVVLLLKSLGVQDLLQFHFMDPPPEDNMLNSMYQLWILGALDNTGGLTSTGRLMVEFPLDPALSKMLIVSCDMGCSSEILLIVSMLSVPAIFYRPKGREEESDQIREKFAVPESDHLTYLNVYLQWKNNNYSTIWCNDHFIHAKAMRKVREVRAQLKDIMVQQRMSLASCGTDWDIVRKCICAAYFHQAAKLKGIGEYVNIRTGMPCHLHPTSSLFGMGYTPDYIVYHELVMTTKEYMQCVTAVDGEWLAELGPMFYSVKQAGKSRQENRRRAKEEASAMEEEMALAEEQLRARRQEQEKRSPLGSVRSTKIYTPGRKEQGEPMTPRRTPARFGL

SEQ ID NO: 915278 - protein, 1227 aa, Homo sapiens; identical to SEQ ID NO: 915277

SEQ ID NO: 915279 - protein, 1050 aa, Homo sapiens
MGDTSEDASIHRLEGTDLDCQVGGLICKSKSAASEQHVFKAPAPRPSLLGLDLLASLKRREREEKDDGEDKKKSKVSSYKDWEESKDDQKDAEEEGGDQAGQNIRKDRHYRSARVETPSHPGGVSEEFWERSRQRERERREHGVYASSKEEKDWKKEKSRDRDYDRKRDRDERDRSRHSSRSERDGGSERSSRRNEPESPRHRPKDAATPSRSTWEEEDSGYGSSRRSQWESPSPTPSYRDSERSHRLSTRDRDRSVRGKYSDDTPLPTPSYKYNEWADDRRHLGSTPRLSRGRGRREEGEEGISFDTEEERQQWEDDQRQADRDWYMMDEGYDEFHNPLAYSSEDYVRRREQHLHKQKQKRISAQRRQINEDNERWETNRMLTSGVVHRLEVDEDFEEDNAAKVHLMVHNLVPPFLDGRIVFTKQPEPVIPVKDATSDLAIIARKGSQTVRKHREQKERKKAQHKHWELAGTKLGDIMGVKKEEEPDKAVTEDGKVDYRTEQKFADHMKRKSEASSEFAKKKSILEQRQYLPIFAVQQELLTIIRDNSIVIVVGETGSGKTTQLTQYLHEDGYTDYGMIGCTQPRRVAAMSVAKRVSEEMGGNLGEEVGYAIRFEDCTSENTLIKYMTDGILLRESLREADLDHYSAIIMDEAHERSLNTDVLFGLLREVVARRSDLKLIVTSATMDAEKFAAFFGNVPIFHIPGRTFPVDILFSKTPQEDYVEAAVKQSLQVHLSGAPGDILIFMPGQEDIEVTSDQIVEHLEELENAPALAVLPIYSQLPSDLQAKIFQKAPDGVRKCIVATNIAETSLTVDGIMFVIDSGYCKLKVFNPRIGMDALQIYPISQANANQRSGRAGRTGPGQCFRLYTQSAYKNELLTTTVPEIQRTNLANVVLLLKSLGVQDLLQFHFMDPPPEDNMLNSMYQLWILGALDNTGGLTSTGRLMVEFPLDPALSKMLIVSCDMGCSSEILLIVSMLSVPAIFYRPKGREEESDQIREKFAVPESDHLTYLNVYLQWKNNNYSTIWCNDHFIHAKAMRKVEWWMSRMLG

SEQ ID NO: 915280 - protein, 1360 aa, Homo sapiens
MGDTSEDASIHRLEGTDLDCQVGGLICKSKSAASEQHVFKAPAPRPSLLGLDLLASLKRREREEKDDGEDKKKSKVSSYKDWEESKDDQKDAEEEGGDQAGQNIRKDRHYRSARVETPSHPGGVSEEFWERSRQRERERREHGVYASSKEEKDWKKEKSRDRDYDRKRDRDERDRSRHSSRSERDGGSERSSRRNEPESPRHRPKDAATPSRSTWEEEDSGYGSSRRSQWESPSPTPSYRDSERSHRLSTRDRDRSVRGKYSDDTPLPTPSYKYNEWADDRRHLGSTPRLSRGRGRREEGEEGISFDTEEERQQWEDDQRQADRDWYMMDEGYDEFHNPLAYSSEDYVRRREQHLHKQKQKRISAQRRQINEDNERWETNRMLTSGVVHRLEVDEDFEEDNAAKVHLMVHNLVPPFLDGRIVFTKQPEPVIPVKDATSDLAIIARKGSQTVRKHREQKERKKAQHKHWELAGTKLGDIMGVKKEEEPDKAVTEDGKVDYRTEQKFADHMKRKSEASSEFAKKKSILEQRQYLPIFAVQQELLTIIRDNSIVIVVGETGSGKTTQLTQYLHEDGYTDYGMIGCTQPRRVAAMSVAKRVSEEMGGNLGEEVGYAIRFEDCTSENTLIKYMTDGILLRESLREADLDHYSAIIMDEAHERSLNTDVLFGLLREVVARRSDLKLIVTSATMDAEKFAAFFGNVPIFHIPGRTFPVDILFSKVLRPPCYELTLPCQHFSDAKPAGGWRVGRGLGWRRFPGDHGANGAACSSGTRGQRTLLWVRFCFIISLRLKYRAQGGTVPSCRGLAVRPMWRCGGPQSPWLHSRAVPGPLGSQEMPGLRFQYLPLTVSPLLLQTPQEDYVEAAVKQSLQVHLSGAPGDILIFMPGQEDIEVTSDQIVEHLEELENAPALAVLPIYSQLPSDLQAKIFQKAPDGVRKCIVATNIAETSLTVDGIMFVIDSGYCKLKVFNPRIGMDALQIYPISQANANQRSGRAGRTGPGQCFRLYTQSAYKNELLTTTVPEIQRTNLANVVLLLKSLGVQDLLQFHFMDPPPEDNMLNSMYQLWILGALDNTGGLTSTGRLMVEFPLDPALSKMLIVSCDMGCSSEILLIVSMLSVPAIFYRPKGREEESDQIREKFAVPESDHLTYLNVYLQWKNNNYSTIWCNDHFIHAKAMRKVREVRAQLKDIMVQQRMSLASCGTDWDIVRKCICAAYFHQAAKLKGIGEYVNIRTGMPCHLHPTSSLFGMGYTPDYIVYHELVMTTKEYMQCVTAVDGEWLAELGPMFYSVKQAGKSRQENRRRAKEEASAMEEEMALAEEQLRARRQEQEKRSPLGSVRSTKIYTPGRKEQGEPMTPRRTPARFGL

SEQ ID NO: 915281 - protein, 977 aa, Homo sapiens
MGDTSEDASIHRLEGTDLDCQVGGLICKSKSAASEQHVFKAPAPRPSLLGLDLLASLKRREREEKDDGEDQADRDWYMMDEGYDEFHNPLAYSSEDYVRRREQHLHKQKQKRISAQRRQINEDNERWETNRMLTSGVVHRLEVDEDFEEDNAAKVHLMVHNLVPPFLDGRIVFTKQPEPVIPVKDATSDLAIIARKGSQTVRKHREQKERKKAQHKHWELAGTKLGDIMGVKKEEEPDKAVTEDGKVDYRTEQKFADHMKRKSEASSEFAKKKSILEQRQYLPIFAVQQELLTIIRDNSIVIVVGETGSGKTTQLTQYLHEDGYTDYGMIGCTQPRRVAAMSVAKRVSEEMGGNLGEEVGYAIRFEDCTSENTLIKYMTDGILLRESLREADLDHYSAIIMDEAHERSLNTDVLFGLLREVVARRSDLKLIVTSATMDAEKFAAFFGNVPIFHIPGRTFPVDILFSKTPQEDYVEAAVKQSLQVHLSGAPGDILIFMPGQEDIEVTSDQIVEHLEELENAPALAVLPIYSQLPSDLQAKIFQKAPDGVRKCIVATNIAETSLTVDGIMFVIDSGYCKLKVFNPRIGMDALQIYPISQANANQRSGRAGRTGPGQCFRLYTQSAYKNELLTTTVPEIQRTNLANVVLLLKSLGVQDLLQFHFMDPPPEDNMLNSMYQLWILGALDNTGGLTSTGRLMVEFPLDPALSKMLIVSCDMGCSSEILLIVSMLSVPAIFYRPKGREEESDQIREKFAVPESDHLTYLNVYLQWKNNNYSTIWCNDHFIHAKAMRKVREVRAQLKDIMVQQRMSLASCGTDWDIVRKCICAAYFHQAAKLKGIGEYVNIRTGMPCHLHPTSSLFGMGYTPDYIVYHELVMTTKEYMQCVTAVDGEWLAELGPMFYSVKQAGKSRQENRRRAKEEASAMEEEMALAEEQLRARRQEQEKRSPLGSVRSTKIYTPGRKEQGEPMTPRRTPARFGL

SEQ ID NO: 915282 - protein, 1189 aa, Homo sapiens
MGDTSEDASIHRLEGTDLDCQVGGLICKSKSAASEQHVFKAPAPRPSLLGLDLLASLKRREREEKDDGEDKKKSKVSSYKDWEESKDDQKDAEEEGGDQAGQNIRKDRHYRSARVETPSHPGGVSEEFWERSRQRERERREHGVYASSKEEKDWKKEKSRDRDYDRKRDRDERDRSRHSSRSERDGGSERSSRRNEPESPRHRPKDAATPSRSTWEEEDSGYGSSRRSQWESPSPTPSYRDSERSHRLSTRDRDRSVRGKYSDDTPLPTPSYKYNEWADDRRHLGSTPRLSRGRGRREEGEEGISFDTEEERQQWEDDQRQADRDWYMMDEGYDEFHNPLAYSSEDYVRRREQHLHKQKQKRISAQRRQINEDNERWETNRMLTSGVVHRLEVDEDFEEDNAAKVHLMVHNLVPPFLDGRIVFTKQPEPVIPVKDATSDLAIIARKGSQTVRKHREQKERKKAQHKHWELAGTKLGDIMGVKKEEEPDKAVTEDGKVDYRTEQKFADHMKRKSEASSEFAKKKSILEQRQYLPIFAVQQELLTIIRDNSIVIVVGETGSGKTTQLTQYLHEDGYTDYGMIGCTQPRRVAAMSVAKRVSEEMGGNLGEEVGYAIRFEDCTSENTLIKYMTDGILLRESLREADLDHYSAIIMDEAHERSLNTDVLFGLLREVVARRSDLKLIVTSATMDAEKFAAFFGNVPIFHIPGRTFPVDILFSKTPQEDYVEAAVKQSLQVHLSGAPGDILIFMPGQEDIEVTSDQIVEHLEELENAPALAVLPIYSQLPSDLQAKIFQKAPDGVRKCIVATNIAETSLTVDGIMFVIDSGYCKLKVFNPRIGMDALQIYPISQANANQRSGRAGRTGPGQCFRLYTQSAYKNELLTTTVPEIQRTNLANVVLLLKSLGVQDLLQFHFMDPPPEDNMLNSMYQLWILGALDNTGGLTSTGRLMVEFPLDPALSKMLIVSCDMGCSSEILLIVSMLSVPAIFYRPKGREEESDQIREKFAVPESDHLTYLNVYLQWKNNNYSTIWCNDHFIHAKAMRKVREVRAQLKDIMVQQRMSLASCGTDWDIVRKCICAAYFHQAAKLKGIGEYVNIRTGMPCHLHPTSSLFGMGYTPDYIVYHELVMTTKEYMQCVTAVDGEWLAELGPMFYSVKQAGKSRQENRRRAKEEASAMEEEMALAEEQLRAWREP

SEQ ID NO: 915283 - protein, 579 aa, Homo sapiens
MGLGDRSQGSPPWGPPSRLFSQVVARRSDLKLIVTSATMDAEKFAAFFGNVPIFHIPGRTFPVDILFSKTPQEDYVEAAVKQSLQVHLSGAPGDILIFMPGQEDIEVTSDQIVEHLEELENAPALAVLPIYSQLPSDLQAKIFQKAPDGVRKCIVATNIAETSLTVDGIMFVIDSGYCKLKVFNPRIGMDALQIYPISQANANQRSGRAGRTGPGQCFRLYTQSAYKNELLTTTVPEIQRTNLANVVLLLKSLGVQDLLQFHFMDPPPEDNMLNSMYQLWILGALDNTGGLTSTGRLMVEFPLDPALSKMLIVSCDMGCSSEILLIVSMLSVPAIFYRPKGREEESDQIREKFAVPESDHLTYLNVYLQWKNNNYSTIWCNDHFIHAKAMRKVREVRAQLKDIMVQQRMSLASCGTDWDIVRKCICAAYFHQAAKLKGIGEYVNIRTGMPCHLHPTSSLFGMGYTPDYIVYHELVMTTKEYMQCVTAVDGEWLAELGPMFYSVKQAGKSRQENRRRAKEEASAMEEEMALAEEQLRARRQEQEKRSPLGSVRSTKIYTPGRKEQGEPMTPRRTPARFGL

SEQ ID NO: 915284 - protein, 1222 aa, Homo sapiens
MGDTSEDASIHRLEGTDLDCQVGGLICKSKSAASEQHVFKAPAPRPSLLGLDLLASLKRREREEKDDGEDKKKSKVSSYKDWEESKDDQKDAEEEGGDQAGQNIRKDRHYRSARVETPSHPGGVSEEFWERSRQRERERREHGVYASSKEEKDWKKEKSRDRDYDRKRDRDERDRSRHSSRSERDGGSERSSRRNEPESPRHRPKDAATPSRSTWEEEDSGYGSSRRSQWESPSPTPSYRDSERSHRLSTRDRDRSVRGKYSDDTPLPTPSYKYNEWADDRRHLGSTPRLSRGRGRREEGEEGISFDTEEERQQWEDDQRQADRDWYMMDEGYDEFHNPLAYSSEDYVRRREQHLHKQKQKRISAQRRQINEDNERWETNRMLTSGVVHRLEVDEDFEEDNAAKVHLMVHNLVPPFLDGRIVFTKQPEPVIPVKDATSDLAIIARKGSQTVRKHREQKERKKAQHKHWELAGTKLGDIMGVKKEEEPDKAVTEDGKVDYRTEQKFADHMKRKSEASSEFAKKKSILEQRQYLPIFAVQQELLTIIRDNSIVIVVGETGSGKTTQLTQYLHEDGYTDYGMIGCTQPRRVAAMSVAKRVSEEMGGNLGEEVGYAIRFEDCTSENTLIKYMTDGILLRESLREADLDHYSAIIMDEAHERSLNTDVLFGLLREVVARRSDLKLIVTSATMDAEKFAAFFGNVPIFHIPGRTFPVDILFSKTPQEDYVEAAVKQSLQVHLSGAPGDILIFMPGQEDIEVTSDQIVEHLEELENAPALAVLPIYSQLPSDLQAKIFQKAPDGVRKCIVATNIAETSLTVDGIMFVIDSGYCKLKVFNPRIGMDALQIYPISQANANQRSGRAGRTGPGQCFRLYTQSAYKNELLTTTVPEIQRTNLANVVLLLKSLGVQDLLQFHFMDPPPEDNMLNSMYQLWILGALDNTGGLTSTGRLMVEFPLDPALSKMLIVSCDMGCSSEILLIVSMLSVPAIFYRPKGREEESDQIREKFAVPESDHLTYLNVYLQWKNNNYSTIWCNDHFIHAKAMRKVREVRAQLKDIMVQQRMSLASCGTDWDIVRKCICAAYFHQAAKLKGIGEYVNIRTGMPCHLHPTSSLFGMGYTPDYIVYHELVMTTKEYMQCVTAVDGEWLAELGPMFYSVKQAGKSRQVRILCSSQGCCLPVGSVFPPLGIEDLRSSNPLTSLCKHKGCDPAGWVCLIPHHPLQLFGRLSL

SEQ ID NO: 915285 - protein, 1050 aa, Homo sapiens; identical to SEQ ID NO: 915279

SEQ ID NO: 915286 - protein, 246 aa, Homo sapiens
MGDTSEDASIHRLEGTDLDCQVGGLICKSKSAASEQHVFKAPAPRPSLLGLDLLASLKRREREEKDDGEDKKKSKVSSYKDWEESKDDQKDAEEEGGDQAGQNIRKDRHYRSARVETPSHPGGVSEEFWERSRQRERERREHGVYASSKEEKDWKKENTIVFIIATLISLKTIPLRRICAYGHTSLAPGKQGGLGLLVSISKHMAKYGHTKLIQVNIGPFLPGVPNMVNPGICPYCTHTLPLSPTL

SEQ ID NO: 915287 - protein, 66 aa, Homo sapiens
MEQTDLFPFQAQHKHWELAGTKLGDIMGVKKEEEPDKAVTEDGKVDYRWAASASSTSALLQRWGPM

SEQ ID NO: 915288 - protein, 126 aa, Homo sapiens
MPCHLHPTSSLFGMGYTPDYIVYHELVMTTKEYMQCVTAVDGEWLAELGPMFYSVKQAGKSRQVRILCSSQGCCLPVGSVFPPLGIEDLRSSNPLTSLCKHKGCDPAGWVCLIPHHPLQLFGRLSL

SEQ ID NO: 915289 - protein, 1227 aa, Homo sapiens; identical to SEQ ID NO: 915277

SEQ ID NO: 915290 - protein, 1259 aa, Homo sapiens
MGDTSEDASIHRLEGTDLDCQVGGLICKSKSAASEQHVFKAPAPRPSLLGLDLLASLKRREREEKDDGEDKKKSKVSSYKDWEESKDDQKDAEEEGGDQAGQNIRKDRHYRSARVETPSHPGGVSEEFWERSRQRERERREHGVYASSKEEKDWKKEKSRDRDYDRKRDRDERDRSRHSSRSERDGGSERSSRRNEPESPRHRPKDAATPSRSTWEEEDSGYGSSRRSQWESPSPTPSYRDSERSHRLSTRDRDRSVRGKYSDDTPLPTPSYKYNEWADDRRHLGSTPRLSRGRGRREEGEEGISFDTEEERQQWEDDQRQADRDWYMMDEGYDEFHNPLAYSSEDYVRRREQHLHKQKQKRISAQRRQINEDNERWETNRMLTSGVVHRLEVDEDFEEDNAAKVHLMVHNLVPPFLDGRIVFTKQPEPVIPVKDATSDLAIIARKGSQTVRKHREQKERKKAQHKHWELAGTKLGDIMGVKKEEEPDKAVTEDGKVDYRTEQKFADHMKRKSEASSEFAKKKSILEQRQYLPIFAVQQELLTIIRDNSIVIVVGETGSGKTTQLTQYLHEDGYTDYGMIGCTQPRRVAAMSVAKRVSEEMGGNLGEEVGYAIRFEDCTSENTLIKYMTDGILLRESLREADLDHYSAIIMDEAHERSLNTDVLFGLLREVVARRSDLKLIVTSATMDAEKFAAFFGNVPIFHIPGRTFPVDILFSKTPQEDYVEAAVKQSLQVHLSGAPGDILIFMPGQEDIEVRALVTDCDERVCLAYERLGFQCLYSSSLGSQVTSDQIVEHLEELENAPALAVLPIYSQLPSDLQAKIFQKAPDGVRKCIVATNIAETSLTVDGIMFVIDSGYCKLKVFNPRIGMDALQIYPISQANANQRSGRAGRTGPGQCFRLYTQSAYKNELLTTTVPEIQRTNLANVVLLLKSLGVQDLLQFHFMDPPPEDNMLNSMYQLWILGALDNTGGLTSTGRLMVEFPLDPALSKMLIVSCDMGCSSEILLIVSMLSVPAIFYRPKGREEESDQIREKFAVPESDHLTYLNVYLQWKNNNYSTIWCNDHFIHAKAMRKVREVRAQLKDIMVQQRMSLASCGTDWDIVRKCICAAYFHQAAKLKGIGEYVNIRTGMPCHLHPTSSLFGMGYTPDYIVYHELVMTTKEYMQCVTAVDGEWLAELGPMFYSVKQAGKSRQENRRRAKEEASAMEEEMALAEEQLRARRQEQEKRSPLGSVRSTKIYTPGRKEQGEPMTPRRTPARFGL

SEQ ID NO: 915291 - protein, 541 aa, Homo sapiens
MDAEKFAAFFGNVPIFHIPGRTFPVDILFSKTPQEDYVEAAVKQSLQVHLSGAPGDILIFMPGQEDIEVTSDQIVEHLEELENAPALAVLPIYSQLPSDLQAKIFQKAPDGVRKCIVATNIAETSLTVDGIMFVIDSGYCKLKVFNPRIGMDALQIYPISQANANQRSGRAGRTGPGQCFRLYTQSAYKNELLTTTVPEIQRTNLANVVLLLKSLGVQDLLQFHFMDPPPEDNMLNSMYQLWILGALDNTGGLTSTGRLMVEFPLDPALSKMLIVSCDMGCSSEILLIVSMLSVPAIFYRPKGREEESDQIREKFAVPESDHLTYLNVYLQWKNNNYSTIWCNDHFIHAKAMRKVREVRAQLKDIMVQQRMSLASCGTDWDIVRKCICAAYFHQAAKLKGIGEYVNIRTGMPCHLHPTSSLFGMGYTPDYIVYHELVMTTKEYMQCVTAVDGEWLAELGPMFYSVKQAGKSRQENRRRAKEEASAMEEEMALAEEQLRARRQEQEKRSPLGSVRSTKIYTPGRKEQGEPMTPRRTPARFGL

SEQ ID NO: 915292 - protein, 843 aa, Homo sapiens
LGPQIEVRSPLYQVLRPDSCGAWCWESWRLEDWNVARCHQHSGGVYHLRGEACSPVGLIFHCSQSCGRMEQTDLFPFQAQHKHWELAGTKLGDIMGVKKEEEPDKAVTEDGKVDYRTEQKFADHMKRKSEASSEFAKKKSILEQRQYLPIFAVQQELLTIIRDNSIVIVVGETGSGKTTQLTQYLHEDGYTDYGMIGCTQPRRVAAMSVAKRVSEEMGGNLGEEVGYAIRFEDCTSENTLIKYMTDGILLRESLREADLDHYSAIIMDEAHERSLNTDVLFGLLREVVARRSDLKLIVTSATMDAEKFAAFFGNVPIFHIPGRTFPVDILFSKTPQEDYVEAAVKQSLQVHLSGAPGDILIFMPGQEDIEVTSDQIVEHLEELENAPALAVLPIYSQLPSDLQAKIFQKAPDGVRKCIVATNIAETSLTVDGIMFVIDSGYCKLKVFNPRIGMDALQIYPISQANANQRSGRAGRTGPGQCFRLYTQSAYKNELLTTTVPEIQRTNLANVVLLLKSLGVQDLLQFHFMDPPPEDNMLNSMYQLWILGALDNTGGLTSTGRLMVEFPLDPALSKMLIVSCDMGCSSEILLIVSMLSVPAIFYRPKGREEESDQIREKFAVPESDHLTYLNVYLQWKNNNYSTIWCNDHFIHAKAMRKVREVRAQLKDIMVQQRMSLASCGTDWDIVRKCICAAYFHQAAKLKGIGEYVNIRTGMPCHLHPTSSLFGMGYTPDYIVYHELVMTTKEYMQCVTAVDGEWLAELGPMFYSVKQAGKSRQENRRRAKEEASAMEEEMALAEEQLRARRQEQEKRSPLGSVRSTKIYTPGRKEQGEPMTPRRTPARFGL

SEQ ID NO: 915293 - protein, 1111 aa, Homo sapiens
MGDTSEDASIHRLEGTDLDCQVGGLICKSKSAASEQHVFKAPAPRPSLLGLDLLASLKRREREEKDDGEDKKKSKVSSYKDWEESKDDQKDAEEEGGDQAGQNIRKDRHYRSARVETPSHPGGVSEEFWERSRQRERERREHGVYASSKEEKDWKKEKSRDRDYDRKRDRDERDRSRHSSRSERDGGSERSSRRNEPESPRHRPKDAATPSRSTWEEEDSGYGSSRRSQWESPSPTPSYRDSERSHRLSTRDRDRSVRGKYSDDTPLPTPSYKYNEWADDRRHLGSTPRLSRGRGRREEGEEGISFDTEEERQQWEDDQRQADRDWYMMDEGYDEFHNPLAYSSEDYVRRREQHLHKQKQKRISAQRRQINEDNERWETNRMLTSGVVHRLEVDEDFEEDNAAKVHLMVHNLVPPFLDGRIVFTKQPEPVIPVKDATSDLAIIARKGSQTVRKHREQKERKKAQHKHWELAGTKLGDIMGVKKEEEPDKAVTEDGKVDYRTEQKFADHMKRKSEASSEFAKKKSILEQRQYLPIFAVQQELLTIIRDNSIVIVVGETGSGKTTQLTQYLHEDGYTDYGMIGCTQPRRVAAMSVAKRVSEEMGGNLGEEVGYAIRFEDCTSENTLIKYMTDGILLRESLREADLDHYSAIIMDEAHERSLNTDVLFGLLREVVARRSDLKLIVTSATMDAEKFAAFFGNVPIFHIPGRTFPVDILFSKTPQEDYVEAAVKQSLQVHLSGAPGDILIFMPGQEDIEVTSDQIVEHLEELENAPALAVLPIYSQLPSDLQAKIFQKAPDGVRKCIVATNIAETSLTVDGIMFVIDSGYCKLKVFNPRIGMDALQIYPISQANANQRSGRAGRTGPGQCFRLYTQSAYKNELLTTTVPEIQRTNLANVVLLLKSLGVQDLLQFHFMDPPPEDNMLNSMYQLWILGALDNTGGLTSTGRLMVEFPLDPALSKMLIVSCDMGCSSEILLIVSMLSVPAIFYRPKGREEESDQIREKFAVPESDHLTYLNVYLQWKNNNYSTIWCNDHFIHAKAMRKVREVRAQLKDIMVQQRMSLASCGTDWDIVRKCICAAYFHQAAKLKGIGEYVNIRTGMPCHLHPTSSLFGMG

SEQ ID NO: 915294 - protein, 614 aa, Homo sapiens
MGDTSEDASIHRLEGTDLDCQVGGLICKSKSAASEQHVFKAPAPRPSLLGLDLLASLKRREREEKDDGEDKKKSKVSSYKDWEESKDDQKDAEEEGGDQAGQNIRKDRHYRSARVETPSHPGGVSEEFWERSRQRERERREHGVYASSKEEKDWKKEKSRDRDYDRKRDRDERDRSRHSSRSERDGGSERSSRRNEPESPRHRPKDAATPSRSTWEEEDSGYGSSRRSQWESPSPTPSYRDSERSHRLSTRDRDRSVRGKYSDDTPLPTPSYKYNEWADDRRHLGSTPRLSRGRGRREEGEEGISFDTEEERQQWEDDQRQADRDWYMMDEGYDEFHNPLAYSSEDYVRRREQHLHKQKQKRISAQRRQINEDNERWETNRMLTSGVVHRLEVDEDFEEDNAAKVHLMVHNLVPPFLDGRIVFTKQPEPVIPVKDATSDLAIIARKGSQTVRKHREQKERKKAQHKHWELAGTKLGDIMGVKKEEEPDKAVTEDGKVDYRTEQKFADHMKRKSEASSEFAKKKSILEQRQYLPIFAVQQELLTIIRDNSIVIVVGETGSGKTTQLTQYLHEDGYTDYGMIGCTQPRRVAAMSVAKRVSEEMGGNLGEEVSGRGG

SEQ ID NO: 915295 - protein, 101 aa, Homo sapiens
MGDTSEDASIHRLEGTDLDCQVGGLICKSKSAASEQHVFKAPAPRPSLLGLDLLASLKRREREEKDDGEDSSFKKKTKQAKTSGFSKNCGFKSFVLIIKHY

SEQ ID NO: 915296 - protein, 400 aa, Homo sapiens
PEPARRRRRQGAASSHTESAAASRVGSNRSRARAGGGAMACAGLLTVCLLRPPAPQPQPQTPRHPQLAPDPGPAGHTLFQDVFRRADKNDDGKLSFEEFQNYFADGVLSLGELQELFSGIDGHLTDNLETEKLCDYFSEHLGVYRPVLAALESLNRAVLAAMDATKLEYERASKVDQFVTRFLLRETVSQLQALQSSLEGASDTLEAQAHGWRSDAESVEAQSRLCGSRRAGRRALRSVSRSSTWSPGSSDTGRSSEAEMQWRLQVNRLQELIDQLECKAPRLEPLREEDLAKGPDLHILMAQRQVQVAEEGLQDFHRALRCYVDFTGAQSHCLHVSAQKMLDGASFTLYEFWQDEASWRRHQQSPGSKAFQRILIDHLRAPDTLTTVFFPASWWIMNNN

SEQ ID NO: 915297 - protein, 485 aa, Homo sapiens
PEPARRRRRQGAASSHTESAAASRVGSNRSRARAGGGAMACAGLLTVCLLRPPAPQPQPQTPRHPQLAPDPGPAGHTLFQDVFRRADKNDDGKLSFEEFQNYFADGVLSLGELQELFSGIDGHLTDNLETEKLCDYFSEHLGVYRPVLAALESLNRAVLAAMDATKLEYERASKVDQFVTRFLLRETVSQLQALQSSLEGASDTLEAQAHGWRYVRVLSTCGASAQAPIVPPFQIPTVPASWSLHFRAGKPWQGSHGGVNETGFGAEASESQEACLPHPGLSRPGAPVLGPVSLTSSRSDAESVEAQSRLCGSRRAGRRALRSVSRSSTWSPGSSDTGRSSEAEMQWRLQVNRLQELIDQLECKAPRLEPLREEDLAKGPDLHILMAQRQVQVAEEGLQDFHRALRCYVDFTGAQSHCLHVSAQKMLDGASFTLYEFWQDEASWRRHQQSPGSKAFQRILIDHLRAPDTLTTVFFPASWWIMNNN

SEQ ID NO: 915298 - protein, 345 aa, Homo sapiens
TRWAKALGRRERDRGPERKQCGCGPEVFRRADKNDDGKLSFEEFQNYFADGVLSLGELQELFSGIDGHLTDNLETEKLCDYFSEHLGVYRPVLAALESLNRAVLAAMDATKLEYERASKVDQFVTRFLLRETVSQLQALQSSLEGASDTLEAQAHGWRSDAESVEAQSRLCGSRRAGRRALRSVSRSSTWSPGSSDTGRSSEAEMQWRLQVNRLQELIDQLECKAPRLEPLREEDLAKGPDLHILMAQRQVQVAEEGLQDFHRALRCYVDFTGAQSHCLHVSAQKMLDGASFTLYEFWQDEASWRRHQQSPGSKAFQRILIDHLRAPDTLTTVFFPASWWIMNNN

SEQ ID NO: 915299 - protein, 410 aa, Homo sapiens
PEPARRRRRQGAASSHTESAAASRVGSNRSRARAGGGAMACAGLLTVCLLRPPAPQPQPQTPRHPQLAPDPGPAGHTLFQDVFRRADKNDDGKLSFEEFQNYFADGVLSLGELQELFSGIDGHLTDNLETEKLCDYFSEHLGVYRPVLAALESLNRAVLAAMDATKLEYERASKVDQFVTRFLLRETVSQLQALQSSLEGASDTLEAQAHGWRPGPVSLTSSRSDAESVEAQSRLCGSRRAGRRALRSVSRSSTWSPGSSDTGRSSEAEMQWRLQVNRLQELIDQLECKAPRLEPLREEDLAKGPDLHILMAQRQVQVAEEGLQDFHRALRCYVDFTGAQSHCLHVSAQKMLDGASFTLYEFWQDEASWRRHQQSPGSKAFQRILIDHLRAPDTLTTVFFPASWWIMNNN

SEQ ID NO: 915300 - protein, 241 aa, Homo sapiens
LTVPPGPQEYERASKVDQFVTRFLLRETVSQLQALQSSLEGASDTLEAQAHGWRSDAESVEAQSRLCGSRRAGRRALRSVSRSSTWSPGSSDTGRSSEAEMQWRLQVNRLQELIDQLECKAPRLEPLREEDLAKGPDLHILMAQRQVQVAEEGLQDFHRALRCYVDFTGAQSHCLHVSAQKMLDGASFTLYEFWQDEASWRRHQQSPGSKAFQRILIDHLRAPDTLTTVFFPASWWIMNNN

SEQ ID NO: 915301 - protein, 336 aa, Homo sapiens
HVSRPLLAGLLGCFGPFVGTIVSHGRAGHHWGRWPTLRLLCPLGPGNIVTSRADLTKLQALSTAFQGPQEYERASKVDQFVTRFLLRETVSQLQALQSSLEGASDTLEAQAHGWRSDAESVEAQSRLCGSRRAGRRALRSVSRSSTWSPGSSDTGRSSEAEMQWRLQVNRLQELIDQLECKVRAVGPGPHKGGPSWYPPEPGPCWRPGPHSVPSQAPRLEPLREEDLAKGPDLHILMAQRQVQVAEEGLQDFHRALRCYVDFTGAQSHCLHVSAQKMLDGASFTLYEFWQDEASWRRHQQSPGSKAFQRILIDHLRAPDTLTTVFFPASWWIMNNN

SEQ ID NO: 915302 - protein, 230 aa, Homo sapiens
MNLALLLTCYVTLAQEYERASKVDQFVTRFLLRETVSQLQALQSSLEGASDTLEAQAHGWRSDAESVEAQSRLCGSRRAGRRALRSVSRSSTWSPGSSDTGRSSEAEMQWRLQVNRLQELIDQLECKHILMAQRQVQVAEEGLQDFHRALRCYVDFTGAQSHCLHVSAQKMLDGASFTLYEFWQDEASWRRHQQSPGSKAFQRILIDHLRAPDTLTTVFFPASWWIMNNN

SEQ ID NO: 915303 - protein, 88 aa, Homo sapiens
PEPARRRRRQGAASSHTESAAASRVGSNRSRARAGGGAMACAGLLTVCLLRPPAPQPQPQTPRHPQLRAPDTLTTVFFPASWWIMNNN

SEQ ID NO: 915304 - protein, 343 aa, Homo sapiens
PEPARRRRRQGAASSHTESAAASRVGSNRSRARAGGGAMACAGLLTVCLLRPPAPQPQPQTPRHPQLAPDPGPAGHTLFQDVFRRADKNDDGKLSFEEFQNYFADGVLSLGELQELFSGIDGHLTDNLETEKLCDYFSEHLGVYRPVLAALESLNRAVLAAMDATKLEYERASKVDQFVTRFLLRETVSQLQALQSSLEGASDTLEAQAHGWRSDAESVEAQSRLCGSRRAGRRALRSVSRSSTWSPGSSDTGRSSEAGRCAVAQEMCAVAAMGKWPRVRAREMHCGSGDERHDRDGKVAQSQGSGDARRDGDGKVAWSQGSGDVRCAGGGKVPSQMELRLPL

SEQ ID NO: 915305 - protein, 172 aa, Homo sapiens
PEPARRRRRQGAASSHTESAAASRVGSNRSRARAGGGAMACAGLLTVCLLRPPAPQPQPQTPRHPQLAPDPGPAGHTLFQDVFRRADKNDDGKLSFEEFQNYFADGVLSLGELQELFSGIDGHLTDNLETEKLCDYFSEHLGVYRPVLAALESLNRAVLAAMDATKLGEWSG

SEQ ID NO: 915306 - protein, 400 aa, Homo sapiens; identical to SEQ ID NO: 915296

SEQ ID NO: 915307 - protein, 434 aa, Homo sapiens
PEPARRRRRQGAASSHTESAAASRVGSNRSRARAGGGAMACAGLLTVCLLRPPAPQPQPQTPRHPQLAPDPGPAGHTLFQDVFRRADKNDDGKLSFEEFQNYFADGVLSLGELQELFSGIDGHLTDNLETEKLCDYFSEHLGVYRPVLAALESLNRAVLAAMDATKLEYERASKVDQFVTRFLLRETVSQLQALQSSLEGASDTLEAQAHGWRSDAESVEAQSRLCGSRRAGRRALRSVSRSSTWSPGSSDTGRSSEAEMQWRLQVNRLQELIDQLECKVRAVGPGPHKGGPSWYPPEPGPCWRPGPHSVPSQAPRLEPLREEDLAKGPDLHILMAQRQVQVAEEGLQDFHRALRCYVDFTGAQSHCLHVSAQKMLDGASFTLYEFWQDEASWRRHQQSPGSKAFQRILIDHLRAPDTLTTVFFPASWWIMNNN

SEQ ID NO: 915308 - protein, 400 aa, Homo sapiens; identical to SEQ ID NO: 915296

SEQ ID NO: 915309 - protein, 309 aa, Homo sapiens
MDIVDQALQNYFADGVLSLGELQELFSGIDGHLTDNLETEKLCDYFSEHLGVYRPVLAALESLNRAVLAAMDATKLEYERASKVDQFVTRFLLRETVSQLQALQSSLEGASDTLEAQAHGWRSDAESVEAQSRLCGSRRAGRRALRSVSRSSTWSPGSSDTGRSSEAEMQWRLQVNRLQELIDQLECKAPRLEPLREEDLAKGPDLHILMAQRQVQVAEEGLQDFHRALRCYVDFTGAQSHCLHVSAQKMLDGASFTLYEFWQDEASWRRHQQSPGSKAFQRILIDHLRAPDTLTTVFFPASWWIMNNN

SEQ ID NO: 915310 - protein, 382 aa, Homo sapiens
PEPARRRRRQGAASSHTESAAASRVGSNRSRARAGGGAMACAGLLTVCLLRPPAPQPQPQTPRHPQLAPDPGPAGHTLFQDVFRRADKNDDGKLSFEEFQNYFADGVLSLGELQELFSGIDGHLTDNLETEKLCDYFSEHLGVYRPVLAALESLNRAVLAAMDATKLEYERASKVDQFVTRFLLRETVSQLQALQSSLEGASDTLEAQAHGWRSDAESVEAQSRLCGSRRAGRRALRSVSRSSTWSPGSSDTGRSSEAEMQWRLQVNRLQELIDQLECKHILMAQRQVQVAEEGLQDFHRALRCYVDFTGAQSHCLHVSAQKMLDGASFTLYEFWQDEASWRRHQQSPGSKAFQRILIDHLRAPDTLTTVFFPASWWIMNNN

SEQ ID NO: 915311 - protein, 226 aa, Homo sapiens
MPPSWSDAESVEAQSRLCGSRRAGRRALRSVSRSSTWSPGSSDTGRSSEAEMQWRLQVNRLQELIDQLECKVRAVGPGPHKGGPSWYPPEPGPCWRPGPHSVPSQAPRLEPLREEDLAKGPDLHILMAQRQVQVAEEGLQDFHRALRCYVDFTGAQSHCLHVSAQKMLDGASFTLYEFWQDEASWRRHQQSPGSKAFQRILIDHLRAPDTLTTVFFPASWWIMNNN

SEQ ID NO: 915312 - protein, 400 aa, Homo sapiens; identical to SEQ ID NO: 915296

SEQ ID NO: 915313 - protein, 382 aa, Homo sapiens; identical to SEQ ID NO: 915310

SEQ ID NO: 915314 - protein, 258 aa, Homo sapiens
PEPARRRRRQGAASSHTESAAASRVGSNRSRARAGGGAMACAGLLTVCLLRPPAPQPQPQTPRHPQLAPDPGPAGHTLFQDVFRRADKNDDGKLSFEEFQNYFADGVLSLGELQELFSGIDGHLTERVREGAVDYFSEHLGVYRPVLAALESLNRAVLAAMDATKLEYERASKVDQFVTRFLLRETVSQLQALQSSLEGASDTLEAQAHGWRRIRERVGAYQLFENPSDEAEPLAFNRHHLSPGLCHGAVTATRGVRS

SEQ ID NO: 915315 - protein, 274 aa, Homo sapiens
MPKYCRAPNCSNTAGRLGADNRPVSFYKFPLKDGPRLQAWLQHMGCEHWVPSCHQHLCSEHFTPSCFQWRWGVRYLRPDAVPSIFSRGPPAKSQRRTRSTQKPVSPPPPLQKNTPLPQSPAIPVSGPVRLVVLGPTSGSPKTVATMLLTPLAPAPTPERSQPEVPAQQAQTGLGPVLGALQRRVRRLQRCQERHQAQLQALERLAQQLHGESLLARARRGLQRLTTAQTLGPEESQTFTIICGGPDIAMVLAQDPAPATVDAKPELLDTRIPSA

SEQ ID NO: 915316 - protein, 129 aa, Homo sapiens
MLLTPLAPAPTPERSQPEVPAQQAQTGLGPVLGALQRRVRRLQRCQERHQAQLQALERLAQQLHGESLLARARRGLQRLTTAQTLGPEESQTFTIICGGPDIAMVLAQDPAPATVDAKPELLDTRIPSA

SEQ ID NO: 915317 - protein, 223 aa, Homo sapiens
MPKYCRAPNCSNTAGRLGADNRPVSFYKFPLKDGPRLQAWLQHMGCEHWVPSCHQHLCSEHFTPSCFQWRWGVRYLRPDAVPSIFSRGPPAKSQRRTRSTQKPVSPPPPLQKNTPLPQSPAIPVSGPVRLVVLGPTSGSPKTVATMLLTPLAPAPTPERSQPEVRPSAGSTATPGAEAATVPGAAPGAAAGPGTAGTAATRGEPAGTGTPGSAAPDNSPDPWT

SEQ ID NO: 915318 - protein, 274 aa, Homo sapiens; identical to SEQ ID NO: 915315

SEQ ID NO: 915319 - protein, 545 aa, Homo sapiens [sequence omitted]

SEQ ID NO: 915320 - protein, 393 aa, Homo sapiens
MKQLENQEVARWVFFCQLCSWFTWYCCTRTLTNTMETVLTIIALFYYPLEGSKSMNSVKYSSLVALAFIIRPTAVILWTPLLFRHFCQEPRKLDLILHHFLPVGFVTLSLSLMIDRIFFGQWTLVQFNFLKFNVLQNWGTFYGSHPWHWYFSQGFPVILGTHLPFFIHGCYLAPKRYRILLVTVLWTLLVYSMLSHKEFRFIYPVLPFCMVFCGYSLTHLKTWKKPALSFLFLSNLFLALYTGLVHQRGTLDVMSHIQKVCYNNPNKSSASIFIMMPCHSTPYYSHVHCPLPMRFLQCPPDLTGKSHYLDEADVFYLNPLNWLHREFHDDASLPTHLITFSILEEEISAFLISSNYKRTAVFFHTHLPEGRIGSHIYVYERKLKGKFNMKMKF

SEQ ID NO: 915321 - protein, 344 aa, Homo sapiens
MEPGGGDASLTLHGLQNRSHGKIKLRKRKSTLYFNTQEKSARRRGDLLGENIYLLLFTIALRILNCFLVQTSFVPDEYWQSLEVSHHMVFNYGYLTWEWTERLRSYTYPLIFASIYKILHLLGKDSVQLLIWIPRLAQALLSAVADVRLYSLMKQLENQEVARWVFFCQLCSWFTWYCCTRTLTNTMETVLTIIALFYYPLEGSKSMNSVKYSSLVALAFIIRPTAVILWTPLLFRHFCQEPRKLDLILHHFLPVGFVTLSLSLMIDRIFFGQWTLVQFNFLKFNVLQNWGTFYGSHPWHWYFSQGFPVILGTHLPFFIHGCYLAPKRYRILLVTVLWTLLVYR

SEQ ID NO: 915322 - protein, 217 aa, Homo sapiens
MEPGGGDASLTLHGLQNRSHGKIKLRKRKSTLYFNTQEKSARRRGDLLGENIYLLLFTIALRILNCFLVQTSFVPDEYWQSLEVSHHMVFNYGYLTWEWTERLRSYTYPLIFASIYKILHLLGKDSVQLLIWIPRLAQALLSAVADVRLYSLMKQLENQEVARWVFFCQLCSWFTWYCCTRTLTNTNGKTGSSTNKAPFSQLNPFGERVSKRSMETK

SEQ ID NO: 915323 - protein, 509 aa, Homo sapiens
MEPGGGDASLTLHGLQNRSHGKIKLRKRKSTLYFNTQEKSARRRGDLLGENIYLLLFTIALRILNCFLVQTSFVPDEYWQSLEVSHHMVFNYGYLTWEWTERLRSYTYPLIFASIYKILHLLGKDSVQLLIWIPRLAQALLSAVADVRLYSLMKQLENQEVARWVFFCQLCSWFTWYCCTRTLTNTMETVLTIIALFYYPLEGSKSMNSVKYSSLVALAFIIRPTAVILWTPLLFRHFCQEPRKLDLILHHFLPVGFVTLSLSLMIDRIFFGQWTLVQFNFLKFNVLQNWGTFYGSHPWHWYFSQGFPVILGTHLPFFIHGCYLAPKRYRILLVTVLWTLLVYSMLSHKEFRFIYPVLPFCMVFCGYSLTHLKTWKKPALSFLFLSNLFLALYTGLVHQRGTLDVMSHIQKVCYNNPNKSSASIFIMMPCHSTPYYSHVHCPLPMRFLQCPPDLTGKSHYLDEADVFYLNPLNWLHREFHDDASLPTHLITFSILEEVSKHEKEENSVF

SEQ ID NO: 915324 - protein, 183 aa, Homo sapiens
MEPGGGDASLTLHGLQNRSHGKIKLRKRKSTLYFNTQEKSARRRGDLLGENIYLLLFTIALRILNCFLVQTSFVPDEYWQSLEVSHHMVFNYGYLTWEWTERLRSYTYPLIFASIYKILHLLGKDSVQLLIWIPRLAQALLSAVADVRLYSLMKQLENQEVARWVVSPKYFRSCMPVISFLWV

SEQ ID NO: 915325 - protein, 427 aa, Homo sapiens
MFLHPAEIQKLVLEGRVGEAIETTQRFYPGLLEHNPNLLFMLKCRQFVEMVNGTDSEVRSLSSRSPKSQDSYPGSPSLSPRHGPSSSHMHNTGADSPSCSNGVASTKSKQNHSKYPAPSSSSSSSSSSSSSSPSSVNYSESNSTDSTKSQHHSSTSNQETSNPWLQLERRPNQAAPTTPPGPTPTSTPPHSDSEMEMEAEHYPNGVLGSMSTRIVNGAYKHEDLQTDESSMDDRHPRRQLCGGNQAATERIILFGRELQALSEQLGREYGKNLAHTEMLQDAFSLLAYSDPWSCPVGQQLDPIQREPVCAALNSAILVLPGLLEHNPNLLFMLKCRQFVEMVNGTDSEVRSLSSRSPKSQDSYPGSPSLSPRHGPSSSHMHNTGADSPSCSNGVASTKSKQNHSKYPAPSSSSSSSAFSSLHWVFLH

SEQ ID NO: 915326 - protein, 300 aa, Homo sapiens
AKVDWDPAAGALRVNHYSRFDPSYMGIGLSAQGVNMNRLPGWDKHSYGYHGDDGHSFCSSGTGQPYGPTFTTGDVIGCCVNLINGTCFYTKNGHSLGIAFTDLPANLYPTVGLQTPGEIVDANFGQQPFLFDIEDYMREWRAKVQGTVHCFPISARLGEWQAVLQNMVSSYLVHHGYCATATAFARMTETPIQEEQASIKNRQKIQKTGCWEGRDGARPSEKQPRQLLTQGCWRKQHEHPSSMASKVEEGTEERMAEHGTEKRKTRKIRNSQEKRQKPQGTENREDTQHTKPEKEPRATK

SEQ ID NO: 915327 - protein, 557 aa, Homo sapiens
AKVDWDPAAGALRVNHYSRFDPSYMGIGLSAQGVNMNRLPGWDKHSYGYHGDDGHSFCSSGTGQPYGPTFTTGDVIGCCVNLINGTCFYTKNGHSLGIAFTDLPANLYPTVGLQTPGEIVDANFGQQPFLFDIEDYMREWRAKVQGTVHCFPISARLGEWQAVLQNMVSSYLVHHGYCATATAFARMTETPIQEEQASIKNRQKIQKLVLEGRVGEAIETTQRFYPGLLEHNPNLLFMLKCRQFVEMVNGTDSEVRSLSSRSPKSQDSYPGSPSLSPRHGPSSSHMHNTGADSPSCSNGVASTKSKQNHSKYPAPSSSSSSSSSSSSSSPSSVNYSESNSTDSTKSQHHSSTSNQETSNPWLQLERRPNQAAPTTPPGPTPTSTPPHSDSEMEMEAEHYPNGVLGSMSTRIVNGAYKHEDLQTDESSMDDRHPRRQLCGGNQAATERIILFGRELQALSEQLGREYGKNLAHTEMLQDAFSLLAYSDPWSCPVGQQLDPIQREPVCAALNSAILESQNLPKQPPLMLALGQASECLRLMARAGLGSCSFARVDDYLH

SEQ ID NO: 915328 - protein, 557 aa, Homo sapiens; identical to SEQ ID NO: 915327

SEQ ID NO: 915329 - protein, 51 aa, Homo sapiens
FDIEDYMREWRAKVQGTVHCFPISARLGEWQAVLQKLSALLLPLPTPTPPQ

SEQ ID NO: 915330 - protein, 620 aa, Homo sapiens
MAAATADPGAGNPQPGDSSGGGAGGGLPSPGEQELSRRLQRLYPAVNQQETPLPRSWSPKDKYNYIGLSQGNLRVHYKGHGKNHKDAASVRATHPIPAACGIYYFEVKIVSKGRDGYMGIGLSAQGVNMNRLPGWDKHSYGYHGDDGHSFCSSGTGQPYGPTFTTGDVIGCCVNLINGTCFYTKNGHSLGIAFTDLPANLYPTVGLQTPGEIVDANFGQQPFLFDIEDYMREWRAKVQGTVHCFPISARLGEWQAVLQNMVSSYLVHHGYCATATAFARMTETPIQEEQASIKNRQKIQKLVLEGRVGEAIETTQRFYPGLLEHNPNLLFMLKCRQFVEMVNGTDSEVRSLSSRSPKSQDSYPGSPSLSPRHGPSSSHMHNTGADSPSCSNGVASTKSKQNHSKYPAPSSSSSSSSSSSSSSPSSVNYSESNSTDSTKSQHHSSTSNQETSDSEMEMEAEHYPNGVLGSMSTRIVNGAYKHEDLQTDESSMDDRHPRRQLCGGNQAATERIILFGRELQALSEQLGREYGKNLAHTEMLQDAFSLLAYSDPWSCPVGQQLDPIQREPVCAALNSAILESQNLPKQPPLMLALGQASECLRLMARAGLGSCSFARVDDYLH

SEQ ID NO: 915331 - protein, 557 aa, Homo sapiens; identical to SEQ ID NO: 915327

SEQ ID NO: 915332 - protein, 557 aa, Homo sapiens; identical to SEQ ID NO: 915327

SEQ ID NO: 915333 - protein, 557 aa, Homo sapiens; identical to SEQ ID NO: 915327

SEQ ID NO: 915334 - protein, 194 aa, Homo sapiens
CDALRPRWRPAAQPPRLLAGETISSGGGRGGAGVRPHRKRKSKRRKWWAFWVTSYLLPAGAQAVVVYLPVVLPIGEDGPGDGAEGPAASAGLFAVFAGQGTIDQFEYDGCDNCDAYLQMKGNREMVYDCTSSSFDGIIAMMSPEDSWVSKWQRVSNFKPGVYAVSVTGRLPQGIVRELKSRGVAYKSRDTAIKT

SEQ ID NO: 915335 - protein, 194 aa, Homo sapiens; identical to SEQ ID NO: 915334

SEQ ID NO: 915336 - protein, 198 aa, Homo sapiens
CDALRPRWRPAAQPPRLLAGETISSGGGRGGAGVRPHRKRKSKRRKWWAFWVTSYLLPAGAQAVVVYLPVVLPIGEDGPGDGAEGPAASAGLFAVFAGQGTIDQFEYDGCDNCDAYLQMKGNREMVYDCTSSSFDGIIAMMSPEDSWVSKWQRVSNFKPGVYAVSVTGRLPQDLARCKAASIFALHLLPLLISCSGTK

SEQ ID NO: 915337 - protein, 194 aa, Homo sapiens; identical to SEQ ID NO: 915334

SEQ ID NO: 915338 - protein, 194 aa, Homo sapiens; identical to SEQ ID NO: 915334

SEQ ID NO: 915339 - protein, 136 aa, Homo sapiens
CDALRPRWRPAAQPPRLLAGETISSGGGRGGAGVRPHRKRKSKRRKWWAFWVTSYLLPAGAQAVVVYLPVVLPIGEDGPGDGAEGPAASAGLFAVFAGQGTIDQFEYDGCDNCDAYLQMKGNREMVYDCTSSSFDG

SEQ ID NO: 915340 - protein, 194 aa, Homo sapiens; identical to SEQ ID NO: 915334

SEQ ID NO: 915341 - protein, 194 aa, Homo sapiens; identical to SEQ ID NO: 915334

SEQ ID NO: 915342 - protein, 136 aa, Homo sapiens; identical to SEQ ID NO: 915339

SEQ ID NO: 915343 - protein, 194 aa, Homo sapiens; identical to SEQ ID NO: 915334

SEQ ID NO: 915344 - protein, 132 aa, Homo sapiens
MALETVPKDLRHLRACLLCSLVKGVSRGPGCRAHGGPSTIDQFEYDGCDNCDAYLQMKGNREMVYDCTSSSFDGIIAMMSPEDSWVSKWQRVSNFKPGVYAVSVTGRLPQGIVRELKSRGVAYKSRDTAIKT

SEQ ID NO: 915345 - protein, 198 aa, Homo sapiens; identical to SEQ ID NO: 915336

SEQ ID NO: 915346 - protein, 364 aa, Homo sapiens
MAAISTSIPVISQPQFTAMNEPQCFYNESIAFFYNRSGKHLATEWNTVSKLVMGLGITVCIFIMLANLLVMVAIYVNRRFHFPIYYLMANLAAADFFAGLAYFYLMFNTGPNTRRLTVSTWLLRQGLIDTSLTASVANLLAIAIERHITVFRMQLHTRMSNRRVVVVIVVIWTMAIVMGAIPSVGWNCICDIENCSNMAPLYSDSYLVFWAIFNLVTFVVMVVLYAHIFGYVRQRTMRMSRHSSGPRRNRDTMMSLLKTVVIVLGAFIICWTPGLVLLLLDVCCPQCDVLAYEKFFLLLAEFNSAMNPIIYSYRDKEMSATFRQILCCQRSENPTGPTEGSDRSASSLNHTILAGVHSNDHSVV

SEQ ID NO: 915347 - protein, 364 aa, Homo sapiens; identical to SEQ ID NO: 915346

SEQ ID NO: 915348 - protein, 364 aa, Homo sapiens; identical to SEQ ID NO: 915346

SEQ ID NO: 915349 - protein, 364 aa, Homo sapiens; identical to SEQ ID NO: 915346

SEQ ID NO: 915350 - protein, 364 aa, Homo sapiens; identical to SEQ ID NO: 915346

SEQ ID NO: 915351 - protein, 125 aa, Homo sapiens
LAPEASLYKRERTPCCYTLLIFHRYRAFIICWTPGLVLLLLDVCCPQCDVLAYEKFFLLLAEFNSAMNPIIYSYRDKEMSATFRQILCCQRSENPTGPTEGSDRSASSLNHTILAGVHSNDHSVV

SEQ ID NO: 915352 - protein, 364 aa, Homo sapiens; identical to SEQ ID NO: 915346

SEQ ID NO: 915353 - protein, 364 aa, Homo sapiens; identical to SEQ ID NO: 915346

SEQ ID NO: 915354 - protein, 364 aa, Homo sapiens; identical to SEQ ID NO: 915346

SEQ ID NO: 915355 - protein, 346 aa, Homo sapiens
MNEPQCFYNESIAFFYNRSGKHLATEWNTVSKLVMGLGITVCIFIMLANLLVMVAIYVNRRFHFPIYYLMANLAAADFFAGLAYFYLMFNTGPNTRRLTVSTWLLRQGLIDTSLTASVANLLAIAIERHITVFRMQLHTRMSNRRVVVVIVVIWTMAIVMGAIPSVGWNCICDIENCSNMAPLYSDSYLVFWAIFNLVTFVVMVVLYAHIFGYVRQRTMRMSRHSSGPRRNRDTMMSLLKTVVIVLGAFIICWTPGLVLLLLDVCCPQCDVLAYEKFFLLLAEFNSAMNPIIYSYRDKEMSATFRQILCCQRSENPTGPTEGSDRSASSLNHTILAGVHSNDHSVV

SEQ ID NO: 915356 - protein, 364 aa, Homo sapiens; identical to SEQ ID NO: 915346

SEQ ID NO: 915357 - protein, 793 aa, Homo sapiens
MPAGPVQAVPPPPPVPTEPKQPTEEEASSKEDSAPSKPVVGIIYPPPEVRNIVDKTASFVARNGPEFEARIRQNEINNPKFNFLNPNDPYHAYYRHKVSEFKEGKAQEPSAAIPKVMQQQQQTTQQQLPQKVQAQVIQETIVPKEPPPEFEFIADPPSISAFDLDVVKLTAQFVARNGRQFLTQLMQKEQRNYQFDFLRPQHSLFNYFTKLVEQYTKILIPPKGLFSKLKKEAENPREVLDQVCYRVEWAKFQERERKKEEEEKEKERVAYAQIDWHDFVVVETVDFQPNEQGNFPPPTTPEELGARILIQERYEKFGESEEVEMEVESDEEDDKQEKAEEPPSQLDQDTQVQDMDEGSDDEEEGQKVPPPPETPMPPPLPPTPDQVIVRKDYDPKASKPLPPAPAPDEYLVSPITGEKIPASKMQEHMRIGLLDPRWLEQRDRSIREKQSDDEVYAPGLDIESSLKQLAERRTDIFGVEETAIGKKIGEEEIQKPEEKVTWDGHSGSMARTQQAAQANITLQEQIEAIHKAKGLVPEDDTKEKIGPSKPNEIPQQPPPPSSATNIPSSAPPITSVPRPPTMPPPVRTTVVSAVPVMPRPPMASVVRLPPGSVIAPMPPIIHAPRINVVPMPPSAPPIMAPRPPPMIVPTAFVPAPPVAPVPAPAPMPPVHPPPPMEDEPTSKKLKTEDSLMPEEEFLRRNKGPVSIKVQVPNMQDKTEWKLNGQVLVFTLPLTDQVSVIKVKIHEATGMPAGKQKLQYEGIFIKDSNSLAYYNMANGAVIHLALKERGGRKK

SEQ ID NO: 915358 - protein, 793 aa, Homo sapiens; identical to SEQ ID NO: 915357

SEQ ID NO: 915359 - protein, 793 aa, Homo sapiens; identical to SEQ ID NO: 915357

SEQ ID NO: 915360 - protein, 728 aa, Homo sapiens
MPAGPVQAVPPPPPVPTEPKQPTEEEASSKEDSAPSKPVVGIIYPPPEVRNIVDKTASFVARNGPEFEARIRQNEINNPKFNFLNPNDPYHAYYRHKVSEFKEGKAQFVARNGRQFLTQLMQKEQRNYQFDFLRPQHSLFNYFTKLVEQYTKILIPPKGLFSKLKKEAENPREVLDQVCYRVEWAKFQERERKKEEEEKEKERVAYAQIDWHDFVVVETVDFQPNEQGNFPPPTTPEELGARILIQERYEKFGESEEVEMEVESDEEDDKQEKAEEPPSQLDQDTQVQDMDEGSDDEEEGQKVPPPPETPMPPPLPPTPDQVIVRKDYDPKASKPLPPAPAPDEYLVSPITGEKIPASKMQEHMRIGLLDPRWLEQRDRSIREKQSDDEVYAPGLDIESSLKQLAERRTDIFGVEETAIGKKIGEEEIQKPEEKVTWDGHSGSMARTQQAAQANITLQEQIEAIHKAKGLVPEDDTKEKIGPSKPNEIPQQPPPPSSATNIPSSAPPITSVPRPPTMPPPVRTTVVSAVPVMPRPPMASVVRLPPGSVIAPMPPIIHAPRINVVPMPPSAPPIMAPRPPPMIVPTAFVPAPPVAPVPAPAPMPPVHPPPPMEDEPTSKKLKTEDSLMPEEEFLRRNKGPVSIKVQVPNMQDKTEWKLNGQVLVFTLPLTDQVSVIKVKIHEATGMPAGKQKLQYEGIFIKDSNSLAYYNMANGAVIHLALKERGGRKK

SEQ ID NO: 915361 - protein, 578 aa, Homo sapiens
MKALEVVASSGADPGFSVAPSCFPSLQVCYRVEWAKFQERERKKEEEEKEKERVAYAQIDWHDFVVVETVDFQPNEQGNFPPPTTPEELGARILIQERYEKFGESEEVEMEVESDEEDDKQEKAEEPPSQLDQDTQVQDMDEGSDDEEEGQKVPPPPETPMPPPLPPTPDQVIVRKDYDPKASKPLPPAPAPDEYLVSPITGEKIPASKMQEHMRIGLLDPRWLEQRDRSIREKQSDDEVYAPGLDIESSLKQLAERRTDIFGVEETAIGKKIGEEEIQKPEEKVTWDGHSGSMARTQQAAQANITLQEQIEAIHKAKGLVPEDDTKEKIGPSKPNEIPQQPPPPSSATNIPSSAPPITSVPRPPTMPPPVRTTVVSAVPVMPRPPMASVVRLPPGSVIAPMPPIIHAPRINVVPMPPSAPPIMAPRPPPMIVPTAFVPAPPVAPVPAPAPMPPVHPPPPMEDEPTSKKLKTEDSLMPEEEFLRRNKGPVSIKVQVPNMQDKTEWKLNGQVLVFTLPLTDQVSVIKVKIHEATGMPAGKQKLQYEGIFIKDSNSLAYYNMANGAVIHLALKERGGRKK

SEQ ID NO: 915362 - protein, 369 aa, Homo sapiens
MQEHMRIGLLDPRWLEQRDRSIREKQSDDEVYAPGLDIESSLKQLAERRTDIFGVEETAIGKKIGEEEIQKPEEKVTWDGHSGSMARTQQAAQANITLQEQIEAIHKAKGLVPEDDTKEKIGPSKPNEIPQQPPPPSSATNIPSSAPPITSVPRPPTMPPPVRTTVVSAVPVMPRPPMASVVRLPPGSVIAPMPPIIHAPRINVVPMPPSAPPIMAPRPPPMIVPTAFVPAPPVAPVPAPAPMPPVHPPPPMEDEPTSKKLKTEDSLMPEEEFLRRNKGPVSIKVQVPNMQDKTEWKLNGQVLVFTLPLTDQVSVIKVKIHEATGMPAGKQKLQYEGIFIKDSNSLAYYNMANGAVIHLALKERGGRKK

SEQ ID NO: 915363 - protein, 133 aa, Homo sapiens
MPAGPVQAVPPPPPVPTEPKQPTEEEASSKEDSAPSKPVVGIIYPPPEVRNIVDKTASFVARNGPEFEARIRQNEINNPKFNFLNPNDPYHAYYRHKVSEFKEGKALWARWSLGLLGLGPSGAAAAGCLLLLL

SEQ ID NO: 915364 - protein, 793 aa, Homo sapiens; identical to SEQ ID NO: 915357

SEQ ID NO: 915365 - protein, 793 aa, Homo sapiens; identical to SEQ ID NO: 915357

SEQ ID NO: 915366 - protein, 793 aa, Homo sapiens; identical to SEQ ID NO: 915357

SEQ ID NO: 915367 - protein, 793 aa, Homo sapiens; identical to SEQ ID NO: 915357

SEQ ID NO: 915368 - protein, 735 aa, Homo sapiens
MPAGPVQAVPPPPPVPTEPKQPTEEEASSKEDSAPSKPVVGIIYPPPEVRNIVDKTASFVARNGPEFEARIRQNEINNPKFNFLNPNDPYHAYYRHKVSEFKEGKAQEPSAAIPKVMQQQQQTTQQQLPQKVQAQVIQETIVPKEPPPEFEFIADPPSISAFDLDVVKLTAQFVARNGRQFLTQLMQKEQRNYQFDFLRPQHSLFNYFTKLVEQYTKILIPPKGLFSKLKKEAENPREVLDQVCYRVEWAKFQERERKKEEEEKEKERVAYAQIDWHDFVVVETVDFQPNEQGNFPPPTTPEELGARILIQERYEKFGESEEVEMEVESDEEDDKQEKAEEPPSQLDQDTQVQDMDEGSDDEEEGQKVPPPPETPMPPPLPPTPDQVIVRKDYDPKASKPLPPAPAPDEYLVSPITGEKIPASKMQEHMRIGLLDPRWLEQRDRSIREKQSDDEVYAPGLDIESSLKQLAERRTDIFGVEETAIGKKIGEEEIQKPEEKVTWDGHSGSMARTQQAAQANITLQEQIEAIHKAKGLVPEDDTKEKIGPSKPNEIPQQPPPPSSATNIPSSAPPITSVPRPPTMPPPVRTTVVSAVPVMPRPPMASVVRLPPGSVIAPMPPIIHAPRINVVPMPPSAPPIMAPRPPPMIVPTAFVPAPPVAPVPAPAPMPPVHPPPPMEDEPTSKKLKTEDSLMPEEEFLRRNKGPVSIKLGALSGGKVQLHAPWPCSERLAFALIN

SEQ ID NO: 915369 - protein, 260 aa, Homo sapiens
MPAGPVQAVPPPPPVPTEPKQPTEEEASSKEDSAPSKPVVGIIYPPPEVRNIVDKTASFVARNGPEFEARIRQNEINNPKFNFLNPNDPYHAYYRHKVSEFKEGKAQEPSAAIPKVMQQQQQTTQQQLPQKVQAQVIQETIVPKEPPPEFEFIADPPSISAFDLDVVKLTAQFVARNGRQFLTQLMQKEQRNYQFDFLRPQHSLFNYFTKLVEQYTKILIPPKGLFSKLKKEAENPREVLDQPKKFLGSRCGLPQLGIGA

SEQ ID NO: 915370 - protein, 103 aa, Homo sapiens
MPAGPVQAVPPPPPVPTEPKQPTEEEASSKEDSAPSKPVVGIIYPPPEVRNIVDKTASFVARNGPEFEARIRQNEINNPKFNFLNPNDPYHAYYLGYYYLGDN

SEQ ID NO: 915371 - protein, 123 aa, Homo sapiens
MVLQVSAAPRTVALTALLMVLLTSVVQGRATPENYLFQGRQECYAFNGTQRFLERYIYNREEFVRFDSDVGEFRAVTELGRPDEEYWNSQKDILEEKRAVPDRMCRHNYELGEAHDPAAPSPA

SEQ ID NO: 915372 - protein, 175 aa, Homo sapiens
MRSTGTARRTSWRRSGQCRTGCADTTTSWARPMTLQRRVQPRVNVSPSKKGPLQHHNLLVCHVTDFYPGSIQVRWFLNGQEETAGVVSTNLIRNGDWTFQILVMLEMTPQQGDVYTCQVEHTSLDSPVTVEWKAQSDSARSKTLTGAGGFVLGLIICGVGIFMHRRSKKVQRGSA

SEQ ID NO: 915373 - protein, 175 aa, Homo sapiens; identical to SEQ ID NO: 915372

SEQ ID NO: 915374 - protein, 160 aa, Homo sapiens
MGHSASWRDTTTSWARPMTLQRRVQPRVNVSPSKKGPLQHHNLLVCHVTDFYPGSIQVRWFLNGQEETAGVVSTNLIRNGDWTFQILVMLEMTPQQGDVYTCQVEHTSLDSPVTVEWKAQSDSARSKTLTGAGGFVLGLIICGVGIFMHRRSKKVQRGSA

SEQ ID NO: 915375 - protein, 123 aa, Homo sapiens; identical to SEQ ID NO: 915371

SEQ ID NO: 915376 - protein, 123 aa, Homo sapiens; identical to SEQ ID NO: 915371

SEQ ID NO: 915377 - protein, 123 aa, Homo sapiens; identical to SEQ ID NO: 915371

SEQ ID NO: 915378 - protein, 126 aa, Homo sapiens
MVLQVSAAPRTVALTALLMVLLTSVVQGRATPENYPMATSGGLSLTQTHSPATSSPIDAHFEALSLSKFTFSFLVLHFPNIFSIPGPIRDAVAPWGKGTNPWQQLHSIPLFNVTFSTGGISFLCWS

SEQ ID NO: 915379 - protein, 123 aa, Homo sapiens; identical to SEQ ID NO: 915371

SEQ ID NO: 915380 - protein, 123 aa, Homo sapiens; identical to SEQ ID NO: 915371

SEQ ID NO: 915381 - protein, 145 aa, Homo sapiens
MVLQVSAAPRTVALTALLMVLLTSVVQGRATPENYLFQGRQECYAFNGTQRFLERYIYNREEFVRFDSDVGEFRAVTELGRPDEEYWNSQKDILEEKRAVPDRMCRHNYELGEAHDPAAPRQHSSPMVPEWTGGNSWGRVHQPDP

SEQ ID NO: 915382 - protein, 123 aa, Homo sapiens; identical to SEQ ID NO: 915371

SEQ ID NO: 915383 - protein, 71 aa, Homo sapiens
ARYPNVLLRAESDCAFHSTVTGLIQAGVLHLAGVDISLLEGASSSITRSKKGQGEICINRVPELTEKTIVP

SEQ ID NO: 915384 - protein, 137 aa, Homo sapiens
MSQKKGRKEGRKEGRKEGRKEGQSQILFHYFSSTLLVQPRVNVSPSKKGPLQHHNLLVCHVTDFYPGSIQVRWFLNGQEETAGVVSTNLIRNGDWTFQILVMLEMTPQQGDVYTCQVEHTSLDSPVTVEWSESLMTL

SEQ ID NO: 915385 - protein, 120 aa, Homo sapiens
IPRFAEKAPLALLSQSIIQRCCSCKSINRKSIHNLAGQRSSSAVSRLPSLGSGAAPLPPWLARNVVIRPGAGMTSCSRSSAAGAEAAAGRWGAGRRELTEHSAGAAGLRPVAACAGTCAD

SEQ ID NO: 915386 - protein, 120 aa, Homo sapiens; identical to SEQ ID NO: 915385

SEQ ID NO: 915387 - protein, 120 aa, Homo sapiens; identical to SEQ ID NO: 915385

SEQ ID NO: 915388 - protein, 120 aa, Homo sapiens; identical to SEQ ID NO: 915385

SEQ ID NO: 915389 - protein, 120 aa, Homo sapiens; identical to SEQ ID NO: 915385

SEQ ID NO: 915390 - protein, 103 aa, Homo sapiens
QLLESIDVEHFSLFNVGDSLLCGYLVAMTDVETTYADFIASGRTGRRNAIHDILVSSASGNSNELALKLAGLDINKTEGEEDAQRSSTEQSGEAQGEAAKSES

SEQ ID NO: 915391 - protein, 120 aa, Homo sapiens; identical to SEQ ID NO: 915385

SEQ ID NO: 915392 - protein, 347 aa, Homo sapiens
MPARALLPRRMGHRTLASTPALWASIPCPRSELRLDLVLPSGQSFRWREQSPAHWSGVLADQVWTLTQTEEQLHCTVYRGDKSQASRPTPDELEAVRKYFQLDVTLAQLYHHWGSVDSHFQEVAQKFQGVRLLRQDPIECLFSFICSSNNNIARITGMVERLCQAFGPRLIQLDDVTYHGFPSLQALAGPEVEAHLRKLGLGYRARYVSASARAILEEQGGLAWLQQLRESSYEEAHKALCILPGVGTKVADCICLMALDKPQAVPVDVHMWHIAQRDYSWHPTTSQAKGPSPQTNKELGNFFRSLWGPYAGWAQALQVLFSADLRQSRHAQEPPAKRRKGSKGPEG

SEQ ID NO: 915393 - protein, 424 aa, Homo sapiens
MPARALLPRRMGHRTLASTPALWASIPCPRSELRLDLVLPSGQSFRWREQSPAHWSGVLADQVWTLTQTEEQLHCTVYRGDKSQASRPTPDELEAVRKYFQLDVTLAQLYHHWGSVDSHFQEVAQKFQGVRLLRQDPIECLFSFICSSNNNIARITGMVERLCQAFGPRLIQLDDVTYHGFPSLQALAGPEVEAHLRKLGLGYRARYVSASARAILEEQGGLAWLQQLRESSYEEAHKALCILPGVGTKVADCICLMALDKPQAVPVDVHMWHIAQRDYSWHPTTSQAKGPSPQTNKELGNFFRSLWGPYAGWAQAGLLGNAFDGHQLLRPLIFCQDHLREGPPIGRGDSQGEELEPQLPSSLSSIPYGFCDHCWTKDVDDPPLVTHPSPGSRDGHMTQAWPVKVVSPLATVIGHVMQASLLAL

SEQ ID NO: 915394 - protein, 356 aa, Homo sapiens
MPARALLPRRMGHRTLASTPALWASIPCPRSELRLDLVLPSGQSFRWREQSPAHWSGVLADQVWTLTQTEEQLHCTVYRGDKSQASRPTPDELEAVRKYFQLDVTLAQLYHHWGSVDSHFQEVAQKFQGVRLLRQDPIECLFSFICSSNNNIARITGMVERLCQAFGPRLIQLDDVTYHGFPSLQALAGPEVEAHLRKLGLGYRARYVSASARAILEEQGGLAWLQQLRESSYEEAHKALCILPGVGTKVADCICLMALDKPQAVPVDVHMWHIAQRDYSWHPTTSQAKGPSPQTNKELGNFFRSLWGPYAGWAQALCQVITTFMTFLGPHRLDQMPPEELQTSSSRLGGPPWQCI

SEQ ID NO: 915395 - protein, 357 aa, Homo sapiens
MPARALLPRRMGHRTLASTPALWASIPCPRSELRLDLVLPSGQSFRWREQSPAHWSGVLADQVWTLTQTEEQLHCTVYRGDKSQASRPTPDELEAVRKYFQLDVTLAQLYHHWGSVDSHFQEVAQKFQGVRLLRQDPIECLFSFICSSNNNIARITGMVERLCQAFGPRLIQLDDVTYHGFPSLQALAGPEVEAHLRKLGLGYRARYVSASARAILEEQGGLAWLQQLRESSYEEAHKALCILPGVGTKGLLGNAFDGHQLLRPLIFCQDHLREGPPIGRGDSQGEELEPQLPSSLSSIPYGFCDHCWTKDVDDPPLVTHPSPGSRDGHMTQAWPVKVVSPLATVIGHVMQASLLAL

SEQ ID NO: 915396 - protein, 185 aa, Homo sapiens
MGHRTLASTPALWASIPCPRSELRLDLVLPSGQSFRWREQSPAHWSGVLADQVWTLTQTEEQLHCTVYRGDKSQASRPTPDELEAVRKYFQLDVTLAQLYHHWGSVDSHFQEVAQKFQGVRLLRQDPIECLFSFICSSNNNIARITGMVERLCQAFGPRLIQLDDVTYHGFPSLQALAGPPWQCI

SEQ ID NO: 915397 - protein, 356 aa, Homo sapiens
MPARALLPRRMGHRTLASTPALWASIPCPRSELRLDLVLPSGQSFRWREQSPAHWSGVLADQVWTLTQTEEQLHCTVYRGDKSQASRPTPDELEAVRKYFQLDVTLAQLYHHWGSVDSHFQEVAQKFQGVRLLRQDPIECLFSFICSSNNNIARITGMVERLCQAFGPRLIQLDDVTYHGFPSLQALAGPEVEAHLRKLGLGYRARYVSASARAILEEQGGLAWLQQLRESSYEEAHKALCILPGVGTKETFSGACGDLMLAGPKRYRCCSVPTCANPAMLRSHQQSAERVPKGRKARWGTLDKEIPQAPSPPFPTSLSPSPPSLMLGRGLPVTTSKARHPQIKQSVCTTRWGGGY

SEQ ID NO: 915398 - protein, 287 aa, Homo sapiens
MPARALLPRRMGHRTLASTPALWASIPCPRSELRLDLVLPSGQSFRWREQSPAHWSGVLADQVWTLTQTEEQLHCTVYRGDKSQASRPTPDELEAVRKYFQLDVTLAQLYHHWGSVDSHFQEVAQKFQGVRLLRQDPIECLFSFICSSNNNIARITGMVERLCQAFGPRLIQLDDVTYHGFPSLQALAGPEVEAHLRKLGLGYRARYVSASARAILEEQGGLAWLQQLRESSYEEAHKALCILPGVGTKAVTDAAMMATRHSLTAVPVMSYVTFTYVLLRAINNPGV

SEQ ID NO: 915399 - protein, 190 aa, Homo sapiens
MPARALLPRRMGHRTLASTPALWASIPCPRSELRLDLVLPSGQSFRWREQSPAHWSGVLADQVWTLTQTEEQLHCTVYRGDKSQASRPTPDELEAVRKYFQLDVTLAQLYHHWGSVDSHFQEVAQKFQGVRLLRQDPIECLFSFICSSNNNIARITGMVERLCQAFGPRLIQLDDVTYHGFPSLQALAGG

SEQ ID NO: 915400 - protein, 316 aa, Homo sapiens
MCLGLRWREQSPAHWSGVLADQVWTLTQTEEQLHCTVYRGDKSQASRPTPDELEAVRKYFQLDVTLAQLYHHWGSVDSHFQEVAQKFQGVRLLRQDPIECLFSFICSSNNNIARITGMVERLCQAFGPRLIQLDDVTYHGFPSLQALAGPEVEAHLRKLGLGYRARYVSASARAILEEQGGLAWLQQLRESSYEEAHKALCILPGVGTKVADCICLMALDKPQAVPVDVHMWHIAQRDYSWHPTTSQAKGPSPQTNKELGNFFRSLWGPYAGWAQALCQVITTFMTFLGPHRLDQMPPEELQTSSSRLGGPPWQCI

SEQ ID NO: 915401 - protein, 213 aa, Homo sapiens
MPARALLPRRMGHRTLASTPALWASIPCPRSELRLDLVLPSGQSFRWREQSPAHWSGVLADQVWTLTQTEEQLHCTVYRGDKSQASRPTPDELEAVRKYFQLDVTLAQLYHHWGSVDSHFQEVAQKFQGVRLLRQDPIECLFSFICSSNNNIARITGMVERLCQAFGPRLIQLDDVTYHGFPSLQALAGNFFRSLWGPYAGWAQAVSVPRCPP

SEQ ID NO: 915402 - protein, 236 aa, Homo sapiens
MPARALLPRRMGHRTLASTPALWASIPCPRSELRLDLVLPSGQSFRWREQSPAHWSGVLADQVWTLTQTEEQLHCTVYRGDKSQASRPTPDELEAVRKYFQLDVTLAQLYHHWGSVDSHFQEVAQKFQGVRLLRQDPIECLFSFICSSNNNIARITGMVERLCQAFGPRLIQLDDVTYHGFPSLQALAGNFFRSLWGPYAGWAQALQVLFSADLRQSRHAQEPPAKRRKGSKGPEG

SEQ ID NO: 915403 - protein, 324 aa, Homo sapiens
MPARALLPRRMGHRTLASTPALWASIPCPRSELRLDLVLPSGQSFRWREQSPAHWSGVLADQVWTLTQTEEQLHCTVYRGDKSQASRPTPDELEAVRKYFQLDVTLAQLYHHWGSVDSHFQEVAQKFQGVRLLRQDPIECLFSFICSSNNNIARITGMVERLCQAFGPRLIQLDDVTYHGFPSLQALAGPEVEAHLRKLGLGYRARYVSASARAILEEQGGLAWLQQLRESSYEEAHKALCILPGVGTKVADCICLMALDKPQAVPVDVHMWHIAQRDYSWHPTTSQAKGPSPQTNKELGNFFRSLWGPYAGWAQAVSVPRCPP

SEQ ID NO: 915404 - protein, 322 aa, Homo sapiens
MPARALLPRRMGHRTLASTPALWASIPCPRSELRLDLVLPSGQSFRWREQSPAHWSGVLADQVWTLTQTEEQLHCTVYRGDKSQASRPTPDELEAVRKYFQLDVTLAQLYHHWGSVDSHFQEVAQKFQGVRLLRQDPIECLFSFICSSNNNIARITGMVERLCQAFGPRLIQLDDVTYHGFPSLQALAGPEVEAHLRKLGLGYRARYVSASARAILEEQGGLAWLQQLRESSYEEAHKALCILPGVGTKVADCICLMALDKPQAVPVDVHMWHIAQRDYSWHPTTSQAKGPSPQTNKELGNFFRSLWGPYAGWAQAAGSDAS

SEQ ID NO: 915405 - protein, 359 aa, Homo sapiens
MPARALLPRRMGHRTLASTPALWASIPCPRSELRLDLVLPSGQSFRWREQSPAHWSGVLADQVWTLTQTEEQLHCTVYRGDKSQASRPTPDELEAVRKYFQLDVTLAQLYHHWGSVDSHFQEVAQKFQGVRLLRQDPIECLFSFICSSNNNIARITGMVERLCQAFGPRLIQLDDVTYHGFPSLQALAGPEVEAHLRKLGLGYRARYVSASARAILEEQGGLAWLQQLRESSYEEAHKALCILPGVGTKVADCICLMALDKPQAVPVDVHMWHIAQRDYSWHPTTSQAKGPSPQTNKELGNFFRSLWGPYAGWAQAGLLGNAFDGHQLLRPLIFCQDHLREGPLATVIGHVMQASLLAL

SEQ ID NO: 915406 - protein, 324 aa, Homo sapiens; identical to SEQ ID NO: 915403

SEQ ID NO: 915407 - protein, 261 aa, Homo sapiens
MLPWLNCITTGVPWTPTSKRWLRNSKVCDCCDKTPSNAFSLLSVPPTTTSPASLAWWSGCARLLDLGSSSLMMSPTMASPACRPWLVADCICLMALDKPQAVPVDVHMWHIAQRDYSWHPTTSQAKGPSPQTNKELGNFFRSLWGPYAGWAQAGLLGNAFDGHQLLRPLIFCQDHLREGPPIGRGDSQGEELEPQLPSSLSSIPYGFCDHCWTKDVDDPPLVTHPSPGSRDGHMTQAWPVKVVSPLATVIGHVMQASLLAL

SEQ ID NO: 915408 - protein, 316 aa, Homo sapiens; identical to SEQ ID NO: 915400

SEQ ID NO: 915409 - protein, 190 aa, Homo sapiens; identical to SEQ ID NO: 915399

SEQ ID NO: 915410 - protein, 218 aa, Homo sapiens
MPARALLPRRMGHRTLASTPALWASIPCPRSELRLDLVLPSGQSFRWREQSPAHWSGVLADQVWTLTQTEEQLHCTVYRGDKSQASRPTPDELEAVRKYFQLDVTLAQLYHHWGSVDSHFQEVAQKFQGVRLLRQDPIECLFSFICSSNNNIARITGMVERLCQAFGPRLIQLDDVTYHGFPSLQALAGVPVPAEGLLTSASAFQSPLRSRQPEADRR

SEQ ID NO: 915411 - protein, 568 aa, Homo sapiens
MLLLPSAADGRGTAITHALTSASTLCQVEPVGRWFEAFVKRRNRNASASFQELEDKKELSEESEDEELQLEEFPMLKTLDPKDWKNQDHYAVLGLGHVRYKATQRQIKAAHKAMVLKHHPDKRKAAGEPIKEGDNDYFTCITKAYEMLSDPVKRRAFNSVDPTFDNSVPSKSEAKDNFFEVFTPVFERNSRWSNKKNVPKLGDMNSSFEDVDIFYSFWYNFDSWREFSYLDEEEKEKAECRDERRWIEKQNRATRAQRKKEEMNRIRTLVDNAYSCDPRIKKFKEEEKAKKEAEKKAKAEAKRKEQEAKEKQRQAELEAARLAKEKEEEEVRQQALLAKKEKDIQKKAIKKERQKLRNSCKIEEINEQIRKEKEEAEARMRQASKNTEKSTGGGGNGSKNWSEDDLQLLIKAVNLFPAGTNSRWEVIANYMNIHSSSGVKRTAKDVIGKAKSLQKLDPHQKDDINKKAFDKFKKEHGVVPQADNATPSERFEGPYTDFTPWTTEEQKLLEQALKTYPVNTPERWEKIAEAVPGRTKKDCMKRYKELVEMVKAKKAAQEQVLNASRAKK

SEQ ID NO: 915412 - protein, 118 aa, Homo sapiens
MLLLPSAADGRGTAITHALTSASTLCQVEPVGRWFEAFVKRRNRNASASFQELEDKKELSEESEDEELQLEEFPMLKTLDPKDWKNQDHYAVLGLGHVRYKATQRQIKAARKYLVILK

SEQ ID NO: 915413 - protein, 621 aa, Homo sapiens
MLLLPSAADGRGTAITHALTSASTLCQVEPVGRWFEAFVKRRNRNASASFQELEDKKELSEESEDEELQLEEFPMLKTLDPKDWKNQDHYAVLGLGHVRYKATQRQIKAAHKAMVLKHHPDKRKAAGEPIKEGDNDYFTCITKAYEMLSDPVKRRAFNSVDPTFDNSVPSKSEAKDNFFEVFTPVFERNSRWSNKKNVPKLGDMNSSFEDVDIFYSFWYNFDSWREFSYLDEEEKEKAECRDERRWIEKQNRATRAQRKKEEMNRIRTLVDNAYSCDPRIKKFKEEEKAKKEAEKKAKAEAKRKEQEAKEKQRQAELEAARLAKEKEEEEVRQQALLAKKEKDIQKKAIKKERQKLRNSCKTWNHFSDNEAERVKMMEEVEKLCDRLELASLQCLNETLTSCTKEVGKAALEKQIEEINEQIRKEKEEAEARMRQASKNTEKSTGGGGNGSKNWSEDDLQLLIKAVNLFPAGTNSRWEVIANYMNIHSSSGVKRTAKDVIGKAKSLQKLDPHQKDDINKKAFDKFKKEHGVVPQADNATPSERFEGPYTDFTPWTTEEQKLLEQALKTYPVNTPERWEKIAEAVPGRTKKDCMKRYKELVEMVKAKKAAQEQVLNASRAKK

SEQ ID NO: 915414 - protein, 621 aa, Homo sapiens; identical to SEQ ID NO: 915413

SEQ ID NO: 915415 - protein, 637 aa, Homo sapiens
MLLLPSAADGRGTAITHALTSASTLCQVEPVGRWFEAFVKRRNRNASASFQELEDKKELSEESEDEELQLEEFPMLKTLDPKDWKNQDHYAVLGLGHVRYKATQRQIKAAHKAMVLKHHPDKRKAAGEPIKEGDNDYFTCITKGSPGDSYQKLILTVNSSYEMLSDPVKRRAFNSVDPTFDNSVPSKSEAKDNFFEVFTPVFERNSRWSNKKNVPKLGDMNSSFEDVDIFYSFWYNFDSWREFSYLDEEEKEKAECRDERRWIEKQNRATRAQRKKEEMNRIRTLVDNAYSCDPRIKKFKEEEKAKKEAEKKAKAEAKRKEQEAKEKQRQAELEAARLAKEKEEEEVRQQALLAKKEKDIQKKAIKKERQKLRNSCKTWNHFSDNEAERVKMMEEVEKLCDRLELASLQCLNETLTSCTKEVGKAALEKQIEEINEQIRKEKEEAEARMRQASKNTEKSTGGGGNGSKNWSEDDLQLLIKAVNLFPAGTNSRWEVIANYMNIHSSSGVKRTAKDVIGKAKSLQKLDPHQKDDINKKAFDKFKKEHGVVPQADNATPSERFEGPYTDFTPWTTEEQKLLEQALKTYPVNTPERWEKIAEAVPGRTKKDCMKRYKELVEMVKAKKAAQEQVLNASRAKK

SEQ ID NO: 915416 - protein, 512 aa, Homo sapiens
MLLLPSAADGRGTAITHALTSASTLCQVEPVGRWFEAFVKRRNRNASASFQELEDKKELSEESEDEELQLEEFPMLKTLDPKDWKNQDHYAVLGLGHVRYKATQRQIKAAHKAMVLKHHPDKRKAAGEPIKEGDNDYFTCITKAYEMLSDPVKRRAFNSVDPTFDNSVPSKSEAKDNFFEVFTPVFERNSRWSNKKNVPKLGDMNSSFEDVDIFYSFWYNFDSWREFSYLDEEEKEKAECRDERRWIEKQNRATRAQRKKEEMNRIRTLVDNAYSCDPRIKKFKEEEKAKKEAEKKAKAEAKRKEQEAKEKQRQAELEAARLAKEKEEEEVRQQALLAKKEKDIQKKAIKKERQKLRNSCKTWNHFSDNEAERVKMMEEVEKLCDRLELASLQCLNETLTSCTKEVGKAALEKQIEEINEQIRKEKEEAEARMRQASKNTEKSTGGGGNGSKNWSEDDLQLLIKAVNLFPAGTNSRWEVIANYMNIHSSSGVKRTAKDVIGKAKSLQKLGEF

SEQ ID NO: 915417 - protein, 475 aa, Homo sapiens
MLSDPVKRRAFNSVDPTFDNSVPSKSEAKDNFFEVFTPVFERNSRWSNKKNVPKLGDMNSSFEDVDIFYSFWYNFDSWREFSYLDEEEKEKAECRDERRWIEKQNRATRAQRKKEEMNRIRTLVDNAYSCDPRIKKFKEEEKAKKEAEKKAKAEAKRKEQEAKEKQRQAELEAARLAKEKEEEEVRQQALLAKKEKDIQKKAIKKERQKLRNSCKTWNHFSDNEAERVKMMEEVEKLCDRLELASLQCLNETLTSCTKEVGKAALEKQIEEINEQIRKEKEEAEARMRQASKNTEKSTGGGGNGSKNWSEDDLQLLIKAVNLFPAGTNSRWEVIANYMNIHSSSGVKRTAKDVIGKAKSLQKLDPHQKDDINKKAFDKFKKEHGVVPQADNATPSERFEGPYTDFTPWTTEEQKLLEQALKTYPVNTPERWEKIAEAVPGRTKKDCMKRYKELVEMVKAKKAAQEQVLNASRAKK

SEQ ID NO: 915418 - protein, 402 aa, Homo sapiens
MLLLPSAADGRGTAITHALTSASTLCQVEPVGRWFEAFVKRRNRNASASFQELEDKKELSEESEDEELQLEEFPMLKTLDPKDWKNQDHYAVLGLGHVRYKATQRQIKAAHKAMVLKHHPDKRKAAGEPIKEGDNDYFTCITKAYEMLSDPVKRRAFNSVDPTFDNSVPSKSEAKDNFFEVFTPVFERNSRWSNKKNVPKLGDMNSSFEDVDIFYSFWYNFDSWREFSYLDEEEKEKAECRDERRWIEKQNRATRAQRKKEEMNRIRTLVDNAYSCDPRIKKFKEEEKAKKEAEKKAKAEAKRKEQEAKEKQRQAELEAARLAKEKEEEEVRQQALLAKKEKDIQKKAIKKERQKLRNSCKTWNHFSDNEAERVKMMEEVEKLCDRLELARYTYGTAIEVFT

SEQ ID NO: 915419 - protein, 500 aa, Homo sapiens
SQLILEGTTTPSDLAVMSMAAFMNDTEAMRTRKFMTNRLLERKQMVIDVLHPGKATVPKTEIREKLAKMYKTTPDVIFVFGFRTHFGGGRTTGFGMIYDSLDYAKKNEPKHRLARHGLYEKKKTFKKATKGTTRAQRKKEEMNRIRTLVDNAYSCDPRIKKFKEEEKAKKEAEKKAKAEAKRKEQEAKEKQRQAELEAARLAKEKEEEEVRQQALLAKKEKDIQKKAIKKERQKLRNSCKTWNHFSDNEAERVKMMEEVEKLCDRLELASLQCLNETLTSCTKEVGKAALEKQIEEINEQIRKEKEEAEARMRQASKNTEKSTGGGGNGSKNWSEDDLQLLIKAVNLFPAGTNSRWEVIANYMNIHSSSGVKRTAKDVIGKAKSLQKLDPHQKDDINKKAFDKFKKEHGVVPQADNATPSERFEGPYTDFTPWTTEEQKLLEQALKTYPVNTPERWEKIAEAVPGRTKKDCMKRYKELVEMVKAKKAAQEQVLNASRAKK

SEQ ID NO: 915420 - protein, 337 aa, Homo sapiens
MDGGSEAQGKKTDVNTGRDERNKEIQGQRQAELEAARLAKEKEEEEVRQQALLAKKEKDIQKKAIKKERQKLRNSCKTWNHFSDNEAERVKMMEEVEKLCDRLELASLQCLNETLTSCTKEVGKAALEKQIEEINEQIRKEKEEAEARMRQASKNTEKSTGGGGNGSKNWSEDDLQLLIKAVNLFPAGTNSRWEVIANYMNIHSSSGVKRTAKDVIGKAKSLQKLDPHQKDDINKKAFDKFKKEHGVVPQADNATPSERFEGPYTDFTPWTTEEQKLLEQALKTYPVNTPERWEKIAEAVPGRTKKDCMKRYKELVEMVKAKKAAQEQVLNASRAKK

SEQ ID NO: 915421 - protein, 138 aa, Homo sapiens [sequence omitted]

SEQ ID NO: 915422 - protein, 218 aa, Homo sapiens [sequence omitted]

SEQ ID NO: 915423 - protein, 272 aa, Homo sapiens [sequence omitted]

SEQ ID NO: 915424 - protein, 402 aa, Homo sapiens; identical to SEQ ID NO: 915418

SEQ ID NO: 915425 - protein, 556 aa, Homo sapiens [sequence omitted]

SEQ ID NO: 915426 - protein, 479 aa, Homo sapiens [sequence omitted]

SEQ ID NO: 915427 - protein, 464 aa, Homo sapiens
MCILDFHTKCNVLKKGERLDLSSILEGKERYPLKQIHSLALKRIFFHLFCLDHVLFLCYIRYNFDSWREFSYLDEEEKEKAECRDERRWIEKQNRATRAQRKKEEMNRIRTLVDNAYSCDPRIKKFKEEEKAKKEAEKKAKAEAKRKEQEAKEKQRQAELEAARLAKEKEEEEVRQQALLAKKEKDIQKKAIKKERQKLRNSCKTWNHFSDNEAERVKMMEEVEKLCDRLELASLQCLNETLTSCTKEVGKAALEKQIEEINEQIRKEKEEAEARMRQASKNTEKSTGGGGNGSKNWSEDDLQLLIKAVNLFPAGTNSRWEVIANYMNIHSSSGVKRTAKDVIGKAKSLQKLDPHQKDDINKKAFDKFKKEHGVVPQADNATPSERFEGPYTDFTPWTTEEQKLLEQALKTYPVNTPERWEKIAEAVPGRTKKDCMKRYKELVEMVKAKKAAQEQVLNASRAKK

SEQ ID NO: 915428 - protein, 402 aa, Homo sapiens; identical to SEQ ID NO: 915418

SEQ ID NO: 915429 - protein, 157 aa, Homo sapiens
AASRQDYFVLGLPRPRPGPCCLYLWGLHMWTATARGCHGHTTQQSKNPPAENALSKVPLNSILGDNPWLRGTGCAVQNCGALGSTLAEGAEHLPRGTCTFGSAKLQRTCSQVLRNHCLPQGQGQPCPPFSWTVLRPQYCTQQGSNSLGMERSDLDRN

SEQ ID NO: 915430 - protein, 569 aa, Homo sapiens
MATEGGGKEMNEIKTQFTTREGLYKLLPHSEYSRPNRVPFNSQGSNPVRVSFVNLNDQSGNGDRLCFNVGRELYFYIYKGVRKAADLSKPIDKRIYKGTQPTCHDFNHLTATAESVSLLVGFSAGQVQLIDPIKKETSKLFNEERLIDKSRVTCVKWVPGSESLFLVAHSSGNMYLYNVEHTCGTTAPHYQLLKQGESFAVHTCKSKSTRNPLLKWTVGEGALNEFAFSPDGKFLACVSQDGFLRVFNFDSVELHGTMKSYFGGLLCVCWSPDGKYIVTGGEDDLVTVWSFVDCRVIARGHGHKSWVSVVAFDPYTTSVEEGDPMEFSGSDEDFQDLLHFGRDRANSTQSRLSKRNSTDSRPVSVTYRFGSVGQDTQLCLWDLTEDILFPHQPLSRARTHTNVMNATSPPAGSNGNSVTTPGNSVPPPLPRSNSLPHSAVSNAGSKSSVMDGAIASGVSKFATLSLHDRKERHHEKDHKRNHSMGHISSKSSDKLNLVTKTKTDPAKTLGTPLCPRMEDVPLLEPLICKKIAHERLTVLIFLEDCIVTACQEGFICTWGRPGKVVSFNP

SEQ ID NO: 915431 - protein, 508 aa, Homo sapiens
MATEGGGKEMNEIKTQFTTREGLYKLLPHSEYSRPNRVPFNSQGSNPVRVSFVNLNDQSGNGDRLCFNVGRELYFYIYKGVRKRLIDKSRVTCVKWVPGSESLFLVAHSSGNMYLYNVEHTCGTTAPHYQLLKQGESFAVHTCKSKSTRNPLLKWTVGEGALNEFAFSPDGKFLACVSQDGFLRVFNFDSVELHGTMKSYFGGLLCVCWSPDGKYIVTGGEDDLVTVWSFVDCRVIARGHGHKSWVSVVAFDPYTTSVEEGDPMEFSGSDEDFQDLLHFGRDRANSTQSRLSKRNSTDSRPVSVTYRFGSVGQDTQLCLWDLTEDILFPHQPLSRARTHTNVMNATSPPAGSNGNSVTTPGNSVPPPLPRSNSLPHSAVSNAGSKSSVMDGAIASGVSKFATLSLHDRKERHHEKDHKRNHSMGHISSKSSDKLNLVTKTKTDPAKTLGTPLCPRMEDVPLLEPLICKKIAHERLTVLIFLEDCIVTACQEGFICTWGRPGKVVSFNP

SEQ ID NO: 915432 - protein, 312 aa, Homo sapiens
MKSYFGGLLCVCWSPDGKYIVTGGEDDLVTVWSFVDCRVIARGHGHKSWVSVVAFDPYTTSVEEGDPMEFSGSDEDFQDLLHFGRDRANSTQSRLSKRNSTDSRPVSVTYRFGSVGQDTQLCLWDLTEDILFPHQPLSRARTHTNVMNATSPPAGSNGNSVTTPGNSVPPPLPRSNSLPHSAVSNAGSKSSVMDGAIASGVSKFATLSLHDRKERHHEKDHKRNHSMGHISSKSSDKLNLVTKTKTDPAKTLGTPLCPRMEDVPLLEPLICKKIAHERLTVLIFLEDCIVTACQEGFICTWGRPGKVVSFNP

SEQ ID NO: 915433 - protein, 396 aa, Homo sapiens
MYLYNVEHTCGTTAPHYQLLKQGESFAVHTCKSKSTRNPLLKWTVGEGALNEFAFSPDGKFLACVSQDGFLRVFNFDSVELHGTMKSYFGGLLCVCWSPDGKYIVTGGEDDLVTVWSFVDCRVIARGHGHKSWVSVVAFDPYTTSVEEGDPMEFSGSDEDFQDLLHFGRDRANSTQSRLSKRNSTDSRPVSVTYRFGSVGQDTQLCLWDLTEDILFPHQPLSRARTHTNVMNATSPPAGSNGNSVTTPGNSVPPPLPRSNSLPHSAVSNAGSKSSVMDGAIASGVSKFATLSLHDRKERHHEKDHKRNHSMGHISSKSSDKLNLVTKTKTDPAKTLGTPLCPRMEDVPLLEPLICKKIAHERLTVLIFLEDCIVTACQEGFICTWGRPGKVVSFNP

SEQ ID NO: 915434 - protein, 396 aa, Homo sapiens; identical to SEQ ID NO: 915433

SEQ ID NO: 915435 - protein, 157 aa, Homo sapiens
MATEGGGKEMNEIKTQFTTREGLYKLLPHSEYSRPNRVPFNSQGSNPVRVSFVNLNDQSGNGDRLCFNVGRELYFYIYKGVRKAADLSKPIDKRIYKGTQPTCHDFNHLTATAESVSLLVGFSAGQVQLIDPIKKETSKLFNEEAFEGRYATFSPFV

SEQ ID NO: 915436 - protein, 600 aa, Homo sapiens
MATEGGGKEMNEIKTQFTTREGLYKLLPHSEYSRPNRVPFNSQGSNPVRVSFVNLNDQSGNGDRLCFNVGRELYFYIYKGVRKAADLSKPIDKRIYKGTQPTCHDFNHLTATAESVSLLVGFSAGQVQLIDPIKKETSKLFNEENSCQHLWKVDWNEERQNEGSKTSEEALVTVQRLIDKSRVTCVKWVPGSESLFLVAHSSGNMYLYNVEHTCGTTAPHYQLLKQGESFAVHTCKSKSTRNPLLKWTVGEGALNEFAFSPDGKFLACVSQDGFLRVFNFDSVELHGTMKSYFGGLLCVCWSPDGKYIVTGGEDDLVTVWSFVDCRVIARGHGHKSWVSVVAFDPYTTSVEEGDPMEFSGSDEDFQDLLHFGRDRANSTQSRLSKRNSTDSRPVSVTYRFGSVGQDTQLCLWDLTEDILFPHQPLSRARTHTNVMNATSPPAGSNGNSVTTPGNSVPPPLPRSNSLPHSAVSNAGSKSSVMDGAIASGVSKFATLSLHDRKERHHEKDHKRNHSMGHISSKSSDKLNLVTKTKTDPAKTLGTPLCPRMEDVPLLEPLICKKIAHERLTVLIFLEDCIVTACQEGFICTWGRPGKVVSFNP

SEQ ID NO: 915437 - protein, 396 aa, Homo sapiens; identical to SEQ ID NO: 915433

SEQ ID NO: 915438 - protein, 396 aa, Homo sapiens; identical to SEQ ID NO: 915433

SEQ ID NO: 915439 - protein, 569 aa, Homo sapiens; identical to SEQ ID NO: 915430

SEQ ID NO: 915440 - protein, 115 aa, Homo sapiens
HLAKTADPGARAQGSPGCGEEWLWHLPILWVLQALLEVFGLFGLWSFSPGTEVEMGRRPGQCSWKLTLHFSAPVFQFKSAFSSAETTELSGKCVVALATGEVWGQLVIRKGMEDV

SEQ ID NO: 915441 - protein, 257 aa, Homo sapiens
MAAPMNGQVCVVTGASRGIGRGIALQLCKAGATVYITGRHLDTLRVVAQEAQSLGGQCVPVVCDSSQESEVRSLFEQVDREQQGRLDVLVNNAYAGVQTILNTRNKAFWETPASMWDDINNVGLRGHYFCSVYGARLMVPAGQGLIVVISSPGSLQYMFNVPYGVGKAACDKLAADCAHELRRHGVSCVSLWPGIVQTELLKEHMAKEEVLQDPVLKQFKSAFSSAETTELSGKCVVALATGEVWGQLVIRKGMEDV

SEQ ID NO: 915442 - protein, 237 aa, Homo sapiens
RSLRPHPQVLTWAGTLPLYLSTESPRVLLQNQSLNTASMWDDINNVGLRGHYFCSVYGARLMVPAGQGLIVVISSPGSLQYMFNVPYGVGKAACDKLAADCAHELRRHGVSCVSLWPGIVQTELLKEHMAKEEVLQDPVLKQFKSAFSSAETTELSGKCVVALATDPNILSLSGKVLPSCDLARRYGLRDVDGRPVQDYLSLSSVLSHVSGLGWLASYLPSFLRVPKWIIALYTSKF

SEQ ID NO: 915443 - protein, 313 aa, Homo sapiens
MAAPMNGQVCVVTGASRGIGRGIALQLCKAGATVYITGRHLDTLRVVAQEAQSLGGQCVPVVCDSSQESEVRSLFEQVDREQQGRLDVLVNNAYAGVQTILNTRNKAFWETPASMWDDINNVGLRGHYFCSVYGARLMVPAGQGLIVVISSPGSLQYMFNVPYGVGKAACDKLAADCAHELRRHGVSCVSLWPGIVQTELLKEHMAKEEVLQDPVLKQFKSAFSSAETTELSGKCVVALATDPNILSLSGKVLPSCDLARRYGLRDVDGRPVQDYLSLSSVLSHVSGLGWLASYLPSFLRVPKWIIALYTSKF

SEQ ID NO: 915444 - protein, 313 aa, Homo sapiens; identical to SEQ ID NO: 915443

SEQ ID NO: 915445 - protein, 177 aa, Homo sapiens
MAAPMNGQVCVVTGASRGIGRGIALQLCKAGATVYITGRHLDTLRVVAQEAQSLGGQCVPVVCDSSQESEVRSLFEQVDREQQGRLDVLVNNAYAGVQTILNTRNKAFWETPASMWDDINNVGLRGHYFCSVYGARLMVPAGQGLIVVISSPGSLQYMFNVPYGVGKAAVRTQWHRS

SEQ ID NO: 915446 - protein, 313 aa, Homo sapiens; identical to SEQ ID NO: 915443

SEQ ID NO: 915447 - protein, 402 aa, Homo sapiens
MDGEEQQPPHEANVEPVVPSEASEPVPRVLSGDPQNLSDVDAFNLLLEMKLKRRRQRPNLPRTVTQLVAEDGSRVYVVGTAHFSDDSKRDVVKTIREVQPDVVVVELCQYRVSMLKMDESTLLREAQELSLEKLQQAVRQNGLMSGLMQMLLLKVSAHITEQLGMAPGGEFREAFKEASKVPFCKFHLGDRPIPVTFKRAIAALSFWQKVRLAWGLCFLSDPISKDDVERCKQKDLLEQMMAEMIGEFPDLHRTIVSERDVYLTYMLRQAARRLELPRASDGDGRRRRGTPCEAEARAGTDPLSFPTAEPRKCVPSVVVGVVGMGHVPGIEKNWSTDLNIQEIMTVPPPSVSGRVSRLAVKAAFFGLLGYSLYWMGRRTASLVLSLPAAQYCLQRVTEARHK

SEQ ID NO: 915448 - protein, 359 aa, Homo sapiens
PLRARAAWRPAEERRCLASVRRAARTARSPQVQEAAAQPWTGRSSSHRTRPTWNLLCRQRLQSRCPGCFLETPRTCTIREVQPDVVVVELCQYRVSMLKMDESTLLREAQELSLEKLQQAVRQNGLMSGLMQMLLLKVSAHITEQLGMAPGGEFREAFKEASKVPFCKFHLGDRPIPVTFKRAIAALSFWQKVRLAWGLCFLSDPISKDDVERCKQKDLLEQMMAEMIGEFPDLHRTIVSERDVYLTYMLRQAARRLELPRASDAEPRKCVPSVVVGVVGMGHVPGIEKNWSTDLNIQEIMTVPPPSVSGRVSRLAVKAAFFGLLGYSLYWMGRRTASLVLSLPAAQYCLQRVTEARHK

SEQ ID NO: 915449 - protein, 376 aa, Homo sapiens
MDGEEQQPPHEANVEPVVPSEASEPVPRVLSGDPQNLSDVDAFNLLLEMKLKRRRQRPNLPRTVTQLVAEDGSRVYVVGTAHFSDDSKRDVVKTIREVQPDVVVVELCQYRVSMLKMDESTLLREAQELSLEKLQQAVRQNGLMSGLMQMLLLKVSAHITEQLGMAPGGEFREAFKEASKVPFCKFHLGDRPIPVTFKRAIAALSFWQKVRLAWGLCFLSDPISKDDVERCKQKDLLEQMMAEMIGEFPDLHRTIVSERDVYLTYMLRQAARRLELPRASDAEPRKCVPSVVVGVVGMGHVPGIEKNWSTDLNIQEIMTVPPPSVSGRVSRLAVKAAFFGLLGYSLYWMGRRTASLVLSLPAAQYCLQRVTEARHK

SEQ ID NO: 915450 - protein, 454 aa, Homo sapiens
MDGEEQQPPHEANVEPVVPSEASEPVPRVLSGDPQNLSDVDAFNLLLEMKLKRRRQRPNLPRTVTQLVAEDGSRVYVVGTAHFSDDSKRDVVKTIREVQPDVVVVELCQYRVSMLKMDESTLLREAQELSLEKLQQAVRQNGLMSGLMQMLLLKVSAHITEQLGMAPGGEFREAFKEASKVPFCKFHLGDRPIPVTFKRAIAALSFWQKVRLAWGLCFLSDPIRYGLPPGPWPACRVVCGRLQALLCRSKRSNPHSRPSLPFPSATNPKQTCCGPCPVSTVPAPPPQPVAHPCGAAAIPLHSKDDVERCKQKDLLEQMMAEMIGEFPDLHRTIVSERDVYLTYMLRQAARRLELPRASDAEPRKCVPSVVVGVVGMGHVPGIEKNWSTDLNIQEIMTVPPPSVSGRVSRLAVKAAFFGLLGYSLYWMGRRTASLVLSLPAAQYCLQRVTEARHK

SEQ ID NO: 915451 - protein, 224 aa, Homo sapiens
MDGEEQQPPHEANVEPVVPSEASEPVPRVLSGDPQNLSDVDAFNLLLEMKLKRRRQRPNLPRTVTQLVAEDGSRVYVVGTAHFSDDSKRDVVKTIREVQPDVVVVELCQYRVSMLKMDESTLLREAQELSLEKLQQAVRQNGLMSGLMQMLLLKVSAHITEQLGMAPGGEFREAFKEASKVPFCKFHLGDRPIPVTFKRAIAALSFWQKVRLAWGLCFLSDPIR

SEQ ID NO: 915452 - protein, 376 aa, Homo sapiens; identical to SEQ ID NO: 915449

SEQ ID NO: 915453 - protein, 266 aa, Homo sapiens
MDGEEQQPPHEANVEPVVPSEASEPVPRVLSGDPQNLSDVDAFNLLLEMKLKRRRQRPNLPRTVTQLVAEDGSRVYVVGTAHFSDDSKRDVVKTIREVQPDVVVVELCQYRVSMLKMDESTLLREAQELSLEKLQQAVRQGAQPRARVRVRVGVKATCLPVAQVPLTAHAPSQCGCAWPALGIAGLGTSPGPGEMKEAPLPGFRQGRRKWVALQAEAGAGHPRTGLLSSCWGWVRSQCKVGPPVPHPGPKWVGLRAPPVPTSPALQ

SEQ ID NO: 915454 - protein, 379 aa, Homo sapiens
MDGEEQQPPHEANVEPVVPSEASEPVPRVLSGDPQNLSDVDAFNLLLEMKLKRRRQRPNLPRTVTQLVAEDGSRVYVVGTAHFSDDSKRDVVKTIREVQPDVVVVELCQYRVSMLKMDESTLLREAQELSLEKLQQAVRQNGLMSGLMQMLLLKVSAHITEQLGMAPGGEFREAFKEASKVPFCKFHLGDRPIPVTFKRAIAALSFWQKVRLAWGLCFLSDPISKDDVERCKQKDLLEQMMAEMIGEFPDLHRTIVSERDVYLTYMLRQAARRLELPRASDAEPRKCVPSVVVGVVGMGHVPGIEKNWSTDLNIQEIMTVPPPSVSGRVSRLAVKAAFFGLLGYSLYWMGRRTASLVLSLPAAQYCLQRVTEARHKEKN

SEQ ID NO: 915455 - protein, 87 aa, Homo sapiens
PLRARAAWRPAEERRCLASVRRAARTARSPQVQEAAAQPWTGRSSSHRTRPTWNLLCRQRLQSRCPGCFLETPRTCPTWTPSTCSWR

SEQ ID NO: 915456 - protein, 376 aa, Homo sapiens; identical to SEQ ID NO: 915449

SEQ ID NO: 915457 - protein, 367 aa, Homo sapiens
MDGEEQQPPHEANVEPVVPSEASEPVPRVLSGDPQNLSDVDAFNLLLEMKLKRRRQRPNLPRTVTQLVAEDGSRVYVVGTAHFSDDSKRDVVKTIREVQPDVVVVELCQYRVSMLKMDESTLLREAQELSLEKLQQAVRQNGLMSGLMQMLLLKVSAHITEQLGMAPGGEFREAFKEASKVPFCKFHLGDRPIPVTFKRAIAALSFWQKVRLAWGLCFLSDPISKDDVERCKQKDLLEQMMAEMIGEFPDLHRTIVSERDVYLTYMLRQAARRLELPRASDAEPRKCVPSVVVGVVGMGHVPGIEKNWSTDLNIQEIMTVSRLAVKAAFFGLLGYSLYWMGRRTASLVLSLPAAQYCLQRVTEARHK

SEQ ID NO: 915458 - protein, 319 aa, Homo sapiens [sequence omitted]

SEQ ID NO: 915459 - protein, 376 aa, Homo sapiens; identical to SEQ ID NO: 915449

SEQ ID NO: 915460 - protein, 266 aa, Homo sapiens; identical to SEQ ID NO: 915453

SEQ ID NO: 915461 - protein, 101 aa, Homo sapiens
KNWSTDLNIQAVAHAHDAHDHGGDALPGIEKNWSTDLNIQEIMTVPPPSVSGRVSRLAVKAAFFGLLGYSLYWMGRRTASLVLSLPAAQYCLQRVTEARHK

SEQ ID NO: 915462 - protein, 153 aa, Homo sapiens
MDGEEQQPPHEANVEPVVPSEASEPVPRVLSGDPQNLSDVDAFNLLLEMKLKRRRQRPNLPRTVTQLVAEDGSRVYVVGTAHFSDDSKRDVVKTIREVQPDVVVVELCQYRVSMLKMDESTLLREAQELSLEKLQQAVRQPVPPRHFWVPGAS

SEQ ID NO: 915463 - protein, 139 aa, Homo sapiens
MNCWLPTVLWSCKPRSCPAGPPTPEAQSEEERSDEEPEAKEEEEEKPHMPTEFDFDDEPVTPKDSLIDRRRTPGSSARSQKREARLDKVLSDMKRHKKLEEQILRTGRDLFSLDSEDPSPASPPLRSSGSSLFPRQRKY

SEQ ID NO: 915464 - protein, 139 aa, Homo sapiens; identical to SEQ ID NO: 915463

SEQ ID NO: 915465 - protein, 149 aa, Homo sapiens
MSLARGHGDTAASTAAPLSEEGEVTSGLQALAVEDTGGPSASAGKAEDEGEGGREETEREGSGGEEAQGEVPSAGGEEPAEEDSEDWCVPCSDEEVELPADGQPWMPPPSEIQRLYELLAAHGTLELQAEILPRRASHAGGPERRGEIR

SEQ ID NO: 915466 - protein, 139 aa, Homo sapiens; identical to SEQ ID NO: 915463

SEQ ID NO: 915467 - protein, 139 aa, Homo sapiens; identical to SEQ ID NO: 915463

SEQ ID NO: 915468 - protein, 359 aa, Homo sapiens
MGGLEKKKYERGSATNYITRNKARKKLQLSLADFRRLCILKGIYPHEPKHKKKVNKGSTAARTFYLIKDIRFLLHEPIVNKFREYKVFVRKLRKAYGKSEWNTVERLKDNKPNYKLDHIIKERYPTFIDALRDLDDALSMCFLFSTFPRTGKCHVQTIQLCRRLTVEFMHYIIAARALRKVFLSIKGIYYQAEVLGQPIVWITPYAFSHDHPTDVDYRVMATFTEFYTTLLGFVNFRLYQLLNLHYPPKSRVSQAKGNAGEGQSVESQSDGELGAHKVRGTRVGAVPKARGPEGRKYPPRGTITAEAKTRQERPNTEKIEGPHHHPKEKRQENTHRERATTHDVDDETNAPQKQQRKQK

SEQ ID NO: 915469 - protein, 513 aa, Homo sapiens
MGGLEKKKYERGSATNYITRNKARKKLQLSLADFRRLCILKGIYPHEPKHKKKVNKGSTAARTFYLIKDIRFLLHEPIVNKFREYKVFVRKLRKAYGKSEWNTVERLKDNKPNYKLDHIIKERYPTFIDALRDLDDALSMCFLFSTFPRTGKCHVQTIQLCRRLTVEFMHYIIAARALRKVFLSIKGIYYQAEVLGQPIVWITPYAFSHDHPTDVDYRVMATFTEFYTTLLGFVNFRLYQLLNLHYPPKLEGQAQAEAKAGEGTYALDSESCMEKLAALSASLARVVVPATEEEAEVDEFPTDGEMSAQEEDRRKELEAQEKHKKLFEGLKFFLNREVPREALAFIIRSFGGEVSWDKSLCIGATYDVTDSRITHQIVDRPGQQTSVIGRCYVQPQWVFDSVNARLLLPVAEYFSGVQLPPHLSPFVTEKEGDYVPPEKLKLLALQRGEDPGNLNESEEEEEEDDNNEGDGDEEGENEEEEEDAEAGSEKEEEARLAALEEAQGDGRHLEAGG

SEQ ID NO: 915470 - protein, 581 aa, Homo sapiens
MYERGSATNYITRNKARKKLQLSLADFRRLCILKGIYPHEPKHKKKVNKGSTAARTFYLIKDIRFLLHEPIVNKFREYKVFVRKLRKAYGKSEWNTVERLKDNKPNYKLDHIIKERYPTFIDALRDLDDALSMCFLFSTFPRTGKCHVQTIQLCRRLTVEFMHYIIAARALRKVFLSIKGIYYQAEVLGQPIVWITPYAFSHDHPTDVDYRVMATFTEFYTTLLGFVNFRLYQLLNLHYPPKLEGQAQAEAKAGEGTYALDSESCMEKLAALSASLARVVVPATEEEAEVDEFPTDGEMSAQEEDRRKELEAQEKHKKLFEGLKFFLNREVPREALAFIIRSFGGEVSWDKSLCIGATYDVTDSRITHQIVDRPGQQTSVIGRCYVQPQWVFDSVNARLLLPVAEYFSGVQLPPHLSPFVTEKEGDYVPPEKLKLLALQRGEDPGNLNESEEEEEEDDNNEGDGDEEGENEEEEEDAEAGSEKEEEARLAALEEQRMEGKKPRVMAGTLKLEDKQRLAQEEESEAKRLAIMMMKKREKYLYQKIMFGKRRKIREANKLAEKRKAHDEAVRSEKKAKKARPE

SEQ ID NO: 915471 - protein, 588 aa, Homo sapiens
MGGLEKKKYERGSATNYITRNKARKKLQLSLADFRRLCILKGIYPHEPKHKKKVNKGSTAARTFYLIKDIRFLLHEPIVNKFREYKVFVRKLRKAYGKSEWNTVERLKDNKPNYKLDHIIKERYPTFIDALRDLDDALSMCFLFSTFPRTGKCHVQTIQLCRRLTVEFMHYIIAARALRKVFLSIKGIYYQAEVLGQPIVWITPYAFSHDHPTDVDYRVMATFTEFYTTLLGFVNFRLYQLLNLHYPPKLEGQAQAEAKAGEGTYALDSESCMEKLAALSASLARVVVPATEEEAEVDEFPTDGEMSAQEEDRRKELEAQEKHKKLFEGLKFFLNREVPREALAFIIRSFGGEVSWDKSLCIGATYDVTDSRITHQIVDRPGQQTSVIGRCYVQPQWVFDSVNARLLLPVAEYFSGVQLPPHLSPFVTEKEGDYVPPEKLKLLALQRGEDPGNLNESEEEEEEDDNNEGDGDEEGENEEEEEDAEAGSEKEEEARLAALEEQRMEGKKPRVMAGTLKLEDKQRLAQEEESEAKRLAIMMMKKREKYLYQKIMFGKRRKIREANKLAEKRKAHDEAVRSEKKAKKARPE

SEQ ID NO: 915472 - protein, 465 aa, Homo sapiens
MGGLEKKKYERGSATNYITRNKARKKLQLSLADFRRLCILKGIYPHEPKHKKKVNKGSTAARTFYLIKDIRFLLHEPIVNKFREYKVFVRKLRKAYGKSEWNTVERLKDNKPNYKLDHIIKERYPTFIDALRDLDDALSMCFLFSTFPRTGKCHVQTIQLCRRLTVEFMHYIIAARALRKVFLSIKGIYYQAEVLGQPIVWITPYAFSHDHPTDVDYRVMATFTEFYTTLLGFVNFRLYQLLNLHYPPKLEGQAQAEAKAGEGTYALDSESCMEKLAALSASLARVVVPATEEEAEVDEFPTDGEMSAQEEDRRKELEAQEKHKKLFEGLKFFLNREVPREALAFIIRSFGGEVSWDKSLCIGATYDVTDSRITHQIVDRPGQQTSVIGRCYVQPQWVFDSVNARLLLPVAEYFSGVQLPPHLSPFVTEKEGDYVPPEKLKLLALQRGEDPRTPVMSQKTERKTD

SEQ ID NO: 915473 - protein, 333 aa, Homo sapiens
PSPFVRSSTYALDSESCMEKLAALSASLARVVVPATEEEAEVDEFPTDGEMSAQEEDRRKELEAQEKHKKLFEGLKFFLNREVPREALAFIIRSFGGEVSWDKSLCIGATYDVTDSRITHQIVDRPGQQTSVIGRCYVQPQWVFDSVNARLLLPVAEYFSGVQLPPHLSPFVTEKEGDYVPPEKLKLLALQRGEDPGNLNESEEEEEEDDNNEGDGDEEGENEEEEEDAEAGSEKEEEARLAALEEQRMEGKKPRVMAGTLKLEDKQRLAQEEESEAKRLAIMMMKKREKYLYQKIMFGKRRKIREANKLAEKRKAHDEAVRSEKKAKKARPE

SEQ ID NO: 915474 - protein, 356 aa, Homo sapiens
MGGLEKKKYERGSATNYITRNKARKKLQLSLADFRRLCILKGIYPHEPKHKKKVNKGSTAARTFYLIKDIRFLLHEPIVNKFREYKVFVRKLRKAYGKSEWNTVERLKDNKPNYKLDHIIKERYPTFIDALRDLDDALSMCFLFSTFPRTGKCHVQTIQLCRRLTVEFMHYIIAARALRKVFLSIKGIYYQAEVLGQPIVWITPYAFSHDHPTDVDYRVMATFTEFYTTLLGFVNFRLYQLLNLHYPPKLEGQAQAEAKAGEGTYALDSESCMEKLAALSASLARVVVPATEEEAEVDEFPTDGKMSAQEEDRRKEICDMVFGIDMVWLRPHLNPILNCNSHMSRERLVGGDWIMG

SEQ ID NO: 915475 - protein, 155 aa, Homo sapiens
SYHRYALTATPSPLPSPLGNLNESEEEEEEDDNNEGDGDEEGENEEEEEDAEAGSEKEEEARLAALEEQRMEGKKPRVMAGTLKLEDKQRLAQEEESEAKRLAIMMMKKREKYLYQKIMFGKRRKIREANKLAEKRKAHDEAVRSEKKAKKARPE

SEQ ID NO: 915476 - protein, 127 aa, Homo sapiens
MSQKRRRKRTTTTKVMVMKREKMRRRRKMQRLVQKRRKRPGWQPWKKPRVMAGTLKLEDKQRLAQEEESEAKRLAIMMMKKREKYLYQKIMFGKRRKIREANKLAEKRKAHDEAVRSEKKAKKARPE

SEQ ID NO: 915477 - protein, 118 aa, Homo sapiens
MYERGSATNYITRNKARKKLQLSLADFRRLCILKGIYPHEPKHKKKVNKGSTAARTFYLIKDIRFLLLLSPASPDPSCSLAGPVGSPRFPWMELPCWCLVREEASVPSLILCSQEPVT

SEQ ID NO: 915478 - protein, 114 aa, Homo sapiens
MNQREPEAGGNSAQSHPAPREPLLSSGSRSLTTLSNRYLDNAILSRTMECGAPLHPRRHRAVPKPSAPLRPNMQRGSQSMNRHQGDYRKACISTFVLTLKVFVTIVSGKDLERV

SEQ ID NO: 915479 - protein, 588 aa, Homo sapiens; identical to SEQ ID NO: 915471

SEQ ID NO: 915480 - protein, 609 aa, Homo sapiens
DGSNLGVVAKAGWWSAPQRGAMGGLEKKKYERGSATNYITRNKARKKLQLSLADFRRLCILKGIYPHEPKHKKKVNKGSTAARTFYLIKDIRFLLHEPIVNKFREYKVFVRKLRKAYGKSEWNTVERLKDNKPNYKLDHIIKERYPTFIDALRDLDDALSMCFLFSTFPRTGKCHVQTIQLCRRLTVEFMHYIIAARALRKVFLSIKGIYYQAEVLGQPIVWITPYAFSHDHPTDVDYRVMATFTEFYTTLLGFVNFRLYQLLNLHYPPKLEGQAQAEAKAGEGTYALDSESCMEKLAALSASLARVVVPATEEEAEVDEFPTDGEMSAQEEDRRKELEAQEKHKKLFEGLKFFLNREVPREALAFIIRSFGGEVSWDKSLCIGATYDVTDSRITHQIVDRPGQQTSVIGRCYVQPQWVFDSVNARLLLPVAEYFSGVQLPPHLSPFVTEKEGDYVPPEKLKLLALQRGEDPGNLNESEEEEEEDDNNEGDGDEEGENEEEEEDAEAGSEKEEEARLAALEEQRMEGKKPRVMAGTLKLEDKQRLAQEEESEAKRLAIMMMKKREKYLYQKIMFGKRRKIREANKLAEKRKAHDEAVRSEKKAKKARPE

SEQ ID NO: 915481 - protein, 581 aa, Homo sapiens; identical to SEQ ID NO: 915470

SEQ ID NO: 915482 - protein, 588 aa, Homo sapiens; identical to SEQ ID NO: 915471

SEQ ID NO: 915483 - protein, 270 aa, Homo sapiens
NKAKYEAGCKSAEESSEPRGARGGPGFIIRSFGGEVSWDKSLCIGATYDVTDSRITHQIVDRPGQQTSVIGRCYVQPQWVFDSVNARLLLPVAEYFSGVQLPPHLSPFVTEKEGDYVPPEKLKLLALQRGEDPGNLNESEEEEEEDDNNEGDGDEEGENEEEEEDAEAGSEKEEEARLAALEEQRMEGKKPRVMAGTLKLEDKQRLAQEEESEAKRLAIMMMKKREKYLYQKIMFGKRRKIREANKLAEKRKAHDEAVRSEKKAKKARPE

SEQ ID NO: 915484 - protein, 223 aa, Homo sapiens
METSYSRITHQIVDRPGQQTSVIGRCYVQPQWVFDSVNARLLLPVAEYFSGVQLPPHLSPFVTEKEGDYVPPEKLKLLALQRGEDPGNLNESEEEEEEDDNNEGDGDEEGENEEEEEDAEAGSEKEEEARLAALEEQRMEGKKPRVMAGTLKLEDKQRLAQEEESEAKRLAIMMMKKREKYLYQKIMFGKRRKIREANKLAEKRKAHDEAVRSEKKAKKARPE

SEQ ID NO: 915485 - protein, 135 aa, Homo sapiens
MVDDGEVGGWIDGGMDEMDGWVKNEEEEEDAEAGSEKEEEARLAALEEQRMEGKKPRVMAGTLKLEDKQRLAQEEESEAKRLAIMMMKKREKYLYQKIMFGKRRKIREANKLAEKRKAHDEAVRSEKKAKKARPE

SEQ ID NO: 915486 - protein, 90 aa, Homo sapiens
DGSNLGVVAKAGWWSAPQRGAMGGLEKKKYERGSATNYITRNKARKKLQLSLADFRTPHALWLGQWAALASLGWSCPAGAWSEKRPLCPA

SEQ ID NO: 915487 - protein, 192 aa, Homo sapiens
RPPPPPQLPSRAARRGKSARRLAMARGGDTGCTGPSETSASGAAAIALPGLEGPATDAQCQTLPLTVLKSRSPSPRSLPPALSCPPPQPAMLEHLSSLPTQMDYKGQKLAEQMFQGIILFSAIVGFIYGYVAEQFGWTVYIVMAGFAFSCLLTLPPWPIYRRHPLKWLPVQESSTDDKKPGERKIKRHAKNN

SEQ ID NO: 915488 - protein, 164 aa, Homo sapiens
RPPPPPQLPSRAARRGKSARRLAMARGGDTGCTGPSETSASGAAAIALPGLEGPATDAQCQTLPLTVLKSRSPSPRSLPPALSCPPPQPAMLEHLSSLPTQMDYKGQKLAEQMFQGIILFSAIVGFIYGYVAEQFGWTVYIVMAGFAFSCLVRNLWVLVAAWVL

SEQ ID NO: 915489 - protein, 164 aa, Homo sapiens
RPPPPPQLPSRAARRGKSARRLAMARGGDTGCTGPSETSASGAAAIALPGLEGPATDAQCQTLPLTVLKSRSPSPRSLPPALSCPPPQPAMLEHLSSLPTQMVRAQPGDLCTPFLCLAASKPMLEHRPGAALFRARMVTVHPLSRIASWVPFSSTPRESPVHSP

SEQ ID NO: 915490 - protein, 164 aa, Homo sapiens; identical to SEQ ID NO: 915489

SEQ ID NO: 915491 - protein, 163 aa, Homo sapiens
RPPPPPQLPSRAARRGKSARRLAMARGGDTGCTGPSETSASGAAAIALPGLEGPATDAQCQTLPLTVLKSRSPSPRSLPPALSCPPPQPAMLEHLSSLPTQMDYKGQKLAEQMFQGIILFSALTLPPWPIYRRHPLKWLPVQESSTDDKKPGERKIKRHAKNN

SEQ ID NO: 915492 - protein, 188 aa, Homo sapiens
RPPPPPQLPSRAARRGKSARRLAMARGGDTGCTGPSETSASGAAAIALPGLEGPATDAQCQTLPLTVLKSRSPSPRSLPPALSCPPPQPAMLEHLSSLPTQMDYKGQKLAEQMFQGIILFSAIVGFIYGYVAEQFGWTVYIVMAGFAFSCLLTLPPWPIYRRHPLKWLPVQESSTDDKKPGPGPRGIL

SEQ ID NO: 915493 - protein, 192 aa, Homo sapiens; identical to SEQ ID NO: 915487

SEQ ID NO: 915494 - protein, 171 aa, Homo sapiens
RPPPPPQLPSRAARRGKSARRLAMARGGDTGCTGPSETSASGAAAIALPGLEGPATDAQCQTLPLTVLKSRSPSPRSLPPALSCPPPQPAMLEHLSSLPTQMDYKGQKLAEQMFQGIILFSAVSIGFTFNLTLPPWPIYRRHPLKWLPVQESSTDDKKPGERKIKRHAKNN

SEQ ID NO: 915495 - protein, 192 aa, Homo sapiens; identical to SEQ ID NO: 915487

SEQ ID NO: 915496 - protein, 192 aa, Homo sapiens; identical to SEQ ID NO: 915487

SEQ ID NO: 915497 - protein, 197 aa, Homo sapiens
RPPPPPQLPSRAARRGKSARRLAMARGGDTGCTGPSETSASGAAAIALPGLEGPATDAQCQTLPLTVLKSRSPSPRSLPPALSCPPPQPAMLEHLSSLPTQMDYKGQKLAEQMFQGIILFSAIVGFIYGYVAEQFGWTVYIVMAGFAFSCLLTLPPWPIYRRHPLKWLPVQESSTDDKKPGERKIKRHATKLLSYPR

SEQ ID NO: 915498 - protein, 326 aa, Homo sapiens
MATNFSDIVKQGYVKMKSRKLGIYRRCWLVFRKSSSKGPQRLEKYPDEKSVCLRGCPKVTEISNVKCVTRLPKETKRQAVAIIFTDDSARTFTCDSELEAEEWYKTLSVECLGSRLNDISLGEPDLLAPGVQCEQTDRFNVFLLPCPNLDVYGECKLQITHENIYLWDIHNPRVKLVSWPLCSLRRYGRDATRFTFEAGRMCDAGEGLYTFQTQEGEQIYQRVHSATLAIAEQHKRVLLEMEKNVRLLNKGTEHYSYPCTPTTMLPRSAYWHHITGSQNIAEASSYAGEGYGAAQASSETDLLNRFILLKPKPSQGDSSEAKTPSQ

SEQ ID NO: 915499 - protein, 326 aa, Homo sapiens; identical to SEQ ID NO: 915498

SEQ ID NO: 915500 - protein, 326 aa, Homo sapiens; identical to SEQ ID NO: 915498

SEQ ID NO: 915501 - protein, 326 aa, Homo sapiens; identical to SEQ ID NO: 915498

SEQ ID NO: 915502 - protein, 326 aa, Homo sapiens; identical to SEQ ID NO: 915498

SEQ ID NO: 915503 - protein, 326 aa, Homo sapiens; identical to SEQ ID NO: 915498

SEQ ID NO: 915504 - protein, 244 aa, Homo sapiens
HTKSKHVHVVSHNAPPHSLLWMLDQVRITCTSKLTNQCLGEPDLLAPGVQCEQTDRFNVFLLPCPNLDVYGECKLQITHENIYLWDIHNPRVKLVSWPLCSLRRYGRDATRFTFEAGRMCDAGEGLYTFQTQEGEQIYQRVHSATLAIAEQHKRVLLEMEKNVRLLNKGTEHYSYPCTPTTMLPRSAYWHHITGSQNIAEASSYAGEGYGAAQASSETDLLNRFILLKPKPSQGDSSEAKTPSQ

SEQ ID NO: 915505 - protein, 324 aa, Homo sapiens
MATNFSDIVKQGYVKMKSRKLGIYRRCWLVFRKSSSKGPQRLEKYPDEKSVCLRGCPKVTEISNVKCVTRLPKETKRQAVAIIFTDDSARTFTCDSELEAEEWYKTLSVECLGSRLNDISLGEPDLLAPGVQCEQTDRFNVFLLPCPNLDVYGECKLQITHENIYLWDIHNPRVKLVSWPLCSLRRYGRDATRFTFEAGRMCDAGEGLYTFQTQEGEQIYQRVHSATLAIAEQHKRVLLEMEKNVRLLNKGTEHYSYPCTPTTMLPRSAYWHHITGSQNIAEASSYAGEGYGAAQASSETDLLNRFILLKPKVFGEGGRAGWLS

SEQ ID NO: 915506 - protein, 326 aa, Homo sapiens; identical to SEQ ID NO: 915498

SEQ ID NO: 915507 - protein, 365 aa, Homo sapiens
MATNFSDIVKQGYVKMKSRKLGIYRRCWLVFRKSSSKGPQRLEKYPDEKSVCLRGCPKVTEISNVKCVTRLPKETKRQAVAIIFTDDSARTFTCDSELEAEEWYKTLSVECLGSRLNDISLGEPDLLAPGVQCEQTDRFNVFLLPCPNLDVYGECKLQITHENIYLWDIHNPRVKLVSWPLCSLRRYGRDATRFTFEAGRMCDAGEGLYTFQTQEGEQIYQRVHSATLAIAEQHKRVLLEMEKNVRLLNKGTEHYSYPCTPTTMLPRSAYWHHITGSQNIAEASSYAGESLPCPTPTCQEALWRMRPIGQGSFDLALSSEPASVPTGEGYGAAQASSETDLLNRFILLKPKPSQGDSSEAKTPSQ

SEQ ID NO: 915508 - protein, 326 aa, Homo sapiens; identical to SEQ ID NO: 915498

SEQ ID NO: 915509 - protein, 326 aa, Homo sapiens
MISARLSESCLYSSARPPCQRQIYRRCWLVFRKSSSKGPQRLEKYPDEKSVCLRGCPKVTEISNVKCVTRLPKETKRQAVAIIFTDDSARTFTCDSELEAEEWYKTLSVECLGSRLNDISLGEPDLLAPGVQCEQTDRFNVFLLPCPNLDVYGECKLQITHENIYLWDIHNPRVKLVSWPLCSLRRYGRDATRFTFEAGRMCDAGEGLYTFQTQEGEQIYQRVHSATLAIAEQHKRVLLEMEKNVRLLNKGTEHYSYPCTPTTMLPRSAYWHHITGSQNIAEASSYAGEGYGAAQASSETDLLNRFILLKPKPSQGDSSEAKTPSQ

SEQ ID NO: 915510 - protein, 126 aa, Homo sapiens
MCDAGEGLYTFQTQEGEQIYQRVHSATLAIAEQHKRVLLEMEKNVRLLNKGTEHYSYPCTPTTMLPRSAYWHHITGSQNIAEASSYAGEGYGAAQASSETDLLNRFILLKPKPSQGDSSEAKTPSQ

SEQ ID NO: 915511 - protein, 145 aa, Homo sapiens
VPAPAAASARMSPPASGSGLSEITGGLDPDPVPGQRPPRPAPPRELRAPGWPCSDRLAPPHTTRLPLLPPGMRRELRTVPSPKGASSFSPRIGREERGPPRGSQDAELQSPGPAPSPSSASLQRLPTAGLSPSGRSSLTPQLHLY

SEQ ID NO: 915512 - protein, 210 aa, Homo sapiens
MAASVEQREGTIQVQGQALFFREALPGSGQARFSVLLLHGIRFSSETWQNLGTLHRLAQAGYRAVAIDLPGLGHSKEAAAPAPIGELAPGSFLAAVVDALELGPPVVISPSLSGMYSLPFLTAPGSQLPGFVPVAPICTDKINAANYASVKTPALIVYGDQDPMGQTSFEHLKQLPNHRVLIMKGAGHPCYLDKPEEWHTGLLDFLQGLQ

SEQ ID NO: 915513 - protein, 242 aa, Homo sapiens
GTVRVLGEHAPASRLRESTQLPRPFTSTAAAGMAASVEQREGTIQVQGQALFFREALPGSGQARFSVLLLHGIRFSSETWQNLGTLHRLAQAGYRAVAIDLPGLGHSKEAAAPAPIGELAPGSFLAAVVDALELGPPVVISPSLSGMYSLPFLTAPGSQLPGFVPVAPICTDKINAANYASVKTPALIVYGDQDPMGQTSFEHLKQLPNHRVLIMKGAGHPCYLDKPEEWHTGLLDFLQGLQ

SEQ ID NO: 915514 - protein, 242 aa, Homo sapiens
MYKCDTGCNFSDEGVVSHCYQGAFIEQQYAAGMAASVEQREGTIQVQGQALFFREALPGSGQARFSVLLLHGIRFSSETWQNLGTLHRLAQAGYRAVAIDLPGLGHSKEAAAPAPIGELAPGSFLAAVVDALELGPPVVISPSLSGMYSLPFLTAPGSQLPGFVPVAPICTDKINAANYASVKTPALIVYGDQDPMGQTSFEHLKQLPNHRVLIMKGAGHPCYLDKPEEWHTGLLDFLQGLQ

SEQ ID NO: 915515 - protein, 168 aa, Homo sapiens
TRGSTHASRTRGSSTRLLPVCASPRSSPGLGHSKEAAAPAPIGELAPGSFLAAVVDALELGPPVVISPSLSGMYSLPFLTAPGSQLPGFVPVAPICTDKINAANYASVKTPALIVYGDQDPMGQTSFEHLKQLPNHRVLIMKGAGHPCYLDKPEEWHTGLLDFLQGLQ

SEQ ID NO: 915516 - protein, 274 aa, Homo sapiens
MDAASLWPQEGAPEHGQSPPPLDGARPLPSVPPPAPGHRQHAPASRLRESTQLPRPFTSTAAAGMAASVEQREGTIQVQGQALFFREALPGSGQARFSVLLLHGIRFSSETWQNLGTLHRLAQAGYRAVAIDLPGLGHSKEAAAPAPIGELAPGSFLAAVVDALELGPPVVISPSLSGMYSLPFLTAPGSQLPGFVPVAPICTDKINAANYASVKTPALIVYGDQDPMGQTSFEHLKQLPNHRVLIMKGAGHPCYLDKPEEWHTGLLDFLQGLQ

SEQ ID NO: 915517 - protein, 227 aa, Homo sapiens
HHPPPSPLPHSTHLPTPFTTTPPPPIPPTLHPTTIHLHPHPLFFPHPLPPTPHPPFSLLLLHPIPFSSHTSHNLTLHTLPHPPYPPFPIHLPPLHSNPPPPPPIPHLPPPTFLPPLHPFHLPPPLFITPSLTPIYSLPFLTPRSHLPFLPLAPISTHKINPANYPTLNTPALIVYGDQDPMGQTSFEHLKQLPNHRVLIMKGAGHPCYLDKPEEWHTGLLDFLQGLQ

SEQ ID NO: 915518 - protein, 274 aa, Homo sapiens; identical to SEQ ID NO: 915516

SEQ ID NO: 915519 - protein, 274 aa, Homo sapiens; identical to SEQ ID NO: 915516

SEQ ID NO: 915520 - protein, 274 aa, Homo sapiens; identical to SEQ ID NO: 915516

SEQ ID NO: 915521 - protein, 274 aa, Homo sapiens; identical to SEQ ID NO: 915516

SEQ ID NO: 915522 - protein, 153 aa, Homo sapiens
VRSEFWDSTRLLPVCASPRSSPAPAPIGELAPGSFLAAVVDALELGPPVVISPSLSGMYSLPFLTAPGSQLPGFVPVAPICTDKINAANYASVKTPALIVYGDQDPMGQTSFEHLKQLPNHRVLIMKGAGHPCYLDKPEEWHTGLLDFLQGLQ

SEQ ID NO: 915523 - protein, 274 aa, Homo sapiens; identical to SEQ ID NO: 915516

SEQ ID NO: 915524 - protein, 256 aa, Homo sapiens
MDAASLWPQEGAPEHGQSPPPLDGARPLPSVPPPAPGHRQHAPASRLRESTQLPRPFTSTAAAGMAASVEQREGTIQVQGQALFFREALPGSGQARFSVLLLHGIRFSSETWQNLGTLHRLAQAGYRAVAIDLPGLGHSKEAAAPAPIGELAPGSFLAAVVDALELGPPVVISPSLSGMYSLPFLTAPGSQLPGFVPVAPICTDGDQDPMGQTSFEHLKQLPNHRVLIMKGAGHPCYLDKPEEWHTGLLDFLQGLQ

SEQ ID NO: 915525 - protein, 69 aa, Homo sapiens
LQPGQQELKLCLRKKKSRDASRAFVTGDCSEAGLVDDVSDLSAAEMLTLHNWLSFYEKNYVCVGKSSIG

SEQ ID NO: 915526 - protein, 264 aa, Homo sapiens
MLRCGGRGLLLGLAVAAAAVMAARLMGWWGPRAGFRLFIPEELSRYRGGPGDPGLYLALLGRVYDVSSGRRHYEPGSHYSGFAGRDASRAFVTGDCSEAGLVDDVSDLSAAEMLTLHNWLSFYEKNYVCVGRVTGRFYGEDGLPTPALTQVEAAITRGLEANKLQLQEKQTFPPCNAEWSSARGSRLWCSQKSGGVSRDWIGVPRKLYKPGAKEPRCVCVRTTGPPSGQMPDNPPHRNRGDLDHPNLAEYTGCPPLAITCSFPL

SEQ ID NO: 915527 - protein, 152 aa, Homo sapiens
MLTLHNWLSFYEKNYVCVGRVTGRFYGEDGLPTPALTQVEAAITRGLEANKLQLQEKQTFPPCNAEWSSARGSRLWCSQKSGGVSRDWIGVPRKLYKPGAKEPRCVCVRTTGPPSGQMPDNPPHRNRGDLDHPNLAEYTGCPPLAITCSFPL

SEQ ID NO: 915528 - protein, 150 aa, Homo sapiens
MTDFLEEHQYHFTIETGRVTGRFYGEDGLPTPALTQVEAAITRGLEANKLQLQEKQTFPPCNAEWSSARGSRLWCSQKSGGVSRDWIGVPRKLYKPGAKEPRCVCVRTTGPPSGQMPDNPPHRNRGDLDHPNLAEYTGCPPLAITCSFPL

SEQ ID NO: 915529 - protein, 264 aa, Homo sapiens; identical to SEQ ID NO: 915526

SEQ ID NO: 915530 - protein, 264 aa, Homo sapiens; identical to SEQ ID NO: 915526

SEQ ID NO: 915531 - protein, 264 aa, Homo sapiens; identical to SEQ ID NO: 915526

SEQ ID NO: 915532 - protein, 201 aa, Homo sapiens
MLRCGGRGLLLGLAVAAAAVMAARLMGWWGPRAGFRLFIPEELSRYRGGPGDPGLYLALLGRVYDVSSGRRHYEPGSHYSGFAGRDASRAFVTGDCSEAGLVDDVSDLSAAEMLTLHNWLSFYEKNYVCVGRVTGRFYGEDGLPTPALTQVEAAITRGLEANKLQLQEKQTFPPCNAEWSSARGSRLWCSQKRWRERLPPT

SEQ ID NO: 915533 - protein, 191 aa, Homo sapiens
MLRCGGRGLLLGLAVAAAAVMAARLMGWWGPRAGFRLFIPEELSRYRGGPGDPGLYLALLGRVYDVSSGRRHYEPGSHYSGFAGRDASRAFVTGDCSEAGLVDDVSDLSAAEMLTPGRSCDHQRLGGQQTTAAREADIPAVQRGVELSQGQPALVLPEEVSRLPFFSFLPVPNPTPRPSCLQYSVNSGIDC

SEQ ID NO: 915534 - protein, 264 aa, Homo sapiens; identical to SEQ ID NO: 915526

SEQ ID NO: 915535 - protein, 152 aa, Homo sapiens; identical to SEQ ID NO: 915527

SEQ ID NO: 915536 - protein, 144 aa, Homo sapiens
DLHYQHNLGVLSLCCPSRMTGVSCFCHYTSHPLHHLLCSYKDPKKWNNRIADLRKQIEELSERKYVMSKLEKSCNLMFMGFYTMELLFIMGVPWTSPELPASHAILTRFSLEDGKLMNLAAADLGPDQSGVTATTLGAAESREH

SEQ ID NO: 915537 - protein, 251 aa, Homo sapiens
MLLPPGSLSRPRTFSSQPLQTKLMTHNGLFRPIPYVTAVSADEPTAPQQPPQAQLHRYNGLFRPSSCLPAFSPGPELSQVDLTRPSSCFFAASPGPAPASWWPLQAQPLPPVGLYSPNICLTADSSRPASASQWTLQTQMVSHCGILSRSSCLSAASPGPAPPASQWPLSAQPSSCLPAAFPSPAFDFWWPLQASTRPSLLPPEGLHRPSLCLTADSPRPASSRLTAASPVQSSCLSATSAGPATACQWPL

SEQ ID NO: 915538 - protein, 149 aa, Homo sapiens [sequence omitted]

SEQ ID NO: 915539 - protein, 251 aa, Homo sapiens; identical to SEQ ID NO: 915537

SEQ ID NO: 915540 - protein, 251 aa, Homo sapiens; identical to SEQ ID NO: 915537

SEQ ID NO: 915541 - protein, 251 aa, Homo sapiens; identical to SEQ ID NO: 915537

SEQ ID NO: 915542 - protein, 251 aa, Homo sapiens; identical to SEQ ID NO: 915537

SEQ ID NO: 915543 - protein, 149 aa, Homo sapiens [sequence omitted]

SEQ ID NO: 915544 - protein, 157 aa, Homo sapiens
MLLPPGSLSRPRTFSSQPLQTKLMTHNGLFRPIPYVTAVSADEPTAPQQPPQAQLHRYNGLFRPSSCLPAFSPGPELSQVDLTRPSSCFFAASPGPAPASWWPLQAQPLPPVGLYSPNICLTADSSRPASASLWTPQAKLPTFQQLLHTQLLPPSGL

SEQ ID NO: 915545 - protein, 149 aa, Homo sapiens [sequence omitted]

SEQ ID NO: 915546 - protein, 251 aa, Homo sapiens; identical to SEQ ID NO: 915537

SEQ ID NO: 915547 - protein, 251 aa, Homo sapiens; identical to SEQ ID NO: 915537

SEQ ID NO: 915548 - protein, 149 aa, Homo sapiens [sequence omitted]

SEQ ID NO: 915549 - protein, 149 aa, Homo sapiens [sequence omitted]

SEQ ID NO: 915550 - protein, 251 aa, Homo sapiens; identical to SEQ ID NO: 915537

SEQ ID NO: 915551 - protein, 149 aa, Homo sapiens [sequence omitted]

SEQ ID NO: 915552 - protein, 149 aa, Homo sapiens [sequence omitted]

SEQ ID NO: 915553 - protein, 62 aa, Homo sapiens
MTVKLPQPYGIVSSIKLLFFVNSKALPLHLQRVPKYFLEGGAPYPNSPFGGVVLTIPWPAVL

SEQ ID NO: 915554 - protein, 186 aa, Homo sapiens
MTVGPFPGLVPASWLTLEAQNFLKSAFCPTSVYCRTLQARPLPHSGPSRPRWCLTVASSVEAPAFRQPLQAQLLLPPSGLFRPSPAHASRRPSQAPLLTFGGLCRPRQGPASCLPKACTGPASASQRTLHAQLALASLRPPQSKAPAFRPLRQVQLLPASGLFRPSSFLTTAFPGPVFPFWQPLGF

SEQ ID NO: 915555 - protein, 149 aa, Homo sapiens [sequence omitted]

SEQ ID NO: 915556 - protein, 149 aa, Homo sapiens [sequence omitted]

SEQ ID NO: 915557 - protein, 149 aa, Homo sapiens [sequence omitted]

SEQ ID NO: 915558 - protein, 149 aa, Homo sapiens [sequence omitted]

SEQ ID NO: 915559 - protein, 608 aa, Homo sapiens
MGPKKSWRSHFFPLPEVWLLLLLSQALSPSHGPQTQAGVGLVWSVPLPSALRSQSCLGAPLRDASELTTVHLFPTRGWGARRALWVHSSASASSAASRRRLRAQASGISSFSLVDGGAPREDGGARGVWLPSSGQVSAQRTGRRLVGLEPTPTGSLTPRPPRPVPGMPRARKGNTLRKGGQRRGGGARSSAQADSGSSDDEAASEARSTASECPSLLSTTAEDSLGGDVVDEQGQQEDLEEKLKEYVDCLTDKSAKTRQGALESLRLALASRLLPDFLLERRLTLADALEKCLKKGKGEEQALAAAVLGLLCVQLGPGPKGEELFHSLQPLLVSVLSDSTASPAARLHCASALGLGCYVAAADIQDLVSCLACLESVFSRFYGLGGSSTSPVVPASLHGLLSAALQAWALLLTICPSTQISHILDRQLPRLPQLLSSESVNLRIAAGETIALLFELARDLEEEFVYEDMEALCSVLRTLATDSNKYRAKADRRRQRSTFRAVLHSVEGGECEEEIVRFGFEVLYMDSWARHRIYAAFKEVLGSGMHHHLQNNELLRDIFGLGPVLLLDATALKACKVPRFEKHLYNAAAFKARTKARSRVRDKRADIL

SEQ ID NO: 915560 - protein, 642 aa, Homo sapiens
MGPKKSWRSHFFPLPEVWLLLLLSQALSPSHGPQTQAGVGLVWSVPLPSALRSQSCLGAPLRDASELTTVHLFPTRGWGARRALWVHSSASASSAGGPQALDYHSHGALRAASRRRLRAQASGISSFSLVDVGLNRMAWNSPSRRPVWQGGAPREDGGARGVWLPSSGQVSAQRTGRRLVGLEPTPTGSLTPRPPRPVPGMPRARKGNTLRKGGQRRGGGARSSAQADSGSSDDEAASEARSTASECPSLLSTTAEDSLGGDVVDEQGQQEDLEEKLKEYVDCLTDKSAKTRQGALESLRLALASRLLPDFLLERRLTLADALEKCLKKGKGEEQALAAAVLGLLCVQLGPGPKGEELFHSLQPLLVSVLSDSTASPAARLHCASALGLGCYVAAADIQDLVSCLACLESVFSRFYGLGGSSTSPVVPASLHGLLSAALQAWALLLTICPSTQISHILDRQLPRLPQLLSSESVNLRIAAGETIALLFELARDLEEEFVYEDMEALCSVLRTLATDSNKYRAKADRRRQRSTFRAVLHSVEGGECEEEIVRFGFEVLYMDSWARHRIYAAFKEVLGSGMHHHLQNNELLRDIFGLGPVLLLDATALKACKVPRFEKHLYNAAAFKARTKARSRVRDKRADIL

SEQ ID NO: 915561 - protein, 642 aa, Homo sapiens; identical to SEQ ID NO: 915560

SEQ ID NO: 915562 - protein, 748 aa, Homo sapiens
MGPKKSWRSHFFPLPEVWLLLLLSQALSPSHGPQTQAGVGLVWSVPLPSALRSQSCLGAPLRDASELTTVHLFPTRGWGARRALWVHSSASASSAGGPQALDYHSHGALRAASRRRLRAQASGISSFSLVDVGLNRMAWNSPSRRPVWQGGAPREDGGARGVWLPSSGQVSAQRTGRRLVGLEPTPTGSLTPRPPRPVPGMPRARKGNTLRKGGQRRGGGARSSAQADSGSSDDEAASEARSTASECPSLLSTTAEDSLGGDVVDEQGQQEDLEEKLKEYVDCLTDKSAKTRQGALESLRLALASRLLPDFLLERRLTLADALEKCLKKGKGEEQALAAAVLGLLCVQLGPGPKGEELFHSLQPLLVSVLSDSTASPAARLHCASALGLGCYVAAADIQDLVSCLACLESVFSRFYGLGGSSTSPVVPASLHGLLSAALQAWALLLTICPSTQISHILDRQLPRLPQLLSSESVNLRIAAGETIALLFELARDLEVRGTRMGGAVVTPPAHHRLDAGGATQNRTALGHYAEEVAPKQIYLLDVMMGALSSGVLACQRPRRGQRGQAEKRGSLSERRGLGSALFRASRAQASTTHPPMLPLQEEFVYEDMEALCSVLRTLATDSNKYRAKADRRRQRSTFRAVLHSVEGGECEEEIVRFGFEVLYMDSWARHRIYAAFKEVLGSGMHHHLQNNELLRDIFGLGPVLLLDATALKACKVPRFEKHLYNAAAFKARTKARSRVRDKRADIL

SEQ ID NO: 915563 - protein, 642 aa, Homo sapiens; identical to SEQ ID NO: 915560

SEQ ID NO: 915564 - protein, 637 aa, Homo sapiens
MGPKKSWRSHFFPLPEVWLLLLLSQALSPSHGPQTQAGVGLVWSVPLPSALRSQSCLGAPLRDASELTTVHLFPTRGWGARRALWVHSSASASSAGGPQALDYHSHGALRAASRRRLRAQASGISSFSLVDVGLNRMAWNSPSRRPVWQGGAPREDGGARGVWLPSSGQVSAQRTGRRLVGLEPTPTGSLTPRPPRPVPGMPRARKGNTLRKGGQRRGGGARSSAQADSGSSDDEAASEARSTASECPSLLSTTAEDSLGGDVVDEQGQQEDLEEKLKEYVDCLTDKSAKTRQGALESLRLALASRLLPDFLLERRLTLADALEKCLKKGKGEEQALAAAVLGLLCVQLGPGPKGEELFHSLQPLLVSVLSDSTASPAARLHCASALGLGCYVAAADIQDLVSCLACLESVFSRFYGLGGSSTSPVVPASLHGLLSAALQAWALLLTICPSTQISHILDRQLPRLPQLLSSESVNLRIAAGETIALLFELARDLEEEFVYEDMEALCSVLRTLATDSNKYRAKADRRRQRSTFRAVLHSVEGGECEEEIVRFGFEVLYMDSWARHRIYAAFKEVLGSGMHHHLQNNELLRDIFGLGPVLLLDATALKACKVPRFEKVCTLGHLSLPPIPISWRPGIL

SEQ ID NO: 915565 - protein, 642 aa, Homo sapiens; identical to SEQ ID NO: 915560

SEQ ID NO: 915566 - protein, 637 aa, Homo sapiens; identical to SEQ ID NO: 915564

SEQ ID NO: 915567 - protein, 670 aa, Homo sapiens
MGPKKSWRSHFFPLPEVWLLLLLSQALSPSHGPQTQAGVGLVWSVPLPSALRSQSCLGAPLRDASELTTVHLFPTRGWGARRALWVHSSASASSAGGPQALDYHSHGALRAASRRRLRAQASGISSFSLVDVGLNRMAWNSPSRRPVWQGGAPREDGGARGVWLPSSGQVSAQRTGRRLVGLEPTPTGSLTPRPPRPVPGMPRARKGNTLRKGGQRRGGGARSSAQADSGSSDDEAASEARSTASECPSLLSTTAEDSLGGDVVDEQGQQEDLEEKLKEYVDCLTDKSAKTRQGALESLRLALASRLLPDFLLERRLTLADALEKCLKKGKGEEQALAAAVLGLLCVQLGPGPKGEELFHSLQPLLVSVLSDSTASPAARLHCASALGLGCYVAAADIQVRGLWAQVVEHLRAVTLPLSSPASLCSYDLVSCLACLESVFSRFYGLGGSSTSPVVPASLHGLLSAALQAWALLLTICPSTQISHILDRQLPRLPQLLSSESVNLRIAAGETIALLFELARDLEEEFVYEDMEALCSVLRTLATDSNKYRAKADRRRQRSTFRAVLHSVEGGECEEEIVRFGFEVLYMDSWARHRIYAAFKEVLGSGMHHHLQNNELLRDIFGLGPVLLLDATALKACKVPRFEKHLYNAAAFKARTKARSRVRDKRADIL

SEQ ID NO: 915568 - protein, 743 aa, Homo sapiens
MGPKKSWRSHFFPLPEVWLLLLLSQALSPSHGPQTQAGVGLVWSVPLPSALRSQSCLGAPLRDASELTTVHLFPTRGWGARRALWVHSSASASSAGGPQALDYHSHGALRAASRRRLRAQASGISSFSLVDVGLNRMAWNSPSRRPVWQGGAPREDGGARGVWLPSSGQVSAQRTGRRLVGLEPTPTGSLTPRPPRPVPGMPRARKGNTLRKGGQRRGGGARSSAQADSGSSDDEAASEARSTASECPSLLSTTAEDSLGGDVVDEQGQQEDLEEKLKEYVDCLTDKSAKTRQGALESLRLALASRLLPDFLLERRLTLADALEKCLKKGKGEEQALAAAVLGLLCVQLGPGPKGEELFHSLQPLLVSVLSDSTASPAARLHCASALGLGCYVAAADIQDLVSCLACLESVFSRFYGLGGSSTSPVVPASLHGLLSAALQAWALLLTICPSTQISHILDRQLPRLPQLLSSESVNLRIAAGETIALLFELARDLEVRGTRMGGAVVTPPAHHRLDAGGATQNRTALGHYAEEVAPKQIYLLDVMMGALSSGVLACQRPRRGQRGQAEKRGSLSERRGLGSALFRASRAQASTTHPPMLPLQEEFVYEDMEALCSVLRTLATDSNKYRAKADRRRQRSTFRAVLHSVEGGECEEEIVRFGFEVLYMDSWARHRIYAAFKEVLGSGMHHHLQNNELLRDIFGLGPVLLLDATALKACKVPRFEKVCTLGHLSLPPIPISWRPGIL

SEQ ID NO: 915569 - protein, 604 aa, Homo sapiens
MGPKKSWRSHFFPLPEVWLLLLLSQALSPSHGPQTQAGVGLVWSVPLPSALRSQSCLGAPLRDASELTTVHLFPTRGWGARRALWVHSSASASSAGGPQALDYHSHGALRAASRRRLRAQASGISSFSLVDVGLNRMAWNSPSRRPVWQGGAPREDGGARGVWLPSSGQVSAQRTGRRLVGLEPTPTGSLTPRPPRPVPGMPRARKGNTLRKGGQRRGGGARSSAQADSGSSDDEAASEARSTASECPSLLSTTAEDSLGGDVVDEQGQQEDLEEKLKEYVDCLTDKSAKTRQGALESLRLALASRLLPDFLLERRLTLADALEKCLKKGKGEEQALAAAVLGLLCVQLGPGPKGEELFHSLQPLLVSVLSDSTASPAARLHCASALGLGCYVAAADIQDLVSCLACLESVFSRFYGLGGSSTSPVVPASLHGLLSAALQAWALLLTICPSTQISHILDRQLPRLPQLLSSESVNLRIAAGETIALLFELARDLEEEFVYEDMEALCSVLRTLATDSNKYRAKADRRRQRSTFRAVLHSVEGGECEEEIVRFGFEVLYMDSWARHRIYAAFKEVLGSGMHHHLQTMSYSLHLCLACLFSYYYTT

SEQ ID NO: 915570 - protein, 697 aa, Homo sapiens
MGPKKSWRSHFFPLPEVWLLLLLSQALSPSHGPQTQAGVGLVWSVPLPSALRSQSCLGAPLRDASELTTVHLFPTRGWGARRALWVHSSASASSAGGPQALDYHSHGALRAASRRRLRAQASGISSFSLVDVGLNRMAWNSPSRRPVWQGGAPREDGGARGVWLPSSGQVSAQRTGRRLVGLEPTPTGSLTPRPPRPVPGMPRARKGNTLRKGGQRRGGGARSSAQADSGSSDDEAASEARSTASECPSLLSTTAEDSLGGDVVDEQGQQEDLEEKLKEYVDCLTDKSAKTRQGALESLRLALASRLLPDFLLERRLTLADALEKCLKKGKGEEQALAAAVLGLLCVQLGPGPKGEELFHSLQPLLVSVLSDSTASPAARLHVSCLCPMKPFLHLIPQQSGGFPLSSASFTLRGVSSRAGNPGSPADRGIALPFSQQCASALGLGCYVAAADIQDLVSCLACLESVFSRFYGLGGSSTSPVVPASLHGLLSAALQAWALLLTICPSTQISHILDRQLPRLPQLLSSESVNLRIAAGETIALLFELARDLEEEFVYEDMEALCSVLRTLATDSNKYRAKADRRRQRSTFRAVLHSVEGGECEEEIVRFGFEVLYMDSWARHRIYAAFKEVLGSGMHHHLQNNELLRDIFGLGPVLLLDATALKACKVPRFEKHLYNAAAFKARTKARSRVRDKRADIL

SEQ ID NO: 915571 - protein, 435 aa, Homo sapiens
MGLGSLAGLTPQGARSSAQADSGSSDDEAASEARSTASECPSLLSTTAEDSLGGDVVDEQGQQEDLEEKLKEYVDCLTDKSAKTRQGALESLRLALASRLLPDFLLERRLTLADALEKCLKKGKGEEQALAAAVLGLLCVQLGPGPKGEELFHSLQPLLVSVLSDSTASPAARLHCASALGLGCYVAAADIQDLVSCLACLESVFSRFYGLGGSSTSPVVPASLHGLLSAALQAWALLLTICPSTQISHILDRQLPRLPQLLSSESVNLRIAAGETIALLFELARDLEEEFVYEDMEALCSVLRTLATDSNKYRAKADRRRQRSTFRAVLHSVEGGECEEEIVRFGFEVLYMDSWARHRIYAAFKEVLGSGMHHHLQNNELLRDIFGLGPVLLLDATALKACKVPRFEKHLYNAAAFKARTKARSRVRDKRADIL

SEQ ID NO: 915572 - protein, 368 aa, Homo sapiens
MPQPSQHHCRGQPCAKTRQGALESLRLALASRLLPDFLLERRLTLADALEKCLKKGKGEEQALAAAVLGLLCVQLGPGPKGEELFHSLQPLLVSVLSDSTASPAARLHCASALGLGCYVAAADIQDLVSCLACLESVFSRFYGLGGSSTSPVVPASLHGLLSAALQAWALLLTICPSTQISHILDRQLPRLPQLLSSESVNLRIAAGETIALLFELARDLEEEFVYEDMEALCSVLRTLATDSNKYRAKADRRRQRSTFRAVLHSVEGGECEEEIVRFGFEVLYMDSWARHRIYAAFKEVLGSGMHHHLQNNELLRDIFGLGPVLLLDATALKACKVPRFEKHLYNAAAFKARTKARSRVRDKRADIL

SEQ ID NO: 915573 - protein, 702 aa, Homo sapiens
MGPKKSWRSHFFPLPEVWLLLLLSQALSPSHGPQTQAGVGLVWSVPLPSALRSQSCLGAPLRDASELTTVHLFPTRGWGARRALWVHSSASASSAGGPQALDYHSHGALRAASRRRLRAQASGISSFSLVDVGLNRMAWNSPSRRPVWQGGAPREDGGARGVWLPSSGQVSAQRTGRRLVGLEPTPTGSLTPRPPRPVPGMPRARKGNTLRKGGQRRGGGARSSAQADSGSSDDEAASEARSTASECPSLLSTTAEDSLGESGWKFDRGLVRAPWAEDKKRCCPGGLAGGDVVDEQGQQEDLEEKLKEYVDCLTDKRYPWLPANSYTQLQAVIKGGLAHMTPLLDSPSAKTRQGALESLRLALASRLLPDFLLERRLTLADALEKCLKKGKGEEQALAAAVLGLLCVQLGPGPKGEELFHSLQPLLVSVLSDSTASPAARLHCASALGLGCYVAAADIQDLVSCLACLESVFSRFYGLGGSSTSPVVPASLHGLLSAALQAWALLLTICPSTQISHILDRQLPRLPQLLSSESVNLRIAAGETIALLFELARDLEEEFVYEDMEALCSVLRTLATDSNKYRAKADRRRQRSTFRAVLHSVEGGECEEEIVRFGFEVLYMDSWARHRIYAAFKEVLGSGMHHHLQNNELLRDIFGLGPVLLLDATALKACKVPRFEKHLYNAAAFKARTKARSRVRDKRADIL

SEQ ID NO: 915574 - protein, 803 aa, Homo sapiens
MGPKKSWRSHFFPLPEVWLLLLLSQALSPSHGPQTQAGVGLVWSVPLPSALRSQSCLGAPLRDASELTTVHLFPTRGWGARRALWVHSSASASSAGGPQALDYHSHGALRAASRRRLRAQASGISSFSLVDVGLNRMAWNSPSRRPVWQGGAPREDGGARGVWLPSSGQVSAQRTGRRLVGLEPTPTGSLTPRPPRPVPGMPRARKGNTLRKGGQRRGGGARSSAQADSGSSDDEAASEARSTASECPSLLSTTAEDSLGGDVVDEQGQQEDLEEKLKEYVDCLTDKSAKTRQGALESLRLALASRLLPDFLLERRLTLADALEKCLKKGKGEEQALAAAVLGLLCVQLGPGPKGEELFHSLQPLLVSVLSDSTASPAARLHVSCLCPMKPFLHLIPQQSGGFPLSSASFTLRGVSSRAGNPGSPADRGIALPFSQQCASALGLGCYVAAADIQDLVSCLACLESVFSRFYGLGGSSTSPVVPASLHGLLSAALQAWALLLTICPSTQISHILDRQLPRLPQLLSSESVNLRIAAGETIALLFELARDLEVRGTRMGGAVVTPPAHHRLDAGGATQNRTALGHYAEEVAPKQIYLLDVMMGALSSGVLACQRPRRGQRGQAEKRGSLSERRGLGSALFRASRAQASTTHPPMLPLQEEFVYEDMEALCSVLRTLATDSNKYRAKADRRRQRSTFRAVLHSVEGGECEEEIVRFGFEVLYMDSWARHRIYAAFKEVLGSGMHHHLQNNELLRDIFGLGPVLLLDATALKACKVPRFEKHLYNAAAFKARTKARSRVRDKRADIL

SEQ ID NO: 915575 - protein, 140 aa, Homo sapiens
MEALCSVLRTLATDSNKYRAKADRRRQRSTFRAVLHSVEGGECEEEIVRFGFEVLYMDSWARHRIYAAFKEVLGSGMHHHLQNNELLRDIFGLGPVLLLDATALKACKVPRFEKHLYNAAAFKARTKARSRVRDKRADIL

SEQ ID NO: 915576 - protein, 410 aa, Homo sapiens
MGPKKSWRSHFFPLPEVWLLLLLSQALSPSHGPQTQAGVGLVWSVPLPSALRSQSCLGAPLRDASELTTVHLFPTRGWGARRALWVHSSASASSAGGPQALDYHSHGALRAASRRRLRAQASGISSFSLVDVGLNRMAWNSPSRRPVWQGGAPREDGGARGVWLPSSGQVSAQRTGRRLVGLEPTPTGSLTPRPPRPVPGMPRARKGNTLRKGGQRRGGGARSSAQADSGSSDDEAASEARSTASECPSLLSTTAEDSLGGDVVDEQGQQEDLEEKLKEYVDCLTDKSAKTRQGALESLRLALASRLLPDFLLERRLTLADALEKCLKKGKGEEQALAAAVLGLLCVQLGPGPKGEELFHSLQPLLVSVLSDSTASPAARLHCASALGLGCYVAAADIQAAAPAAPALVQ

SEQ ID NO: 915577 - protein, 408 aa, Homo sapiens
MGPKKSWRSHFFPLPEVWLLLLLSQALSPSHGPQTQAGVGLVWSVPLPSALRSQSCLGAPLRDASELTTVHLFPTRGWGARRALWVHSSASASSAGGPQALDYHSHGALRAASRRRLRAQASGISSFSLVDVGLNRMAWNSPSRRPVWQGGAPREDGGARGVWLPSSGQVSAQRTGRRLVGLEPTPTGSLTPRPPRPVPGMPRARKGNTLRKGGQRRGGGARSSAQADSGSSDDEAASEARSTASECPSLLSTTAEDSLGGDVVDEQGQQEDLEEKLKEYVDCLTDKSAKTRQGALESLRLALASRLLPDFLLERRLTLADALEKCLKKGKGEEQALAAAVLGLLCVQLGPGPKGEELFHSLQPLLVSVLSDSTASPAARLHCASAWLAVRGALTSGLFLLLLEGSAG

SEQ ID NO: 915578 - protein, 601 aa, Homo sapiens
MTTNTQGKGYVKLIIAPLKMSYAVSWSERHGNNQAIFRHLHYLGTALHSTMMSAVQLLGTIKDYPYTAMLIHLNAKIYYEFFIVLKVYVNYFSKLLWSHVYSSCICDMQKDEDSWPPGVYILMVLLVQADCFSLLMNIAWLLIISYLEGSLGEQFLKAEGCAKFQGIDSLSLHCISPARYHFFPQGAMQVMLISMNQKRNHSALEHLNHPPKPPMLSCYSCQSITKKINSSLRLYIPQFSFFSQSLYIILYSDGPGFAYKPFKTDYVVLILTFLCMTPIPFLKQHCDRCGASTCISKQIINPTFELKLAWILVMSRNSSESRNLFCMLIKLKLGLIESASNSDRTLTLVLEYEHSNAGLKMSSVVVTSYFIYAFVNNEAIETKTNSLNIFRLFSCFNKGFFLLPLKMGSEKINRGNHKTFKLSGLGRSSAHPLTTCLVPLVPKHVENKRHKLSMLNKTSCYGCNNQKGAEFQKEYESRECQYGVCKITRYGYGVVYDMLYVDKVGGLLKLGFELKRVRMHIFPLFQDFQMTRHMLWMILVPTTNDQTIKYPCNKGDFLFVNSPENTDRSVVSLLFYCIKNSLNKFYSQSFILDGFGQTAIS

SEQ ID NO: 915579 - protein, 387 aa, Homo sapiens
MLSCYSCQSITKKINSSLRLYIPQFSFFSQSLYIILYSDGPGFAYKPFKTDYVVLILTFLCMTPIPFLKQHCDRCGASTCISKQIINPTFELKLAWILVMSRNSSESRNLFCMLIKLKLGLIESASNSDRTLTLVLEYEHSNAGLKMSSVVVTSYFIYAFVNNEAIETKTNSLNIFRLFSCFNKGFFLLPLKMGSEKINRGNHKTFKLSGLGRSSAHPLTTCLVPLSPSMFENKRHKLSMLNKTSCYGCNNQKGAEFQKEYESRECQYGVCKITRYGYGVVYDMLYVDKVGGLLKLGFELKRVRMHIFPLFQDFQMTRHMLWMILVPTTNDQTIKYPCNKGDFLFVNSPENTDRSVVSLLFYCIKNSLNKFYSQSFILDGFGQTAIS

SEQ ID NO: 915580 - protein, 150 aa, Homo sapiens
AKCETPSSQMALHEGFVLLFLKEKELHGKFSHPPPSAPNSSMSKVVFYFSETESHSVAQAGVQWCNLSSLQPPPPGFKQLLLTSSNPPGLLFSCLNMACLLVSLFSYSLYVKKLHFACLMEMLLIASVSAFLICRPFTFPVCSMLCANTQ

SEQ ID NO: 915581 - protein, 1166 aa, Homo sapiens
MFPLCAGVLYLQYGDETKQLRMPNEITSADTIRALFVSAFPQQLTMKMLESPSVAIYIKDESRNVYYELNDVRNIQDRSLLKVYNKDPAHAFNHTPKTMNGDMRMQRELVYARGDGPGAPRPGSTAHPPHAIPNSPPSTPVPHSMPPSPSRIPYGGTRSMVVPGNATIPRDRISSLPVSRPISPSPSAILERRDVKPDEDMSGKNIAMYRNEGFYADPYLYHEGRMSIASSHGGHPLDVPDHIIAYHRTAIRSASAYCNPSMQAEMHMEQSLYRQKSRKYPDSHLPTLGSKTPPASPHRVSDLRMIDMHAHYNAHGPPHTMQPDRASPSRQAFKKEPGTLVYIEKPRSAAGLSSLVDLGPPLMEKQVFAYSTATIPKDRETRERMQAMEKQIASLTGLVQSALFKGPITSYSKDASSEKMMKTTANRNHTDSAGTPHVSGGKMLSALESTVPPSQPPPVGTSAIHMSLLEMRRSVAELRLQLQQMRQLQLQNQELLRAMMKKAELEISGKVMETMKRLEDPCSAQRVLVEQERQKYLHEEEKIVKKLCELEDFVEDLKKDSTAASRLVTLKDVEDGAFLLRQVGEAVATLKGEFPTLQNKMRAILRIEVEAVRFLKEEPHKLDSLLKRVRSMTDVLTMLRRHVTDGLLKGTDAAQAAQYMAMEKATAAEVLKSQEEAAHTSGQPFHSTGAPGDAKSEVVPLSGMMVRHAQSSPVVIQPSQHSVALLNPAQNLPHVASSPAVPQEATSTLQMSQAPQSPQIPMNGSAMQSLFIEEIHSVSAKNRAVSIEKAEKKWEEKRQNLDHYNGKEFEKLLEEAQANIMKSIPNLEMPPATGPLPRGDAPVDKVELSEDSPNSEQDLEKLGGKSPPPPPPPPRRSYLPGSGLTTTRSGDVVYTGRKENITAKASSEDAGPSPQTRATKYPAEEPASAWTPSPPPVTTSSSKDEEEEEEEGDKIMAELQGSSGAPQTSRMPVPMSAKNRPGTLDKPGKQSKLQDPRQYRQANGSAKKSGGDFKPTSPSLPASKIPALSPSSGKSSSLPSSSGDSSNLPNPPATKPSIASNPLSPQTGPPAHSASLIPSVSNGSLKFQSLTHTGKGHHLSFSPQSQNGRAPPPLSFSSSPPSPASSVSLNQGAKGTRTIHTPSLTSYKAQNGSSSKATPSTAKETS

SEQ ID NO: 915582 - protein, 566 aa, Homo sapiens
MRAILRIEVEAVRFLKEEPHKLDSLLKRVRSMTDVLTMLRRHVTDGLLKGTDAAQAAQYMAMEKATAAEVLKSQEEAAHTSGQPFHSTGAPGDAKSEVVPLSGMMVRHAQSSPVVIQPSQHSVALLNPAQNLPHVASSPAVPQEATSTLQMSQAPQSPQIPMNGSAMQSLFIEEIHSVSAKNRAVSIEKAEKKWEEKRQNLDHYNGKEFEKLLEEAQANIMKSIPNLEMPPATGPLPRGDAPVDKVELSEDSPNSEQDLEKLGGKSPPPPPPPPRRSYLPGSGLTTTRSGDVVYTGRKENITAKASSEDAGPSPQTRATKYPAEEPASAWTPSPPPVTTSSSKDEEEEEEEGDKIMAELQGSSGAPQTSRMPVPMSAKNRPGTLDKPGKQSKLQDPRQYRQANGSAKKSGGDFKPTSPSLPASKIPALSPSSGKSSSLPSSSGDSSNLPNPPATKPSIASNPLSPQTGPPAHSASLIPSVSNGSLKFQSLTHTGKGHHLSFSPQSQNGRAPPPLSFSSSPPSPASSVSLNQGAKGTRTIHTPSLTSYKAQNGSSSKATPSTAKETS

SEQ ID NO: 915583 - protein, 566 aa, Homo sapiens; identical to SEQ ID NO: 915582

SEQ ID NO: 915584 - protein, 1027 aa, Homo sapiens
MQRELVYARGDGPGAPRPGSTAHPPHAIPNSPPSTPVPHSMPPSPSRIPYGGTRSMVVPGNATIPRDRISSLPVSRPISPSPSAILERRDVKPDEDMSGKNIAMYRNEGFYADPYLYHEGRMSIASSHGGHPLDVPDHIIAYHRTAIRSASAYCNPSMQAEMHMEQSLYRQKSRKYPDSHLPTLGSKTPPASPHRVSDLRMIDMHAHYNAHGPPHTMQPDRASPSRQAFKKEPGTLVYIEKPRSAAGLSSLVDLGPPLMEKQVFAYSTATIPKDRETSEKMMKTTANRNHTDSAGTPHVSGGKMLSALESTVPPSQPPPVGTSAIHMSLLEMRRSVAELRLQLQQMRQLQLQNQELLRAMMKKAELEISGKVMETMKRLEDPCSAQRVLVEQERQKYLHEEEKIVKKLCELEDFVEDLKKDSTAASRLVTLKDVEDGAFLLRQVGEAVATLKGEFPTLQNKMRAILRIEVEAVRFLKEEPHKLDSLLKRVRSMTDVLTMLRRHVTDGLLKGTDAAQAAQYMAMEKATAAEVLKSQEEAAHTSGQPFHSTGAPGDAKSEVVPLSGMMVRHAQSSPVVIQPSQHSVALLNPAQNLPHVASSPAVPQEATSTLQMSQAPQSPQIPMNGSAMQSLFIEEIHSVSAKNRAVSIEKAEKKWEEKRQNLDHYNGKEFEKLLEEAQANIMKSIPNLEMPPATGPLPRGDAPVDKVELSEDSPNSEQDLEKLGGKSPPPPPPPPRRSYLPGSGLTTTRSGDVVYTGRKENITAKASSEDAGPSPQTRATKYPAEEPASAWTPSPPPVTTSSSKDEEEEEEEGDKIMAELQGSSGAPQTSRMPVPMSAKNRPGTLDKPGKQSKLQDPRQYRQANGSAKKSGGDFKPTSPSLPASKIPALSPSSGKSSSLPSSSGDSSNLPNPPATKPSIASNPLSPQTGPPAHSASLIPSVSNGSLKFQSLTHTGKGHHLSFSPQSQNGRAPPPLSFSSSPPSPASSVSLNQGAKGTRTIHTPSLTSYKAQNGSSSKATPSTAKETS

SEQ ID NO: 915585 - protein, 566 aa, Homo sapiens; identical to SEQ ID NO: 915582

SEQ ID NO: 915586 - protein, 566 aa, Homo sapiens; identical to SEQ ID NO: 915582

SEQ ID NO: 915587 - protein, 627 aa, Homo sapiens
MCWCPCSRSELEDFVEDLKKDSTAASRLVTLKDVEDGAFLLRQVGEAVATLKGEFPTLQNKMRAILRIEVEAVRFLKEEPHKLDSLLKRVRSMTDVLTMLRRHVTDGLLKGTDAAQAAQYMAMEKATAAEVLKSQEEAAHTSGQPFHSTGAPGDAKSEVVPLSGMMVRHAQSSPVVIQPSQHSVALLNPAQNLPHVASSPAVPQEATSTLQMSQAPQSPQIPMNGSAMQSLFIEEIHSVSAKNRAVSIEKAEKKWEEKRQNLDHYNGKEFEKLLEEAQANIMKSIPNLEMPPATGPLPRGDAPVDKVELSEDSPNSEQDLEKLGGKSPPPPPPPPRRSYLPGSGLTTTRSGDVVYTGRKENITAKASSEDAGPSPQTRATKYPAEEPASAWTPSPPPVTTSSSKDEEEEEEEGDKIMAELQGSSGAPQTSRMPVPMSAKNRPGTLDKPGKQSKLQDPRQYRQANGSAKKSGGDFKPTSPSLPASKIPALSPSSGKSSSLPSSSGDSSNLPNPPATKPSIASNPLSPQTGPPAHSASLIPSVSNGSLKFQSLTHTGKGHHLSFSPQSQNGRAPPPLSFSSSPPSPASSVSLNQGAKGTRTIHTPSLTSYKAQNGSSSKATPSTAKETS

SEQ ID NO: 915588 - protein, 566 aa, Homo sapiens; identical to SEQ ID NO: 915582

SEQ ID NO: 915589 - protein, 405 aa, Homo sapiens
MRAILRIEVEAVRFLKEEPHKLDSLLKRVRSMTDVLTMLRRHVTDGLLKGTDAAQAAQYMAMEKATAAEVLKSQEEAAHTSGQPFHSTGAPGDAKSEVVPLSGMMVRHAQSSPVVIQPSQHSVALLNPAQNLPHVASSPAVPQEATSTLQMSQAPQSPQIPMNGSAMQSLFIEEIHSVSAKNRAVSIEKAEKKWEEKRQNLDHYNGKEFEKLLEEAQANIMKSIPNLEMPPATGPLPRGDAPVDKVELSEDSPNSEQDLEKLGGKSPPPPPPPPRRSYLPGSGLTTTRSGDVVYTGRKENITAKASSEDAGPSPQTRATKYPAEEPASAWTPSPPPVTTSSSKDEEEEEEEGDKIMAELQGSSGAPQTSRMPVPMSAKNRPGTLDKPGKQSKLQDPRQYRQVVLP

SEQ ID NO: 915590 - protein, 618 aa, Homo sapiens [sequence omitted]

SEQ ID NO: 915591 - protein, 405 aa, Homo sapiens; identical to SEQ ID NO: 915589

SEQ ID NO: 915592 - protein, 779 aa, Homo sapiens [sequence omitted]

SEQ ID NO: 915593 - protein, 405 aa, Homo sapiens; identical to SEQ ID NO: 915589

SEQ ID NO: 915594 - protein, 155 aa, Homo sapiens
MNLYDTPENTVRRQEQPSIESTSPISRTDEIRKNTYRTLDSLEQTIKQLENTISEMSPKALVDTSCSSNRDSVASSSHIAQEASPRPLLVPDEGPTALEPPTSIPSASRKGSSGAPQTSRMPVPMSAKNRPGTLDKPGKQSKLQDPRQYRQVVLP

SEQ ID NO: 915595 - protein, 405 aa, Homo sapiens; identical to SEQ ID NO: 915589

SEQ ID NO: 915596 - protein, 313 aa, Homo sapiens
MQRELVYARGDGPGAPRPGSTAHPPHAIPNSPPSTPVPHSMPPSPSRIPYGGTRSMVVPGNATIPRDRISSLPVSRPISPSPSAILERRDVKPDEDMSGKNIAMYRNEGFYADPYLYHEGRMSIASSHGGHPLDVPDHIIAYHRTAIRSASAYCNPSMQAEMHMEQSLYRQKSRKYPDSHLPTLGSKTPPASPHRVSDLRMIDMHAHYNAHGPPHTMQPDRASPSRQAFKKEPGTLVYIEKPRSAAGLSSLVDLGPPLMEKQVFAYSTATIPKDRETRERMQAMEKQIASLTGLVQSALFKGPITSYSKDASR

SEQ ID NO: 915597 - protein, 313 aa, Homo sapiens; identical to SEQ ID NO: 915596

SEQ ID NO: 915598 - protein, 283 aa, Homo sapiens
MQRELVYARGDGPGAPRPGSTAHPPHAIPNSPPSTPVPHSMPPSPSRIPYGGTRSMVVPGNATIPRDRISSLPVSRPISPSPSAILERRDVKPDEDMSGKNIAMYRNEGFYADPYLYHEGRMSIASSHGGHPLDVPDHIIAYHRTAIRSASAYCNPSMQAEMHMEQSLYRQKSRKYPDSHLPTLGSKTPPASPHRVSDLRMIDMHAHYNAHGPPHTMQPDRASPSRQAFKKEPGTLVYIEKPRSAAGLSSLVDLGPPLMEKQVFAYSTATIPKDRETRIEEKQ

SEQ ID NO: 915599 - protein, 113 aa, Homo sapiens
QSLYRQKSRKYPDSHLPTLGSKTPPASPHRVSDLRMIDMHAHYNAHGPPHTMQPDRASPSRQAFKKEPGTLVYIEKPRSAAGLSSLVDLGPPLMEKQVFAYSTATIPKDRETR

SEQ ID NO: 915600 - protein, 544 aa, Homo sapiens
MPGRCQSDAAMRVNGPASRAPAGWTSGSLHTGPRAGRPRAQARGVRGRGLLLRPRPAKELPLPRKGGAWAPAGNPGPLHPLGVAVGMAGSGRLVLRPWIRELILGSETPSSPRAGQLLEVLQDAEAAVAGPSHAPDTSDVGATLLVSDGTHSVRCLVTREALDTSDWEEKEFGFRGTEGRLLLLQDCGVHVQVAEGGAPAEFYLQVDRFSLLPTEQPRLRVPGCNQDLDVQKKLYDCLEEHLSESTSSNAGLSLSQLLDEMREDQEHQGALVCLAESCLTLEGPCTAPPVTHWAASRCKATGEAVYTVPSSMLCISENDQLILSSLGPCQRTQGPELPPPDPALQDLSLTLIASPPSSPSSSGTPALPGHMSSEESGTSISLLPALSLAAPDPGQRSSSQPSPAICSAPATLTPRSPHASRTPSSPLQSCTPSLSPRSHVPSPHQALVTRPQKPSLEFKEFVGLPCKNRPPFPRTGATRGAQEPCSVWEPPKRHRDGSAFQYEYEPPCTSLCARVQAVRLPPQLMAWALHFLMDAQPGSEPTPM

SEQ ID NO: 915601 - protein, 224 aa, Homo sapiens
MPGRCQSDAAMRVNGPASRAPAGWTSGSLHTGPRAGRPRAQARGVRGRGLLLRPRPAKELPLPRKGGAWAPAGNPGPLHPLGVAVGMAGSGRLVLRPWIRELILGSETPSSPRAGQLLEVLQDAEAAVAGPSHAPDTSDVGATLLVSDGTHSVRCLVTREALDTSDWEEKEFGFRGTEGRLLLLQDCGVHVQVAEGGAPAEFYLQVDRFSLLPTEQPRLRVPGW

SEQ ID NO: 915602 - protein, 544 aa, Homo sapiens; identical to SEQ ID NO: 915600

SEQ ID NO: 915603 - protein, 544 aa, Homo sapiens; identical to SEQ ID NO: 915600

SEQ ID NO: 915604 - protein, 519 aa, Homo sapiens
MPGRCQSDAAMRVNGPASRAPAGWTSGSLHTGPRAGRPRAQARGVRGRGLLLRPRPAKELPLPRKGGAWAPAGNPGPLHPLGVAVGMAGSGRLVLRPWIRELILGSETPSSPRAGQLLEVLQDAEAAVAGPSHAPDTSDVGATLLVSDGTHSVRCLVTREALDTSDWEEKEFGFRGTEGRLLLLQDCGVHVQVAEGGAPAEFYLQVDRFSLLPTEQPRLRVPGCNQDLDVQKKLYDCLEEHLSESTSSNAGLSLSQLLDEMREDQEHQGALVCLAESCLTLEGPCTAPPVTHWAASRCKATGEAVYTVPSSMLCISENDQLILSSLGPCQRTQGPELPPPDPALQDLSLTLIASPPSSPSSSGTPALPGHMSSEESGTSISLLPALSLAAPDPGQRSSSQPSPAICSAPATLTPRSPHASRTPSSPLQSCTPSLSPRSHVPSPHQALVTRPQKPSLEFKEFVGLPCKNRPPFPRTGATRGAQEPCSVWEPPKRHRDGSAFQYEYEPPCTSLCARVQAVR

SEQ ID NO: 915605 - protein, 503 aa, Homo sapiens
MPGRCQSDAAMRVNGPASRAPAGWTSGSLHTGPRAGRPRAQARGVRGRGLLLRPRPAKELPLPRKGGAWAPAGNPGPLHPLGVAVGMAGSGRLVLRPWIRELILGSETPSSPRAGQLLEVLQDAEAAVAGPSHAPDTSDVGATLLVSDGTHSVRCLVTREALDTSDWEEKEFGFRGTEGRLLLLQDCGVHVQVAEGGAPAEFYLQVDRFSLLPTEQPRLRVPGCNQDLDVQKKLYDCLEEHLSESTSSNAGLSLSQLLDEMREDQEHQGALVCLAESCLTLEGPCTAPPVTHWAASRCKATGEAVYTVPSSMLCISENDQLILSSLGPCQRTQGPELPPPDPALQDLSLTLIASPPSSPSSSGTPALPGHMSSEESGTSISLLPALSLAAPDPGQRSSSQPSPAICSAPATLTPRSPHASRTPSSPLQSCTPSLSPRSHVPSPHQALVTRPQKPSLEFKEFVGLPCKNRPPFPRTGATRGAQEPCSVWVSIAPLQLEGRTRKA

SEQ ID NO: 915606 - protein, 503 aa, Homo sapiens; identical to SEQ ID NO: 915605

SEQ ID NO: 915607 - protein, 531 aa, Homo sapiens
MPGRCQSDAAMRVNGPASRAPAGWTSGSLHTGPRAGRPRAQARGVRGRGLLLRPRPAKELPLPRKGGAWAPAGNPGPLHPLGVAVGMAGSGRLVLRPWIRELILGSETPSSPRAGQLLEVLQDAEAAVAGPSHAPDTSDVGATLLVSDGTHSVRCLVTREALDTSDWEEKEFGFRGTEGRLLLLQDCGVHVQVAEGGAPAEFYLQVDRFSLLPTEQPRLRVPGCNQDLDVQKKLYDCLEEHLSESTSSNAGLSLSQLLDEMREDQEHQGALVCLAESCLTLEGPCTAPPVTHWAASRCKATGEAVYTVPSSMLCISENDQLILSSLGPCQRTQGPELPPPDPALQDLSLTLIASPPSSPSSSGTPALPGHMSSEESGTSISLLPALSLAAPDPGQRSSSQPSPAICSAPATLTPRSPHASRTPSSPLQSCTPSLSPRSHVPSPHQALVTRPQKPSLEFKEFVGLPCKNRPPFPRTGATRGAQEPCSVWYEYEPPCTSLCARVQAVRLPPQLMAWALHFLMDAQPGSEPTPM

SEQ ID NO: 915608 - protein, 569 aa, Homo sapiens
MPGRCQSDAAMRVNGPASRAPAGWTSGSLHTGPRAGRPRAQARGVRGRGLLLRPRPAKELPLPRKGGAWAPAGNPGPLHPLGVAVGMAGSGRLVLRPWIRELILGSETPSSPRAGQLLEVSPHSGPGDRGGGPGWWDDAARRRQVLQDAEAAVAGPSHAPDTSDVGATLLVSDGTHSVRCLVTREALDTSDWEEKEFGFRGTEGRLLLLQDCGVHVQVAEGGAPAEFYLQVDRFSLLPTEQPRLRVPGCNQDLDVQKKLYDCLEEHLSESTSSNAGLSLSQLLDEMREDQEHQGALVCLAESCLTLEGPCTAPPVTHWAASRCKATGEAVYTVPSSMLCISENDQLILSSLGPCQRTQGPELPPPDPALQDLSLTLIASPPSSPSSSGTPALPGHMSSEESGTSISLLPALSLAAPDPGQRSSSQPSPAICSAPATLTPRSPHASRTPSSPLQSCTPSLSPRSHVPSPHQALVTRPQKPSLEFKEFVGLPCKNRPPFPRTGATRGAQEPCSVWEPPKRHRDGSAFQYEYEPPCTSLCARVQAVRLPPQLMAWALHFLMDAQPGSEPTPM

SEQ ID NO: 915609 - protein, 461 aa, Homo sapiens
MFQSRERAALLGIRERLILKVRDTLQIHRDRADCIEVLQDAEAAVAGPSHAPDTSDVGATLLVSDGTHSVRCLVTREALDTSDWEEKEFGFRGTEGRLLLLQDCGVHVQVAEGGAPAEFYLQVDRFSLLPTEQPRLRVPGCNQDLDVQKKLYDCLEEHLSESTSSNAGLSLSQLLDEMREDQEHQGALVCLAESCLTLEGPCTAPPVTHWAASRCKATGEAVYTVPSSMLCISENDQLILSSLGPCQRTQGPELPPPDPALQDLSLTLIASPPSSPSSSGTPALPGHMSSEESGTSISLLPALSLAAPDPGQRSSSQPSPAICSAPATLTPRSPHASRTPSSPLQSCTPSLSPRSHVPSPHQALVTRPQKPSLEFKEFVGLPCKNRPPFPRTGATRGAQEPCSVWEPPKRHRDGSAFQYEYEPPCTSLCARVQAVRLPPQLMAWALHFLMDAQPGSEPTPM

SEQ ID NO: 915610 - protein, 357 aa, Homo sapiens [sequence omitted]

SEQ ID NO: 915611 - protein, 420 aa, Homo sapiens
MPGRCQSDAAMRVNGPASRAPAGWTSGSLHTGPRAGRPRAQARGVRGRGLLLRPRPAKELPLPRKGGAWAPAGNPGPLHPLGVAVGMAGSGRLVLRPWIRELILGSETPSSPRAGQLLEVLQDAEAAVAGPSHAPDTSDVGATLLVSDGTHSVRCLVTREALDTSDWEEKEFGFRGTEGRLLLLQDCGVHVQVAEGGAPAEFYLQVDRFSLLPTEQPRLRVPGCNQDLDVQKKLYDCLEEHLSESTSSNAGLSLSQLLDEMREDQEHQGALVCLAESCLTLEGPCTAPPVTHWAASRCKATGEAVYTVPSSMLCISENDQLILSSLGPCQRTQGPELPPPDPALQDLSLTLIASPPSSPSSSGPELPGEPRSPALSGNPQRGIVMVLPSSMSMSHPARPSVLGSKLSGFLPSSWPGPCTF

SEQ ID NO: 915612 - protein, 129 aa, Homo sapiens
MAELIQKKLQGEVEKYQQLQKDLSKSMSGRQKLEAQLTENNIVKEELALLDGSNVVFKLLGPVLVKQELGEARATVGKRLDYITAEIKRYESQLRDLERQSEQQRETLAQLQQEFQRAQAAKAGAPGKA

SEQ ID NO: 915613 - protein, 129 aa, Homo sapiens; identical to SEQ ID NO: 915612

SEQ ID NO: 915614 - protein, 129 aa, Homo sapiens; identical to SEQ ID NO: 915612

SEQ ID NO: 915615 - protein, 102 aa, Homo sapiens
MAELIQKKLQGEVEKYQQLQKDLSKSMSGRQKLEAQLTENNIVKEELALLDGSNVVFKLLGPVLVKQELGEARATVGKRLDYITAEIKRYESLPQPPPLLMP

SEQ ID NO: 915616 - protein, 116 aa, Homo sapiens
MAELIQKKLQGEVEKYQQLQKDLSKSMSGRQKLEAQLTENNIVKEKEVRDWDLWGEEGPVLAMVLITYVPSLHQELALLDGSNVVFKLLGPVLVKQELGEARATVGKRLDYITAEM

SEQ ID NO: 915617 - protein, 126 aa, Homo sapiens
FLLPQIHIHLTRIVGIGGTFDVSKLPFLSSPDLSKSMSGRQKLEAQLTENNIVKEKEVRDWDLWGEEGPVLAMVLITYVPSLHQELALLDGSNVVFKLLGPVLVKQELGEARATVGKRLDYITAEM

SEQ ID NO: 915618 - protein, 429 aa, Homo sapiens
MAVAVGRPSNEELRNLSLSGHVGFDSLPDQLVNKSTSQGFCFNILCVGETGIGKSTLMDTLFNTKFESDPATHNEPGVRLKARSYELQESNVRLKLTIVDTVGFGDQINKDDSYKPIVEYIDAQFEAYLQEELKIKRSLFNYHDTRIHACLYFIAPTGHSLKSLDLVTMKKLDSKVNIIPIIAKADTIAKNELHKFKSKIMSELVSNGVQIYQFPTDEETVAEINATMSVHLPFAVVGSTEEVKIGNKMAKARQYPWGVVQVENENHCDFVKLREMLIRVNMEDLREQTHTRHYELYRRCKLEEMGFKDTDPDSKPFSLQETYEAKRNEFLGELQKKEEEMRQMFVMRVKEKEAELKEAEKELHEKFDLLKRTHQEEKKKVEDKKKELEEEVNNFQKKKAAAQLLQSQAQQSGAQQTKKDKDKKNASFT

SEQ ID NO: 915619 - protein, 71 aa, Homo sapiens
ALIKREGRRRGGSRCRWLPAGRRRAERSREGGAREASRSPSTSSSRSRRKAPGRSRSRCRSCDGRGRGETV

SEQ ID NO: 915620 - protein, 429 aa, Homo sapiens; identical to SEQ ID NO: 915618

SEQ ID NO: 915621 - protein, 429 aa, Homo sapiens; identical to SEQ ID NO: 915618

SEQ ID NO: 915622 - protein, 429 aa, Homo sapiens; identical to SEQ ID NO: 915618

SEQ ID NO: 915623 - protein, 429 aa, Homo sapiens; identical to SEQ ID NO: 915618

SEQ ID NO: 915624 - protein, 429 aa, Homo sapiens; identical to SEQ ID NO: 915618

SEQ ID NO: 915625 - protein, 429 aa, Homo sapiens; identical to SEQ ID NO: 915618

SEQ ID NO: 915626 - protein, 452 aa, Homo sapiens
KIKRMAGMKESQISAAGAGAAAAMAVAVGRPSNEELRNLSLSGHVGFDSLPDQLVNKSTSQGFCFNILCVGETGIGKSTLMDTLFNTKFESDPATHNEPGVRLKARSYELQESNVRLKLTIVDTVGFGDQINKDDSYKPIVEYIDAQFEAYLQEELKIKRSLFNYHDTRIHACLYFIAPTGHSLKSLDLVTMKKLDSKVNIIPIIAKADTIAKNELHKFKSKIMSELVSNGVQIYQFPTDEETVAEINATMSVHLPFAVVGSTEEVKIGNKMAKARQYPWGVVQVENENHCDFVKLREMLIRVNMEDLREQTHTRHYELYRRCKLEEMGFKDTDPDSKPFSLQETYEAKRNEFLGELQKKEEEMRQMFVMRVKEKEAELKEAEKELHEKFDLLKRTHQEEKKKVEDKKKELEEEVNNFQKKKAAAQLLQSQAQQSGAQQTKKDKDKKNASFT

SEQ ID NO: 915627 - protein, 372 aa, Homo sapiens
MDTLFNTKFESDPATHNEPGVRLKARSYELQESNVRLKLTIVDTVGFGDQINKDDSYKPIVEYIDAQFEAYLQEELKIKRSLFNYHDTRIHACLYFIAPTGHSLKSLDLVTMKKLDSKVNIIPIIAKADTIAKNELHKFKSKIMSELVSNGVQIYQFPTDEETVAEINATMSVHLPFAVVGSTEEVKIGNKMAKARQYPWGVVQVENENHCDFVKLREMLIRVNMEDLREQTHTRHYELYRRCKLEEMGFKDTDPDSKPFSLQETYEAKRNEFLGELQKKEEEMRQMFVMRVKEKEAELKEAEKELHEKFDLLKRTHQEEKKKVEDKKKELEEEVNNFQKKKAAAQLLQSQAQQSGAQQTKKDKDKKNASFT

SEQ ID NO: 915628 - protein, 397 aa, Homo sapiens
MAVAVGRPSNEELRNLSLSGHVGFDSLPDQLVNKSTSQGFCFNILCVGETGIGKSTLMDTLFNTKFESDPATHNEPGVRLKARSYELQESNVRLKLTIVDTVGFGDQINKDDSYKPIVEYIDAQFEAYLQEELKIKRSLFNYHDTRIHACLYFIAPTGHSLKSLDLVTMKKLDSKVNIIPIIAKADTIAKNELHKFKSKIMSELVSNGVQIYQFPTDEETVAEINATMSVHLPFAVVGSTEEVKIGNKMAKARQYPWGVVQVENENHCDFVKLREMLIRVNMEDLREQTHTRHYELYRRCKLEEMGFKDTDPDSKPFSLQETYEAKRNEFLGELQKKEEEMRQMFVMRVKEKEAELKEAEKELHEKFDLLKRTHQEEKKKVEDKKKKDKDKKNASFT

SEQ ID NO: 915629 - protein, 429 aa, Homo sapiens; identical to SEQ ID NO: 915618

SEQ ID NO: 915630 - protein, 429 aa, Homo sapiens; identical to SEQ ID NO: 915618

SEQ ID NO: 915631 - protein, 429 aa, Homo sapiens; identical to SEQ ID NO: 915618

SEQ ID NO: 915632 - protein, 429 aa, Homo sapiens; identical to SEQ ID NO: 915618

SEQ ID NO: 915633 - protein, 429 aa, Homo sapiens; identical to SEQ ID NO: 915618

SEQ ID NO: 915634 - protein, 425 aa, Homo sapiens
MAVAVGRPSNEELRNLSLSGHVGFDSLPDQLVNKSTSQGFCFNILCVGETGIGKSTLMDTLFNTKFESDPATHNEPGVRLKARSYELQESNVRLKLTIVDTVGFGDQINKDDSYKPIVEYIDAQFEAYLQEELKIKRSLFNYHDTRIHACLYFIAPTGHSLKSLDLVTMKKLDSKVNIIPIIAKADTIAKNELHKFKSKIMSELVSNGVQIYQFPTDEETVAEINATMSVHLPFAVVGSTEEVKIGNKMAKARQYPWGVVQVENENHCDFVKLREMLIRVNMEDLREQTHTRHYELYRRCKLEEMGFKDTDPDSKPFSLQETYEAKRNEFLGELQKKEEEMRQMFVMRVKEKEAELKEAEKELHEKFDLLKRTHQEEKKKVEDKKKELEEEVNNFQKKKAAAQLLQSQAQQSGAQQTKKDKDKKN

SEQ ID NO: 915635 - protein, 432 aa, Homo sapiens
MAVAVGRPSNEELRNLSLSGHVGFDSLPDQLVNKSTSQGFCFNILCVGETGIGKSTLMDTLFNTKFESDPATHNEPGVRLKARSYELQESNVRLKLTIVDTVGFGDQINKDDSYKPIVEYIDAQFEAYLQEELKIKRSLFNYHDTRIHACLYFIAPTGHSLKSLDLVTMKKLDSKVNIIPIIAKADTIAKNELHKFKSKIMSELVSNGVQIYQFPTDEETVAEINATMSVHLPFAVVGSTEEVKIGNKMAKARQYPWGVVQVENENHCDFVKLREMLIRVNMEDLREQTHTRHYELYRRCKLEEMGFKDTDPDSKPFSLQETYEAKRNEFLGELQKKEEEMRQMFVMRVKEKEAELKEAEKELHEKFDLLKRTHQEEKKKVEDKKKELEEEVNNFQKKKAAAQLLQSQAQQSGAQQTKKDKDKKNSPWLCTE

SEQ ID NO: 915636 - protein, 429 aa, Homo sapiens
MAVAVGRPSNEELRNLSLSGHVGFDSLPDQLVNKSTSQGFCFNILCVGETGIGKSTLMDTLFNTKFESDPATHNEPGVRLKARSYELQESNVRLKLTIVDTVGFGDQINKDDSYKPIVEYIDAQFEAYLQEELKIKRSLFNYHDTRIHACLYFIAPTGHSLKSLDLVTMKKLDSKVNIIPIIAKADTIAKNELHKFKSKIMSELVSNGVQIYQFPTDEETVAEINATMSVHLPFAVVGSTEEVKIGNKMAKARQYPWGVVQVENENHCDFVKLREMLIRVNMEDLREQTHTRHYELYRRCKLEEMGFKDTDPDSKPFSLQETYEAKRNEFLGELQKKEEEMRQMFVMRVKEKEAELKEAEKELHEKFDLLKRTHQEEKKKVEDKKKELEEEVNNFQKKKAAAQLLQSQAQQSGAQQTKKDKDKKNFFFM

SEQ ID NO: 915637 - protein, 474 aa, Homo sapiens
MAVAVGRPSNEELRNLSLSGHVGFDSLPDQLVNKSTSQGFCFNILCVGETGIGKSTLMDTLFNTKFESDPATHNEPGVRLKARSYELQESNVRLKLTIVDTVGFGDQINKDDSYKPIVEYIDAQFEAYLQEELKIKRSLFNYHDTRIHACLYFIAPTGHSLKSLDLVTMKKLDSKVNIIPIIAKADTIAKNELHKFKSKIMSELVSNGVQIYQFPTDEETVAEINATMSVHLPFAVVGSTEEVKIGNKMAKARQYPWGVVQVENENHCDFVKLREMLIRVNMEDLREQTHTRHYELYRRCKLEEMGFKDTDPDSKPFSLQETYEAKRNEFLGELQKKEEEMRQMFVMRVKEKEAELKEAEKELHEKFDLLKRTHQEEKKKVEDKKKKKKKKKKKKKKKKKKKKKKKKERRRKKNEERRQNEEEERKKNKGGGRTIITLIKQQRKVYKRNRRDTNKQENQKSADNVRQSTTAQRN

SEQ ID NO: 915638 - protein, 425 aa, Homo sapiens
MAVAVGRPSNEELRNLSLSGHVGFDSLPDQLVNKSTSQGFCFNILCVGETGIGKSTLMDTLFNTKFESDPATHNEPGVRLKARSYELQESNVRLKLTIVDTVGFGDQINKDDSYKPIVEYIDAQFEAYLQEELKIKRSLFNYHDTRIHACLYFIAPTGHSLKSLDLVTMKKLDSKVNIIPIIAKADTIAKNELHKFKSKIMSELVSNGVQIYQFPTDEETVAEINATMSVHLPFAVVGSTEEVKIGNKMAKARQYPWGVVQVENENHCDFVKLREMLIRVNMEDLREQTHTRHYELYRRCKLEEMGFKDTDPDSKPFSLQETYEAKRNEFLGELQKKEEEMRQMFVMRVKEKEAELKEAEKELHEKFDLLKRTHQEEKKKVEDKKKELEEEVNNFQKKKAAAQLLQSQAQQSGAQQTKKDKDKKK

SEQ ID NO: 915639 - protein, 425 aa, Homo sapiens; identical to SEQ ID NO: 915638

SEQ ID NO: 915640 - protein, 425 aa, Homo sapiens; identical to SEQ ID NO: 915638

SEQ ID NO: 915641 - protein, 327 aa, Homo sapiens
GKGKLRRRSVSGNMASRSKRRAVESGVPQPPDPPVQRDEEEEKEVENEDEDDDDSDKEKDEEDEVIDEEVNIEFEAYSLSDNDYDGIKKLLQQLFLKAPVNTAELTDLLIQQNHIGSVIKQTDVSEDSNDDMDEDEVFGFISLLNLTERKGTQCVEQIQELVLRFCEKNCEKSMVEQLDKFLNDTTKPVGLLLSERFINVPPQIALPMYQQLQKELAGAHRTNKPCGKCYFYLLISKTFVEAGKNNSKKKPSNKKKAALMFANAEEEFFYEKAILKFNYSVQEESDTCLGGKWSFDDVPMTPLRTVMLIPGDKMNEIMDKLKEYLSV

SEQ ID NO: 915642 - protein, 335 aa, Homo sapiens
GKGKLRRRSVSGNMASRSKRRAVESGVPQPPDPPVQRDEEEEKEVENEDEDDDDSDKEKDEEDEVIDEEVNIEFEAYSLSDNDYDGIKKLLQQLFLKAPVNTAELTDLLIQQNHIGSVIKQTDVSEDSNDDMDEDEVFGFISLLNLTERKGTQCVEQIQELVLRFCEKNCEKSMVEQLDKFLNDTTKPVGLLLSERFINVPPQIALPMYQQLQKELAGAHRTNKPCGKCYFYLLISKTFVEAGKNNSKKKPSNKKKAALMFANAEEEFFYEEQGKPEVLGGPDTRRGLEPVPIQHNGGSRGQVTALVSLKAGLIQSRSTLSDFQGTFMTVGIALS

SEQ ID NO: 915643 - protein, 335 aa, Homo sapiens; identical to SEQ ID NO: 915642

SEQ ID NO: 915644 - protein, 305 aa, Homo sapiens
GKGKLRRRSVSGNMASRSKRRAVESGVPQPPDPPVQRDEEEEKEVENEDEDDDDSDKEKDEEDEVIDEEVNIEFEAYSLSDNDYDGIKKLLQQLFLKAPVNTAELTDLLIQQNHIGSVIKQTDVSEDSNDDMDEDEVFGFISLLNLTERKGTQCVEQIQELVLRFCEKNCEKSMVEQLDKFLNDTTKPVGLLLSERFINVPPQIALPMYQQLQKELAGAHRTNKPCGKCYFYLLISKTFVEAGKNNSKKKPSNKKKAALMFANAEEEFFYEEQGKPEVLGGPDTRRGLEPVPIQHNGWSVPPVLE

SEQ ID NO: 915645 - protein, 277 aa, Homo sapiens
GKGKLRRRSVSGNMASRSKRRAVESGVPQPPDPPVQRDEEEEKEVENEDEDDDDSDKEKDEEDEVIDEEVNIEFEAYSLSDNDYDGIKKLLQQLFLKAPVNTAELTDLLIQQNHIGSVIKQTDVSEDSNDDMDEDEVFGFISLLNLTERKGTQCVEQIQELVLRFCEKNCEKSMVEQLDKFLNDTTKPVGLLLSERFINVPPQIALPMYQQLQKELAGAHRTNKPCGKCYFYLLISKTFVEAGKNNSKKKPSNKKKAALMFANAEEEFFYEVVHGGK

SEQ ID NO: 915646 - protein, 196 aa, Homo sapiens
MDEDEVFGFISLLNLTERKGTQCVEQIQELVLRFCEKNCEKSMVEQLDKFLNDTTKPVGLLLSERFINVPPQIALPMYQQLQKELAGAHRTNKPCGKCYFYLLISKTFVEAGKNNSKKKPSNKKKAALMFANAEEEFFYEKAILKFNYSVQEESDTCLGGKWSFDDVPMTPLRTVMLIPGDKMNEIMDKLKEYLSV

SEQ ID NO: 915647 - protein, 309 aa, Homo sapiens
GKGKLRRRSVSGNMASRSKRRAVESGVPQPPDPPVQRDEEEEKEVENEDEDDDDSDKAYSLSDNDYDGIKKLLQQLFLKAPVNTAELTDLLIQQNHIGSVIKQTDVSEDSNDDMDEDEVFGFISLLNLTERKGTQCVEQIQELVLRFCEKNCEKSMVEQLDKFLNDTTKPVGLLLSERFINVPPQIALPMYQQLQKELAGAHRTNKPCGKCYFYLLISKTFVEAGKNNSKKKPSNKKKAALMFANAEEEFFYEKAILKFNYSVQEESDTCLGGKWSFDDVPMTPLRTVMLIPGDKMNEIMDKLKEYLSV

SEQ ID NO: 915648 - protein, 235 aa, Homo sapiens
HGRSRPGVNRTREHIGSVIKQTDVSEDSNDDMDEDEVFGFISLLNLTERKGTQCVEQIQELVLRFCEKNCEKSMVEQLDKFLNDTTKPVGLLLSERFINVPPQIALPMYQQLQKELAGAHRTNKPCGKCYFYLLISKTFVEAGKNNSKKKPSNKKKAALMFANAEEEFFYEEQGKPEVLGGPDTRRGLEPVPIQHNGGSRGQVTALVSLKAGLIQSRSTLSDFQGTFMTVGIALS

SEQ ID NO: 915649 - protein, 237 aa, Homo sapiens
GKGKLRRRSVSGNMASRSKRRAVESGVPQPPDPPVQRDEEEEKEVENEDEDDDDSDKEKDEEDEVIDEEVNIEFEAYSLSDNDYDGIKKLLQQLFLKAPVNTAELTDLLIQQNHIGSVIKQTDVSEDSNDDMDEDEVFGFISLLNLTERKGTQCVEQIQELVLRFCEKNCEKSMVEQLDKFLNDTTKPVGLLLSERFINVPPQIALPMYQQLQWFTGASDSPGFSEGWTNSIKINSK

SEQ ID NO: 915650 - protein, 237 aa, Homo sapiens; identical to SEQ ID NO: 915649

SEQ ID NO: 915651 - protein, 183 aa, Homo sapiens
GKGKLRRRSVSGNMASRSKRRAVESGVPQPPDPPVQRDEEEEKEVENEDEDDDDSDKEKDEEDEVIDEEVNIEFEAYSLSDNDYDGIKKLLQQLFLKAPVNTAELTDLLIQQNHIGSVIKGTQCVEQIQELVLRFCEKNCEKSMVEQLDKFLNDTTKPVGLLLSERFINVPPQIALPMYQQLQ

SEQ ID NO: 915652 - protein, 131 aa, Homo sapiens
GKGKLRRRSVSGNMASRSKRRAVESGVPQPPDPPVQRDEEEEKEVENEDEDDDDSDKEKDEEDEVIDEEVNIEFEAYSLSDNDYDGIKKLLQQLFLKAPVNTAELTDLLIQQNHIGSVIKVSRIIVFILIK

SEQ ID NO: 915653 - protein, 794 aa, Homo sapiens
QAFQVSLEDLTGHEGNEKGAGPEPPGSEEEEEEQEESLAVAEQGKGRRESESSRSSRRPSGRSPTSTEKRMSFESISSLPEVEPDPEAGSEQEVFSAVEGPSAEETPSDTESPEVLETQLDAHQGLLGMDPPGDMVDFVAAESTEDLKALSSEEEEEMGGAAQEPESLLPPSVLDQASVIAERFVSSFSRRSSVAQEDSKSSGFGSPRLVSRSSSVLSLEGSEKGLARHGSATDSLSCQLSPEVDISVGVATEDSPSVNGMEPPSPGCPVEPDRSSCKKKESALSTRDRLLLDKIKSYYENAEHHDAGFSVRRRESLSYIPKGLVRNSISRFNSLPRPDPEPVPPVGSKRQVGSRPTSWALFELPGPSQAVKGDPPPISDAEFRPSSEIVKIWEGMESSGGSPGKGPGQGQANGFDLHEPLFILEEHELGAITEESATASPESSSPTEGRSPAHLARELKELVKELSSSTQGELVAPLHPRIVQLSHVMDSHVSERVKNKVYQLARQYSLRIKSNKPVMARPPLQWEKVAPERDGKSPTVPCLQEEAGEPLGGKGKRKPVLSLFDYEQLMAQEHSPPKPSSAGEMSPQRFFFNPSAVSQRTTSPGGRPSARSPLSPTETFSWPDVRELCSKYASRDEARRAGGGRPRGPPVNRSHSVPENMVEPPLSGRVGRCRSLSTKRGRGGGEAAQSPGPLPQSKPDGGETLYVTADLTLEDNRRVIVMEKGPLPSPTAGLEESSGQGPSSPVALLGQVQDFQQSAECQPKEEGSRDPADPSQQGRVRNLREKFQALNSVG

SEQ ID NO: 915654 - protein, 617 aa, Homo sapiens
QAFQVSLEDLTGHEGNEKGAGPEPPGSEEEEEEQEESLAVAEQGKGRRESESSRSSRRPSGRSPTSTEKRMSFESISSLPEVEPDPEAGSEQEVFSAVEGPSAEETPSDTESPEVLETQLDAHQGLLGMDPPGDMVDFVAAESTEDLKALSSEEEEEMGGAAQEPESLLPPSVLDQASVIAERFVSSFSRRSSVAQEDSKSSGFGSPRLVSRSSSVLSLEGSEKGLARHGSATDSLSCQLSPEVDISVGVATEDSPSVNGMEPPSPGCPVEPDRSSCKKKESALSTRDRLLLDKIKTGGPTDPRIVQLSHVMDSHVSERVKNKVYQLARQYSLRIKSNKPVMARPPLQWEKVAPERDGKSPTVPCLQEEAGEPLGGKGKRKPVLSLFDYEQLMAQEHSPPKPSSAGEMSPQRFFFNPSAVSQRTTSPGGRPSARSPLSPTETFSWPDVRELCSKYASRDEARRAGGGRPRGPPVNRSHSVPENMVEPPLSGRVGRCRSLSTKRGRGGGEAAQSPGPLPQSKPDGGETLYVTADLTLEDNRRVIVMEKGPLPSPTAGLEESSGQGPSSPVALLGQVQDFQQSAECQPKEEGSRDPADPSQQGRVRNLREKFQALNSVG

SEQ ID NO: 915655 - protein, 823 aa, Homo sapiens
QAFQVSLEDLTGHEGNEKGAGPEPPGSEEEEEEQEESLAVAEQVADFASSLLAALHCWHYRANALLFSRGAMGKGRRESESSRSSRRPSGRSPTSTEKRMSFESISSLPEVEPDPEAGSEQEVFSAVEGPSAEETPSDTESPEVLETQLDAHQGLLGMDPPGDMVDFVAAESTEDLKALSSEEEEEMGGAAQEPESLLPPSVLDQASVIAERFVSSFSRRSSVAQEDSKSSGFGSPRLVSRSSSVLSLEGSEKGLARHGSATDSLSCQLSPEVDISVGVATEDSPSVNGMEPPSPGCPVEPDRSSCKKKESALSTRDRLLLDKIKSYYENAEHHDAGFSVRRRESLSYIPKGLVRNSISRFNSLPRPDPEPVPPVGSKRQVGSRPTSWALFELPGPSQAVKGDPPPISDAEFRPSSEIVKIWEGMESSGGSPGKGPGQGQANGFDLHEPLFILEEHELGAITEESATASPESSSPTEGRSPAHLARELKELVKELSSSTQGELVAPLHPRIVQLSHVMDSHVSERVKNKVYQLARQYSLRIKSNKPVMARPPLQWEKVAPERDGKSPTVPCLQEEAGEPLGGKGKRKPVLSLFDYEQLMAQEHSPPKPSSAGEMSPQRFFFNPSAVSQRTTSPGGRPSARSPLSPTETFSWPDVRELCSKYASRDEARRAGGGRPRGPPVNRSHSVPENMVEPPLSGRVGRCRSLSTKRGRGGGEAAQSPGPLPQSKPDGGETLYVTADLTLEDNRRVIVMEKGPLPSPTAGLEESSGQGPSSPVALLGQVQDFQQSAECQPKEEGSRDPADPSQQGRVRNLREKFQALNSVG

SEQ ID NO: 915656 - protein, 823 aa, Homo sapiens; identical to SEQ ID NO: 915655

SEQ ID NO: 915657 - protein, 377 aa, Homo sapiens
QAFQVSLEDLTGHEGNEKGAGPEPPGSEEEEEEQEESLAVAEQVADFASSLLAALHCWHYRANALLFSRGAMGKGRRESESSRSSRRPSGRSPTSTEKRMSFESISSLPEVEPDPEAGSEQEVFSAVEGPSAEETPSDTESPEVLETQLDAHQGLLGMDPPGDMVDFVAAESTEDLKALSSEEEEEMGGAAQEPESLLPPSVLDQASVIAERFVSSFSRRSSVAQEDSKSSGFGSPRLVSRSSSVLSLEGSEKGLARHGSATDSLSCQLSPEVDISVGVATEDSPSVNGMEPPSPGCPVEPDRSSCKKKESALSTRDRLLLDKIKSYYENAEHHDAGFSVRRRESLSYIPKGLVRNSISRRLRQWPGEALFCNGAFS

SEQ ID NO: 915658 - protein, 823 aa, Homo sapiens; identical to SEQ ID NO: 915655

SEQ ID NO: 915659 - protein, 617 aa, Homo sapiens; identical to SEQ ID NO: 915654

SEQ ID NO: 915660 - protein, 597 aa, Homo sapiens
ADVDLRIPVTEAWFSRESRLTGKKSEKGLARHGSATDSLSCQLSPEVDISVGVATEDSPSVNGMEPPSPGCPVEPDRSSCKKKESALSTRDRLLLDKIKSYYENAEHHDAGFSVRRRESLSYIPKGLVRNSISRFNSLPRPDPEPVPPVGSKRQVGSRPTSWALFELPGPSQAVKGDPPPISDAEFRPSSEIVKIWEGMESSGGSPGKGPGQGQANGFDLHEPLFILEEHELGAITEESATASPESSSPTEGRSPAHLARELKELVKELSSSTQGELVAPLHPRIVQLSHVMDSHVSERVKNKVYQLARQYSLRIKSNKPVMARPPLQWEKVAPERDGKSPTVPCLQEEAGEPLGGKGKRKPVLSLFDYEQLMAQEHSPPKPSSAGEMSPQRFFFNPSAVSQRTTSPGGRPSARSPLSPTETFSWPDVRELCSKYASRDEARRAGGGRPRGPPVNRSHSVPENMVEPPLSGRVGRCRSLSTKRGRGGGEAAQSPGPLPQSKPDGGETLYVTADLTLEDNRRVIVMEKGPLPSPTAGLEESSGQGPSSPVALLGQVQDFQQSAECQPKEEGSRDPADPSQQGRVRNLREKFQALNSVG

SEQ ID NO: 915661 - protein, 823 aa, Homo sapiens; identical to SEQ ID NO: 915655

SEQ ID NO: 915662 - protein, 3325 aa, Homo sapiens
MEVEQEQRRRKVEAGRTKLAHFRQRKTKGDSSHSEKKTAKRKGSAVDASVQEESPVTKEDSALCGGGDICKSTSCDDTPDGAGGAFAAQPEDCDGEKREDLEQLQQKQVNDHPPEQCGMFTVSDHPPEQHGMFTVGDHPPEQRGMFTVSDHPPEQHGMFTVSDHPPEQRGMFTISDHQPEQRGMFTVSDHTPEQRGIFTISDHPAEQRGMFTKECEQECELAITDLESGREDEAGLHQSQAVHGLELEALRLSLSNMHTAQLELTQANLQKEKETALTELREMLNSRRAQELALLQSRQQHELELLREQHAREKEEVVLRCGQEAAELKEKLQSEMEKNAQIVKTLKEDWESEKDLCLENLRKELSAKHQSEMEDLQNQFQKELAEQRAELEKIFQDKNQAERALRNLESHHQAAIEKLREDLQSEHGRCLEDLEFKFKESEKEKQLELENLQASYEDLKAQSQEEIRRLWSQLDSARTSRQELSELHEQLLARTSRVEDLEQLKQREKTQHESELEQLRIYFEKKLRDAEKTYQEDLTLLQQRLQGAREDALLDSVEVGLSCVGLEEKPEKGRKDHVDELEPERHKESLPRFQAELEESHRHQLEALESPLCIQHEGHVSDRCCVETSALGHEWRLEPSEGHSQELPWVHLQGVQDGDLEADTERAARVLGLETEHKVQLSLLQTELKEEIELLKIENRNLFEKLQHETRLKDDLEKVKHNLIEDHQKELNNAKQKTELMKQEFQRKETDWKVMKEELQREAEEKLTLMLLELREKAESEKQTIINKLELREAEMRQLQDQQAAQILDLERSLTEQQARLQQLEQDLTSDDALHCSQCGREPPTAQDGELAALHVKEDCALQLMLARSRFLEERKEIAEKFSAEQDAFLQLLQERHQQQLLSVTAELEARHQAALGELTASLESKQGALLAARVAELQTKHAADLGALETRHLSSLDSLESCYLSEFQTIREEHRQALELLRADFEEQLWKKDSLHQTILTQELEKLKRKHEGELQSVRDHLRTEASTELAGTVAHELQGVHQGEFGSEKKTALHEKEETLRLQSAQAQPFHQEEKESLSLQLQKKNHQVQQLKDQVLSLSHEIEECRSELEVLQQRRERENREGANLLSMLKADVNLSHSERGALQDALRRLLGLFGETLRAAVTLRSRIGERVGLCLDDAGAGLALSTAPALEETWSDVALPELDRTLSECAEMSSVAEISSHMRESFLMSPESVRECEQPIRRVFQSLSLAVDGLMEMALDSSRQLEEARQLHSRFEKEFSFKNEETAQVVRKHQELLECLTEESAAKAELALELHKTQGTLEGFKVETADLKEVLAGKEDSEHRLVLELESLRRQLQQAAQEQAALREECTRLWSRGEATATDAEAREAALRKEVEDLTKEQSETRKQAEKDRSALLSQMKILESELEEQLSQHRGCAKQAEAVTALEQQVASLDKHLRNQRQFMDEQAAEREHEREEFQQEIQRLEGQLRQAAKPQPWGPRDSQQAPLDGEVELLQQKLREKLDEFNELAIQKESADRQVLMQEEEIKRLEEMNINIRKKVAQLQEEVEKQKNIVKGLEQDKEVLKKQQMSSLLLASTLQSTLDAGRCPEPPSGSPPEGPEIQLEVTQRALLRRESEVLDLKEQLEKMKGDLESKNEEILHLNLKLDMQNSQTAVSLRELEEENTSLKVIYTRSSEIEELKATIENLQENQKRLQKEKAEEIEQLHEVIEKLQHELSLMGPVVHEVSDSQAGSLQSELLCSQAGGPRGQALQGELEAALEAKEALSRLLADQERRHSQALEALQQRLQGAEEAAELQLAELERNVALREAEVEDMASRIQEFEAALKAKEATIAERNLEIDALNQRKAAHSAELEAVLLALARIRRALEQQPLAAGAAPPELQWLRAQCARLSRQLQVLHQRFLRCQVELDRRQARRATAHTRVPGAHPQPRMDGGAKAQVTGDVEASHDAALEPVVPDPQGDLQPVLVTLKDAPLCKQEGVMSVLTVCQRQLQSELLLVKNEMRLSLEDGGKGKEKVLEDCQLPKVDLVAQVKQLQEKLNRLLYSMTFQNVDAADTKSLWPMASAHLLESSWSDDSCDGEEPDISPHIDTCDANTATGGVTDVIKNQAIDACDANTTPGGVTDVIKNWDSLIPDEMPDSPIQEKSECQDMSLSSPTSVLGGSRHQSHTAEAGPRKSPVGMLDLSSWSSPEVLRKDWTLEPWPSLPVTPHSGALSLCSADTSLGDRADTSLPQTQGPGLLCSPGVSAAALALQWAESPPADDHHVQRTAVEKDVEDFITTSFDSQETLSSPPPGLEGKADRSEKSDGSGFGARLSPGSGGPEAQTAGPVTPASISGRFQPLPEAMKEKEVRPKHVKALLQMVRDESHQILALSEGLAPPSGEPHPPRKEDEIQDISLHGGKTQEVPTACPDWRGDLLQVVQEAFEKEQEMQGVELQPRLSGSDLGGHSSLLERLEKIIREQGDLQEKSLEHLRLPDRSSLLSEIQALRAQLRMTHLQNQEKLQHLRTALTSAEARGSQQEHQLRRQVELLAYKVEQEKCIAGDLQKTLSEEQEKANSVQKLLAAEQTVVRDLKSDLCESRQKSEQLSRSLCEVQQEVLQLRSMLSSKENELKAALQELESEQGKGRALQSQLEEEQLRHLQRESQSAKALEELRASLETQRAQSSRLCVALKHEQTAKDNLQKELRIEHSRCEALLAQERSQLSELQKDLAAEKSRTLELSEALRHERLLTEQLSQRTQEACVHQDTQAHHALLQKLKEEKSRVVDLQAMLEKVQQQALHSQQQLEAEAQKHCEALRREKEVSATLKSTVEALHTQKRELRCSLEREREKPAWLQAELEQSHPRLKEQEGRKAARRSAEARQSPAAAEQWRKWQRDKEKLRELELQRQRDLHKIKQLQQTVRDLESKDEVPGSRLHLGSARRAAGSDADHLREQQRELEAMRQRLLSAARLLTSFTSQAVDRTVNDWTSSNEKAVMSLLHTLEELKSDLSRPTSSQKKMAAELQFQFVDVLLKDNVSLTKALSTVTQEKLELSRAVSKLEKLLKHHLQKGCSPSRSERSAWKPDETAPQSSLRRPDPGRLPPAASEEAHTSNVKMEKLYLHYLRAESFRKALIYQKKYLLLLIGGFQDSEQETLSMIAHLGVFPSKAERKITSRPFTRFRTAVRVVIAILRLRFLVKKWQEVDRKGALAQGKAPRPGPRARQPQSPPRTRESPPTRDVPSGHTRDPARGRRLAAAASPHSGGRATPSPNSRLERSLTASQDPEHSLTEYIHHLEVIQQRLGGVLPDSTSKKSCHPMIKQ

SEQ ID NO: 915663 - protein, 3240 aa, Homo sapiens
MEVEQEQRRRKVEAGRTKLAHFRQRKTKGDSSHSEKKTAKRKGSAVDASVQEESPVTKEDSALCGGGDICKSTSCDDTPDGAGGAFAAQPEDCDGEKREDLEQLQQKQVNDHPPEQCGMFTVSDHPPEQHGMFTVGDHPPEQRGMFTVSDHPPEQRGMFTISDHQPEQRGMFTVSDHTPEQRGIFTISDHPAEQRGMFTKECEQECELAITDLESGREDEAGLHQSQRPFLRLQAVHGLELEALRLSLSNMHTAQLELTQANLQKEKETALTELREMLNSRRAQELALLQSRQQHELELLREQHAREKEEVVLRCGQEAAELKEKLQSEMEKNAQIVKTLKEDWESEKDLCLENLRKELSAKHQSEMEDLQNQFQKELAEQRAELEKIFQDKNQAERALRNLESHHQAAIEKLREDLQSEHGRCLEDLEFKFKESEKEKQLELENLQASYEDLKAQSQEEIRRLWSQLDSARTSRQELSELHEQLLARTSRVEDLEQLKQREKTQHESELEQLRIYFEKKLRDAEKTYQEDLTLLQQRLQGAREDALLDSVEVGLSCVGLEEKPEKGRKDHVDELEPERHKESLPRFQAELEESHRHQLEALESPLCIQHEGHVSDRCCVETSALGHEWRLEPSEGHSQELPWVHLQGVQDGDLEADTERAARVLGLETEHKVQLSLLQTELKEEIELLKIENRNLFEKLQHETRLKDDLEKVKHNLIEDHQKELNNAKQKTELMKQEFQRKETDWKVMKEELQREAEEKLTLMLLELREKAESEKQTIINKLELREAEMRQLQDQQAAQILDLERSLTEQQARLQQLEQDLTSDDALHCSQCGREPPTAQDGELAALHVKEDCALQLMLARSRFLEERKEIAEKFSAEQDAFLQLLQERHQQQLLSVTAELEARHQAALGELTASLESKQGALLAARVAELQTKHAADLGALETRHLSSLDSLESCYLSEFQTIREEHRQALELLRADFEEQLWKKDSLHQTILTQELEKLKRKHEGELQSVRDHLRTEASTELAGTVAHELQGVHQGEFGSEKKTALHEKEETLRLQSAQAQPFHQEEKESLSLQLQKKNHQVQQLKDQVLSLSHEIEECRSELEVLQQRRERENREGANLLSMLKADVNLSHSERGALQDALRRLLGLFGETLRAAVTLRSRIGERVGLCLDDAGAGLALSTAPALEETWSDVALPELDRTLSECAEMSSVAEISSHMRESFLMSPESVRECEQPIRRVFQSLSLAVDGLMEMALDSSRQLEEARQLHSRFEKEFSFKNEETAQVVRKHQELLECLTEESAAKAELALELHKTQGTLEGFKVETADLKEVLAGKEDSEHRLVLELESLRRQLQQAAQEQAALREECTRLWSRGEATATDAEAREAALRKEVEDLTKEQSETRKQAEKDRSALLSQMKILESELEEQLSQHRGCAKQAEAVTALEQQVASLDKHLRNQRQFMDEQAAEREHEREEFQQEIQRLEGQLRQAAKPQPWGPRDSQQAPLDGEVELLQQKLREKLDEFNELAIQKESADRQVLMQEEEIKRLEEMNINIRKKVAQLQEEVEKQKNIVKGLEQDKEVLKKQQMSSLLLASTLQSTLDAGRCPEPPSGSPPEGPEIQLEVTQRALLRRESEVLDLKEQLEKMKGDLESKNEEILHLNLKLDMQNSQTAVSLRELEEENTSLKVIYTRSSEIEELKATIENLQENQKRLQKEKAEEIEQLHEVIEKLQHELSLMGPVVHEVSDSQAGSLQSELLCSQAGGPRGQALQGELEAALEAKEALSRLLADQERRHSQALEALQQRLQGAEEAAELQLAELERNVALREAEVEDMASRIQEFEAALKAKEATIAERNLEIDALNQRKAAHSAELEAVLLALARIRRALEQQPLAAGAAPPELQWLRAQCARLSRQLQVLHQRFLRCQVELDRRQARRATAHTRVPGAHPQPRMDGGAKAQVTGDVEASHDAALEPVVPDPQGDLQPVLVTLKDAPLCKQEGVMSVLTVCQRQLQSELLLVKNEMRLSLEDGGKGKEKVLEDCQLPKVDLVAQVKQLQEKLNRLLYSMTFQNVDAADTKSLWPMASAHLLESSWSDDSCDGEEPDISPHIDTCDANTATGGVTDVIKNQAIDACDANTTPGGVTDVIKNWDSLIPDEMPDSPIQEKSECQDMSLSSPTSVLGGSRHQSHTAEAGPRKSPVGMLDLSSWSSPEVLRKDWTLEPWPSLPVTPHSGALSLCSADTSLGDRADTSLPQTQGPGLLCSPGVSAAALALQWAESPPADDHHVQRTAVEKDVEDFITTSFDSQETLSSPPPGLEGKADRSEKSDGSGFGARLSPGSGGPEAQTAGPVTPASISGRFQPLPEAMKEKEVRPKHVKALLQMVRDESHQILALSEGLAPPSGEPHPPRKEDEIQDISLHGGKTQEVPTACPDWRGDLLQVVQEAFEKEQEMQGVELQPRLSGSDLGGHSSLLERLEKIIREQGDLQEKSLEHLRLPDRSSLLSEIQALRAQLRMTHLQNQEKLQHLRTALTSAEARGSQQEHQLRRQVELLAYKVEQEKCIAGDLQKTLSEEQEKANSVQKLLAAEQTVVRDLKSDLCESRQKSEQLSRSLCEVQQEVLQLRSMLSSKENELKAALQELESEQGKGRALQSQLEEEQLRHLQRESQSAKALEELRASLETQRAQSSRLCVALKHEQTAKDNLQKELRIEHSRCEALLAQERSQLSELQKDLAAEKSRTLELSEALRHERLLTEQLSQRTQEACVHQDTQAHHALLQKLKEEKSRVVDLQAMLEKVQQQALHSQQQLEAEAQKHCEALRREKERELELQRQRDLHKIKQLQQTVRDLESKDEVPGSRLHLGSARRAAGSDADHLREQQRELEAMRQRLLSAARLLTSFTSQAVDRTVNDWTSSNEKAVMSLLHTLEELKSDLSRPTSSQKKMAAELQFQFVDVLLKDNVSLTKALSTVTQEKLELSRAVSKLEKLLKHHLQKGCSPSRSERSAWKPDETAPQSSLRRPDPGRLPPAASEEAHTSNVKMEKLYLHYLRAESFRKALIYQKKYLLLLIGGFQDSEQETLSMIAHLGVFPSKAERKITSRPFTRFRTAVRVVIAILRLRFLVKKWQEVDRKGALAQGKAPRPGPRARQPQSPPRTRESPPTRDVPSGHTRDPARGRRLAAAASPHSGGRATPSPNSRLERSLTASQDPEHSLTEYIHHLEVIQQRLGGVLPDSTSKKSCHPMIKQ

SEQ ID NO: 915664 - protein, 2874 aa, Homo sapiens
MEDLQNQFQKELAEQRAELEKIFQDKNQAERALRNLESHHQAAIEKLREDLQSEHGRCLEDLEFKFKESEKEKQLELENLQASYEDLKAQSQEEIRRLWSQLDSARTSRQELSELHEQLLARTSRVEDLEQLKQREKTQHESELEQLRIYFEKKLRDAEKTYQEDLTLLQQRLQGAREDALLDSVEVGLSCVGLEEKPEKGRKDHVDELEPERHKESLPRFQAELEESHRHQLEALESPLCIQHEGHVSDRCCVETSALGHEWRLEPSEGHSQELPWVHLQGVQDGDLEADTERAARVLGLETEHKVQLSLLQTELKEEIELLKIENRNLFEKLQHETRLKDDLEKVKHNLIEDHQKELNNAKQKTELMKQEFQRKETDWKVMKEELQREAEEKLTLMLLELREKAESEKQTIINKLELREAEMRQLQDQQAAQILDLERSLTEQQARLQQLEQDLTSDDALHCSQCGREPPTAQDGELAALHVKEDCALQLMLARSRFLEERKEIAEKFSAEQDAFLQLLQERHQQQLLSVTAELEARHQAALGELTASLESKQGALLAARVAELQTKHAADLGALETRHLSSLDSLESCYLSEFQTIREEHRQALELLRADFEEQLWKKDSLHQTILTQELEKLKRKHEGELQSVRDHLRTEASTELAGTVAHELQGVHQGEFGSEKKTALHEKEETLRLQSAQAQPFHQEEKESLSLQLQKKNHQVQQLKDQVLSLSHEIEECRSELEVLQQRRERENREGANLLSMLKADVNLSHSERGALQDALRRLLGLFGETLRAAVTLRSRIGERVGLCLDDAGAGLALSTAPALEETWSDVALPELDRTLSECAEMSSVAEISSHMRESFLMSPESVRECEQPIRRVFQSLSLAVDGLMEMALDSSRQLEEARQLHSRFEKEFSFKNEETAQVVRKHQELLECLTEESAAKAELALELHKTQGTLEGFKVETADLKEVLAGKEDSEHRLVLELESLRRQLQQAAQEQAALREECTRLWSRGEATATDAEAREAALRKEVEDLTKEQSETRKQAEKDRSALLSQMKILESELEEQLSQHRGCAKQAEAVTALEQQVASLDKHLRNQRQFMDEQAAEREHEREEFQQEIQRLEGQLRQAAKPQPWGPRDSQQAPLDGEVELLQQKLREKLDEFNELAIQKESADRQVLMQEEEIKRLEEMNINIRKKVAQLQEEVEKQKNIVKGLEQDKEVLKKQQMSSLLLASTLQSTLDAGRCPEPPSGSPPEGPEIQLEVTQRALLRRESEVLDLKEQLEKMKGDLESKNEEILHLNLKLDMQNSQTAVSLRELEEENTSLKVIYTRSSEIEELKATIENLQENQKRLQKEKAEEIEQLHEVIEKLQHELSLMGPVVHEVSDSQAGSLQSELLCSQAGGPRGQALQGELEAALEAKEALSRLLADQERRHSQALEALQQRLQGAEEAAELQLAELERNVALREAEVEDMASRIQEFEAALKAKEATIAERNLEIDALNQRKAAHSAELEAVLLALARIRRALEQQPLAAGAAPPELQWLRAQCARLSRQLQVLHQRFLRCQVELDRRQARRATAHTRVPGAHPQPRMDGGAKAQVTGDVEASHDAALEPVVPDPQGDLQPVLVTLKDAPLCKQEGVMSVLTVCQRQLQSELLLVKNEMRLSLEDGGKGKEKVLEDCQLPKVDLVAQVKQLQEKLNRLLYSMTFQNVDAADTKSLWPMASAHLLESSWSDDSCDGEEPDISPHIDTCDANTATGGVTDVIKNQAIDACDANTTPGGVTDVIKNWDSLIPDEMPDSPIQEKSECQDMSLSSPTSVLGGSRHQSHTAEAGPRKSPVGMLDLSSWSSPEVLRKDWTLEPWPSLPVTPHSGALSLCSADTSLGDRADTSLPQTQGPGLLCSPGVSAAALALQWAESPPADDHHVQRTAVEKDVEDFITTSFDSQETLSSPPPGLEGKADRSEKSDGSGFGARLSPGSGGPEAQTAGPVTPASISGRFQPLPEAMKEKEVRPKHVKALLQMVRDESHQILALSEGLAPPSGEPHPPRKEDEIQDISLHGGKTQEVPTACPDWRGDLLQVVQEAFEKEQEMQGVELQPRLSGSDLGGHSSLLERLEKIIREQGDLQEKSLEHLRLPDRSSLLSEIQALRAQLRMTHLQNQEKLQHLRTALTSAEARGSQQEHQLRRQVELLAYKVEQEKCIAGDLQKTLSEEQEKANSVQKLLAAEQTVVRDLKSDLCESRQKSEQLSRSLCEVQQEVLQLRSMLSSKENELKAALQELESEQGKGRALQSQLEEEQLRHLQRESQSAKALEELRASLETQRAQSSRLCVALKHEQTAKDNLQKELRIEHSRCEALLAQERSQLSELQKDLAAEKSRTLELSEALRHERLLTEQLSQRTQEACVHQDTQAHHALLQKLKEEKSRVVDLQAMLEKVQQQALHSQQQLEAEAQKHCEALRREKERELELQRQRDLHKIKQLQQTVRDLESKDEVPGSRLHLGSARRAAGSDADHLREQQRELEAMRQRLLSAARLLTSFTSQAVDRTVNDWTSSNEKAVMSLLHTLEELKSDLSRPTSSQKKMAAELQFQFVDVLLKDNVSLTKALSTVTQEKLELSRAVSKLEKLLKHHLQKGCSPSRSERSAWKPDETAPQSSLRRPDPGRLPPAASEEAHTSNVKMEKLYLHYLRAESFRKALIYQKKYLLLLIGGFQDSEQETLSMIAHLGVFPSKAERKITSRPFTRFRTAVRVVIAILRLRFLVKKWQEVDRKGALAQGKAPRPGPRARQPQSPPRTRESPPTRDVPSGHTRDPARGRRLAAAASPHSGGRATPSPNSRLERSLTASQDPEHSLTEYIHHLEVIQQRLGGVLPDSTSKKSCHPMIKQ

SEQ ID NO: 915665 - protein, 2859 aa, Homo sapiens
GAAGPSSVSLLAVPPTSLPLRVLLLLPALWLLPPLGESSPHSGAYESLSRRGPSSLSGSGMGPFPSSAPTTGNQALASRLACCGCPILRRLPDSVYVAELHEQLLARTSRVEDLEQLKQREKTQHESELEQLRIYFEKKLRDAEKTYQEDLTLLQQRLQGAREDALLDSVEVGLSCVGLEEKPEKGRKDHVDELEPERHKESLPRFQAELEESHRHQLEALESPLCIQHEGHVSDRCCVETSALGHEWRLEPSEGHSQELPWVHLQGVQDGDLEADTERAARVLGLETEHKVQLSLLQTELKEEIELLKIENRNLFEKLQHETRLKDDLEKVKHNLIEDHQKELNNAKQKTELMKQEFQRKETDWKVMKEELQREAEEKLTLMLLELREKAESEKQTIINKLELREAEMRQLQDQQAAQILDLERSLTEQQARLQQLEQDLTSDDALHCSQCGREPPTAQDGELAALHVKEDCALQLMLARSRFLEERKEIAEKFSAEQDAFLQLLQERHQQQLLSVTAELEARHQAALGELTASLESKQGALLAARVAELQTKHAADLGALETRHLSSLDSLESCYLSEFQTIREEHRQALELLRADFEEQLWKKDSLHQTILTQELEKLKRKHEGELQSVRDHLRTEASTELAGTVAHELQGVHQGEFGSEKKTALHEKEETLRLQSAQAQPFHQEEKESLSLQLQKKNHQVQQLKDQVLSLSHEIEECRSELEVLQQRRERENREGANLLSMLKADVNLSHSERGALQDALRRLLGLFGETLRAAVTLRSRIGERVGLCLDDAGAGLALSTAPALEETWSDVALPELDRTLSECAEMSSVAEISSHMRESFLMSPESVRECEQPIRRVFQSLSLAVDGLMEMALDSSRQLEEARQLHSRFEKEFSFKNEETAQVVRKHQELLECLTEESAAKAELALELHKTQGTLEGFKVETADLKEVLAGKEDSEHRLVLELESLRRQLQQAAQEQAALREECTRLWSRGEATATDAEAREAALRKEVEDLTKEQSETRKQAEKDRSALLSQMKILESELEEQLSQHRGCAKQAEAVTALEQQVASLDKHLRNQRQFMDEQAAEREHEREEFQQEIQRLEGQLRQAAKPQPWGPRDSQQAPLDGEVELLQQKLREKLDEFNELAIQKESADRQVLMQEEEIKRLEEMNINIRKKVAQLQEEVEKQKNIVKGLEQDKEVLKKQQMSSLLLASTLQSTLDAGRCPEPPSGSPPEGPEIQLEVTQRALLRRESEVLDLKEQLEKMKGDLESKNEEILHLNLKLDMQNSQTAVSLRELEEENTSLKVIYTRSSEIEELKATIENLQENQKRLQKEKAEEIEQLHEVIEKLQHELSLMGPVVHEVSDSQAGSLQSELLCSQAGGPRGQALQGELEAALEAKEALSRLLADQERRHSQALEALQQRLQGAEEAAELQLAELERNVALREAEVEDMASRIQEFEAALKAKEATIAERNLEIDALNQRKAAHSAELEAVLLALARIRRALEQQPLAAGAAPPELQWLRAQCARLSRQLQVLHQRFLRCQVELDRRQARRATAHTRVPGAHPQPRMDGGAKAQVTGDVEASHDAALEPVVPDPQGDLQPVLVTLKDAPLCKQEGVMSVLTVCQRQLQSELLLVKNEMRLSLEDGGKGKEKVLEDCQLPKVDLVAQVKQLQEKLNRLLYSMTFQNVDAADTKSLWPMASAHLLESSWSDDSCDGEEPDISPHIDTCDANTATGGVTDVIKNQAIDACDANTTPGGVTDVIKNWDSLIPDEMPDSPIQEKSECQDMSLSSPTSVLGGSRHQSHTAEAGPRKSPVGMLDLSSWSSPEVLRKDWTLEPWPSLPVTPHSGALSLCSADTSLGDRADTSLPQTQGPGLLCSPGVSAAALALQWAESPPADDHHVQRTAVEKDVEDFITTSFDSQETLSSPPPGLEGKADRSEKSDGSGFGARLSPGSGGPEAQTAGPVTPASISGRFQPLPEAMKEKEVRPKHVKALLQMVRDESHQILALSEGLAPPSGEPHPPRKEDEIQDISLHGGKTQEVPTACPDWRGDLLQVVQEAFEKEQEMQGVELQPRLSGSDLGGHSSLLERLEKIIREQGDLQEKSLEHLRLPDRSSLLSEIQALRAQLRMTHLQNQEKLQHLRTALTSAEARGSQQEHQLRRQVELLAYKVEQEKCIAGDLQKTLSEEQEKANSVQKLLAAEQTVVRDLKSDLCESRQKSEQLSRSLCEVQQEVLQLRSMLSSKENELKAALQELESEQGKGRALQSQLEEEQLRHLQRESQSAKALEELRASLETQRAQSSRLCVALKHEQTAKDNLQKELRIEHSRCEALLAQERSQLSELQKDLAAEKSRTLELSEALRHERLLTEQLSQRTQEACVHQDTQAHHALLQKLKEEKSRVVDLQAMLEKVQQQALHSQQQLEAEAQKHCEALRREKERELELQRQRDLHKIKQLQQTVRDLESKDEVPGSRLHLGSARRAAGSDADHLREQQRELEAMRQRLLSAARLLTSFTSQAVDRTVNDWTSSNEKAVMSLLHTLEELKSDLSRPTSSQKKMAAELQFQFVDVLLKDNVSLTKALSTVTQEKLELSRAVSKLEKLLKHHLQKGCSPSRSERSAWKPDETAPQSSLRRPDPGRLPPAASEEAHTSNVKMEKLYLHYLRAESFRKALIYQKKYLLLLIGGFQDSEQETLSMIAHLGVFPSKAERKITSRPFTRFRTAVRVVIAILRLRFLVKKWQEVDRKGALAQGKAPRPGPRARQPQSPPRTRESPPTRDVPSGHTRDPARGRRLAAAASPHSGGRATPSPNSRLERSLTASQDPEHSLTEYIHHLEVIQQRLGGVLPDSTSKKSCHPMIKQ

SEQ ID NO: 915666 - protein, 2254 aa, Homo sapiens
TYYYYLPLLGIVDHGSKRKHEGELQSVRDHLRTEASTELAGTVAHELQGVHQGEFGSEKKTALHEKEETLRLQSAQAQPFHQEEKESLSLQLQKKNHQVQQLKDQVLSLSHEIEECRSELEVLQQRRERENREGANLLSMLKADVNLSHSERGALQDALRRLLGLFGETLRAAVTLRSRIGERVGLCLDDAGAGLALSTAPALEETWSDVALPELDRTLSECAEMSSVAEISSHMRESFLMSPESVRECEQPIRRVFQSLSLAVDGLMEMALDSSRQLEEARQLHSRFEKEFSFKNEETAQVVRKHQELLECLTEESAAKAELALELHKTQGTLEGFKVETADLKEVLAGKEDSEHRLVLELESLRRQLQQAAQEQAALREECTRLWSRGEATATDAEAREAALRKEVEDLTKEQSETRKQAEKDRSALLSQMKILESELEEQLSQHRGCAKQAEAVTALEQQVASLDKHLRNQRQFMDEQAAEREHEREEFQQEIQRLEGQLRQAAKPQPWGPRDSQQAPLDGEVELLQQKLREKLDEFNELAIQKESADRQVLMQEEEIKRLEEMNINIRKKVAQLQEEVEKQKNIVKGLEQDKEVLKKQQMSSLLLASTLQSTLDAGRCPEPPSGSPPEGPEIQLEVTQRALLRRESEVLDLKEQLEKMKGDLESKNEEILHLNLKLDMQNSQTAVSLRELEEENTSLKVIYTRSSEIEELKATIENLQENQKRLQKEKAEEIEQLHEVIEKLQHELSLMGPVVHEVSDSQAGSLQSELLCSQAGGPRGQALQGELEAALEAKEALSRLLADQERRHSQALEALQQRLQGAEEAAELQLAELERNVALREAEVEDMASRIQEFEAALKAKEATIAERNLEIDALNQRKAAHSAELEAVLLALARIRRALEQQPLAAGAAPPELQWLRAQCARLSRQLQVLHQRFLRCQVELDRRQARRATAHTRVPGAHPQPRMDGGAKAQVTGDVEASHDAALEPVVPDPQGDLQPVLVTLKDAPLCKQEGVMSVLTVCQRQLQSELLLVKNEMRLSLEDGGKGKEKVLEDCQLPKVDLVAQVKQLQEKLNRLLYSMTFQNVDAADTKSLWPMASAHLLESSWSDDSCDGEEPDISPHIDTCDANTATGGVTDVIKNQAIDACDANTTPGGVTDVIKNWDSLIPDEMPDSPIQEKSECQDMSLSSPTSVLGGSRHQSHTAEAGPRKSPVGMLDLSSWSSPEVLRKDWTLEPWPSLPVTPHSGALSLCSADTSLGDRADTSLPQTQGPGLLCSPGVSAAALALQWAESPPADDHHVQRTAVEKDVEDFITTSFDSQETLSSPPPGLEGKADRSEKSDGSGFGARLSPGSGGPEAQTAGPVTPASISGRFQPLPEAMKEKEVRPKHVKALLQMVRDESHQILALSEGLAPPSGEPHPPRKEDEIQDISLHGGKTQEVPTACPDWRGDLLQVVQEAFEKEQEMQGVELQPRLSGSDLGGHSSLLERLEKIIREQGDLQEKSLEHLRLPDRSSLLSEIQALRAQLRMTHLQNQEKLQHLRTALTSAEARGSQQEHQLRRQVELLAYKVEQEKCIAGDLQKTLSEEQEKANSVQKLLAAEQTVVRDLKSDLCESRQKSEQLSRSLCEVQQEVLQLRSMLSSKENELKAALQELESEQGKGRALQSQLEEEQLRHLQRESQSAKALEELRASLETQRAQSSRLCVALKHEQTAKDNLQKELRIEHSRCEALLAQERSQLSELQKDLAAEKSRTLELSEALRHERLLTEQLSQRTQEACVHQDTQAHHALLQKLKEEKSRVVDLQAMLEKVQQQALHSQQQLEAEAQKHCEALRREKERELELQRQRDLHKIKQLQQTVRDLESKDEVPGSRLHLGSARRAAGSDADHLREQQRELEAMRQRLLSAARLLTSFTSQAVDRTVNDWTSSNEKAVMSLLHTLEELKSDLSRPTSSQKKMAAELQFQFVDVLLKDNVSLTKALSTVTQEKLELSRAVSKLEKLLKHHLQKGCSPSRSERSAWKPDETAPQSSLRRPDPGRLPPAASEEAHTSNVKMEKLYLHYLRAESFRKALIYQKKYLLLLIGGFQDSEQETLSMIAHLGVFPSKAERKITSRPFTRFRTAVRVVIAILRLRFLVKKWQEVDRKGALAQGKAPRPGPRARQPQSPPRTRESPPTRDVPSGHTRDPARGRRLAAAASPHSGGRATPSPNSRLERSLTASQDPEHSLTEYIHHLEVIQQRLGGVLPDSTSKKSCHPMIKQ

SEQ ID NO: 915667 - protein, 2113 aa, Homo sapiens
MLGADSLQSPRGALQDALRRLLGLFGETLRAAVTLRSRIGERVGLCLDDAGAGLALSTAPALEETWSDVALPELDRTLSECAEMSSVAEISSHMRESFLMSPESVRECEQPIRRVFQSLSLAVDGLMEMALDSSRQLEEARQLHSRFEKEFSFKNEETAQVVRKHQELLECLTEESAAKAELALELHKTQGTLEGFKVETADLKEVLAGKEDSEHRLVLELESLRRQLQQAAQEQAALREECTRLWSRGEATATDAEAREAALRKEVEDLTKEQSETRKQAEKDRSALLSQMKILESELEEQLSQHRGCAKQAEAVTALEQQVASLDKHLRNQRQFMDEQAAEREHEREEFQQEIQRLEGQLRQAAKPQPWGPRDSQQAPLDGEVELLQQKLREKLDEFNELAIQKESADRQVLMQEEEIKRLEEMNINIRKKVAQLQEEVEKQKNIVKGLEQDKEVLKKQQMSSLLLASTLQSTLDAGRCPEPPSGSPPEGPEIQLEVTQRALLRRESEVLDLKEQLEKMKGDLESKNEEILHLNLKLDMQNSQTAVSLRELEEENTSLKVIYTRSSEIEELKATIENLQENQKRLQKEKAEEIEQLHEVIEKLQHELSLMGPVVHEVSDSQAGSLQSELLCSQAGGPRGQALQGELEAALEAKEALSRLLADQERRHSQALEALQQRLQGAEEAAELQLAELERNVALREAEVEDMASRIQEFEAALKAKEATIAERNLEIDALNQRKAAHSAELEAVLLALARIRRALEQQPLAAGAAPPELQWLRAQCARLSRQLQVLHQRFLRCQVELDRRQARRATAHTRVPGAHPQPRMDGGAKAQVTGDVEASHDAALEPVVPDPQGDLQPVLVTLKDAPLCKQEGVMSVLTVCQRQLQSELLLVKNEMRLSLEDGGKGKEKVLEDCQLPKVDLVAQVKQLQEKLNRLLYSMTFQNVDAADTKSLWPMASAHLLESSWSDDSCDGEEPDISPHIDTCDANTATGGVTDVIKNQAIDACDANTTPGGVTDVIKNWDSLIPDEMPDSPIQEKSECQDMSLSSPTSVLGGSRHQSHTAEAGPRKSPVGMLDLSSWSSPEVLRKDWTLEPWPSLPVTPHSGALSLCSADTSLGDRADTSLPQTQGPGLLCSPGVSAAALALQWAESPPADDHHVQRTAVEKDVEDFITTSFDSQETLSSPPPGLEGKADRSEKSDGSGFGARLSPGSGGPEAQTAGPVTPASISGRFQPLPEAMKEKEVRPKHVKALLQMVRDESHQILALSEGLAPPSGEPHPPRKEDEIQDISLHGGKTQEVPTACPDWRGDLLQVVQEAFEKEQEMQGVELQPRLSGSDLGGHSSLLERLEKIIREQGDLQEKSLEHLRLPDRSSLLSEIQALRAQLRMTHLQNQEKLQHLRTALTSAEARGSQQEHQLRRQVELLAYKVEQEKCIAGDLQKTLSEEQEKANSVQKLLAAEQTVVRDLKSDLCESRQKSEQLSRSLCEVQQEVLQLRSMLSSKENELKAALQELESEQGKGRALQSQLEEEQLRHLQRESQSAKALEELRASLETQRAQSSRLCVALKHEQTAKDNLQKELRIEHSRCEALLAQERSQLSELQKDLAAEKSRTLELSEALRHERLLTEQLSQRTQEACVHQDTQAHHALLQKLKEEKSRVVDLQAMLEKVQQQALHSQQQLEAEAQKHCEALRREKERELELQRQRDLHKIKQLQQTVRDLESKDEVPGSRLHLGSARRAAGSDADHLREQQRELEAMRQRLLSAARLLTSFTSQAVDRTVNDWTSSNEKAVMSLLHTLEELKSDLSRPTSSQKKMAAELQFQFVDVLLKDNVSLTKALSTVTQEKLELSRAVSKLEKLLKHHLQKGCSPSRSERSAWKPDETAPQSSLRRPDPGRLPPAASEEAHTSNVKMEKLYLHYLRAESFRKALIYQKKYLLLLIGGFQDSEQETLSMIAHLGVFPSKAERKITSRPFTRFRTAVRVVIAILRLRFLVKKWQEVDRKGALAQGKAPRPGPRARQPQSPPRTRESPPTRDVPSGHTRDPARGRRLAAAASPHSGGRATPSPNSRLERSLTASQDPEHSLTEYIHHLEVIQQRLGGVLPDSTSKKSCHPMIKQ

SEQ ID NO: 915668 - protein, 3282 aa, Homo sapiens
MEVEQEQRRRKVEAGRTKLAHFRQRKTKGDSSHSEKKTAKRKGSAVDASVQEESPVTKEDSALCGGGDICKSTSCDDTPDGAGGAFAAQPEDCDGEKREDLEQLQQKQVNDHPPEQCGMFTVSDHPPEQHGMFTVGDHPPEQRGMFTVSDHPPEQRGMFTISDHQPEQRGMFTVSDHTPEQRGIFTISDHPAEQRGMFTKECEQECELAITDLESGREDEAGLHQSQRPFLRLQAVHGLELEALRLSLSNMHTAQLELTQANLQKEKETALTELREMLNSRRAQELALLQSRQQHELELLREQHAREKEEVVLRCGQEAAELKEKLQSEMEKNAQIVKTLKEDWESEKDLCLENLRKELSAKHQSEMEDLQNQFQKELAEQRAELEKIFQDKNQAERALRNLESHHQAAIEKLREDLQSEHGRCLEDLEFKFKESEKEKQLELENLQASYEDLKAQSQEEIRRLWSQLDSARTSRQELSELHEQLLARTSRVEDLEQLKQREKTQHESELEQLRIYFEKKLRDAEKTYQEDLTLLQQRLQGAREDALLDSVEVGLSCVGLEEKPEKGRKDHVDELEPERHKESLPRFQAELEESHRHQLEALESPLCIQHEGHVSDRCCVETSALGHEWRLEPSEGHSQELPWVHLQGVQDGDLEADTERAARVLGLETEHKVQLSLLQTELKEEIELLKIENRNLFEKLQHETRLKDDLEKVKHNLIEDHQKELNNAKQKTELMKQEFQRKETDWKVMKEELQREAEEKLTLMLLELREKAESEKQTIINKLELREAEMRQLQDQQAAQILDLERSLTEQQARLQQLEQDLTSDDALHCSQCGREPPTAQDGELAALHVKEDCALQLMLARSRFLEERKEIAEKFSAEQDAFLQLLQERHQQQLLSVTAELEARHQAALGELTASLESKQGALLAARVAELQTKHAADLGALETRHLSSLDSLESCYLSEFQTIREEHRQALELLRADFEEQLWKKDSLHQTILTQELEKLKRKHEGELQSVRDHLRTEASTELAGTVAHELQGVHQGEFGSEKKTALHEKEETLRLQSAQAQPFHQEEKESLSLQLQKKNHQVQQLKDQVLSLSHEIEECRSELEVLQQRRERENREGANLLSMLKADVNLSHSERGALQDALRRLLGLFGETLRAAVTLRSRIGERVGLCLDDAGAGLALSTAPALEETWSDVALPELDRTLSECAEMSSVAEISSHMRESFLMSPESVRECEQPIRRVFQSLSLAVDGLMEMALDSSRQLEEARQLHSRFEKEFSFKNEETAQVVRKHQELLECLTEESAAKAELALELHKTQGTLEGFKVETADLKEVLAGKEDSEHRLVLELESLRRQLQQAAQEQAALREECTRLWSRGEATATDAEAREAALRKEVEDLTKEQSETRKQAEKDRSALLSQMKILESELEEQLSQHRGCAKQAEAVTALEQQVASLDKHLRNQRQFMDEQAAEREHEREEFQQEIQRLEGQLRQAAKPQPWGPRDSQQAPLDGEVELLQQKLREKLDEFNELAIQKESADRQVLMQEEEIKRLEEMNINIRKKVAQLQEEVEKQKNIVKGLEQDKEVLKKQQMSSLLLASTLQSTLDAGRCPEPPSGSPPEGPEIQLEVTQRALLRRESEVLDLKEQLEKMKGDLESKNEEILHLNLKLDMQNSQTAVSLRELEEENTSLKVIYTRSSEIEELKATIENLQENQKRLQKEKAEEIEQLHEVIEKLQHELSLMGPVVHEVSDSQAGSLQSELLCSQAGGPRGQALQGELEAALEAKEALSRLLADQERRHSQALEALQQRLQGAEEAAELQLAELERNVALREAEVEDMASRIQEFEAALKAKEATIAERNLEIDALNQRKAAHSAELEAVLLALARIRRALEQQPLAAGAAPPELQWLRAQCARLSRQLQVLHQRFLRCQVELDRRQARRATAHTRVPGAHPQPRMDGGAKAQVTGDVEASHDAALEPVVPDPQGDLQPVLVTLKDAPLCKQEGVMSVLTVCQRQLQSELLLVKNEMRLSLEDGGKGKEKVLEDCQLPKVDLVAQVKQLQEKLNRLLYSMTFQNVDAADTKSLWPMASAHLLESSWSDDSCDGEEPDISPHIDTCDANTATGGVTDVIKNQAIDACDANTTPGGVTDVIKNWDSLIPDEMPDSPIQEKSEMSGHVSFFTDQRTWWLPPPDLPVTPHSGALSLCSADTSLGDRADTSLPQTQGPGLLCSPGVSAAALALQWAESPPADDHHVQRTAVEKDVEDFITTSFDSQETLSSPPPGLEGKADRSEKSDGSGFGARLSPGSGGPEAQTAGPVTPASISGRFQPLPEAMKEKEVRPKHVKALLQMVRDESHQILALSEGLAPPSGEPHPPRKEDEIQDISLHGGKTQEVPTACPDWRGDLLQVVQEAFEKEQEMQGVELQPRLSGSDLGGHSSLLERLEKIIREQGDLQEKSLEHLRLPDRSSLLSEIQALRAQLRMTHLQNQEKLQHLRTALTSAEARGSQQEHQLRRQVELLAYKVEQEKCIAGDLQKTLSEEQEKANSVQKLLAAEQTVVRDLKSDLCESRQKSEQLSRSLCEVQQEVLQLRSMLSSKENELKAALQELESEQGKGRALQSQLEEEQLRHLQRESQSAKALEELRASLETQRAQSSRLCVALKHEQTAKDNLQKELRIEHSRCEALLAQERSQLSELQKDLAAEKSRTLELSEALRHERLLTEQLSQRTQEACVHQDTQAHHALLQKLKEEKSRVVDLQAMLEKVQQQALHSQQQLEAEAQKHCEALRREKEVSATLKSTVEALHTQKRELRCSLEREREKPAWLQAELEQSHPRLKEQEGRKAARRSAEARQSPAAAEQWRKWQRDKEKLRELELQRQRDLHKIKQLQQTVRDLESKDEVPGSRLHLGSARRAAGSDADHLREQQRELEAMRQRLLSAARLLTSFTSQAVDRTVNDWTSSNEKAVMSLLHTLEELKSDLSRPTSSQKKMAAELQFQFVDVLLKDNVSLTKALSTVTQEKLELSRAVSKLEKLLKHHLQKGCSPSRSERSAWKPDETAPQSSLRRPDPGRLPPAASEEAHTSNVKMEKLYLHYLRAESFRKALIYQKKYLLLLIGGFQDSEQETLSMIAHLGVFPSKAERKITSRPFTRFRTAVRVVIAILRLRFLVKKWQEVDRKGALAQGKAPRPGPRARQPQSPPRTRESPPTRDVPSGHTRDPARGRRLAAAASPHSGGRATPSPNSRLERSLTASQDPEHSLTEYIHHLEVIQQRLGGVLPDSTSKKSCHPMIKQ

SEQ ID NO: 915669 - protein, 3050 aa, Homo sapiens
MEVEQEQRRRKVEAGRTKLAHFRQRKTKGDSSHSEKKTAKRKGSAVDASVQEESPVTKEDSALCGGGDICKSTSCDDTPDGAGGAFAAQPEDCDGEKREDLEQLQQKQVNDHPPEQCGMFTVSDHPPEQHGMFTVGDHPPEQRGMFTVSDHPPEQRGMFTISDHQPEQRGMFTVSDHTPEQRGIFTISDHPAEQRGMFTKECEQECELAITDLESGREDEAGLHQSQRPFLRLQAVHGLELEALRLSLSNMHTAQLELTQANLQKEKETALTELREMLNSRRAQELALLQSRQQHELELLREQHAREKEEVVLRCGQEAAELKEKLQSEMEKNAQIVKTLKEDWESEKDLCLENLRKELSAKHQSEMEDLQNQFQKELAEQRAELEKIFQDKNQAERALRNLESHHQAAIEKLREDLQSEHGRCLEDLEFKFKESEKEKQLELENLQASYEDLKAQSQEEIRRLWSQLDSARTSRQELSELHEQLLARTSRVEDLEQLKQREKTQHESELEQLRIYFEKKLRDAEKTYQEDLTLLQQRLQGAREDALLDSVEVGLSCVGLEEKPEKGRKDHVDELEPERHKESLPRFQAELEESHRHQLEALESPLCIQHEGHVSDRCCVETSALGHEWRLEPSEGHSQELPWVHLQGVQDGDLEADTERAARVLGLETEHKVQLSLLQTELKEEIELLKIENRNLFEKLQHETRLKDDLEKVKHNLIEDHQKELNNAKQKTELMKQEFQRKETDWKVMKEELQREAEEKLTLMLLELREKAESEKQTIINKLELREAEMRQLQDQQAAQILDLERSLTEQQARLQQLEQDLTSDDALHCSQCGREPPTAQDGELAALHVKEDCALQLMLARSRFLEERKEIAEKFSAEQDAFLQLLQERHQQQLLSVTAELEARHQAALGELTASLESKQGALLAARVAELQTKHAADLGALETRHLSSLDSLESCYLSEFQTIREEHRQALELLRADFEEQLWKKDSLHQTILTQELEKLKRKHEGELQSVRDHLRTEASTELAGTVAHELQGVHQGEFGSEKKTALHEKEETLRLQSAQAQPFHQEEKESLSLQLQKKNHQVQQLKDQVLSLSHEIEECRSELEVLQQRRERENREGANLLSMLKADVNLSHSERGALQDALRRLLGLFGETLRAAVTLRSRIGERVGLCLDDAGAGLALSTAPALEETWSDVALPELDRTLSECAEMSSVAEISSHMRESFLMSPESVRECEQPIRRVFQSLSLAVDGLMEMALDSSRQLEEARQLHSRFEKEFSFKNEETAQVVRKHQELLECLTEESAAKAELALELHKTQGTLEGFKVETADLKEVLAGKEDSEHRLVLELESLRRQLQQAAQEQAALREECTRLWSRGEATATDAEAREAALRKEVEDLTKEQSETRKQAEKDRSALLSQMKILESELEEQLSQHRGCAKQAEAVTALEQQVASLDKHLRNQRQFMDEQAAEREHEREEFQQEIQRLEGQLRQAAKPQPWGPRDSQQAPLDGEVELLQQKLREKLDEFNELAIQKESADRQVLMQEEEIKRLEEMNINIRKKVAQLQEEVEKQKNIVKGLEQDKEVLKKQQMSSLLLASTLQSTLDAGRCPEPPSGSPPEGPEIQLEVTQRALLRRESEVLDLKEQLEKMKGDLESKNEEILHLNLKLDMQNSQTAVSLRELEEENTSLKVIYTRSSEIEELKATIENLQENQKRLQKEKAEEIEQLHEVIEKLQHELSLMGPVVHEVSDSQAGSLQSELLCSQAGGPRGQALQGELEAALEAKEALSRLLADQERRHSQALEALQQRLQGAEEAAELQLAELERNVALREAEVEDMASRIQEFEAALKAKEATIAERNLEIDALNQRKAAHSAELEAVLLALARIRRALEQQPLAAGAAPPELQWLRAQCARLSRQLQVLHQRFLRCQVELDRRQARRATAHTRVPGAHPQPRMDGGAKAQVTGDVEASHDAALEPVVPDPQGDLQPVLVTLKDAPLCKQEGVMSVLTVCQRQLQSELLLVKNEMRLSLEDGGKGKEKVLEDCQLPKVDLVAQVKQLQEKLNRLLYSMTFQNVDAADTKSLWPMASAHLLESSWSDDSCDGEEPDISPHIDTCDANTATGGVTDVIKNQAIDACDANTTPGGVTDVIKNWDSLIPDEMPDSPIQEKSECQDMSLSSPTSVLGGSRHQSHTAEAGPRKSPVGMLDLSSWSSPEVLRKDWTLEPWPSLPVTPHSGALSLCSADTSLGDRADTSLPQTQGPGLLCSPGVSAAALALQWAESPPADDHHVQRTAVEKDVEDFITTSFDSQETLSSPPPGLEGKADRSEKSDGSGFGARLSPGSGGPEAQTAGPVTPASISGRFQPLPEAMKEKEVRPKHVKALLQMVRDESHQILALSEGLAPPSGEPHPPRKEDEIQDISLQWGKDAGSAHRVPRLEKELRIEHSRCEALLAQERSQLSELQKDLAAEKSRTLELSEALRHERLLTEQLSQRTQEACVHQDTQAHHALLQKLKEEKSRVVDLQAMLEKVQQQALHSQQQLEAEAQKHCEALRREKEVSATLKSTVEALHTQKRELRCSLEREREKPAWLQAELEQSHPRLKEQEGRKAARRSAEARQSPAAAEQWRKWQRDKEKLRELELQRQRDLHKIKQLQQTVRDLESKDEVPGSRLHLGSARRAAGSDADHLREQQRELEAMRQRLLSAARLLTSFTSQAVDRTVNDWTSSNEKAVMSLLHTLEELKSDLSRPTSSQKKMAAELQFQFVDVLLKDNVSLTKALSTVTQEKLELSRAVSKLEKLLKHHLQKGCSPSRSERSAWKPDETAPQSSLRRPDPGRLPPAASEEAHTSNVKMEKLYLHYLRAESFRKALIYQKKYLLLLIGGFQDSEQETLSMIAHLGVFPSKAERKITSRPFTRFRTAVRVVIAILRLRFLVKKWQEVDRKGALAQGKAPRPGPRARQPQSPPRTRESPPTRDVPSGHTRDPARGRRLAAAASPHSGGRATPSPNSRLERSLTASQDPEHSLTEYIHHLEVIQQRLGGVLPDSTSKKSCHPMIKQ

SEQ ID NO: 915670 - protein, 3328 aa, Homo sapiens
MEVEQEQRRRKVEAGRTKLAHFRQRKTKGDSSHSEKKTAKRKGSAVDASVQEESPVTKEDSALCGGGDICKSTSCDDTPDGAGGAFAAQPEDCDGEKREDLEQLQQKQVNDHPPEQCGMFTVSDHPPEQHGMFTVGDHPPEQRGMFTVSDHPPEQRGMFTISDHQPEQRGMFTVSDHTPEQRGIFTISDHPAEQRGMFTKECEQECELAITDLESGREDEAGLHQSQRPFLRLQAVHGLELEALRLSLSNMHTAQLELTQANLQKEKETALTELREMLNSRRAQELALLQSRQQHELELLREQHAREKEEVVLRCGQEAAELKEKLQSEMEKNAQIVKTLKEDWESEKDLCLENLRKELSAKHQSEMEDLQNQFQKELAEQRAELEKIFQDKNQAERALRNLESHHQAAIEKLREDLQSEHGRCLEDLEFKFKESEKEKQLELENLQASYEDLKAQSQEEIRRLWSQLDSARTSRQELSELHEQLLARTSRVEDLEQLKQREKTQHESELEQLRIYFEKKLRDAEKTYQEDLTLLQQRLQGAREDALLDSVEVGLSCVGLEEKPEKGRKDHVDELEPERHKESLPRFQAELEESHRHQLEALESPLCIQHEGHVSDRCCVETSALGHEWRLEPSEGHSQELPWVHLQGVQDGDLEADTERAARVLGLETEHKVQLSLLQTELKEEIELLKIENRNLFEKLQHETRLKDDLEKVKHNLIEDHQKELNNAKQKTELMKQEFQRKETDWKVMKEELQREAEEKLTLMLLELREKAESEKQTIINKLELREAEMRQLQDQQAAQILDLERSLTEQQARLQQLEQDLTSDDALHCSQCGREPPTAQDGELAALHVKEDCALQLMLARSRFLEERKEIAEKFSAEQDAFLQLLQERHQQQLLSVTAELEARHQAALGELTASLESKQGALLAARVAELQTKHAADLGALETRHLSSLDSLESCYLSEFQTIREEHRQALELLRADFEEQLWKKDSLHQTILTQELEKLKRKHEGELQSVRDHLRTEASTELAGTVAHELQGVHQGEFGSEKKTALHEKEETLRLQSAQAQPFHQEEKESLSLQLQKKNHQVQQLKDQVLSLSHEIEECRSELEVLQQRRERENREGANLLSMLKADVNLSHSERGALQDALRRLLGLFGETLRAAVTLRSRIGERVGLCLDDAGAGLALSTAPALEETWSDVALPELDRTLSECAEMSSVAEISSHMRESFLMSPESVRECEQPIRRVFQSLSLAVDGLMEMALDSSRQLEEARQLHSRFEKEFSFKNEETAQVVRKHQELLECLTEESAAKAELALELHKTQGTLEGFKVETADLKEVLAGKEDSEHRLVLELESLRRQLQQAAQEQAALREECTRLWSRGEATATDAEAREAALRKEVEDLTKEQSETRKQAEKDRSALLSQMKILESELEEQLSQHRGCAKQAEAVTALEQQVASLDKHLRNQRQFMDEQAAEREHEREEFQQEIQRLEGQLRQAAKPQPWGPRDSQQAPLDGEVELLQQKLREKLDEFNELAIQKESADRQVLMQEEEIKRLEEMNINIRKKVAQLQEEVEKQKNIVKGLEQDKEVLKKQQMSSLLLASTLQSTLDAGRCPEPPSGSPPEGPEIQLEVTQRALLRRESEVLDLKEQLEKMKGDLESKNEEILHLNLKLDMQNSQTAVSLRELEEENTSLKVIYTRSSEIEELKATIENLQENQKRLQKEKAEEIEQLHEVIEKLQHELSLMGPVVHEVSDSQAGSLQSELLCSQAGGPRGQALQGELEAALEAKEALSRLLADQERRHSQALEALQQRLQGAEEAAELQLAELERNVALREAEVEDMASRIQEFEAALKAKEATIAERNLEIDALNQRKAAHSAELEAVLLALARIRRALEQQPLAAGAAPPELQWLRAQCARLSRQLQVLHQRFLRCQVELDRRQARRATAHTRVPGAHPQPRMDGGAKAQVTGDVEASHDAALEPVVPDPQGDLQPVLVTLKDAPLCKQEGVMSVLTVCQRQLQSELLLVKNEMRLSLEDGGKGKEKVLEDCQLPKVDLVAQVKQLQEKLNRLLYSMTFQNVDAADTKSLWPMASAHLLESSWSDDSCDGEEPDISPHIDTCDANTATGGVTDVIKNQAIDACDANTTPGGVTDVIKNWDSLIPDEMPDSPIQEKSECQDMSLSSPTSVLGGSRHQSHTAEAGPRKSPVGMLDLSSWSSPEVLRKDWTLEPWPSLPVTPHSGALSLCSADTSLGDRADTSLPQTQGPGLLCSPGVSAAALALQWAESPPADDHHVQRTAVEKDVEDFITTSFDSQETLSSPPPGLEGKADRSEKSDGSGFGARLSPGSGGPEAQTAGPVTPASISGRFQPLPEAMKEKEVRPKHVKALLQMVRDESHQILALSEGLAPPSGEPHPPRKEDEIQDISLHGGKTQEVPTACPDWRGDLLQVVQEAFEKEQEMQGVELQPRLSGSDLGGHSSLLERLEKIIREQGDLQEKSLEHLRLPDRSSLLSEIQALRAQLRMTHLQNQEKLQHLRTALTSAEARGSQQEHQLRRQVELLAYKVEQEKCIAGDLQKTLSEEQEKANSVQKLLAAEQTVVRDLKSDLCESRQKSEQLSRSLCEVQQEVLQLRSMLSSKENELKAALQELESEQGKGRALQSQLEEEQLRHLQRESQSAKALEELRASLETQRAQSSRLCVALKHEQTAKDNLQKELRIEHSRCEALLAQERSQLSELQKDLAAEKSRTLELSEALRHERLLTEQLSQRTQEACVHQDTQAHHALLQKLKEEKSRVVDLQAMLEKVQQQALHSQQQLEAEAQKHCEALRREKEVSATLKSTVEALHTQKRELRCSLEREREKPAWLQAELEQSHPRLKEQEGRKAARRSAEARQSPAAAEQWRKWQRDKEKLRELELQRQRDLHKIKQLQQTVRDLESKDEVPGSRLHLGSARRAAGSDADHLREQQRELEAMRQRLLSAARLLTSFTSQAVDRTVNDWTSSNEKAVMSLLHTLEELKSDLSRPTSSQKKMAAELQFQFVDVLLKDNVSLTKALSTVTQEKLELSRAVSKLEKLLKHHLQKGCSPSRSERSAWKPDETAPQSSLRRPDPGRLPPAASEEAHTSNVKMEKLYLHYLRAESFRKALIYQKKYLLLLIGGFQDSEQETLSMIAHLGVFPSKAERKITSRPFTRFRTAVRVVIAILRLRFLVKKWQEVDRKGALAQGKAPRPGPRARQPQSPPRTRESPPTRDVPSGHTRDPARGRRLAAAASPHSGGRATPSPNSRLERSLTASQDPEHSLTEYIHHLEVIQQRLGGVLPGNASPRRVFIKLIITVPWKRRVC

SEQ ID NO: 915671 - protein, 3328 aa, Homo sapiens; identical to SEQ ID NO: 915670

SEQ ID NO: 915672 - protein, 435 aa, Homo sapiens
FYIIKTDRRCKPRPLSRELELQRQRDLHKIKQLQQTVRDLESKDEVPGSRLHLGSARRAAGSDADHLREQQRELEAMRQRLLSAARLLTSFTSQAVDRTVNDWTSSNEKAVMSLLHTLEELKSDLSRPTSSQKKMAAELQFQFVDVLLKDNVSLTKALSTVTQEKLELSRAVSKLEKLLKHHLQKGCSPSRSERSAWKPDETAPQSSLRRPDPGRLPPAASEEAHTSNVKMEKLYLHYLRAESFRKALIYQKKYLLLLIGGFQDSEQETLSMIAHLGVFPSKAERKITSRPFTRFRTAVRVVIAILRLRFLVKKWQEVDRKGALAQGKAPRPGPRARQPQSPPRTRESPPTRDVPSGHTRDPARGRRLAAAASPHSGGRATPSPNSRLERSLTASQDPEHSLTEYIHHLEVIQQRLGGVLPDSTSKKSCHPMIKQ

SEQ ID NO: 915673 - protein, 324 aa, Homo sapiens [sequence omitted]

SEQ ID NO: 915674 - protein, 324 aa, Homo sapiens [sequence omitted]

SEQ ID NO: 915675 - protein, 116 aa, Homo sapiens
VRPKHVKVWLAGAALTASHVQPRGIPQALCPALPGRALEGQLFLGASEHLHFNDSREAAPRWPRKPPTQPCTGPLGGRLPSGQGGSCEPVGRWCCPESQSRPVPLSRLCLPPACAL

SEQ ID NO: 915676 - protein, 91 aa, Homo sapiens
PALEETWSDVALPELDRTLSECAEMSSVAEISSHMRESFLMSPESVRECEQPIRRVFQSLSLAVDGLMEMALDSSRQVRPRLPGSCGDVNN

SEQ ID NO: 915677 - protein, 79 aa, Homo sapiens [sequence omitted]

SEQ ID NO: 915678 - protein, 149 aa, Homo sapiens
SLKMMGHLVDNVDCRLAWASLAAAPTLPSAIVWMCCPTFLCWKLNPQCSSVGRIVFSKKMMQLENYRTVLIFTQIRRGCIWRIDAKDVKSSAMSERAPHNFRVFLDIHLKEINCCSLNIPHTSVIIPLLTLIHKSYWNFLPTMSVVQNP

SEQ ID NO: 915679 - protein, 149 aa, Homo sapiens; identical to SEQ ID NO: 915678

SEQ ID NO: 915680 - protein, 182 aa, Homo sapiens
WLQTTQRMAHWLQPDMEEADSQCTSQFFQKLSRYRRQPTKTFAKAEFLRITGSTAFRCICGEVPSLVNRSRVKSLVDTTEAMELSTGRINQRFKSSVQRAGSKGHAVNQIWKKRKGFCQGKQPFVDRRKLREARERYSQTTGSRSEMDLLFNAVVGAARDGWEHDSRGHCDLASHRGKNPRS

SEQ ID NO: 915681 - protein, 156 aa, Homo sapiens
MTNVCKEWSLSQALSRLCEILFCQLFPRHVKAIKLPWKKKRRKRKKWKKKEKEKEEEERKRKRKRKKKEEEEEEEEEEEEEEEEEEEEEEAAADALRRHAWSRTFTVTTCSAQGSSTYSIPSYPGPFLSPDVFLLLSYLPGVALEDLPNLFSKIPE

SEQ ID NO: 915682 - protein, 156 aa, Homo sapiens; identical to SEQ ID NO: 915681

SEQ ID NO: 915683 - protein, 201 aa, Homo sapiens
PPSLVLRSSPLFCLTMLQHCLLLEGGILQKEVCSADNFLPLSHSAWGENFAENPNQTLRIPGISLFRGNKSSPRLGRALLQAPPPPRPTCGLLTGQALSYIQLTFQNQIKKLSNTFRKDRAWLLGSQVNRTARQGLAGEALRRPCMPCILGSWEGCSVTGRKMKLKKSKGPVGLNTVGETWAVCLKSPLGKTTPSWWTPSP

SEQ ID NO: 915684 - protein, 201 aa, Homo sapiens; identical to SEQ ID NO: 915683

SEQ ID NO: 915685 - protein, 122 aa, Homo sapiens
MYCCSLLVKLSQSEITVTTDNRLLKIWDRQKSQKSTIYSAPRALWVLKHSGQSVIETLLASGCPVHVTVESKQCNWRYIHMWTIMAIIYTKFTVSWKGGMGSWKNTKIASQLECDVGEAAHG

SEQ ID NO: 915686 - protein, 157 aa, Homo sapiens
MMTMAVLWNRKGGKRAAALNIYRIPPSSRKPALCPTPRDRLEYDEDRLEHSEDRPERPLGEPQGFQDGARACADADGRGEGLAYVRARELHTLEVTGLETVAQSKAHVASLEGLIPEDKVVLLAGSPLQNEATLGQCGVEALTTLEVVGRRLGVHNV

SEQ ID NO: 915687 - protein, 116 aa, Homo sapiens
MMTMAVLWNRKGGKRAAALNIYRIPPSSRKPALCPTPRDRLEYDEDRLEHSEDRPERPLGEPQGFQDGARACADADGRGEGLAYVRARELHTLEVTGLETVAQSKFTMSKSQLILC

SEQ ID NO: 915688 - protein, 158 aa, Homo sapiens
PQSVMFHFLCPCVLIVQFPPMSLNKRPITMLQKHMQELRPNKLLTKNSFHSECFMIFIETLMLYSSQNGSTCSTKEIFPYFLGVKHLSSTNDHTLSFSITLFKTNQLKEPTKEAPLLKLESHTFIRPGTESGEHRKYVFKEYHKEIPSYIFVIYIVRM

SEQ ID NO: 915689 - protein, 325 aa, Homo sapiens
MSKAQCIVANEAMAPVVNSAVSDCPTLKTKLLVSDKSYDGWLDFKKLIQVAPPKQTYMRTKSQDPMAIFFTKGTTGAPKMVEYSQYGLGMGFSQASRRWMDLQPTDVLWSLGDAFGGSLSLSAVLGTWFQGACVFLCHMPTFCPETVLNVLSRFPITTLSANPEMYQELLQHKCFTSYRFKSLKQCVAAGGPISPGVIEDWKRITKLDIYEGYGQTETGLLCATSKTIKLKPSSLGKPLPPYIVQIVDENSNLLPPGEEGNIAIRIKLNQPASLYCPHMVSWEEYASARGHMLYLTGDRGIMDEDGYFWWSGRVDDVANALGQRL

SEQ ID NO: 915690 - protein, 327 aa, Homo sapiens
GTGRTLLCIVANEAMAPVVNSAVSDCPTLKTKLLVSDKSYDGWLDFKKLIQVAPPKQTYMRTKSQDPMAIFFTKGTTGAPKMVEYSQYGLGMGFSQASRRWMDLQPTDVLWSLGDAFGGSLSLSAVLGTWFQGACVFLCHMPTFCPETVLNVLSRFPITTLSANPEMYQELLQHKCFTSYRFKSLKQCVAAGGPISPGVIEDWKRITKLDIYEGYGQTETGLLCATSKTIKLKPSSLGKPLPPYIVQIVDENSNLLPPGEEGNIAIRIKLNQPASLYCPHMVSWEEYASARGHMLYLTGDRGIMDEDGYFWWSGRVDDVANALGQRL

SEQ ID NO: 915691 - protein, 165 aa, Homo sapiens
TLKDCLLGKVWLSMKSNYSNLANKTLSAVIPPPPQAFSGLAPVTQSSPPCLCPCCPRTSPPARRLSTWWPQYDLPDLQALSLNNLPLSVDVQQTFGKVSLGPYSVGVTDRILKLLYFSGSHSPGNPGPDKASEGALMTQSPLKGPAPHDCHTGDSVPTPGICQTH

SEQ ID NO: 915692 - protein, 292 aa, Homo sapiens
MWNCRCWNSLEGSEEDTKMWESLELPRDLNGFDQNADKDMENEIQDEMVSDGDEELVGNWNPEAYEENVVLWAGPKVPVLCAWSPASQPLQPTERGQHRARAVASEGASIKPWQLPHGVEPASAEKSRIEVWKPLPRFQKMYGNIWMPRQKFAVGAGSSWRTSARAIQKGNVRSEPPHRVPTGAPPSGAVRRGPPSRHQNDRFTNSLHHAPGRPTDTQQQAMKAPGREAVSCKATGVELPKTMGTLLLHRCDLDVRHGVKGGHFGALRFDRPAEFRTCMGPVAPLFWQVSPI

SEQ ID NO: 915693 - protein, 151 aa, Homo sapiens
MVKPLWVPAVCSAQPQGPPTTLAALRQPRYRFPDFGTETTTPAPELLKAQVSQPGRKPATAAGSPAPRSAASSRTLSDAVLPWGHGRKKGPGWGTWPRRGGRGGSAGLPAAPARVPTRRHVTRRALSHREASGWAAGIGQSAGPSGAEGRW

SEQ ID NO: 915694 - protein, 193 aa, Homo sapiens
MMGTGKIAQVKMKKTSQGKTMVKANTVRIDGILEVLLCLQEHSFYFMCNENSSILALFKINDSEGILAPHKRLLDGMECDHRSTCDEPLSPQGRRTVAGTQSVPFSCSCGFFHCMDMGCEGMESLYRDIRCRWRAEQAGLQHQAPWDECSILTAMSALCLHSVCEAPSVMTRCWPAWPGQSSEEHYKNVEAIC

SEQ ID NO: 915695 - protein, 143 aa, Homo sapiens
MASTSASGESFSKLTIMMEGKGEAGGSTCTRKKKKQLYRACTVEEVSGWALASNGYWTFDVTFTLIKNGSWLLTWRHLPAGVDRHLIQESWHLAGAPLGRSFQRKEQAAIFAVLQPLLVIPRKTVWSGPPANSSRPAEEASEC

SEQ ID NO: 915696 - protein, 131 aa, Homo sapiens [sequence omitted]

SEQ ID NO: 915697 - protein, 109 aa, Homo sapiens
QAAALQRTRVPERPAGPAQLSLGAFSQKETRLRNNNRNGTALPMRSSLAPEASNQRFLSSLWPAGRGPRRLFFSLTEQLRPPFRGRQCGLAGPDRGDQGLIPSRVDCWK

SEQ ID NO: 915698 - protein, 395 aa, Homo sapiens
LPNPPCSSTSPFQHNPLPTPLPSPNHRSPSCRKKPMRRTPPERGVGKDPPKKHNLNPARKHPPQWEAPTLVDEQPLENYLDMEYFGTIGIGTPAQDFTVVFDTGSSNLWVPSVYCSSLACNNHPTNLSPSFTTQSLQTSTSPLPHSTISSTPIHLSPTQPSTISDTNQIFGLSETEPCSFLYYAPFDGILGLAYPSISSSGATPVFDNIWNQGLVSQDLFSVYLSADDQSGSVVIFGGIDSSYYTGSLNWVPVTVEGYWQITVDSITMNGEAIACAEGCQAIVDTGTSLLTGPTSPIANIQSDIGASENSDGDMVVSCSAISSLPDIVFTINGVQYPVPPSAYILQSEGSCISGFQGMNLPTESGELWILGDVFIRQYFTVFDRANNQVGLAPVA

SEQ ID NO: 915699 - protein, 122 aa, Homo sapiens
LPNPPCSSTSPFQHNPLPTPLPSPNHRSPSCRKKPMRRTPPERGVGKDPPKKHNLNPARKHPPQWEAPTLVDEQPLENYLDMEYFGTIGIGTPAQDFTVVFDTGSSYPGVYCLRYLIESYHV

SEQ ID NO: 915700 - protein, 396 aa, Homo sapiens
LPNPPCSSTSPFQHNPLPTPLPSPNHRSPSCRKKPMRRTPPERGVGKDPPKKHNLNPARKHPPQWEAPTLVDEQPLENYLDMEYFGTIGIGTPAQDFTVVFDTGSSNLWVPSVYCSSLACTNHNRFNPEDSSTYQSTSETVSITYGTGSMTGILGYDTVQVGGISDTNQIFGLSETEPCSFLYYAPFDGILGLAYPSISSSGATPVFDNIWNQGLVSQDLFSVYLSADDQSGSVVIFGGIDSSYYTGSLNWVPVTVEGYWQITVDSITMNGEAIACAEGCQAIVDTGTSLLTGPTSPIANIQSDIGASENSDGDMVVSCSAISSLPDIVFTINGVQYPVPPSAYILQSEGSCISGFQGMNLPTESGELWILGDVFIRQYFTVFDRANNQVGLAPVA

SEQ ID NO: 915701 - protein, 336 aa, Homo sapiens
VEFCTLSPHWYTEQPLENYLDMEYFGTIGIGTPAQDFTVVFDTGSSNLWVPSVYCSSLACTNHNRFNPEDSSTYQSTSETVSITYGTGSMTGILGYDTVQVGGISDTNQIFGLSETEPCSFLYYAPFDGILGLAYPSISSSGATPVFDNIWNQGLVSQDLFSVYLSADDQSGSVVIFGGIDSSYYTGSLNWVPVTVEGYWQITVDSITMNGEAIACAEGCQAIVDTGTSLLTGPTSPIANIQSDIGASENSDGDMVVSCSAISSLPDIVFTINGVQYPVPPSAYILQSEGSCISGFQGMNLPTESGELWILGDVFIRQYFTVFDRANNQVGLAPVA

SEQ ID NO: 915702 - protein, 139 aa, Homo sapiens
MKKKYLEPCPSSSLEDCGYSIILNYYLQLTFSMGPSPIELNMIHIINTQLSHFLQIYAIYFKYIYGKGVCVCVLWCVCVWCGVCVCVSTYFPAEVIVPNLWQVKKLGEGGHAYSSFIQYCKSFFVPPLVYLLCVQYTVS

SEQ ID NO: 915703 - protein, 223 aa, Homo sapiens
VPCPSWSEARGKASMVIQLQGQIRNQPVLPEDRGLCLLTTRNNWGPEGLDETDFKTTTSSEIPGVRRPVLCVPVSALPLTSNVTLMALLQLILGGSLSSSVDGSEMEPLPLPPEALYPSLQWPSGGADRPLDLHQEAATASECSEHSRSWGMEAFSSIRRRKEKQPPKRHLLSASCGREAEANPGFQWGGGGSTLTDKDNSVLQDFERYYKHNRGLRRIYQDP

SEQ ID NO: 915704 - protein, 120 aa, Homo sapiens
MEKSDMEVSNQITLVEDVLAKLCKTIYLLANLLARPLPEGVDPLKLEIYLTDEDFERKDVGLLQTSDNGCTPRIRSERWTCQGKASEASVPTISTMDALLTDQRPLFLILNWPLLSFCLY

SEQ ID NO: 915705 - protein, 1088 aa, Homo sapiens
MHSLSDPARWELRKGRPGRGRSPRTEFCFSTKDKEPRGRQLKDLLPAFCSLQKLPVTNRAAHGLCASLGPDFMTFKVPSSWRHSDSICREWFTLAGAPSRDVLLVSAIITVSLSVTVVLCGLCHWCQRKLEGHSSPEGAGRGSGAEPPAPHRAAPPSPQPTAPRAAAPQDLHSRPHSCRPAQKCGGTLGAAGGEGGDGGPGGVRDVWNRAGCPALFLGPLCLRLSQNFRKGGGGGWAMCLCVCEAPVCRLPLASFLCGFPALECVRVCIGMFAHVCVCVDLDRDFWNNNESTVQQKWSSYPPKEFILNISPYAPYGDPRLSLKASLAGEPPRQPYLAPPAGPGAHPTFCAVRMGLPVWVPPPRLWSLLPPRCVLPWLLGGRCGTLLSGAKVAAAAGLAVEREGRLGEKPAPVPPPGEDALRSGGAAPSEPGSGGKAGRGRWRTVQSHLAAGKLNLSKELWAYLAGQAWAGPWSLLGEAVAATAVATAPMEAWRGPAARTLHWGLLVLALGFFLFHCDPFICFSFLSSPPPAPSFEDSTLSTATTLESIPSSTGEPKCQRPRTLMRQQSLQQPLSQHQRGRQPSQPTTSQSLGQLQAHMASAPGPNPRAYGRGQARQGTSAGSKYRAAGGRSRSNPGSWDHVVGQIRNRGLDMKSFLEGRMVVLSLVLGLSEQDDFANIPDLQNPGTQQNQNAQGDKRYEHRRGPAAAAAEKEARRGRLPRPAPAAGRAVSGSFPSPCLPVLPAGGKAVNTAPVPGQTPHDESDRRTEPRSSVSDLVNSLTSEMLMADFCWCKRSGSTFPDCDGVANLAATEMALSQLSSEEDEAHEGCSRENLGRIQFSVGYNFQESTLTVKIMKAQELPAKDFSGTSDPFVKIYLLPDKKHKLETKVKRKNLNPHWNETFLFEGFPYEKVVQRILYLQVLDYDRFSRNDPIGEVSIPLNKVDLTQMQTFWKDLKPCSDGSGSRGELLLSLCYNPSANSIIVNIIKARNLKAMDIGGTSDPYVKVWLMYKDKRVEKKKTVTMKRNLNPIFNESFAFDIPTEKLRETTIIITVMDKDKLSRNDVIGKFPLHLPINNHITLGKWLGLSKL

SEQ ID NO: 915706 - protein, 166 aa, Homo sapiens
SFLNFLLYSRAQLQCASAWLHDTYYFYMGWPLKKKKALQWLGPHIPAEATCQEDDEEKKDDNVDDAILWLPQLFCGALCSQENLTVLCPFLSLWPPWLLPWAAEGSSDAREGALLAQPKVSGTGSPARSSSGTKDPAWAGARRLELPCRRHCFSCPHRPLLLLGNA

SEQ ID NO: 915707 - protein, 302 aa, Homo sapiens
MATVKSELIECFTSEEPFHHRKVSITGTGSVGMACATSILLKGLSDELAFVDLDEGKLKGETMDLQHDSPFMKMSNIVCSKDYLVTANPHLVIITAGARREKGEMRFNLVRQNVAIFKLMISSIVQQSPLCKLIIVSNPVDILTYVAWKLSAFPKNRVIGSGCNLDTVRFQFFIGQKLGIHSESCRGWILGEHGDSSVPVWSGMNIAGVLLKDLNSDIGTDKDPEKWKNVHKEVIASAYEIIEMKSSTSWAIGLSGADLTESILKNLRRKHPVSTIIKGLYGINEEVFLSIPSLERRVLPTL

SEQ ID NO: 915708 - protein, 708 aa, Homo sapiens
MFPVCFNLQEEGGVADDSAISNLLWRVTESRESQMMIEERKQLITVREEAWKTRGRGAANDSTQFTVAGRMVKKGLASPTAITPVASAICGKTRGTTPVSKPLEVGGMHETVLTVTGKSVKELMKPDDDETFAQFYRNVDCNMLRSPVELDEDFDVIFDPYAPKKYFVESKTPRSSRGGGVTDRDRGSASIRRLTSSVAEHKWAVRPKRQVQASKNPLKMLAAREDLLQEYTEQRLNVAFMESKRIKVEKREYLNPHPASVFGNGFFRCFTHCLVFCLVKANNGAQKALMNFSEVTLAGLASKENFSNVSLRSVNLTEQNSNNSAVPFKRLMLLQIKGRRHVQTRLVEPRASALNSGDCFLLLSPHCCFLWVGEFANAIEKAKVAAGDPKEDELYEAAIIETNCIYCLMDDKLVPDDDYWGKIPKCSLLQPKEVLVFDFGSEVYVWHGKEVTLAQRKIEFQLAKHLWNGTFDYENCDINPLDPGECNPLIRRKGQGRPDWAIFGRLTEHNETILFKEKFLDWTELKRPNEKNPGELAQHKEDSRADVKRNNVTRMVSVPQTTAGAILDRVNIGCGCGLVEGHHRRQFEITSVSVDVWYILEFDYSRLPKQSIGQFHEGDAYVVKWKFMTPLQNTHPDAWRWGKGESGELRRNHPFPCQGGAFPTALLTPSHLGEHAGHRDQVKISDPVSKTVIHDVKQVQEHPAGGSH

SEQ ID NO: 915709 - protein, 708 aa, Homo sapiens; identical to SEQ ID NO: 915708

SEQ ID NO: 915710 - protein, 174 aa, Homo sapiens
MNPCFCGFLVLLSCCLSLLDSQLHNLIALQITCFKDVEIPNFFCDPSQLPHHACCDTFTNNIVMYFPAAIFGFLPTSGILFSYYKIVSSILRVSSSGGNYKALSACGSHLSVVCLFYGTGVGGYLSSDVSSSPRKGAVASVMYTVVTPMLNPFIYSLRNRDIKSVLRRLHGRTV

SEQ ID NO: 915711 - protein, 271 aa, Homo sapiens
EVRLPSRRGPQLGEGSPRPQPSAQEVEAANMPSSPLDSRAHVLVHAGDLRASRLGGCGTPPERRGKTGPGGAGGAHAVAFLARRRFKKQNPEPHLHPHSGPRARPGRQCSGRPWVALSPPLLQTPPPENRSHPTRPGEPPTRGCVRLGSASVQPLRVRIPDPASRRRLAERRVPATPTSRRGHGDLRGAGGGRDSGRGEGTQLGCGARGRSPSGLRLGSLPTSPGPSQDSTSPSAFPLPPAVSTLRLVLLSAPSPTLSSPSCPPPPLFCSL

SEQ ID NO: 915712 - protein, 225 aa, Homo sapiens
MPSMRIFISVNVLLASAVSLGEPVNHADSLAPNQNLWDGIRRSKSGWGCLVTMGFTRSIPDYFAVNRTTHTVMQLHIQLGKHIGIEDAYFRNVPDCCSLHYVSNDEFLNGLVLGHALGTVRAANKLHVAMAHFGTTIVPSFLCRLGGPEKQIKLECYGDHYPCLLSFFKGGTNFCNSFQDVAFLLIYHHGWKRRYGMTKSSRLIPAPDMKSSIFPRSPSEITIWH

SEQ ID NO: 915713 - protein, 365 aa, Homo sapiens
PQFPHLPMRILKVVAASSDTLLVPNREFSKEPELMPKTPSQKNRRKKRRISYVQDENRDPIRRRKSRSSQLSSRRLRSKDSVEKLATVVGENGSVLRRVTRAAAAAAAATMALAAPSSPTPESPTMLTKKPEDNHTQCQLVPVVEIGISERQNAEQHVTQLMSTEPLPRTLSPTPASATAPTSQGIPTSDEESTPKKSKARILESITVSSLMATPQDPKGQGVGTGRSASKLRIAQVSPGPRDSPAFPDSPWRERVLAPILPDNFSTPTGSRTDSQSVRHSPIAPSSPSPQVLAQKYSLVAKQESVVRRASRRLAKKTAEEPAASGRIISRRCSCSHHLPKPGCYTQEGSWLPFSVPGLLSSLFS

SEQ ID NO: 915714 - protein, 217 aa, Homo sapiens
MGASLHSRPACALPECGAAMLRRLEDPQTPGDQRRCVHCAYFQCVQRESKPHMRKMLVYWMLEVCEEQCCEEEQCCKEEVFPLAMNHLHATCPTSPPTRKAQLQLLVAVSMRLASKLRKTGPMTIEKMCIYTDHAVSPCQLRDWEVMVLGKLKWDLAAVIAHDFLALILHRPTGLGQKACPDLFGCLQRKLTLWPPPEAHREHCQPTVDVHLGPKGS

SEQ ID NO: 915715 - protein, 139 aa, Homo sapiens
SGLGMATQAAAWLGGGAGQQPTHGRGAQSCYRETPAPALPAEPAKRSVRASQSPAHRRNRGPFEMHVPGPRPLAQGRQNSGGRGAAQLSPELRNSGKSVREPGLGSALRPPRWQRVRYGRPGTRGSGPGYGHLPPSPSR

SEQ ID NO: 915716 - protein, 179 aa, Homo sapiens
MRGQRSLLLGPARLCLRLLLLLGYRRRCPPLLRGLVQRWRYGKVCLRSLLYNSFGGSDTAVDAAFEPVYWLVDNVIRWFGVVFVVLVIVLTGSIVAIAYLCVLPLILRTYSVPRLCWHFFYSHWNLILIVFHYYQAITTPPGYPPQGRNDIATVSICKKCIYPKPARTHHCSICNRNQG

SEQ ID NO: 915717 - protein, 266 aa, Homo sapiens
MRGQRSLLLGPARLCLRLLLLLGYRRRCPPLLRGLVQRWRYGKVCLRSLLYNSFGGSDTAVDAAFEPVYWLVDNVIRWFGVVFVVLVIVLTGSIVAIAYLCVLPLILRTYSVPRLCWHFFYSHWNLILIVFHYYQAITTPPGYPPQGRNDIATVSICKKCIYPKPARTHHCSICNRCVLKMDHHCPWLNNCVGHYNHRYFFSFCFFMTLGCVYCSYGSWDLFREAYAAIETYHQTPPPTFSFRERMTHKSLVYLWFLCRYLFLIVL

SEQ ID NO: 915718 - protein, 477 aa, Homo sapiens
MPSVMEKPSAGSGILSRSRAKTVPNGGQPHSEDDSSEEEHSHDSMIRVGTNYQAVIPECKPESPARYSNKELKGMLVWSPNHCVSDAKLDKYIAMAKEKHGYNIEQALGMLLWHKHDVEKSLADLANFTPFPDEWTVEDKVLFEQAFGFHGKCFQRIQQMLPDKLIPSLVKYYYSWKKTRSRTSVMDRQARRLGGRKDKEDSDELEEGRGGVSEGEPDPADPKREPLPSRPLNARPGPGKKEVQVSQYRHHPLRTRRRPPKGMYLSPEGLTAVSGSPDLANLTLRGLDSQLISLKRQVQSMKQTNSSLRQALEGGIDPLRPPEANTKFNSRWTTDEQLLAVQGPDYIGLHVRAPISAPCATTPSTSHLAVPATPAAEATFAHGSHSAPTATPTAAGPLPPAPAGPQPAPTASHPPRSGCPPPQRPPWPSAPTHPDWNPSGAPSTLTLSPDVLHQPRAPGPLCWPSPGISGVTEDRRD

SEQ ID NO: 915719 - protein, 305 aa, Homo sapiens
VQGVHSGAERVEAASERRGPGKKEVQVSQYRHHPLRTRRRPPKGMYLSPEGLTAVSGSPDLANLTLRGLDSQLISLKRQVQSMKQTNSSLRQALEGGIDPLRPPEANTKFNSRWTTDEQLLAVQAIRRYGKDFGAIAEVIGNKTLTQVKTFFVSYRRRFNLEEVLQEWEAEQDGAPGAPVPMEEARRGAPLPAPALEEDDEVQITSVSTSVPRSVPPAPPPPPPPTSLSQPPPLLRPPLPTAPTLLRQPPPLQQGRFLQPRLAPNQPPPPLIRPALAAPRHSARPGPQPPPTLIGTPLEPPAPSL

SEQ ID NO: 915720 - protein, 484 aa, Homo sapiens
MPSVMEKPSAGSGILSRSRAKTVPNGGQPHSEDDSSEEEHSHVPPPGSTDSMIRVGTNYQAVIPECKPESPARYSNKELKGMLVWSPNHCVSDAKLDKYIAMAKEKHGYNIEQALGMLLWHKHDVEKSLADLANFTPFPDEWTVEDKVLFEQAFGFHGKCFQRIQQMLPDKLIPSLVKYYYSWKKTRSRTSVMDRQARRLGGRKDKEDSDELEEGRGGVSEGEPDPADPKREPLPSRPLNARPGPGKKEVQVSQYRHHPLRTRRRPPKGMYLSPEGLTAVSGSPDLANLTLRGLDSQLISLKRQVQSMKQTNSSLRQALEGGIDPLRPPEANTKFNSRWTTDEQLLAVQGPDYIGLHVRAPISAPCATTPSTSHLAVPATPAAEATFAHGSHSAPTATPTAAGPLPPAPAGPQPAPTASHPPRSGCPPPQRPPWPSAPTHPDWNPSGAPSTLTLSPDVLHQPRAPGPLCWPSPGISGVTEDRRD

SEQ ID NO: 915721 - protein, 262 aa, Homo sapiens
MPSVMEKPSAGSGILSRSRAKTVPNGGQPHSEDDSSEEEHSHDSMIRVGTNYQAVIPECKPESPARYSNKELKGMLVWSPNHCVSDAKLDKYIAMAKEKHGYNIEQALGMLLWHKHDVEKSLADLANFTPFPDEWTVEDKVLFEQAFGFHGKCFQRIQQMLPDKLIPSLVKYYYSWKKTRSRTSVMDRQARRLGGRKDKEDSDELEEGRGGVSEGEPDPADPKREPLPSRPLNARPASPPSRNLEKWGLGTYADMDLFFNIF

SEQ ID NO: 915722 - protein, 59 aa, Homo sapiens
WSLSGQAWVRSYNPLHQDPAPAAPAVDKYIAMAKEKHGYNIEQVSLGPQGLGNGVERCR

SEQ ID NO: 915723 - protein, 224 aa, Homo sapiens
MRGRRKASCFCRDWELSKGAEFNKPVGEPSTCTHILNITGVPRGVPDEFKTRNQIAVGFESALFWWSTTNKNVDWINYIYYNQQRFISYTRYTLKGVANQLDATSQMAWENRLALHKILAEKGGVCIMLDGKCCTLIPNNTAPDGTITNALQGLIVLVNELVENVGIDDPFTDWLENKCILILILIIIIGTKTGIDWALTTCREYAMSSAWSPDKIVVMSSDDI

SEQ ID NO: 915724 - protein, 224 aa, Homo sapiens; identical to SEQ ID NO: 915723

SEQ ID NO: 915725 - protein, 240 aa, Homo sapiens
SRGAAPVQAAAPPGASSGSMWRTREQLQAEVQRAQARIEDLEKALAEQGQDMKWIEEKQALYRRNQELVEKVMWHEAGAGLATGPGAGRPAGLSLPRTAQSPAKAPVLLACDVQPLLETFILDGLPSTSLSRGHPSSGPRYDRQAPGLWTNPNIPRAVRRFQGWVPGQPASPAASSCPIKQMETEEARLRHEVQDARDQNELLEFRILELEERERKSPAISFHHTPFVDGKSPLQVYCEA

SEQ ID NO: 915726 - protein, 153 aa, Homo sapiens
SRGAAPVQAAAPPGASSGSMWRTREQLQAEVQRAQARIEDLEKALAEQGQDMKWIEEKQALYRRNQELVEKIKQMETEEAQLWPAPQLVSSGSGVLPSSSPAALACWFLMNAPADSTSGLRTFPSTGTSPDVPVAPSWHLVLVPVLHSPSGPT

SEQ ID NO: 915727 - protein, 132 aa, Homo sapiens
SKVNVPADSMRAHPLHHMWPLLASSSLVGRGEQAPLGLLYEGTNPNHDSGALMTSSAPKGPTSYYPQGPERRPGGQGILGVIPVKDKRWRKQNWEEKPSAPDMNLTAAITARLDLCTSKEASLHPAQLGRSQ

SEQ ID NO: 915728 - protein, 166 aa, Homo sapiens
RPLIGGPMGSTSRPNTQTKSLWQLVNAFCSCRMAVLPPVLSLLSCLINSRVAGNFLEGAWQGEGTVVPTFQADSPLHLQTWGSPAIPTELLNRLLRAWQCSAQPLLILKRPQQAGSQKKGTANRLSHHECGTPSFNNLRQFFLGLNAPQSCDNVPEIQREQYDKIM

SEQ ID NO: 915729 - protein, 380 aa, Homo sapiens
MPSAPLALHASGTMEVSGHPQARRCCPEALGKLFPGLCFLCFLVTYALVGAVVFSAIEDGQVLVAADDGEFEKFLEELCRILNCSETVVEDRKQDLQGHLQKVKPQWFNRTTHWSFLSSLFFCCTVFSTVGYGYIYPVTRLGKYLCMLYALFGIPLMFLVLTDTGDILATILSTSYNRFRKFPFFTRPLLSKWCPKSLFKKKPDPKPADEAVPQIIISAEELPGPKLGTCPSRPSCSMELFERSHALEKQNTLQLPPQAMERSNSCPELVLGRLSYSIISNLDEVGQQVERLDIPLPIIALIVFAYISCAAAILPFWETQLDFENAFYFCFVTLTTIGFGDTVLEHPNFFLFFSIYIIVGMEIVFIAFNNLMDVPAFLEI

SEQ ID NO: 915730 - protein, 146 aa, Homo sapiens
GQSMRKLIAGLIFLKIWACTVRTSTDLPQTEGCSQCIHQVTEEIAAGAVECHAFVVPEQQSLQAPAADPLISAVQALHSLSLKGISFSIEEGELLCSCDPGEKGIPRFTFRTKIDPVENKTEERRRYAQQRGRHWLSLTNIADIPM

SEQ ID NO: 915731 - protein, 146 aa, Homo sapiens; identical to SEQ ID NO: 915730

SEQ ID NO: 915732 - protein, 193 aa, Homo sapiens
DHRAPLQCASSVCFLARLTERFVLGVDMFVETLWKVWTELLDVLGLDVSNLSQYFSPASVSSSPARALLLVGVVLLAYWFLSLTLGFTFSVLHVVFGRFFWIVRVVLFSMSCVYILHKYEGEPENAVLPLCFVVAVYFMTGPMGFYWRSSPSGPSNPSNPSVEEKLEHLEKQVRLLNIRLNRVLESLDRSKDK

SEQ ID NO: 915733 - protein, 252 aa, Homo sapiens
MVRAAPQAGPWPGPGSCCCCCCCCCSVLLAPGAQGARGRGGAEKNSYRRTVNTFSQSVSSLFGEDNVRAAQKFLARLTERFVLGVDMFVETLWKVWTELLDVLGLDVSNLSQYFSPASVSSSPARALLLVGVVLLAYWFLSLTLGFTFSVLHVVFGRFFWIVRVVLFSMSCVYILHKYEGEPENAVLPLCFVVAVYFMTGPMGFYWRSSPSGPSNPSNPSVEEKLEHLEKQVRLLNIRLNRVLESLDRSKDK

SEQ ID NO: 915734 - protein, 252 aa, Homo sapiens; identical to SEQ ID NO: 915733

SEQ ID NO: 915735 - protein, 210 aa, Homo sapiens
MVRAAPQAGPWPGPGSCCCCCCCCCSVLLAPGAQGARGRGGAEKNSYRRTVNTFSQSVSSLFGEDNVRAAQKFLARLTERFVLGVDMFVETLWKVWTELLDVLGLDALLHVVFGRFFWIVRVVLFSMSCVYILHKYEGEPENAVLPLCFVVAVYFMTGPMGFYWRSSPSGPSNPSNPSVEEKLEHLEKQVRLLNIRLNRVLESLDRSKDK

SEQ ID NO: 915736 - protein, 135 aa, Homo sapiens
MTTTVAEQRGTHSAESHSSYPVVLELDPSDLMRLKIYGFIKVKFLVTSNSNQSDQRNQPFQCEEYSHPFLLAGCEYWLPPQAPTTHPQALSQQCTKLSLPGHSSSWDVLLVGASHIFCTKRADVPEITSMPFKIQ

SEQ ID NO: 915737 - protein, 133 aa, Homo sapiens
MEKTVGMSQPRALAGRHHSVGIENIGFGLEFKEEERKRIARLVFNDFLVKLLQGRLRLFDVHGGRQMRNKVTFYMAAGKETVGGELPSIKPSDLMRLIHYHENSTGKIHPHDSITSHQVPPMTHGNYRSCNST

SEQ ID NO: 915738 - protein, 152 aa, Homo sapiens
YQLPQEEMLSRELGVLTQPENTQRGNSFSIQHLLKFGLFYQGPAKMGSLHTKTVKKVAWVIIEKYYMHPGNDFHMNKQVGEDCHYPQQEALQQDSRLSHASEEADSQGPNKSTQVLKLEKLHTPAEVHAICSGEEPVPVWRPGLQSVRRETC

SEQ ID NO: 915739 - protein, 169 aa, Homo sapiens
MTKSEKSLVRESTDFSLQTEENIPSFYDDFSGHLILTGSKMAAEVPAITLKLHPTERGKEEESALAHLFGDFLKNGNRDLKGCTTHYQLPIPRAIRFPGRKASDEFALQIENILSIATSPKDVYLNFSKAGFYMWMFLFKDQHSRFPAVSGVGAVVTKGLSQSHDGEEK

SEQ ID NO: 915740 - protein, 170 aa, Homo sapiens
AGTTEFTRTRSGSGSGSGSAVRRLENMSCVLKHSPEEAPYLCLRSHQGGSQLLLTLSKSAHKRFPSTLQKRPRRPVTSEIAVMAAKVLNVFAWIGLAPRASVMHHKKSIFWELLFLDTWCPEAPGTPSEAKPNQPAHKPVADTRESTRRCDVVWMFVPLKSHVDVILNPL

SEQ ID NO: 915741 - protein, 159 aa, Homo sapiens
KNWEQVKLIDVFASPSAMIISFLRPPHPYGTVSQFNLFIINYRVLEKDRKMWESLELPGDLKGSEDRKMWESLELPRDLLNGFDQNADSDKDNEVQDEIVSDRDEKLLGTWWPAFPLLRLQSCLRGANAQLESLLQRMQAQALAASTWSWPCVCAGDKN

SEQ ID NO: 915742 - protein, 228 aa, Homo sapiens
MTSYCKEDGHLLGGISQGLLLECDGFPWMAFHSGNRGIDFERNGLKSKPSGSHFHTTFADIDHLILGSSQEAKCRSCGALRGRSWSVEWLCADGSTCAPFSGPLSDFFPDKDLFISEESTSIIRKLGSSPQEVSGCKPRKRRVDAQTPSVCTKTSLPAAFTFLALDLGHIIDFTRSQAPPTAIQKKARVHVESPLCHMMICLRQSLHCSRARQEFKTSLANMVKPHLY

SEQ ID NO: 915743 - protein, 194 aa, Homo sapiens
NSIFPKREFMLDPTHYLDLKSCSMAPFGEDSPHYTTFYPGYPGAQYTLFYPFWTPTDIHPYQPRGLQQCNAGCTQQCVQVLSTLDHSELEKGKEEELVNRKQMVGYAIMTVEEFHVSLSNSSDLLCFCSVILSERPDGWFPEKGTQNPIKQELISREVLGNAIRTGSRGGKHSVVEEKAWDGIWVPNLNFIGNS

SEQ ID NO: 915744 - protein, 135 aa, Homo sapiens
MAHSESTGDSSFPEFMGCPGPDFGFGMTCQYRSDFLTIGGFDMEVKGWGGEDVHLYRKYLHGDLIVIRTPVSGLFHLWHEKRCADELTPEQYRMCIQSKAMNEASHSHLGMLVFREEIETHLHKQAYRTNSEAVG

SEQ ID NO: 915745 - protein, 202 aa, Homo sapiens
QLWVSCGLSATLLAIPGLRSSSHHHHHHLILITIITIIMALSSSSPDPHHHHYHHHHIITIITSSSSPSSPSSHYHHHHIIIFISLSLPSSSHHHHYHYIIITSSLSHYHHHIMIITIIISSSSYHYHHHHIITSPLSSNHHHHTITVIITSASSSYYRHHHVIIITTIIISSSQQAIQNPAECSTGNPSSSLTTREEHPES

SEQ ID NO: 915746 - protein, 134 aa, Homo sapiens
MLPVDPVKENFMFLKGKLFSIAFPTPFKSRVPLVAVSKEVLEDILDLDLSVSETDDFIQLVSGEKTVFGSIPLAHPYGGQQRCPVFTVTDIKPALSVCQKCYYFHMAVDTGPIISDIEMPLTIHYLLELYLAKI

SEQ ID NO: 915747 - protein, 138 aa, Homo sapiens
MRLPVIQVLLDYGSNQLTWRTQTNLPLKAITEDKEDLGFELSNFCGMNLGMALFSEISSCTGRSPQEPEPPINKWLGGRGPLLGIVRCAATQTVDKGMLGVLKEASSQVCSSPPLNSLRDGREEKMAPRGIQLLPNKS

SEQ ID NO: 915748 - protein, 181 aa, Homo sapiens
NPTRAGPEHEVGRHMPSQAHVWVYIPQGACREENGKAQTTPCLRKSKDALQWNSTYQCILGQKEKGREEKADGGHNINNGHSLRACDELAMVLGPRECKAGEKTKTGTNLRVSCIVQIFQDYWGTNAEHLVLKDFHCSGQLHFGRVELKISGPPAHRVMRIKGETTYEGVQQMSGMTFILF

SEQ ID NO: 915749 - protein, 120 aa, Homo sapiens
LLRPRGSAQTAGRRRPRSPRRWRVKACFQSIPRRSAKIRHLEFRPAKTTDALSQLGYLHFSFLQFPCFRGKTQDLDNCNHLVTNHESGMDHFHPAPCQAVSIFSQSSQESYRNKTYPPIY

SEQ ID NO: 915750 - protein, 137 aa, Homo sapiens
MLWEVRDPEWRDRLELRQRNINSPGHMAPLTYHSAHWEWWLWWGLKEANINFKERCFVHPSCPVDSPEDSGGKWPTSAALALKDMCQTWFWRFLIGWAGPIYSLTRKKPWVGQGSAKMPAGVTWKLCVTALNESVQN

SEQ ID NO: 915751 - protein, 1245 aa, Homo sapiens
MSKQDRNQRPSSMVSETSTAGTASTLEAKPGPKIIKSSSKVHSFGKRDQAIRRNPNVPVVVRGWLHKQDSSGMRLWKRRWFVLADYCLFYYKDSREEAVLGSIPLPSYVISPVAPEDRISRKYSFKAVHTGMRALIYNSSTAGSQAEQSGMRTYYFSADTQEDMNAWVRAMNQAAQVLSRSSLKRDMEKVERQAVPQANHTESCHECGRVGPGHTRDCPHRGHDDIVNFERQEQEGEQYRSQRDPLEGKRDRSKARSPYSPAEEDALFMDLPTGPRGQQAQPQRAEKNGMLPASYGPGEQNGTGGYQRAFPPRTNPEKHSQRKSNLAQVEHWARAQKGDSRSLPLDQTLPRQGPGQSLSFPENYQTLPKSTRHPSGGSSPPPRNLPSDYKYAQDRASHLKMSSEERRAHRDGTVWQLYEWQQRQQFRHGSPTAPICLGSPEFTDQGRSRSMLEVPRSISVPPSPSDIPPPGPPRVFPPRRPHTPAERVTVKPPDQRRSVDISLGDSPRRARGHAVKNSSHVDRRSMPSMGYMTHTVSAPSLHGKSADDTYLQLKKDLEYLDLKMTGRDLLKDRSLKPVKIAESDTDVKLSIFCEQDRVLQDLEDKIRALKENKDQLESVLEVLHRQMEQYRDQPQHLEKIAYQQKLLQEDLVHIRAELSRESTEMENAWNEYLKLENDVEQLKQTLQEQHRRAFFFQEKSQIQKDLWRIEDVTAGLSANKENFRILVESVKNPERKTVPLFPHPPVPSLSTSESKPPPQPSPPTSPVRTPLEVRLFPQLQTYVPYRPHPPQLRKVTSPLQSPTKAKPKVTVRTGRALEDDLTQLSHFAVGKTEAHQEEVSVLSRVEFVICREVCGCGRSCPHANLCANPQGALLQLHSLWAIFANKGLEETYLGIVCAWTSDEVSAQCWVKHMSSAALVFTIYLLPAIVQGPELDPGYGPAPSQRVTVDFSILRSPSQSQIQEVDWSSSPKTGEGKFQNKQQECLGQMAANIGQNAASWDRALCPCSGPHLAEGARARVGPMSRLRLSTAEWVDVTLQQEDEAPPRPPLPELYSPEDQPPAVPPLPREATIIRHTSVRGLKRQSDERKRDRELGQCVNGDSRVELRSYVSEPELATLSGDMAQPSLGLVGPESRYQTLPGRGLSGSTSRLQQSSTIAPYVTLRRGLNAESSKATFPRPKSALERLYSGDHQRGKMSAEEQLERMKRHQKALVRERKRTLGQGERTGLPSSRYLSRPLPGDLGSVC

SEQ ID NO: 915752 - protein, 969 aa, Homo sapiens
CDSRVKHRRKLNGMLPASYGPGEQNGTGGYQRAFPPRTNPEKHSQRKSNLAQVEHWARAQKGDSRSLPLDQTLPRQGPGQSLSFPENYQTLPKSTRHPSGGSSPPPRNLPSDYKYAQDRASHLKMSSEERRAHRDGTVWQLYEWQQRQQFRHGSPTAPICLGSPEFTDQGRSRSMLEVPRSISVPPSPSDIPPPGPPRVFPPRRPHTPAERVTVKPPDQRRSVDISLGDSPRRARGHAVKNSSHVDRRSMPSMGYMTHTVSAPSLHGKSADDTYLQLKKDLEYLDLKMTGRDLLKDRSLKPVKIAESDTDVKLSIFCEQDRVLQDLEDKIRALKENKDQLESVLEVLHRQMEQYRDQPQHLEKIAYQQKLLQEDLVHIRAELSRESTEMENAWNEYLKLENDVEQLKQTLQEQHRRAFFFQEKSQIQKDLWRIEDVTAGLSANKENFRILVESVKNPERKTVPLFPHPPVPSLSTSESKPPPQPSPPTSPVRTPLEVRLFPQLQTYVPYRPHPPQLRKVTSPLQSPTKAKPKVTVRTGRALEDDLTQLSHFAVGKTEAHQEEVSVLSRVEFVICREVCGCGRSCPHANLCANPQGALLQLHSLWAIFANKGLEETYLGIVCAWTSDEVSAQCWVKHMSSAALVFTIYLLPAIVQGPELDPGYGPAPSQRVTVDFSILRSPSQSQIQEVDWSSSPKTGEGKFQNKQQECLGQMAANIGQNAASWDRALCPCSGPHLAEGARARVGPMSRLRLSTAEWVDVTLQQEDEAPPRPPLPELYSPEDQPPAVPPLPREATIIRHTSVRGLKRQSDERKRDRELGQCVNGDSRVELRSYVSEPELATLSGDMAQPSLGLVGPESRYQTLPGRGLSGSTSRLQQSSTIAPYVTLRRGLNAESSKATFPRPKSALERLYSGDHQRGKMSAEEQLERMKRHQKALVRERKRTLGQGERTGLPSSRYLSRPLPGDLGSVC

SEQ ID NO: 915753 - protein, 1202 aa, Homo sapiens
GFTEEGASYFIEPNPHMSKQDRNQRPSSMVSETSTAGTASTLEAKPGPKIIKSSSKVHSFGKRDQAIRRNPNVPVVVRGWLHKQDSSGMRLWKRRWFVLADYCLFYYKDSREEAVLGSIPLPSYVISPVAPEDRISRKYSFKGYGEGGAEAVPQANHTESCHECGRVGPGHTRDCPHRGHDDIVNFERQEQEGEQYRSQRDPLEGKRDRSKARSPYSPAEEDALFMDLPTGPRGQQAQPQRAEKNGMLPASYGPGEQNGTGGYQRAFPPRTNPEKHSQRKSNLAQVEHWARAQKGDSRSLPLDQTLPRQGPGQSLSFPENYQTLPKSTRHPSGGSSPPPRNLPSDYKYAQDRASHLKMSSEERRAHRDGTVWQLYEWQQRQQFRHGSPTAPICLGSPEFTDQGRSRSMLEVPRSISVPPSPSDIPPPGPPRVFPPRRPHTPAERVTVKPPDQRRSVDISLGDSPRRARGHAVKNSSHVDRRSMPSMGYMTHTVSAPSLHGKSADDTYLQLKKDLEYLDLKMTGRDLLKDRSLKPVKIAESDTDVKLSIFCEQDRVLQDLEDKIRALKENKDQLESVLEVLHRQMEQYRDQPQHLEKIAYQQKLLQEDLVHIRAELSRESTEMENAWNEYLKLENDVEQLKQTLQEQHRRAFFFQEKSQIQKDLWRIEDVTAGLSANKENFRILVESVKNPERKTVPLFPHPPVPSLSTSESKPPPQPSPPTSPVRTPLEVRLFPQLQTYVPYRPHPPQLRKVTSPLQSPTKAKPKVTVRTGRALEDDLTQLSHFAVGKTEAHQEEVSVLSRVEFVICREVCGCGRSCPHANLCANPQGALLQLHSLWAIFANKGLEETYLGIVCAWTSDEVSAQCWVKHMSSAALVFTIYLLPAIVQGPELDPGYGPAPSQRVTVDFSILRSPSQSQIQEVDWSSSPKTGEGKFQNKQQECLGQMAANIGQNAASWDRALCPCSGPHLAEGARARVGPMSRLRLSTAEWVDVTLQQEDEAPPRPPLPELYSPEDQPPAVPPLPREATIIRHTSVRGLKRQSDERKRDRELGQCVNGDSRVELRSYVSEPELATLSGDMAQPSLGLVGPESRYQTLPGRGLSGSTSRLQQSSTIAPYVTLRRGLNAESSKATFPRPKSALERLYSGDHQRGKMSAEEQLERMKRHQKALVRERKRTLGQGERTGLPSSRYLSRPLPGDLGSVC

SEQ ID NO: 915754 - protein, 99 aa, Homo sapiens
GFTEEGASYFIEPNPHMSKQDRNQRPSSMVSETSTAGTASTLEAKPGPKIIKSSSKVHSFGKRDQAIRRNPNVPVVVRGWLHKQVRKPRSENPGGNGSG

SEQ ID NO: 915755 - protein, 163 aa, Homo sapiens
FLVQLKFSDPNNVPMVNKLLQLELNDEFIGNYTTDENGEAQFSIDTSDIFDPEFNLKATYVRPKSCYLPSWLTPQYLDAHFLVSRFYSRTNSFLKIVPEPKQLECNHQKVVTVHYSLNSEAYEDDSNVKFFYLMMVKGAILLSGQKEIRNKGIHNVFILKYVL

SEQ ID NO: 915756 - protein, 282 aa, Homo sapiens
MPYLAPLQHTGAPGPWQSCLRSLDPISKRGARPNLLSPHQGHPTPRGPGYPRTSRGVAETLAAECRPGCGPAGPGRGLRPGRGQGWALPELRRSRPARASPPPPVTWIPRFLRGGGGRKGHAQIKVCGPGKLQVLKSVHQGYFKARGRGCVIIYPVRPCTPASLAYTNTCLLGLSNRSHGSPNDVNIRTSEPPPEKYLRGEACAAPGRGCGRKPEVGSKARRLHGSCHPRCALSPMLAASIRQKLAQQTRQPQTCGPFLPSSPPRQPLKALEYEVIIAIIIS

SEQ ID NO: 915757 - protein, 282 aa, Homo sapiens; identical to SEQ ID NO: 915756

SEQ ID NO: 915758 - protein, 167 aa, Homo sapiens
MMLKLLKPNLPRAVSGIHRTLFPPLLNQTGQAPKQWSLALLPPPPRGSQKGSKHRTLSWPCLGLALGDSVFRAPLLLCARAFAFAGCPLIDVRAAGRLRRSPVRALPGAGFGAHATGQRGIQKLYIHFMFLKITHIFKLARVIEKFPKICTLSKPYFSNDFVDRAAF

SEQ ID NO: 915759 - protein, 345 aa, Homo sapiens
GKDILTGKGAKMGYRGCWVTFKSSSYEDLGKIPWVVVMSHEFPYIWRHFRGDGNLGRTRLIQNWWTRRKVRQEHGPERKISFPQWEKDYNLQPMNAYGLFDEYLEMILQFGFTTIFVAAFPLAPLLALLNNIIEIRLDAYKFVTQWRRPLASRAKDIGIWYGILEGIGILSVITNAFVIAITSDFIPRLVYAYKYGPCAGQGEAGQKCMVGYVNASLSVFRISDFENRSEPESDGSEFSGTPLKYCRYRDYRDPPHSLVPYGYTLQFWHVLAARLAFIIVFEHLVFCIKHLISYLIPDLPKDLRDRMRREKYLIQEMMYEAELERLQKERKERKKNGKAHHNEWP

SEQ ID NO: 915760 - protein, 175 aa, Homo sapiens
PSGLGVAMNLRFFPGVFYSSSVSVRLSAPTPDIFLQLHPPLPESTDTHPPTRLFPSPPPSVSGRVSPSNRQEPKRLSTDSSAPFPVVYSCTVRSTSQVQGHQLRHLSRDRTILICPEKDIPLIILNLWMDTYLLTRPSLFNENCLSFHSICEAPLDADMCLHRTSCPQPELARIH

SEQ ID NO: 915761 - protein, 146 aa, Homo sapiens
MTLTKGSFTYSSGEEYRGEWKEGRRHGFGQLMFADGGTYLGHFENGLFNGFGVLTFSDGSRYEGEFAQGKFNGVGVFIRYDNMTFEGEFKNGRVDGFGLLTFPDGSHGIPRNEGLFENNKLLRREKCSAIVQRAQSASKSARNLTA

SEQ ID NO: 915762 - protein, 146 aa, Homo sapiens; identical to SEQ ID NO: 915761

SEQ ID NO: 915763 - protein, 113 aa, Homo sapiens
MAWSRAGPMRSGVAPGCLGNSQWAAGIVPSAVAQDGGVKWGNRWWRWRRARWQPGAHQRKSPRRWNPASRRDGHPERPAPVSSFYPVICHHDPDKRFLHLLQWGGISWRVEGG

SEQ ID NO: 915764 - protein, 146 aa, Homo sapiens; identical to SEQ ID NO: 915761

SEQ ID NO: 915765 - protein, 146 aa, Homo sapiens; identical to SEQ ID NO: 915761

SEQ ID NO: 915766 - protein, 204 aa, Homo sapiens
MAWSRAGPMRSGVAPGCLGNSQWAAGIVPSAVAQDGGVKWGNRWWRWRRARWQPGAHQRKSPRRWNPASRRDGHPERPAPGRRHGFGQLMFADGGTYLGHFENGLFNGFGVLTFSDGSRYEGEFAQGKFNGVGVFIRYDNMTFEGEFKNGRVDGFGLLTFPDGSHGIPRNEGLFENNKLLRREKCSAIVQRAQSASKSARNLTA

SEQ ID NO: 915767 - protein, 245 aa, Homo sapiens
MSCIRDNQAAVGAATLLSLSEGRELSACAASAACLVAGLPGMVTARAPSWPKKSSKAFGARALSSFLNRNKDRGRARWLTPVIPAFWEVEADGLLEVMSSRPAWPTRWSLAPMLECSGVISADCNLRLPGSSDSPASASGVAGITAKISRRCMQEELNFRGHRLIFNTWQFTKQRRGVAMLPRLVSNSGAQAICLPRPFKVLRLQPEEERGNPGEKHLEFKLREEDTESQLRTQTGRRKIIFPSL

SEQ ID NO: 915768 - protein, 146 aa, Homo sapiens
MLEFYLLHGKSASAFTFYYNNLCTHIIMPTIFESIFTFPVPDRVLFTWKLLSKFLSHQVDNNAPLQNPHQFKPLQPVCCCCSSVPAQEPHGTLFCNFSGTSTHLPTFYFPPIQVFAETWALVGSAFCSPGSETGLPMVLPRLVLNS

SEQ ID NO: 915769 - protein, 248 aa, Homo sapiens
MPGPIAGAWTGLGMERGLGTEGQLLAKNRTHRETSSRILFILLFPTHSLVLMGSVPNICHPGKEGPWPKIPLGTMGPQVAGIPSLLRRMGHKSPSQARGKAAIQESFTEVAGRDVGRRQTIDSQAALGLHSEVCGWGSCWGLQLVSVPEPNGCVSPQPPSGSCYMCHPITKVLVTSYPLSPELLLPQPLEGGLTSLREEMMVLTNLSPKRRRNQKGDSRQVWMPGMERSEMVTEFSEFQSFFEQRKPG

SEQ ID NO: 915770 - protein, 248 aa, Homo sapiens; identical to SEQ ID NO: 915769

SEQ ID NO: 915771 - protein, 160 aa, Homo sapiens
GCIRPVILGVISTSRPLNMRKNITGWVYTSCSIMRSRICLLWGVISFSPFQDINNNFTGWVNTAGDAEIIIILSPSSPPGSQSPPHGLCSGLWQEDKLQFPAQNSTNNDPSSVTTQYWSSFDHGLQYQPLETFLKQVSKTPRSNILNDRKISLLVQIVST

SEQ ID NO: 915772 - protein, 285 aa, Homo sapiens
MSRPGGAVTFEHVRWTVVCQEVRGEGLAGESRLDSPALGAPRGKGTRQRGRGQRRPDEPEGSEVSPSTRQPAGMPLGQGCMSRVLLGHLSAPTALEAKPQPTSSCRQHWLQASSCSHGLLTKGYTGQWQEAAGVGDDHDDDGGGGDDDDDDDSGGGGGDYVLQSFDRTFLIQGRVGILPCLACGNLGGGPRERVANFQAQRNQAFRGGFAEKSCTRPFGSSSRTFLHQSFAKLHSVQLSLHPPGRAQGPIEVVSEQTKLLSPLLLPPHGGEFSSVKHTSSKVLLS

SEQ ID NO: 915773 - protein, 191 aa, Homo sapiens
GARATERGSARTGSSSAAGLESAGHVLASVRLVQRMALWGKDWVRELCQGRARRDAGSHSPRRAHGVRGLGCGDGLEGSEGSEGAAAAAATASSAGAAGAVRSWRLRKSCRARRFWKSMSASAMAAFQQLSPAQRKSISLWSVVTMVKYTYLPVRSTQSTLRMEWKRSSLGRARGLAGNRLRRSEMLMAAA

SEQ ID NO: 915774 - protein, 663 aa, Homo sapiens
PAVSSQVPAHTRKMLCKRRSLSLCWIQYRAAAVHELSLLLFFPCAFPTDASQGSTSFPKVSNNCDSIFVNGKEMKSKVDTIVNFTHQHFTSQFEVTVWAPRLPLQIEISDTELSQIKGWRIPVAANRRPTRESDDEDDEEKKGRGCSLQYQHATVRVLTQFVAESPDLGQLTYMLGPDWQFDITDLVTEFMKVEEPKIAQLQDGRTLAGREPGITTVQVLSPLSDSILAEKTVIVLDDRVTIAELGVQLVAGMSLSLQPHRADKRAIVSTAAALDVLQSPQQEAIVSSWILFSDGSVTPLDIYDPKDYSVTVSSLDEMVVSVQANLESKWPIVVAEGEGQGPLIKLEMMISEPCQKTKRKSVLAVGKGNVKVKFEPSSDEHQGGSNDIEGINREYKDHLSNSIEREGNQERAVQEWFHRGTPVGQEESTNKSTTPQSPMEGKNKLLKSGGPDAFTSFPTQGKSPDPNNPSDLTVTSRGLTDLEIGMYALLCVFCLAILVFLINCVAFAWKYRHKRFAVSEQGNIPHSHDWVWLGNEVELLENPVDITLPSEECTTMIDRGLQFEERNFLLNGSSQKTFHSQLLRPSDYVYEKEIKNEPMNSSGPKRKRVKFTSYTTILPEDGGPYTNSILFDSDDNIKWVCQDMGLGDSQDFRDYMESLQDQM

SEQ ID NO: 915775 - protein, 516 aa, Homo sapiens
HARCRLPGRRETMPQTSVVFSSILGPSCSGQVQPGMGERGGGAGGGSGDLIFQDGHLISGSLEALMEHLVPTVDYYPDRTYIFTFLLSSRVFMPPHDLLARVGQICVEQKQQLEAGPEKAKLKSFSAKIVQLLKEWTEAFPYDFQDEKAMAELKAITHRVTQCDEENGTVKKAIAQMTQSLLLSLAARSQLQELREKLRPPAVDKGPILKTKPPAAQKDILGVCCDPLVLAQQLTHIELDRVSSIYPEDLMQIVSHMDSLDNHRCRGDLTKTYSLEAYDNWFNCLSMLVATEVCRVVKKKHRTRMLEFFIDVARECFNIGNFNSMMAIISGMNLSPVARLKKTWSKVKTAKFDVLERGIWSRSEGHGAVMLTRSSLCPQHHMDPSSNFCNYRTALQGATQRSQMANSSREKIVIPVFNLFVKDIYFLHKIHTNHLPNGHINFKKFWEISRQIHEFMTWTQVECPFEKDKKIQSYLLTAPIYSEEALFVASFESEGPENHMEKDSWKTLRTTLLNRA

SEQ ID NO: 915776 - protein, 532 aa, Homo sapiens
RGGGRALLGARLRREGGAGATLARTEETMPQTSVVFSSILGPSCSGQVQPGMGERGGGAGGGSGDLIFQDGHLISGSLEALMEHLVPTVDYYPDRTYIFTFLLSSRVFMPPHDLLARVGQICVEQKQQLEAGPEKAKLKSFSAKIVQLLKEWTEAFPYDFQDEKAMAELKAITHRVTQCDEENGTVKKAIAQMTQSLLLSLAARSQLQELREKLRPPAVDKGPILKTKPPAAQKDILGVCCDPLVLAQQLTHIELDRVSSIYPEDLMQIVSHMDSLDNHRCRGDLTKTYSLEAYDNWFNCLSMLVATEVCRVVKKKHRTRMLEFFIDVARECFNIGNFNSMMAIISGMNLSPVARLKKTWSKVKTAKFDVLERGIWSRSEGHGAVMLTRSSLCPQHHMDPSSNFCNYRTALQGATQRSQMANSSREKIVIPVFNLFVKDIYFLHKIHTNHLPNGHINFKKFWEISRQIHEFMTWTQVECPFEKDKKIQSYLLTAPIYSEEALFVASFESEGPENHMEKDSWKTLRTTLLNRA

SEQ ID NO: 915777 - protein, 179 aa, Homo sapiens
MWEACTICHLVPYSALWGLTLYPLLPQAKLKSFSAKIVQLLKEWTEAFPYDFQDEKAMAELKAITHRVTQCDEENGTVKKAIAQMTQSLLLSLAARSQLQELREKLRPPAVDKGPILKTKPPAAQKDILGVCCDPLVLAQQLTHIELDRVSSIYPEDLMQIVSHMDSLDNHRPRGPDKN

SEQ ID NO: 915778 - protein, 146 aa, Homo sapiens
MAKMLFADKVPKTAENFRALSTGEKGFGYKGSCFHRIIPGFMCQGGDFTRHNGTGGKSIYGEKFEDENFILKHTGPGILSMANAGPNTNGSQFFICTAKTEWLDGKHVVFGKVKEGMNIVEAMERFGSRNGKTSKKITIADCGQLE

SEQ ID NO: 915779 - protein, 98 aa, Homo sapiens
RGPGCNFTRQDPQLSYSTDQHHEASHGPGILSMANAGPNTNGSQFFICTAKTEWLDGKHVVFGKVKEGMNIVEAMERFGSRNGKTSKKITIADCGQLE

SEQ ID NO: 915780 - protein, 165 aa, Homo sapiens; identical to SEQ ID NO: 879533

SEQ ID NO: 915781 - protein, 258 aa, Homo sapiens
MEGVLEAMFEGSIRHFFFRLSFSRPLQTMAIPVALVRRNDGLCMNFVEHGLVFTNAEESPFGLAPESLRPCCLSEKAAGPAATAGSQDGPSGAGLPRFGGPSCYTLCLGPGCVAFSDPQDWEGAWSTCPLEPWGRSVLEALISTSSLGALPRFGETRPGGGSSGPLADTVRAGGRGRGRLRAGVVPLAGAWAGRADPGEGEPRGRSDRLGVLAAAAHASQGLQAWAPGLDQSPGHGTPWLFCTRDLWRGKTLSWVTPR

SEQ ID NO: 915782 - protein, 258 aa, Homo sapiens; identical to SEQ ID NO: 915781

SEQ ID NO: 915783 - protein, 60 aa, Homo sapiens
MHELCRTWPCLHQRGGEPVRFQRGCCLISSLKEEEGEQVPSRSLVSAENSPRKKKMIGYR

SEQ ID NO: 915784 - protein, 258 aa, Homo sapiens; identical to SEQ ID NO: 915781

SEQ ID NO: 915785 - protein, 258 aa, Homo sapiens; identical to SEQ ID NO: 915781

SEQ ID NO: 915786 - protein, 117 aa, Homo sapiens
MTCVEQDKLGQAFEDAFEVLRQHSTGDLQYSPDYRNYLALINHRPHVKGNSSCYGVLPTEEPVYNWRTVIVGVQWCDYSSLKLQIPGVKGSSCLSFPSSWDYRHVPPGLEQCCGLLF

SEQ ID NO: 915787 - protein, 248 aa, Homo sapiens
MTCVEQDKLGQAFEDAFEVLRQHSTGDLQYSPDYRNYLALINHRPHVKGNSSCYGVLPTEEPVYNWRTVINSAADFYFEGNIHQSLQNITENQLVQPTLLQQKGGKGRKKLRLFEYLHESLYNPEMASCIQWVDKTKGIFQFVSKNKEKLAELWGKRKGNRKTMTYQKMARALRNYGRSGEITKIRRKLTYQFSEAILQRLSPSYFLGKEIFYSQCVQPDQEYLSLNNWNANYNYTYANYHELNHHDC

SEQ ID NO: 915788 - protein, 151 aa, Homo sapiens
MTTELGSFVFSRNGKGLRLVGHEIYMLKSKGEKCLADKAKTSHLGVTQMFPEDGRRVKNPTGSPLPGGEGAGAHCCHGMGTHPSQWAKESSKPSEDSCHWFLAAVTPQGKRQRATRSQLRKPCGQLRQGCGLKPKQVLVIVVPTDEETEPP

SEQ ID NO: 915789 - protein, 151 aa, Homo sapiens; identical to SEQ ID NO: 915788

SEQ ID NO: 915790 - protein, 141 aa, Homo sapiens
QQKTNWGLLKALTLIMGNLNNIWEHLEKSGQVKEVGGLKQLTAMQPKYMFPTEGELLPTIHVTIFPGPSSLQSLFGGLFTRTCMRFGAVTQIGGPPLGRSIRCPPVLCSMRKIHLRPRVLRLISPRNSSHQFQIGSPRLSG

SEQ ID NO: 915791 - protein, 141 aa, Homo sapiens
MAIHVDTKRARKYSLAVHLCAQEDKENKSGRKWQQPSLIKRPIWNQSPHYLYPTYNTRTHSIPLPNSCVSLAICRPRKTEENTTTSRWEAIKQQTGKSCPSFLSSFAVLLSSPLLEDPTTEQPGEAKMKFGRVLTTPSQRE

SEQ ID NO: 915792 - protein, 538 aa, Homo sapiens
MVKCPWFTFTCMWDQCGKVLFMWEGGPQITKNSPLPPSLKTSCASRPLSSHSAAKLLDKNPFSVSNPNPLLPSPASLQLAQLQAQLTLHRLKLAQTAVTNNTAAATVLNQVLSKVAMSQPLFNQLRHPSVITGPHGHAGVPQHAAAIPSTRFPSNAIAFSPPSQTRGPGPSMNLPNQPPSAMVMHPFTGVMPQTPGQPAVILGIGKTGPAPATAGFYEYGKASSGQTYGPETDGQPGFLPSSASTSGSVTYEGHYSHTGQDGQAAFSKDFYGPNSQGSHVASGFPAEQAGGLKSEVGPLLQGTNSQWESPHGFSGQSKPDLTAGPMWPPPHNQPYELYDPEEPTSDRTPPSFGGRLNNSKQGFIGAGRRAKEDQALLSVRPLQAHELNDFHGVAPLHLPHICSICDKKVFDLKDWELHVKGKLHAQKCLVFSENAGIRCILGSAEGTLCASPNSTAVYNPAGNEGEQGPTGQQLEAEVGYPQAHYVLSLITRTSLMSPSHGCRKQTDPKTLKCIGPAVWAHQYSLRYLRLESWLAFEV

SEQ ID NO: 915793 - protein, 145 aa, Homo sapiens
VLQSQPEVLMSTSMQTAKVQAAIYRSRGTLNTLSPNASYKWIQLRVRREKPSCSSEIHEVEVVVAPDPTALEPAQSNLGASEVPDCSTLATRRHTKLCRCRGKEGPSDLRRAEVPHGDHADLSHVHQGQPHSGPSQGFCRAVLRL

SEQ ID NO: 915794 - protein, 168 aa, Homo sapiens
MSQALCQKDKLKGPINGTTQPNGQMPQAADSVSAVLEEAQAHAETWKDKKPALGNHQEPGAPPAPQGPKSSLPHPLRCRGPVTPVAAPPHPPRPRAQAAWSSPPRPTTSCRHSHQCRPWSTQSSRCRPRTSWRPPWTSCSLPSLSPRGLLCPTPPTGTKHQCSQAANE

SEQ ID NO: 915795 - protein, 168 aa, Homo sapiens
MEGKTSKQLAYIPPSRPPGELLELRSSRPAWATEQGLISTRNQKISQDKKPALGNHQEPGAPPAPQGPKSSLPHPLRCRGPVTPVAAPPHPPRPRAQAAWSSPPRPTTSCRHSHQCRPWSTQSSRCRPRTSWRPPWTSCSLPSLSPRGLLCPTPPTGTKHQCSQAANE

SEQ ID NO: 915796 - protein, 168 aa, Homo sapiens; identical to SEQ ID NO: 915794

SEQ ID NO: 915797 - protein, 119 aa, Homo sapiens
MSVQTAQTQPAIYRSRVALNTLSHNANHKWGQLRVWWEKPSCSSEIHKVEIAVAPTPLLWRLPSRIWEPARDLTAAHWTPEDTQPPWTSCSLPSLSPRGLLCPTPPTGTKHQCSQAANE

SEQ ID NO: 915798 - protein, 145 aa, Homo sapiens; identical to SEQ ID NO: 915793

SEQ ID NO: 915799 - protein, 484 aa, Homo sapiens
MDTPRGIGTFVVWDYVVFAGMLVISAAIGIYYAFAGGGQQTSKDFLMGGRRMTAVPVALSLTASFMSAVTVLGTPSEVYRFGAIFSIFAFTYFFVVVISAEVFLPVFYKLGITSTYEYLELRFNKCVRLCGTVLFIVQTILYTGIVIYAPALALNQVTGFDLWGAVVATGVVCTFYCTLGGLKAVIWTDVFQIGIMVAGFASVIIQAVVMQGGISTILNDAYDGGRLNFWKYHDCDPWTAKKVSAPDQLMPYLVLDILQDYPGLPGLFVACAYSGTLSTVSSSINALAAVTVEDLIKPYFRSLSERSLSWISQGMSVVYGALCIGMAALASLMGALLQAALSVFGMVGGPLMGLFALGILVPFANSIGALVGLMAGFAISLWVGIGAQIYPPLPERTLPLHLDIQGCNSTYNETNLITTTEMPFTTSVFQIYNVQRTPLMDNWYSLSYLYFSTVGTLVTLLVGILVSLSTGQLFEYQMKQLACV

SEQ ID NO: 915800 - protein, 450 aa, Homo sapiens
GCTSTKLQISAHLIMAIITMTVGTSCLSGPFYTKLFFQETDQMGNNSMEFKRLGDLHIWRHQGGLAVNYLAGKQCEDEEDSKSLDPGALRETAGDGEEDEGDEDRLDNAVRGPGPKGPVGTVSEAQLARRLTKVKNSRRMLSNKPQDFQWTYSNGQWLNRPALNDFIPTAALGLYNPTPVPILGMTLGGSTQLVAPGIAQSCPGLVLAILIGEGNEATPEDPKDPTCWERLGNHPPSVLQIRVRVIEGRQLSGNNIRPVVKVHVCGQTHRTRIKRGNNPFFDELFFYNVNMTPSELMDEIISIRVYNSHSLRADCLMGEFKIDVGFVYDEPGHAVMRKWLLLNDPEDTSSGSKGYMKVSMFVLGTGDEPPPERRDRDNDSDDVESNLLLPAGIALRWVTFLLKIYRAEDIPQMDDAFSQTVKEIFGGNADKKNLVDPFVEVSFAGKKVCT

SEQ ID NO: 915801 - protein, 379 aa, Homo sapiens
MHLTHSLKACQFFTKRQCIHLLWLPRQSTQDQAAWTTDTDCPTVLEAGAGDQDPASDESPQLCLLPVRAPAGPLLARYPSAPAPARRGATAGRVQSLMGQPNPRGGQGQLQAAKAGEQGPPGRTARARLAPTMQAKAHGGRVSPMPSCIGCIVSPRFMRQSPDPQDVHVVAFGDGQPREEAGRGGVCRPTTEAPGEPCGAVVSTFPTVRAAPSRRCPALGVLLSSDGKNAQCHPQRLTSLQGRLHPAVKQGQGAGPGMWGPGSGTHAWDSCASGEPGGPKAPGRAPDCLHGPAAPWAALGPWVWVWGQIQVHLCCECLCCPNEREDGLRAQRGPCGVSVGLKVLQHPSSSVEGSGRGEGRREPAAMEGTAPRPWYAAGA

SEQ ID NO: 915802 - protein, 144 aa, Homo sapiens
RKGGMEEGREGGRKGKGRREKGEREKNERKGKEKKREKERKVKRKKRKESPQRCTVTLPVEGSRLPVAVTGSSWDSPQVYGERAQSCDGPILDEAGSLMVMESPGQVALGFWGMSVSEELNSVNDHVSFEADLSLVEPSDRQQP

SEQ ID NO: 915803 - protein, 944 aa, Homo sapiens
MEREDGKNRTFGSLMGPGCGEGKVKFVSENYTTNYTKPSSGYDCHVSENTNKVSNKTSHFRAFELSQYYFYELSGNTVIERPRQICPYVIVAFRYRESKTMAPPAHKSILERSENEGEERDCRIFLQLNFSFLFKAIIKCLEDRGFFILLTSSALLSEPDFGGKQMGLHGLHLFRSPLSTGVKDLKVEDDISMKVIPILSTLNCALLETKKSLPEERIHPNTLVKRHFQELYKADRSPSLSVAPQDRMKDPTFLGKLPSGFDLIPPAEKCPSESLTQLNSYFSDPSAYILEVSTALDLLAEHPQSPCVSDGICDAGFSLVMTPDPEFLVSEAEVRKETETKKDSEEMLKAKKRVFPLSPASNLRVQPKRKASMPHMVQSKKVNLCRPFPKRTASRADNSSDSPTTLKLVKGQFPQKRKRGAEVLTAQFVQKTKLDRKNQEAPISKDVPVPTNAKRARKQEKSPVKTVPRAKPPVKKSPQKQRVNIVKGNENPRNRKQLQPVKGETASKLQSEISRGCQEDGISINSVQPENTTAAHNDLPENSIVNYDSQALNMLADLALSSATSSTPVSEARNLHCSSELPQNDVLLSKENSLRGTSDHEYHRGVKTQKGELLPNPSSDRKSNSGSDLTVSQDEESLVPCSQAPAKAQSALTEEMLESSDASQSSSVSVEHSYALLLTEHSKKHLQEREILSPLFPRNGTKSPEAATPVGKVMPFRHQPGLLLQQKPPDDPVVKPKDRPPSARVKKSSCSRIVLSCDDSVKITFKCETEYAFSLDSKYTNNPLEKTVVRALHGPWNTDLPDNVEEVKLLLHMWVALFYSNQNKIIRSSRKVVEHSNPAKYVSINSTLESCELREIEESLGLEKCSADSLLETNEISRAHAAEVSFRDPNCLLPFIKTPLTQGLELCVQNEQKKTFARECDPDTQEDQNFICSYNNEVCKAEYR

SEQ ID NO: 915804 - protein, 968 aa, Homo sapiens
MEREDGKNRTFGSLMGPGCGEGKVKFVSENYTTNYTKPSSGYDCHVSENTNKVSNKTSHFRAFELSQYYFYELSGNTVIERPRQICPYVIVAFRYRESKTMAPPAHKSILERSENEGEERDCRIFLQLNFSFLFKAIIKCLEDRGFFILLTSSALLSEPDFGGKQMGLHGLHLFRSPLSTGVKDLKVEDDISMKVIPILSTLNCALLETKKSLPEERIHPNTLVKRHFQELYKADRSPSLSVAPQDRMKDPTFLGKLPSGFDLIPPAEKCPSESLTQLNSYFSDPSAYILEVSTALDLLAEHPQSPCVSDGICDAGFSLVMTPDPEFLVSEAEVRKETETKKDSEEMLKAKKRVFPLSPASNLRVQPKRKASMPHMVQSKKVNLCRPFPKRTASRADNSSDSPTTLKLVKGQFPQKRKRGAEVLTAQFVQKTKLDRKNQEAPISKDVPVPTNAKRARKQEKSPVKTVPRAKPPVKKSPQKQRVNIVKGNENPRNRKQLQPVKGETASKLQSEISRGCQEDGISINSVQPENTTAAHNDLPENSIVNYDSQALNMLADLALSSATSSTPVSEARNLHCSSELPQNDVLLSKENSLRGTSDHEYHRGVKTQKGELLPNPSSDRKSNSGSDLTVSQDEESLVPCSQAPAKAQSALTEEMLESSDASQSSSVSVEHSYALLLTEHSKKHLQEREILSPLFPRNGTKSPEAATPVGKVMPFRHQPGLLLQQKPPDDPVVKPKDRPPSARVKKSSCSRIVLSCDDSVKITFKCETEYAFSLDSKYTNNPLEKTVVRALHGPWNTDLPDNVEEVKLLLHMWVALFYSNQNKIIRSSRKVVEHSNPAKYVSINSTLESCELREIEESLGLEKCSADSLLETNEISRAHAAEVSFRDPNCLLPFIKTPLTQGLELCVQNEQKKTFARECDPDTQEDQNFICSYNNENLLRKGGHTEIEPQHFCQAFHRENDTLIIII

SEQ ID NO: 915805 - protein, 151 aa, Homo sapiens
MGMVSRTIRRQIWFQGEVGGFSAEIIRLKSLRVQLIMGMLSEKPRSGTPAEVAACERVQQKAAVTLARLSRDPDVAREAVRLSCMSRLIELCRSPSERNSSDAVLVACLAALRRLAGVCPEGLQDSDFQQLVQPRLVDSFLLCSNMEESFV

SEQ ID NO: 915806 - protein, 139 aa, Homo sapiens
MGMVSRTIRRQIWFQGEVGGFSAEIIRLKSLRVQLIMGMLSEKPRSGTPAEVAACERVQQKAAVTLARLSRDPDVAREAVRLSCMSRLIELCRSPSERNSSDAVLVACLAMGIQLQVKKTNISALLLWFLFWHIQGCSA

SEQ ID NO: 915807 - protein, 160 aa, Homo sapiens
MGWVAAGRLLFVLQAVFFNQWPATHWLGPEATGSLFNPVNLGFGCSQPQASRGMLANEKLMLKGGYLSHAYIKNTKISHKTTIEGSAGAVISSEVSTREGAASKLIQVIDGRIWFLMGCWTEDFSLSQYAGCSPHSVPCHKGLSIEQLGNRAAGFIRVKE

SEQ ID NO: 915808 - protein, 382 aa, Homo sapiens
MAAGQRRSSLPRRDGGQEEALLTFQTGQPGRGAPHKGGGAIMLGWNVGVFLGGGGGVGKATSLWGCGAWGIRGWRGSLGPSSGGGASSAQCHSLISSGSGVLLLSHFYHAIQPGHLQDTLQASKRNSFGSEWAQALKPAKNTKARRTLKFSRSLNDVGEKAQDTSESFAYVERTCSEGKLILPQDTCLRTNRFHHKEKRTLNHKPLGNSKHSCVSCLSAGRSTASEVEAGKGGRPGLLLEEKADGEATSRSRQLLQYLFSLSHGLSASSLHRFHELESCAARLHTAKSSSGLAGSMGFCSDEMGDDDVFEDSTSAKLKSRVLRAPLCSTEKDSDLDCPSPFSEKLPPISPVSTSGDVCSLRSLVPAVIISNIWIRDPLTKTA

SEQ ID NO: 915809 - protein, 192 aa, Homo sapiens
PVRVNCISNWMNVTLLMVKFSKYIKYLVAKERTAWGNQYWRYDSDKDQALTEDEQGKSYPKLISEGFPGIPSPLDTAFYDRRQKLIYFFKESLVFAFDVNRNRVLNSYPKRITEVFPAVIPQNHPFRNIDSAYYSYAYNSIFFFKGNAYWKVVNDKDKQQNSWLPANGLFPKKFISEKWFDVCDVHISTLNM

SEQ ID NO: 915810 - protein, 1012 aa, Homo sapiens
SLMREVFLLSLFNIKGKAHTGKELSQEIKAFLTGVDPILGHQLSAREHARCGLLLLRSLPPARAAVLDHLRGVFDESVRAHLAALDETPVAGPPHLRPPPPSHVPAGGPGLEDVVQEVQQVLSEFIRANPKAWAPVISAWSIDLMGQLSSTYSGQHQRVPHATGALNELLQLWMGCRATRTLMDIYVQCLSALIGSCPDACVDALLDTSVQHSPHFDWVVAHIGSSFPGTIISRVLSCGLKDFCVHGGAGGGAGSSGGSSSQTPSTDPFPGSPAIPAEKRVPKIASVVGILGHLASRHGDSIRRELLRMFHDSLAGGSGGRSGDPSLQATVPFLLQLAVMSPALLGTVSGELVDCLKPPAVLSQLQQHLQGFPREELDNMLNLAVHLVSQASGAGAYRLLQFLVDTAMPASVITTQGLAVPDTVREACDRLIQLLLLHLQKLVHHRGGSPGEGVLGPPPPPRLVPFLDALKNHVGELCGETLRLERKRFLWQHQLLGLLSVYTRPSCGPEALGHLLSRARSPEELSLATQLYAGLVVSLSGLLPLAFRSCLARVHAGTLQPPFTARFLRNLALLVGWEQQGGEGPAALGAHFGESASAHLSDLAPLLLHPEEEVAEAAASLLAICPFPSEALSPSQLLGLVRAGVHRFFASLRLHGPPGVASACQLLTRLSQTSPAGLKAVLQLLVEGALHRGNTELFGGQVDGDNETLSVVSASLASASLLDTNRRHTAAVPGPGGIWSVFHAGVIGRGLKPPKFVQSRNQQEVIYNTQSLLSLLVHCCSAPGGTECGECWGAPILSPEAAKAVAVTLVESVCPDAAGAELAWPPEEHARATVERDLRIGRRFREQPLLFELLKLVAAAPPALCYCSVLLRGLLAALLGHWEASRHPDTTHSPWHLEASCTLVAVMAEGSLLPPALGNMHEVFSQLAPFEVRLLLLSVWGFLREHGPLPQKFIFQSERGRFIRDFSREGGGEGGPHLAVLHSVLHRNIDRLGLFSGRFQAPSPSTLLRQGT

SEQ ID NO: 915811 - protein, 268 aa, Homo sapiens
MTQTLDTREDPLNLGGGGGGGCGCGWAHSASLSSWSSCHRRRPGAPAYNRPHRYSPKTEYGPPRKQPKQQHGRAFGSNHPCALTGGAGEGPGAHPLQDSGNSPARCKCSGCMAAPSLLLLLLLLERVLEPWLGEAPRQEEALGPQRPRPAPPPSPLLPAEPASGCEHAAAAAPPNTTQFIMNQIYEDMRQQEKVERQQEALRAQKATVSGEASPARSSGNDAPPGGSKETWGLQETLYGFVQNPSLAFSPNPEGKNFTCLWKCLYQSS

SEQ ID NO: 915812 - protein, 393 aa, Homo sapiens
MTQTLDTREDPLNLGGGGGGGCGCGWAHSASLSSWSSCHRRRPGAPAYNRPHRYSPKTEYGPPRKQPKQQHGRAFGSNHPCALTGGAGEGPGAHPLQDSGNSPARCKCSGCMAAPSLLLLLLLLERVLEPWLGEAPRQEEALGPQRPRPAPPPSPLLPAEPASGCEHAAAAAPPNTTQFIMNQIYEDMRQQEKVERQQEALRAQKATVSGEASPARSSGNDAPPGGSKETWGLQETLYGFVQNPSLAFSPNPEENQSLAPLLVEEEEEKKNDDEEEYDQEVCDAKEASEEEEEVEDEEEEVEDEEEEEVEEAEYVEEGEEELEEEELEEEEEVLEENEQRGEEFHLPLEMPLSIFVEAEEKRENFISCTFLNPEQIIPKVPQESLFMAQDFNC

SEQ ID NO: 915813 - protein, 138 aa, Homo sapiens
MDFVICIIAVLLMGKISKYLKDYYIHYHNTQRMKITYSFENWDTFYFESCRKPYDALHSSHSKFPGSKFKNSGQCLTVYSMGFTRLSLLRPRTKWASQIEIILIQIIFPQVSQCKTPQQRAHGDQERQHYHKHLYFLC

SEQ ID NO: 915814 - protein, 229 aa, Homo sapiens
LFPGSWAQMPVPLEGACCLGNAHSRLRGAPPTSSRAQHPLDRRREGGRKKSNSPVLPTWSADPRPTCPSSSRLTLLGPRWTRLYRYWLPPYGPIPVHTTEWQAPGRLELGWGLAPRASSGGACGFAPELPRSSQALRKWANPTRRTDPGLRPAVLLAHPRPLAPSAVPALELLGAFLSPLQGERTGLFSPLLRLFQGNCSRRRLRWHRKSPGGIAQPRFSDSSPPLPAL

SEQ ID NO: 915815 - protein, 112 aa, Homo sapiens
RAVKAKGPVMIPYPFFQSHVEDFYVEGLPKGIFFFFFLRWSFHSYRPGWGAMAQPCWSLQPLPPGFKKFSCLSLPSHWDYRCPPPYQANFCIFSGDAVSPCWPGQSRTPDVK

SEQ ID NO: 915816 - protein, 150 aa, Homo sapiens
MVSHCGILRRSSCLLAASPGPAPPASQWPLSAQPSSCLPAAFPSPAFDFRWPLQASTRPSLLPPEGLHRPSLCLTADSPRPASCCFTAASRVQSSCLSAASAGPGSRLPVASSGPWGSFLTTAFPGPVFPFRRPLRAQNLLKSASPDPLA

SEQ ID NO: 915817 - protein, 184 aa, Homo sapiens
MLLPPGSLSRPRTFSSQPLQTKLMTLNGLFRPIPYVTAASADEATASQQPPQAQLHRYNGLFRPSSCLPAFSPGPELSQVDLTRPSSCILVAPPGPASASRQPLQSQRLPHSRFFTPSIYLTVDPPSQAPNLSAASTHPLPPASGLFRPMGLIPDNGLSRPSFSLPAASPGPEPPQVGLSRPTC

SEQ ID NO: 915818 - protein, 397 aa, Homo sapiens
MHQVQWEALLESERSFQLRLVWEGSFWMHLSRGPQPLSHGAARSHTAGGGNIQLQENKLNTPTDSTLCQPLQTKLMTHNGLFRPIPYVTAASADEATASQQPPQAQLHRYNGLFRPSSCLPAFSPGPEHSQVSLCCPRLECSSAIAADCSLNLPGCSDPPTSTSHVAETTGACHYAQLIFGIFVYVDSRGVTAKRGTIQLQENKLNTPTDFYIMLLPPGSLSRPRTFSSQPLQTKLMTLNGLFRPIPYVTAASADEATASQQPPQAQLHRYNGLFRPSSCLPAFSPGPELSQVDLTRPSSCILVAPPGPASASRQPLQSQRLPHSRFFTPSIYLTVDPPSQAPNLSAASTHPLPPASGLFRPMGLIPDNGLSRPSFSLPAASPGPEPPQVGLSRPTC

SEQ ID NO: 915819 - protein, 112 aa, Homo sapiens; identical to SEQ ID NO: 915815

SEQ ID NO: 915820 - protein, 112 aa, Homo sapiens; identical to SEQ ID NO: 915815

SEQ ID NO: 915821 - protein, 184 aa, Homo sapiens; identical to SEQ ID NO: 915817

SEQ ID NO: 915822 - protein, 146 aa, Homo sapiens
MNRKKSSVDTSQTQLSLALESTFLSTVQCTVLTEGENPTVCDALPMSQSMKNVTRSRNFRAERDHLVQPIHFMGRELKPRENRNATTSVPDLLDAHLQEPYEDKNYHNLYPTYLKNPVHCALIGCPLNLDKCKASYQFLCTAMATR

SEQ ID NO: 915823 - protein, 127 aa, Homo sapiens
MNRKKSSVDTSQTQLSLALESTFLSTVQCTVLTEGENPTVCDALPMSQSMKNVTRSRNFRAERDHLVQPIHFMGRELKPRENRNATTSVPDLLDAHLQVRHLTSSYALQWPLDRFDANHLKSEFLHS

SEQ ID NO: 915824 - protein, 843 aa, Homo sapiens
MAGFCLLCLRRTAPMYWSLALTAQTEPTQELQDSHRSRLLNLLRYQGALIQGIKAGGKKATNTGKVSEVHQKPDESTSEFYEKLCEAYRLYTPFDPEVAGNQCMVNAAFLIQVATKVFVNQDEEAKWEAKHRVKEKAEFLAAALIEREAGFARGHGHGRGCSHGKGQARARPGQETRTGPEEPMVSMVVGGRKIDLMVDTGAEHSAVTQTIRVLSKLYANIIGATGRCELGQERKEIVCSIPQPDRRQQVQEFLGAAGFCQLWIPDYWLLAKPLYEATKGGEKEPLQPDRRQQVQEFLGAAGFCQLWIPDYWLLAKPLYEATKGGEKEPLLWGKEQDMAFKEIKKASIQAPALGLPDMTKPFYLMLRYQGLLCENPYITLEAVNTLNLATLLPIECAEHGKSLLCAPGYHCCVETVDEVFSSWEDLKDQPLRNPDVEYFTDGSSFISEGIKKARYAVVTLSSVAEACPLPVGTSAQKVELIALTRALFLVKGKSVNIYADSKYAFATLHAHGAIYDERGLLTTEGKEIKNKKEIEQLLEAVWAPKEVAVIHCKGQQTGRSDKATGNSKADKEARKTAMTEKTKKEETYAMPLLEPPLADTPNYSSNEKASFVQENGSYQKEGWWKFSDGRLTIPEAIAPQFIKQFHQGTHMGKTDLKILIGRYFIVPCLTAMTRAIYEQCVTCAQNNPRQGPTWPQGIQETGAVPCENLLVDFTELPQAGGYRYMLVFVCTFSRFGLPLTLGSENGPDFVAEVKGCKDELDTETTVEEVLPRDSFKVGPGIAHGPSLSQVYPYKINWVFTYEIVHGPPPPLISQVKGDLKEIGELTLGRQMQVLGEVMQEVQG

SEQ ID NO: 915825 - protein, 156 aa, Homo sapiens
MNESWLEKRVPDLNGCRDRQKYRDWLSLANAAAPSASLDPFMFCYIFHTDLPPPAFFASRTITRLKSQQAHLGAFSLLQRRLQLFTKITVHWGKGNNQTFWRLLDAAFNSRRTHTLLWPFSQSSCLWRPINQWSFSSDPSYSGPSGPQAHPMVIFP

SEQ ID NO: 915826 - protein, 351 aa, Homo sapiens
MADEGKSYSEHDDERVNFPQRKKKGRGPFRWKYGEGNRRSGRGGSGIRSSRLEEDDGDVAMSDAQDGPRVRYNPYTTRPNRRGDTWHDRDRIHVTVRRDRAPPERGGAGTSQDGTSKNWFKITIPYGRKYDKAWLLSMIQSKCSVPFTPIEFHYENTRAQFFVEDASTASALKAVNYKILDRENRRISIIINSSAPPHTILNELKPEQVEQLKLIMSKRYDGSQQALDLKGLRSDPDLVAQNIDVVLNRRSCMAATLRIIEENIPELLSLNLSNNRLYRLDDMSSIVQKAPNLKILNLSGNELKSERELDKIKGLKLEELWLDGNSLCDTFRDQSTYISAIRERFPKLLRL

SEQ ID NO: 915827 - protein, 373 aa, Homo sapiens
GVCMEMASVVKHDDERVNFPQRKKKGRGPFRWKYGEGNRRSGRGGSGIRSSRLEEDDGDVAMSDAQDGPRVRYNPYTTRPNRRGDTWHDRDRIHVTVRRDRAPPERGGAGTSQDGTSKNWFKITIPYGRKYDKAWLLSMIQSKCSVPFTPIEFHYENTRAQFFVEDASTASALKAVNYKILDRENRRISIIINSSAPPHTILNELKPEQVEQLKLIMSKRYDGSQQALDLKGLRSDPDLVAQNIDVVLNRRSCMAATLRIIEENIPELLSLNLSNNRLYRLDDMSSIVQKAPNLKILNLSGNELKSERELDKIKGLKLEELWLDGNSLCDTFRDQSTYISPTCSSPCPNILCHPCGVFGSWPKPDLAELMDTW

SEQ ID NO: 915828 - protein, 684 aa, Homo sapiens
RVHPSVSLEFDQQQGSVCPSESEIYEAVAGDRMAGAPMAAAVQPAEVTVEVGEDLHMHHVRDREMPEALEFNLSANPEASTIFQRNSQTDALEFNPSANPEASTIFQRNSQTDVVEKEEATVQTIVTLEIPHHITQRDADRSLSIPDEQLHSFAVSTVHITKNRNGGGSLNNYSSSIPSTPSTSQEDPQFSVPPTANTPTPVCKRSMRWSNLFTSEKGSDPDKERKAPENHADTIGSGRAIPIKQGMLLKRSGKWLKTWKKKYVTLCSNGVLTYYSSLGDYMKNIHKKEIDLQTSTIKVPGKWPSLATSACTPISSSKSNDLSKDMDTGLGDSICFSPSISSTTGPKLNPPPSPHANKKKHLKKKSTNNFMIVSATGQTWHFEATTYEERDAWVQAIQSQILASLQSCESSKSKSQLTSQSEAMALQSIQNMRGNAHCVDCETQNPKWASLNLGVLMCIECSGIHRSLGTRLSRVRSLELDDWPVELRKVMSSIGNDLANSIWEGSSQGQTKPSEKSTREEKERWILSKYEEKLFLAPLPCTDLSLGQQLLRATADEDLQTAILLLAHGSREEVNETCGEGDGCTALHLACRKGNVVLAQLLIWYGVDVMARDAHGNTALTYARQASSQECINVLLQYGCPDEQHPIDTGFPVSLEFFFLKAPVSAGLTHLKEHTLLCGSHTYS

SEQ ID NO: 915829 - protein, 572 aa, Homo sapiens
HSHQHYLTMTIISVTLEIPHHITQRDADRSLSIPDEQLHSFAVSTVHITKNRNGGGSLNNYSSSIPSTPSTSQEDPQFSVPPTANTPTPVCKRSMRWSNLFTSEKGSDPDKERKAPENHADTIGSGRAIPIKQGMLLKRSGKWLKTWKKKYVTLCSNGVLTYYSSLGDYMKNIHKKEIDLQTSTIKVPGKWPSLATSACTPISSSKSNDLSKDMDTGLGDSICFSPSISSTTGPKLNPPPSPHANKKKHLKKKSTNNFMIVSATGQTWHFEATTYEERDAWVQAIQSQILASLQSCESSKSKSQLTSQSEAMALQSIQNMRGNAHCVDCETQNPKWASLNLGVLMCIECSGIHRSLGTRLSRVRSLELDDWPVELRKVMSSIGNDLANSIWEGSSQGQTKPSEKSTREEKERWILSKYEEKLFLAPLPCTDLSLGQQLLRATADEDLQTAILLLAHGSREEVNETCGEGDGCTALHLACRKGNVVLAQLLIWYGVDVMARDAHGNTALTYARQASSQECINVLLQYGCPDEQHPIDTGFPVSLEFFFLKAPVSAGLTHLKEHTLLCGSHTYS

SEQ ID NO: 915830 - protein, 130 aa, Homo sapiens
RVHPSVSLEFDQQQGSVCPSESEIYEAVAGDRMAGAPMAAAVQPAEVTVEVGEDLHMHHVRDREMPEALEFNLSANPEASTIFQRNSQTDALEFNPSANPEASTIFQRNSQTDGETTLFFPPRERIKALV

SEQ ID NO: 915831 - protein, 285 aa, Homo sapiens
MGQKRSQGKGSLQLSSCSLCIGFIVGEQRGLVNGRQDGLKNTINNSKTITIIITNTIRNTTNTIITVTNTTMNTHTIMINTITNTIKNVVRNTITNSKMIITIVNTIRNTIIITTNTCFSDGVGDDDGDDFTVGDAVSNGVYDIVGIGDVIGVDEGYDLYNNNGVGGDDNGVSDCVDDGNDHFAVSNGISDNIFDGVGDGVDHDGVGVHGGIGHSDDGVGGVSDGVGDDYGDSFAVVDSVSGGIFDGVVFLIVLVMLMMLVMVVMVFLIVMVMVIMMKKAEDWVH

SEQ ID NO: 915832 - protein, 334 aa, Homo sapiens
MFVSLFVYNKNFFFTILFLFSPGVFDIVFATNSTQVIKMILNSSTEDGIKRIQDDCPKAGRHNYIFVMIPTLYSIIFVVGIFGNSLVVIVIYFYMKLKTVASVFLLNLALADLCFLLTLPLWAVYTAMEYRWPFGNYLCKIASASVSFNLYASVFLLTCLSIDRYLAIVHPMKSRLRRTMLVAKVTCIIIWLLAGLASLPAIIHRNVFFIENTNITVCAFHYESQNSTLPIGLGLTKNILGFLFPFLIILTSYTLIWKALKKAYEIQKNKPRNDDIFKIIMAIVLFFFFSWIPHQIFTFLDVLIQLGIIRDCRIADIVDTAMPITICIAYFTIA

SEQ ID NO: 915833 - protein, 150 aa, Homo sapiens
TRAKPGGIEASRKFRMLRCLEVDKLRANRGNERESGWQRIRKPEGQVVSQKARQETDNRWIHHHTLPTADKFISEPLTWCQPILTTSDTYEVAWNRRSRYGEQQMPKIQSSFMLGHIQKPARWTIWEEQSRLSIRLPHWGCFSLLPPIKE

SEQ ID NO: 915834 - protein, 289 aa, Homo sapiens
MWDLPLDPSDMVHTLPSGSAGVCMGEVFETSKSRRVCDPSEPHATSSENREVMVQTFLGPPDRTHREAAQLQLRHTPAPTAVLVTGPEHHVSSGVCVVGAVRGTTPGLLPGLRSPEPCSLPTPSPDACPGTHAVARTPVNPDRSLLLPPLRDGEAGECLGSQANPKDNPQTLFTQELECGEASKPPPWPQNLSHEGPQLACVTPLQHAQWPLNLLQETPTLGCNSLCNIGFHHSTVGTEPASKANGSRGDLPVKSDRAEAPPRDWGSDDLALDRHNDGAKDSVNEDRTC

SEQ ID NO: 915835 - protein, 527 aa, Homo sapiens
MGFNVIRLLSGSAVALVIAPTVLLTMLSSAERGCPKGCRCEGKMVYCESQKLQEIPSSISAGCLGLSLRYNSLQKLKYNQFKGLNQLTWLYLDHNHISNIDENAFNGIRRLKELILSSNRISYFLNNTFRPVTNLRNLDLSYNQLHSLGSEQFRGLRKLLSLHLRSNSLRTIPVRIFQDCRNLELLDLGYNRIRSLARNVFAGMIRLKELHLEHNQFSKLNLALFPRLVSLQNLYLQWNKISVIGQTMSWTWSSLQRLDLSGNEIEAFSGPSVFQCVPNLQRLNLDSNKLTFIGQEILDSWISLNDISLAGNIWECSRNICSLVNWLKSFKGLRENTIICASPKELQGVNVIDAVKNYSICGKSTTERFDLARALPKPTFKPKLPRPKHESKPPLPPTVGATEPGPETDADAEHISFHKIIAGSVALFLSVLVILLVIYVSWKRYPASMKQLQQRSLMRRHRKKKRQSLKQMTPSTQEFYVDYKPTNTETSEMLLNGTGPCTYNKSGSRECEEIISDDLPLEHPSAS

SEQ ID NO: 915836 - protein, 880 aa, Homo sapiens
MLPSPVTSTPFSVKDILNLEQQHQHFHGAHLQADLEHHFHSAPCMLAAAEGTQFSDGGEEDEEDEGEKLSYLNSLAAADGHGDSGLCPQGYVHTVLRDSCSEPKEHEEEPEVVRDRSQKSCQLKKSLETAGDCKAAEESERPKPRSRRKPRVLFSQAQVFELERRFKQQRYLSAPEREHLASSLKLTSTQVKIWFQNRRYKCKRQRQDKSLELGAHAPPPPPRRVAVPVLVRDGKPCVTPSAQAYGAPYSVGASAYSYNSFPAYGYGNSAAAAAAAAAAAAAAAAYSSSYGCAYPAGGGGGGGGTSAATTAMQPACSAAGGGPFVNVSNLGGFGSGGSAQPLHQGTAAGAARFRFAAVSPPQQIPRSRSPDCRGTQDSSRKTSRMRSKVGGGGRLNKLRTWWPTGGVEGSGPFEVPGFAVPPKFYPDAWTSCIDLRSVKSCTLPHLEGRQGKGSLARSPSCWPREGGSFPGCSQGYQRARGRCAAPHCGRALPLGRPPFSPGGRGFMRLLVTCGECLCEACAATRPIVSVPRRVNGEASERRAIVGPGLAERRLRAGKVRKEWLFIGVPNKRRQKDPRAEREPVHQTAGPAATRGRVPPLSRRPRTGTQPPTTWLVILTEETELVLWIGFRKFACLEILEASLDQPAPYPAPEPAVSRGVGTGARGGSWETGRHKDRKPQLRGRVSPQRSGRAIAGKPGTGGARRGLQGFDFGCIWDIRQKGKVEGRFLGEVRVLSSPPLQGGKGKEWKPGPSPRGFSRARARRRSDLGPRLCQGGAGWAGASLETRAGDREVQGPSRSRPVPRFLVQDASGDFPGASSQLQGPEPWKDCDLRARGGQSQLGRECPGEPRESLADSAVKKKKMMVVVGGFLEAERGHHVT

SEQ ID NO: 915837 - protein, 621 aa, Homo sapiens
MSVLKKNRRKDSDTPQEPSEKAKEQQAEAELRKLRQQFRKMVESRKSFKFRNQQKIASQYKEIKTLKTEQDEITLLLSLMKSSRNMNRSEKNYMELRLLLQTKEDYEALIKSLKVLLAELDEKILQMEKKIANQKQIFAKMQEANNPRKLQKQIHILETRLNLVTVHFDKMLTTNAKLRKEIEDLRFEKAAYDNVYQQLQHCLLMEKKTMNLAIEQSSQAYEQRVEAMARMAAMKDRQKKDTSQYNLEIRELERLYAHESKLKSFLLVKLNDRNEFEEQAKREEVKVPKSPSLKAKKHVKKNRGESFESYEVAHLRLLKLAESGNLNQLIEDFLAKEEKNFARFTYVTELNNDMEMMHKRTQRIQDEIILLRSQQKLSHDDNHSVLRQLEATGWQQSTCCPLRCSERHLPDIWVWGITGFQAGSRSTETLPKLGRCLGPTSFTRGHPESRLLLRLRLAPLYILAAQIPHLLYFLLLPALCSGGTTHSAPRPRSLGSHLGPASCSPAIIEKKTNDLLLLETYRRILEVEGAEAEIPPPFINPFWGGSALLKPPEPIKVIPPVLGADPFSDRLDDVEQPLDHSSLRQLVLDNYILKENRSKEVRGDSLPEKVDDFRSRKKVTM

SEQ ID NO: 915838 - protein, 542 aa, Homo sapiens
MKSSRNMNRSEKNYMELRLLLQTKEDYEALIKSLKVLLAELDEKILQMEKKIANQKQIFAKMQEANNPRKLQKQIHILETRLNLVTVHFDKMLTTNAKLRKEIEDLRFEKAAYDNVYQQLQHCLLMEKKTMNLAIEQSSQAYEQRVEAMARMAAMKDRQKKDTSQYNLEIRELERLYAHESKLKSFLLVKLNDRNEFEEQAKREEVKVPKSPSLKAKKHVKKNRGESFESYEVAHLRLLKLAESGNLNQLIEDFLAKEEKNFARFTYVTELNNDMEMMHKRTQRIQDEIILLRSQQKLSHDDNHSVLRQLEATGWQQSTCCPLRCSERHLPDIWVWGITGFQAGSRSTETLPKLGRCLGPTSFTRGHPESRLLLRLRLAPLYILAAQIPHLLYFLLLPALCSGGTTHSAPRPRSLGSHLGPASCSPAIIEKKTNDLLLLETYRRILEVEGAEAEIPPPFINPFWGGSALLKPPEPIKVIPPVLGADPFSDRLDDVEQPLDHSSLRQLVLDNYILKENRSKEVRGDSLPEKVDDFRSRKKVTM

SEQ ID NO: 915839 - protein, 147 aa, Homo sapiens
LFKKINCDATKILVQLGETGKVTDINLPQYFAIIEKKTNDLLLLETYRRILEVEGAEAEIPPPFINPFWGGSALLKPPEPIKVIPPVLGADPFSDRLDDVEQPLDHSSLRQLVLDNYILKENRSKEVRGDSLPEKVDDFRSRKKVTM

SEQ ID NO: 915840 - protein, 670 aa, Homo sapiens
FDQQQGSVCPSESETYEAGARDRMAGAPMAAAVQPAEVTVEVGEDLHMHHVRDREMPEALEFNLSANPESSTIFQRNSQTEALEFNPSANPEASTIFQRNSQTDVVEIRRSNCTNHVSAVRFSQQYSLCSTIFLDDSTAIQHYLTMTIISVTLEIPHHITQRDADRTLSIPDEQLHSFAVSTVHIMKKRNGGGSLNNYSSSIPSTPSTSQEDPQFSVPPTANTPTPVCKRSMRWSNLFTSEKGSDPDKERKAPENHADTIGSGRAIPIKQGMLLKRSGKWLKTWKKKYVTLCSNGMLTYYSSLGDYMKNIHKKEIDLQTSTIKVPGKWPSLATSACTPISSSKSNGLSKDMDTGLGDSICFSPSISSTTSPKLNPPPSPHANKKKHLKKKSTNNFMIVSATGQTWHFEATTYEERDAWVQAIQSQILASLQSCESSKSKSQLTSQSEAMALQSIQNMRGNAHCVDCETQNPKWASLNLGVLMCIECSGIHRSLGPHLSRVRSLELDDWPVELRKVMSSIVNDLANSIWEGSSQGQTKPSEKSTREEKERWIRSKYEEKLFLAPLPCTELSLGQQLLRATADEDLQTAILLLAHGSCEEVNETCGEGDGCTALHLACRKGNVVLAQLLIWYGVDVMARDAHGNTALTYARQASSQECINVLLQYGCPDECV

SEQ ID NO: 915841 - protein, 81 aa, Homo sapiens
FDQQQGSVCPSESETYEAGARDRMAGAPMAAAVQPAEVTVEVGEDLHMHHVRDREMPEGEEVIGAIYPRFASGCCCPHGSL

SEQ ID NO: 915842 - protein, 485 aa, Homo sapiens
MKKRNGGGSLNNYSSSIPSTPSTSQEDPQFSVPPTANTPTPVCKRSMRWSNLFTSEKGSDPDKERKAPENHADTIGSGRAIPIKQGMLLKRSGKWLKTWKKKYVTLCSNGMLTYYSSLGDYMKNIHKKEIDLQTSTIKVPGKWPSLATSACTPISSSKSNGLSKDMDTGLGDSICFSPSISSTTSPKLNPPPSPHANKKKHLKKKSTNNFMIVSATGQTWHFEATTYEERDAWVQAIQSQILASLQSCESSKSKSQLTSQSEAMALQSIQNMRGNAHCVDCETQNPKWASLNLGVLMCIECSGIHRSLGPHLSRVRSLELDDWPVELRKVMSSIVNDLANSIWEGSSQGQTKPSEKSTREEKERWIRSKYEEKLFLAPLPCTELSLGQQLLRATADEDLQTAILLLAHGSCEEVNETCGEGDGCTALHLACRKGNVVLAQLLIWYGVDVMARDAHGNTALTYARQASSQECINVLLQYGCPDECV

SEQ ID NO: 915843 - protein, 267 aa, Homo sapiens
FDQQQGSVCPSESETYEAGARDRMAGAPMAAAVQPAEVTVEVGEDLHMHHVRDREMPEALEFNLSANPESSTIFQRNSQTEALEFNPSANPEASTIFQRNSQTDVVEIRRSNCTNHVSAVRFSQQYSLCSTIFLDDSTAIQHYLTMTIISVTLEIPHHITQRDADRTLSIPDEQLHSFAVSTVHIMKKRNGGGSLNNYSSSIPSTPSTSQEDPQFSVPPTANTPTPVCKRSMRWSNLFTSEKGSDPDHRGHRDYYYRHHHDSKRRRS

SEQ ID NO: 915844 - protein, 670 aa, Homo sapiens; identical to SEQ ID NO: 915840

SEQ ID NO: 915845 - protein, 337 aa, Homo sapiens
GLTVLVITFFTKDISLQHVSVWLFDSAKVPSISSTTSPKLNPPPSPHANKKKHLKKKSTNNFMIVSATGQTWHFEATTYEERDAWVQAIQSQILASLQSCESSKSKSQLTSQSEAMALQSIQNMRGNAHCVDCETQNPKWASLNLGVLMCIECSGIHRSLGPHLSRVRSLELDDWPVELRKVMSSIVNDLANSIWEGSSQGQTKPSEKSTREEKERWIRSKYEEKLFLAPLPCTELSLGQQLLRATADEDLQTAILLLAHGSCEEVNETCGEGDGCTALHLACRKGNVVLAQLLIWYGVDVMARDAHGNTALTYARQASSQECINVLLQYGCPDECV

SEQ ID NO: 915846 - protein, 196 aa, Homo sapiens
MKKRNGGGSLNNYSSSIPSTPSTSQEDPQFSVPPTANTPTPVCKRSMRWSNLFTSEKGSDPDKERKAPENHADTIGSGRAIPIKQGMLLKRSGKWLKTWKKKYVTLCSNGMLTYYSSLGDYMKNIHKKEIDLQTSTIKVPGKWPSLATSACTPISSSKSNGLSKDMDTGLGDSICFSPSISSTTSPKLNPPPSPHA

SEQ ID NO: 915847 - protein, 148 aa, Homo sapiens
KFKEKKATKALRGGNINKPLQCYSEAIKLDPHNHVLYSNRSAAYAKKGDYQKAYEDGCKTVDLKPDWGKGYSRKAAALEFYNRHDSPEDVKRRAMADPEVQQIMSDPAMRLILEQMQKDPQALSEHLKNPVIAQKIQKLMDVGLIAIR

SEQ ID NO: 915848 - protein, 113 aa, Homo sapiens
TQGRAACYTKLLEFQLALKDCEECIQLEPTLIKGYTRKAAALEAMKDYTKAMDVYQKALDLDSSCKEAADGYQRCMMAQYNRHDSPEDVKRRAMADPEVRAWAQLAKRAELDL

SEQ ID NO: 915849 - protein, 245 aa, Homo sapiens
EATIPNNSGWNWAAEEKYKDAIHFYNKSLAEHRTPDVLKKCQQAEKILKEQERLAYINPDLALEEKNKGNECFQKGDYPQAMKHYTEAIKRNPKDAKLYSNRAACYTKLLEFQLALKDCEECIQLEPTFIKGYTRKAAALEAMKDYTKAMDVYQKALDLDSSCKEAADGYQRCMMAQYNRHDSPEDVKRRAMADPEVQQIMSDPAMRLILEQMQKDPQALSEHLKNPVIAQKIQKLMDVGLIAIR

SEQ ID NO: 915850 - protein, 271 aa, Homo sapiens
GDYNKCRELCEKAIEVGRENREDYRQIAKAYARIGNSYFKEEKYKDAIHFYNKSLAEHRTPDVLKKCQQAEKILKEQERLAYINPDLALEEKNKGNECFQKGDYPQAMKHYTEAIKRNPKDAKLYSNRAACYTKLLEFQLALKDCEECIQLEPTFIKGYTRKAAALEAMKDYTKAMDVYQKALDLDSSCKEAADGYQRCMMAQYNRHDSPEDVKRRAMADPEVQQIMSDPAMRLILEQMQKDPQALSEHLKNPVIAQKIQKLMDVGLIAIR

SEQ ID NO: 915851 - protein, 151 aa, Homo sapiens
GRVGRPTRSPRVRKLLEFQLALKDCEECIQLEPTFIKGYTRKAAALEAMKDYTKAMDVYQKALDLDSSCKEAADGYQRCMMAQYNRHDSPEDVKRRAMADPEVQQIMSDPAMRLILEQMQKDPQALSEHLKNPVIAQKIQKLMDVGLIAIR

SEQ ID NO: 915852 - protein, 271 aa, Homo sapiens; identical to SEQ ID NO: 915850

SEQ ID NO: 915853 - protein, 240 aa, Homo sapiens
EATIPNNSGWNWAAEEKYKDAIHFYNKSLAEHRTPDVLKKCQQAEKILKEQERLAYINPDLALEEKNKGNECFQKGDYPQAMKHYTEAIKRNPKDAKLYSNRAACYTKLLEFQLALKDCEECIQLEPTFIKGYTRKAAALEAMKDYTKAMDVYQKALDLDSSCKEAADGYQRCMMAQYNRHDSPEDVKRRAMADPEVQQIMSDPAMRLILEQMQKDPQALSEYVESERRPCWKWRTKAGR

SEQ ID NO: 915854 - protein, 109 aa, Homo sapiens
LSPLVSYLCYLGPAEAVSWVVLTRFTFVSSGLQEAADGYQRCMMAQYNRHDSPEDVKRRAMADPEVQQIMSDPAMRLILEQMQKDPQALSEYVESERRPCWKWRTKAGR

SEQ ID NO: 915855 - protein, 271 aa, Homo sapiens; identical to SEQ ID NO: 915850

SEQ ID NO: 915856 - protein, 271 aa, Homo sapiens; identical to SEQ ID NO: 915850

SEQ ID NO: 915857 - protein, 240 aa, Homo sapiens; identical to SEQ ID NO: 915853

SEQ ID NO: 915858 - protein, 184 aa, Homo sapiens
TKAHAFCLVVMYSSVSQTGIVPRYVFFITSASCRVQAVCLVWDDPSSGVVFPDVVPSVWCWDCEECIQLEPTFIKGYTRKAAALEAMKDYTKAMDVYQKALDLDSSCKEAADGYQRCMMAQYNRHDSPEDVKRRAMADPEVQQIMSDPAMRLILEQMQKDPQALSEYVESERRPCWKWRTKAGR

SEQ ID NO: 915859 - protein, 103 aa, Homo sapiens
FLSVASFKDCEECIQLEPTFIKGYTRKAAALEAMKDYTKAMDVYQKALDLDSSCKEAADGYQRCMMAQYNRHDSPEDVKRRAMADPEVLAPELQLAPELAARP

SEQ ID NO: 915860 - protein, 271 aa, Homo sapiens; identical to SEQ ID NO: 915850

SEQ ID NO: 915861 - protein, 271 aa, Homo sapiens; identical to SEQ ID NO: 915850

SEQ ID NO: 915862 - protein, 271 aa, Homo sapiens; identical to SEQ ID NO: 915850

SEQ ID NO: 915863 - protein, 212 aa, Homo sapiens
EATIPNNSGWNWAAEEKYKDAIHFYNKSLAEHRTPDVLKKCQQAEKILKEQERLAYINPDLALEEKNKGNECFQKGDYPQAMKHYTEAIKRNPKDAKLYSNRAACYTKLLEFQLALKDCEECIQLEPTFIKGYTRKAAALEAMKDYTKAMDVYQKALDLDSSCKEAADGYQRCMMAQYNRHDSPEDVKRRAMADPEVPWNRCRRTPRHSANT

SEQ ID NO: 915864 - protein, 271 aa, Homo sapiens; identical to SEQ ID NO: 915850

SEQ ID NO: 915865 - protein, 271 aa, Homo sapiens; identical to SEQ ID NO: 915850

SEQ ID NO: 915866 - protein, 115 aa, Homo sapiens
MTYSSSILGLDISLFIFYYSVLLRFMGAVVRRKFYSALKSAYVVDADDTASNMLSTSVRKAYSVEGSEVMRIGGEVRLPSRNLKNRTAPSSDSNTAFDSNIFLHINQMGEDFSCK

SEQ ID NO: 915867 - protein, 143 aa, Homo sapiens
MNIPGHSFCVLVSTFTWSKLWGKEHHEDLLLSECHFLFLSFCGLILNPFDRINHISQSHFPANVCLRAGDSVERSFSNKAELLFQLHGHQRESLSKKEAQVWRDKGLYFRKGLLDQAQTLIRADNMSSLHYCKNFFVYGSVVN

SEQ ID NO: 915868 - protein, 116 aa, Homo sapiens
MRIRTEGLRPSCLGAKHLLWDVAAEEGKAEGADSTASWGVVKASCGGPSLAAKWRTAPSMPGFVTRSFSMLSCWHIAAQLEMYGCPHLDLTESEVQPQERSLHPLGFLCSANTSGI

SEQ ID NO: 915869 - protein, 278 aa, Homo sapiens
MPGGLGRTARKRAFCPKDAASLLILSPQNLAVSFQPPVVGIPALSLRRRGERGGGKHPRGGEGPCGRGLHTKPLLSVTPLAVSSQVAASWPDAFRKYFEVIVAVDVGDFLFPLTCEAAHVEGGTPGPPALSGLACVPSSSGHFQTVQLVAKVTGRCRSFQSWMRIRTEGLRPSCLGAKHLLWDVAAEEGKAEGADSTASWGVVKASCGGPSLAAKWRTAPSMPGFVTRSFSMLSCWHIAAQLEMYGCPHLDLTESEVQPQERSLHPLGFLCSANTSGI

SEQ ID NO: 915870 - protein, 288 aa, Homo sapiens
MPGGLGRTARKRAFCPKDAASLLILSPQNLAVSFQPPVVGIPALSLRRRGERGGGKHPRGGEGPCGRGLHTKPLLSVTPLAVSSQVAASWPDAFRKYFEVIVAVDVGDFLFPLTCEAAHVEGGTPGPPALSGLACVPSSSGHFQTVQLVAKVTGRCRSFQSWMRIRTEGLRPSCLGAKHLLWDVAAEEGKAEGADSTASWGVVKASCGGPSLAAKWRTAPSMPGFVTRSFSMLSCWHIAAQLEMYGCPHLDLTESEVQPQERSPAWPIVTVASQLFNVYFPARDMTVH

SEQ ID NO: 915871 - protein, 144 aa, Homo sapiens
MRIRTEGLRPSCLGAKHLLWDVAAEEGKAEGADSTASWGVVKASCGGPSLAAKWRTAPSMPGFVTRSFSMLSCWHIAAQLEMYGCPHLDLTESEVQPQERSTSVSIKFYRDSAILMYLCIACEYFHTTRAELTGCSRDCDGPQA

SEQ ID NO: 915872 - protein, 278 aa, Homo sapiens; identical to SEQ ID NO: 915869

SEQ ID NO: 915873 - protein, 136 aa, Homo sapiens
MRACPYLCPQMADSNSMRVTAPMIQSPPSGSFPRHVGIMGTTVQDEIWVGTQPNYITDLNIYLHQALMSSFTIKYAYQEDINLFIQQLLKAYYVSGTLQVNKENGKGTARQVAENPREYSVTGTKKSVIRSHWPHV

SEQ ID NO: 915874 - protein, 208 aa, Homo sapiens
MVDKAAQKLWFSVLLLKGLNFRWLPGYLIQRPGLAELAVPNFAVRVIVKVKDADTFEPTPPKVGLWLSPETPPEHTPASASLQFSPMKQQFQDMHLPLKTKKERKKSILRPLWPELVVCPETLGGPTPPVWTVGVADPETTGVTGAASPGQISLSGAITPRPCCYRCLPRSLPDCPSGPIGARFLSPAQDGTPRRLGLAQPPYRQQHF

SEQ ID NO: 915875 - protein, 135 aa, Homo sapiens
MNISSTGRITIWNLERLFKMDSNGQATLDQDVPGTVEVGWVGLWIPGEHDDPLSACKYPPEPPHKETKESLVLKTSFGASAKTVGCSAAPKSPEVWWRWWVEVTSRFHARAVDGKRHVFRAASGFLAASSNISIP

SEQ ID NO: 915876 - protein, 146 aa, Homo sapiens
RSSMVMTELWLVQARMWSLPLQETECRAVWPLSAAQGSVPFSSSYRTFSTSLALVALALSPSFSSELHLFARATTLRHTATSRVVVQWGLGPGGLLAREAHAAAPVQTRSQRRRRGPSSCLLIVMKCMLRHMPWELSGSYTSLLWQ

SEQ ID NO: 915877 - protein, 146 aa, Homo sapiens; identical to SEQ ID NO: 915876

SEQ ID NO: 915878 - protein, 195 aa, Homo sapiens
MPPIDAFLCLPFSFALVSGKLYQWKEPVISSVHSKVKRTAEVKEEIVEKEMKKLVHSVFNMADYTFPLQAEAELRPGRTVTMAMTRALRAVAATQRDLGGDRGRACDGSGLSASAGLGKMLRPALPWLYLGLCSLLVGEAEAPSPVDPLERSRPYAVLRGQNLESLSPRLECNGAISARCNLRVWGSSDSPASAP

SEQ ID NO: 915879 - protein, 195 aa, Homo sapiens; identical to SEQ ID NO: 915878

SEQ ID NO: 915880 - protein, 195 aa, Homo sapiens; identical to SEQ ID NO: 915878

SEQ ID NO: 915881 - protein, 180 aa, Homo sapiens
MKGRLTEVRMWGFTKGAPHLARGRSHRRGREKLENLTGAMKKTNCDSGDISAFIFDVNGDTGRFQHFHGELLWKGTYEESTDCVCTCDFIRHPELLGFISILEIENPCTQRKQLLVTGQDSGDTQHKLSHFFPAALRNVQDKLGKHVTRDLGLEFPRNALFGYCNSASEESNPATREVTC

SEQ ID NO: 915882 - protein, 148 aa, Homo sapiens
MMSFDSRSHIQVMLMQEVGSHGLGQLRPCGLEVPNFSIFSYLLLSPSNCSNLCLLPNSKVASTFSEKNLRIVTRYAFQAVGRSQANRKRNEGKAPVRNCQYFIMTLLQRKCAEKCEIQGEESIKMSVSALAKFTVAAYSTSEEYLTSL

SEQ ID NO: 915883 - protein, 185 aa, Homo sapiens
MAPTPASPTERPMHCEIPQCYNRRPFHFHHLHGGPRSPDASGPQRCKNEVHMSSRAFETGHVGTESKVPRGSHTKVTGSSACFLTEEPRATQSRLSGALLFEILANPVLAWWPHDPDKRCSLNFQPQCPTGEQRFLDVTATHLHLHMYPGATFLTLAKSNKPLSPSTFVLVFGISYTSALSTHAS

SEQ ID NO: 915884 - protein, 185 aa, Homo sapiens; identical to SEQ ID NO: 915883

SEQ ID NO: 915885 - protein, 185 aa, Homo sapiens; identical to SEQ ID NO: 915883

SEQ ID NO: 915886 - protein, 316 aa, Homo sapiens
QGSPEERRPRTRGRMMRGVKGGEELGVTEAKRQKCKERQPVPPETRIRLQFEGQFDIELSVGGRVTGQSGVVESIGHLTLPYRDNLFCEWHLQGLSRHYLTNSFEDFNLQNSSGCEKDFVEIWDYHTSGNILGRYCANTIPDSIDTSSNTAVGSAGTSTSPNYPNLNPHGRIYEWRITAPEGRQITLTFSNLRLATHLSCNSEHVIGRVPIEGSRSGLGISPPRKYAVRWIVCLKVKLFFQQMDLGRMEDSLLLIPPVKMQIKWDVVNVLHFNQEEAAMVNLKLVMPLDELLAQFQSCYHEDWCDLFHIPWSIIWC

SEQ ID NO: 915887 - protein, 224 aa, Homo sapiens [sequence omitted]

SEQ ID NO: 915888 - protein, 150 aa, Homo sapiens [sequence omitted]

SEQ ID NO: 915889 - protein, 280 aa, Homo sapiens [sequence omitted]

SEQ ID NO: 915890 - protein, 280 aa, Homo sapiens [sequence omitted]

SEQ ID NO: 915891 - protein, 208 aa, Homo sapiens
MAKVKHRADVGPIVECEIVLDTVSWIVNADEVKVDSEKPSSRSYQCPLAEVSDPFYGVMKDSEEEEFLLSMAGKQGFASQHLSGKWQMLTLINNGPFKLDNDIHVPSHMLNAGDVAERAQRELTRGSGRPQRFRPTRGMALPAPGARGASLSVCPGVGVGGEWVENGQTAKSLLCPNESSGVVVEKGQTTLPATREHFFKATLVFRGC

SEQ ID NO: 915892 - protein, 1840 aa, Homo sapiens
HLSFRRILLWAGMGKCGLCVNMVMDPKGGSWGCQSQSSPRQVLQKEPFEIDGSSVQLAYSQDAYLKGNEAYSGNARNIPEPPPICYPWLPSAPSAMAQPVEISPPDSSLSKQQTSTPVLTQPGRAYRMEIQVPPSPTDVAKSNTAVCVCNESVRTVIVPSEKVVDLLSNRNNHTGPSHRTEEVRYGVSEQTSLKTVSRTTSPPLSIPTTHLIHQPAGSRSLEPSGILLKSGNYSGHSDGISSSRSQAVEAPSVSVNHYSPNSHQHIDWKNYKTYKEYIDNRRLHIGCRTIQERLDSLRAASQSTTDYNQVVPNRTTLQGRRRSTSHDRVPQSVQIRQRSVSQERLEDSVLMKYCPRSASQGALTSPSVSFSNHRTRSWDYIEGQDETLENVNSGTPIPDSNGEKKQTYKWSGFTEQDDRRGICERPRQQEIHKSFRGSNFTVAPSVVNSDNRRMSGRGVGSVSQFKKIPPDLKTLQSNRNFQTTCGMSLPRGISQDRSPLVKVRSNSLKAPSTHVTKPSFSQKSFVSIKDQRPVNHLHQNSLLNQQTWVRTDSAPDQQVETGKSPSLSGASAKPAPQSSENAGTSDLELPVSQRNQDLSLQEAETEQSDTLDNKEAVILREKPPSGRQTPQPLRHQSYILAVNDQETGSDTTCWLPNDARREVHIKRMEERKASSTSPPGDSLASIPFIDEPTSPSIDHDIAHIPASAVISASTSQVPSIATVPPCLTTSAPLIRRQLSHDHESVGPPSLDAQPNSKTERSKSYDEGLDDYREDAKLSFKHVSSLKGIKIADSQKSSEDSGSRKDSSSEVFSDAAKEGWLHFRPLVTDKGKRVGGSIRPWKQMYVVLRGHSLYLYKDKREQTTPSEEEQPISVNACLIDISYSETKRKNVFRLTTSDCECLFQAEDRDDMLAWIKTIQESSNLNEEDTGVTNRDLISRRIKEYNNLMSKAEQLPKTPRQSLSIRQTLLGAKSEPKTQSPHSPKEESERKLLSKDDTSPPKDKGTWRKGIPSIMRKTFEKKPTATGTFGVRLDDCPPAHTNRYIPLIVDICCKLVEERGLEYTGIYRVPGNNAAISSMQEELNKGMADIDIQDDKWRDLNVISSLLKSFFRKLPEPLFTNDKYADFIEANRKEDPLDRLKTLKRLIHDLPEHHYETLKFLSAHLKTVAENSEKNKMEPRNLAIVFGPTLVRTSEDNMTHMVTHMPDQYKIVETLIQHHDWFFTEEGAEEPLTTVQEESTVDSQPVPNIDHLLTNIGRTGVSPGDVSDSATSDSTKSKGSWGSGKDQYSRELLVSSIFAAASRKRKKPKEKAQPSSSEDELDNVFFKKENVEQCHNDTKEESKKESETLGRKQKIIIAKENSTRKDPSTTKDEKISLGKESTPSEEPSPPHNSKHNKSPTLSCRFAILKESPRSLLAQKSSHLEETGSDSGTLLSTSSQASLARFSMKKSTSPETKHSEFLANVSTITSDYSTTSSATYLTSLDSSRLSPEVQSVAESKGDEADDERSELISEGRPVETDSESEFPVFPTALTSERLFRGKLQEVTKSSRRNSEGSELSCTEGSLTSSLDSRRQLFSSHKLIECDTLSRKKSARFKSDSGSLGDAKNEKEAPSLTKVFDVMKKGKSTGSLLTPTRGESEKQEPTWKTKIADRLKLRPRAPADDMFGVGNHKVNAETAKRKSIRRRHTLGGHRDATEISVLNFWKVHEQSGERESELSAVNRLKPKCSAQDLSISDWLARERLRTSTSDLSRGEIGDPQTENPSTREIATTDTPLSLHCNTGSSSSTLASTNRPLLSIPPQSPDQINGESFQNVSKNASSAANAQPHKLSETPGSKAEFHPCL

SEQ ID NO: 915893 - protein, 1766 aa, Homo sapiens
MCNIPEPPPICYPWLPSAPSAMAQPVEISPPDSSLSKQQTSTPVLTQPGRAYRMEIQVPPSPTDVAKSNTAVCVCNESVRTVIVPSEKVVDLLSNRNNHTGPSHRTEEVRYGVSEQTSLKTVSRTTSPPLSIPTTHLIHQPAGSRSLEPSGILLKSGNYSGHSDGISSSRSQAVEAPSVSVNHYSPNSHQHIDWKNYKTYKEYIDNRRLHIGCRTIQERLDSLRAASQSTTDYNQVVPNRTTLQGRRRSTSHDRVPQSVQIRQRSVSQERLEDSVLMKYCPRSASQGALTSPSVSFSNHRTRSWDYIEGQDETLENVNSGTPIPDSNGEKKQTYKWSGFTEQDDRRGICERPRQQEIHKSFRGSNFTVAPSVVNSDNRRMSGRGVGSVSQFKKIPPDLKTLQSNRNFQTTCGMSLPRGISQDRSPLVKVRSNSLKAPSTHVTKPSFSQKSFVSIKDQRPVNHLHQNSLLNQQTWVRTDSAPDQQVETGKSPSLSGASAKPAPQSSENAGTSDLELPVSQRNQDLSLQEAETEQSDTLDNKEAVILREKPPSGRQTPQPLRHQSYILAVNDQETGSDTTCWLPNDARREVHIKRMEERKASSTSPPGDSLASIPFIDEPTSPSIDHDIAHIPASAVISASTSQVPSIATVPPCLTTSAPLIRRQLSHDHESVGPPSLDAQPNSKTERSKSYDEGLDDYREDAKLSFKHVSSLKGIKIADSQKSSEDSGSRKDSSSEVFSDAAKEGWLHFRPLVTDKGKRVGGSIRPWKQMYVVLRGHSLYLYKDKREQTTPSEEEQPISVNACLIDISYSETKRKNVFRLTTSDCECLFQAEDRDDMLAWIKTIQESSNLNEEDTGVTNRDLISRRIKEYNNLMSKAEQLPKTPRQSLSIRQTLLGAKSEPKTQSPHSPKEESERKLLSKDDTSPPKDKGTWRKGIPSIMRKTFEKKPTATGTFGVRLDDCPPAHTNRYIPLIVDICCKLVEERGLEYTGIYRVPGNNAAISSMQEELNKGMADIDIQDDKWRDLNVISSLLKSFFRKLPEPLFTNDKYADFIEANRKEDPLDRLKTLKRLIHDLPEHHYETLKFLSAHLKTVAENSEKNKMEPRNLAIVFGPTLVRTSEDNMTHMVTHMPDQYKIVETLIQHHDWFFTEEGAEEPLTTVQEESTVDSQPVPNIDHLLTNIGRTGVSPGDVSDSATSDSTKSKGSWGSGKDQYSRELLVSSIFAAASRKRKKPKEKAQPSSSEDELDNVFFKKENVEQCHNDTKEESKKESETLGRKQKIIIAKENSTRKDPSTTKDEKISLGKESTPSEEPSPPHNSKHNKSPTLSCRFAILKESPRSLLAQKSSHLEETGSDSGTLLSTSSQASLARFSMKKSTSPETKHSEFLANVSTITSDYSTTSSATYLTSLDSSRLSPEVQSVAESKGDEADDERSELISEGRPVETDSESEFPVFPTALTSERLFRGKLQEVTKSSRRNSEGSELSCTEGSLTSSLDSRRQLFSSHKLIECDTLSRKKSARFKSDSGSLGDAKNEKEAPSLTKVFDVMKKGKSTGSLLTPTRGESEKQEPTWKTKIADRLKLRPRAPADDMFGVGNHKVNAETAKRKSIRRRHTLGGHRDATEISVLNFWKVHEQSGERESELSAVNRLKPKCSAQDLSISDWLARERLRTSTSDLSRGEIGDPQTENPSTREIATTDTPLSLHCNTGSSSSTLASTNRPLLSIPPQSPDQINGESFQNVSKNASSAANAQPHKLSETPGSKAEFHPCL

SEQ ID NO: 915894 - protein, 131 aa, Homo sapiens
IIFNFGPMHIFSFFFFSLSSVYLEVSALNFIFLMTTAANYLFLSFIIHIHYELPAQIFLLIYTQDKTKKCTFKTTYNYKFIYSEHVITSVLYRQNPRKLQFSGINTEGKILEEINRRTNQKVVKETKRELH

SEQ ID NO: 915895 - protein, 428 aa, Homo sapiens
MRGPFPRVAGLGAVGSPLGSKSTPSPPEGGAAALALWRVGDSAPGWQPALAAFAALAIWPTSCVIFIHRILHYQTRGGLQVGAWTGAVDIRGRVPKSEPPRECAHGRPCEYNEHVRAFSDRPIFIVHQRTHIRKSHHEFNECERRSVHFAVSQSILYIRKQIQKKNSMNVVNVGKPSAINPLLSYSRGYTEERNPMNALNVGKLLDIGHALQYIKEHTRDKTYECNECGKNFCEKSNLHVHQRTHTGEKPYGCNECQKAFGDRSALKVHQRIHTGEKPYECKECGKTFSQKPNFINHQEHQRIHTGEKPYECNECEKMFYHKSSLTVHQRTHTGEKPYACSECGKTFYQKSSLTTHQRTHTREQPYEYNESFYQNPNFTKCQRDNIEETLVNILKAQKPSPSWTRSIAETTQVGHYLYSSHFSKISRK

SEQ ID NO: 915896 - protein, 151 aa, Homo sapiens
MPVPCKEFHLSFTELKRLNQTQHFQLPSKQQKIYLTVAMETRTGRHGKAARSANFKSQTATMEIRTLLHIGGRNLHVYTCIRCHIERMTGVVVNCLHQLDWATGCPDTWFNTVSGYAPRMFLDGISIGIGGLSKADGPAKCMWASSNPLRA

SEQ ID NO: 915897 - protein, 189 aa, Homo sapiens
YALLTVGYNPHNTMRKPSVIYLACTGDSGTQTSPFLLVPFRCPRAQLSRCLAFRGYCSSLRVPDSSNSCCPRLPRQLPPALPLPACQSPLAEERGTVTAEPAQMQASAGLPFWSSTLILGSMDVRGWIILCYGSGGCPVHYELSSLLSLSLLPPCEEGACFPFAFRHECKFPEVSQSYCWLSLQNGVLV

SEQ ID NO: 915898 - protein, 189 aa, Homo sapiens; identical to SEQ ID NO: 915897

SEQ ID NO: 915899 - protein, 189 aa, Homo sapiens; identical to SEQ ID NO: 915897

SEQ ID NO: 915900 - protein, 159 aa, Homo sapiens
WEAPKGLEWDGGVMQAAHQVPSGQSGRAPRFLSLHGGLCKDLLLPRLLLLVSWAAVTNYNELSDLKEQPSFFSQVLESRTLKLRCQQSCTSSRASRVEPMPCLWWLRVFLDLWLYTPMSAPTITWPSNCVCVDMTGLRNTYKTGKTVLLDVSVRVFQGD

SEQ ID NO: 915901 - protein, 150 aa, Homo sapiens
MDPCSVGVQLRTTNECHKTYYTRHTGFKTLQELSSNDMLLLQLRTGMTLSGNNTICFHHVKIYIDRFEDLQKSCCDPFNIHKKLAKKNLHVIDLDDATFLSAKFGRQLVPGWKLCPKCTQIINGSVDVDTEDRQKRKPESDVCVIVIFFY

SEQ ID NO: 915902 - protein, 259 aa, Homo sapiens
MDPCSVGVQLRTTNECHKTYYTRHTGFKTLQELSSNDMLLLQLRTGMTLSGNNTICFHHVKIYIDRFEDLQKSCCDPFNIHKKLAKKNLHVIDLDDATFLSAKFGRQLVPGWKLCPKCTQIINGSVDVDTEDRQKRKPESDGRTAKALRSLQFTNPGRQTEFAPETGKREKRRLTKNATAGSDRQVIPAKSKVYDSQGLLIFSGMDLCDCLDEDCLGCFYACPACGSTKCGAECRCDRKWLYEQIEIEGGEIIHNKHAG

SEQ ID NO: 915903 - protein, 259 aa, Homo sapiens; identical to SEQ ID NO: 915902

SEQ ID NO: 915904 - protein, 259 aa, Homo sapiens; identical to SEQ ID NO: 915902

SEQ ID NO: 915905 - protein, 259 aa, Homo sapiens; identical to SEQ ID NO: 915902

SEQ ID NO: 915906 - protein, 259 aa, Homo sapiens; identical to SEQ ID NO: 915902

SEQ ID NO: 915907 - protein, 259 aa, Homo sapiens; identical to SEQ ID NO: 915902

SEQ ID NO: 915908 - protein, 88 aa, Homo sapiens
RAVGKNVTAGLDRQVIPAKSKVYDSQGLLIFSGMDLCDCLDEDCLGCFYACPACGSTKCGAECRCDRKWLYEQIEIEGGEIIHNKHAG

SEQ ID NO: 915909 - protein, 164 aa, Homo sapiens
VGQIVSLISPNARTWMFQLKLLYLLAPFLPPSVLAFCDGWYSENLSKFLGWAFCVALSSLVLCSSWTPTALIAQLSLLNSVNPPASSRFPLPVLCPGNALKEGVGIVLVRMEEDLKEALTMGLEKSSVHTTEYVIHSPSPSKKNGSTAKRMGMDPHQAKDIFLK

SEQ ID NO: 915910 - protein, 198 aa, Homo sapiens
SADITNHTWLSRLLMVLSLLSRYTWSCRVVYIETLHPYCNLLHVRLWRPQASDMSATGFVFLWMRRGILVFGIFRLSALVSPHLCGFIYLWSLMLVTYTWSFGVDVLFVDVDGIPFCLLVFPLTFRPLSCRSVGVCWSSTPDVVCLGITSRGCRTANIAAQSFLWKLCPRGAPTCMRCLSAPTGRCLPVRLHGSQGPT

SEQ ID NO: 915911 - protein, 375 aa, Homo sapiens
GLPSKKVPMDYLTYSTPSTVISPEEFRSLRLSFSPNLDDYNPDIPEWRRDIGRVIKKSLVEKGELCTKTNKLTQQEEARAHGKFWPDVCKAEPHTCRDLKGPKGDATMEPRTNMGSLPLATGVPGQHILVAVLPGLPTTAELFVLPYQDPAGENKRSTDDLEQISELLIHTLNQNSVHFELKPGVRVLVHAAHLTAELAVSTGAQSLRARFSYAKDKRVNGNSNCDKESLTCPVLCSFFSALFPPQAPLVDLTPTHSGSAMLMLLSVVFVGLAVFVIYKFKRKIPGINVYAQMQNEKEQEMISPVSHSESRPNVPQTELRRPGQLIDEKVESQLIDCPLPEVVKWTFSYFNGSLSACEVGMGIQQRGIENLTFTC

SEQ ID NO: 915912 - protein, 67 aa, Homo sapiens
LSAASSPLLAPLGPCRDAVVLPLAGFSFGLAICPNTTLQLPQGLYWLVNRFPLYYKSQCFFFGSTYL

SEQ ID NO: 915913 - protein, 133 aa, Homo sapiens
MPLLLLFIAALDKARPCGVLRAFLPLSLPALHGHSQMRKLKIRELTHFPQGYTVSKRHYQDSNDLLLKFISYSLIASLKAEEWGGGETSRATELNLPPWPSQPRALPAVVGGVWASTIPSLSLSGGSWINRST

SEQ ID NO: 915914 - protein, 133 aa, Homo sapiens; identical to SEQ ID NO: 915913

SEQ ID NO: 915915 - protein, 147 aa, Homo sapiens
MENQTWMAGMFLNLQPMLHQSLPPCVTKTEKRFASTCFYSSTVVINISISFQGSCYRLSNSPATQDGITLQLGCHSRIVRFLGDHSLVVDPSLGTLELNRHPLITAGELSVNSAARTKVEALKQLVLLSSLQPTLVAGKVFLIIQTT

SEQ ID NO: 915916 - protein, 165 aa, Homo sapiens
MTMCSNMGETIRIVGCMDLLLLWPNRGISVFLPKGFKVSKSAIRMQLEAFILTDMETENQILHVLTYKQELNIGDRQQLASADLLPRELGKGPSPTVRGQGFGSENSKNENNKTKGKVLVSSFSLQNPHLPKNQDMKILLRSLEEAMWQVVHIYKIVSSQYCSYW

SEQ ID NO: 915917 - protein, 553 aa, Homo sapiens
IASTLARMVIRYQMKSAVEEGTASGSDGNFSEDVLSKFDEWTFIPDSSMDSVFAQSDDLDSEGSEGSFLVKKKSNSISVGEFYRDAVLQRCSPNLQRHSNSLGPIFDHEDLLKRKRKILSSDDSLTNELRDIDALSQKCCISVHLEHLEKLELHQNALTSFPQQLCETLKSLTHLDLHSNKFTSFPSYLLKMSCIANLDVSRNDIGPSVVLDPTVKCPTLKQFNLSYNQLSFVPENLTDVVEKLEQLILEGNKISGICSPLRLKELKILNLSKNHISSLSENFLEACPKVESFSARMNFLAAMPFLPPSMTILKLSQNKFSCIPEAILNLPHLRSLDMSSNDIQYLPGPAHWKSLNLRELLFSHNQISILDLSEKAYLWSRVEKLHLSHNKLKEIPPEIGCLENLTSLDVSYNLELRSFPNEMGKLSKIWDLPLDELHLNFDFKHIGCKAKDIIRFLQQRLKKAVPYNRMKLMIVGNTGSGKTTLLQQLMKTKKSDLGMQSATVGIDVKDWPIQIRDKRKRDLVLNVWDFAGISFYRILKFTFTICLEQGFKN

SEQ ID NO: 915918 - protein, 139 aa, Homo sapiens
MLPVLKHRTPNSSALGRTGFLAPQLADSRLWDLPLIYAYSHILGTCTFLRGGEIGRHTCKFPPQFGNRYCNPRKSCHKKSLANSLTAISWETSRQSDPEYHSLEAMKSMIKKPARLLSGSKMAYLFAASSREEEHCVLT

SEQ ID NO: 915919 - protein, 135 aa, Homo sapiens
MELLSTKMQKTLGGEICGGGRIGGQLGHTECDMSVKHPVKDAECGSQRDIAHVMVKITTLRWRDDPRLSGGPNLVTEVLRSRVSFPWWSEAEVTTGEWPERCKVAGFEDGGRGPLAKECGWLLEGGNGKETNSPL

SEQ ID NO: 915920 - protein, 347 aa, Homo sapiens
LQPRRVSVMAASCPLPVTPDLPTLRAKLQGLLQFLRDALSISNAHTVDFYTESVWEELVDLPPETVLAALRKSASETEALPSETRPLVEAEWEAGMTDFPKIFCETSQKLVSVEAFALAAKYYSVQNLGICTPFEQLLVALRGNQNQRIGENQKAVEFMNMKKSHEVQAMSELISSIADYYGIKQVIDLGSGKGYLSSFLSLKYGLKVYGIDSSNTNTHGAEERNRKLKKHWKLCHAQSRLDVNGLALKMAKERKVQNKVKNKADTEEVKAKNKQEETGLSDMMKWAGTYATKGFKAGEFNVNKGWCDDFRKTFGLKQIVKIIGEAADADQEAADKFPDAIKKTVEM

SEQ ID NO: 915921 - protein, 252 aa, Homo sapiens
MTDFPKIFCETSQKLVSVEAFALAAKYYSVQNLGICTPFEQLLVALRGNQNQRIGENQKAVEFMNMKKSHEVQAMSELISSIADYYGIKQVIDLGSGKGYLSSFLSLKYGLKVYGIDSSNTNTHGAEERNRKLKKHWKLCHAQSRLDVNGLALKMAKERKVQNKVKNKADTEEVKAKNKQEETGLSDMMKWAGTYATKGFKAGEFNVNKGWCDDFRKTFGLKQIVKIIGEAADADQEAADKFPDAIKKTVEM

SEQ ID NO: 915922 - protein, 144 aa, Homo sapiens
MSLCTGIIEYSSWHRVGSAITVFYGSLLWAKPVRDVAVPAWQTIGLCLPHRARHTAGAQEDTLLVYESLLTSNLLSTKGEIVISQWRGQADTTLTKGEDFTEEGIVGIGFYGCTGTCQIDKRKKGIPGRQASRTQKELKHLGKL

SEQ ID NO: 915923 - protein, 166 aa, Homo sapiens
MITLSSAFSAKQKTHAHKNTHACMCATDMANPKLVLHFEVIVALLSLLQTILSLLLGQRTWLAHLYVLSTENDALHTVGTQKHLLPHDWCFGKHCVSCRHHIFHRFCSIFSSTLKRSQGFEGYPNLNSLLQKGSALSLCSNGFEDHNDYSVLIHGCTLWHACELFS

SEQ ID NO: 915924 - protein, 166 aa, Homo sapiens; identical to SEQ ID NO: 915923

SEQ ID NO: 915925 - protein, 146 aa, Homo sapiens
LALLCMSFILLWTRHKHVLMLKINNELSLNVDFISIPFCYSEPSLFQIAIFFSLITSALLLLCLVGKEKKVSIISLLDCGMKQMGHFANIQSYLEISETYILNPSVLILTIVTIVINTFIFYLSHWTVGSLKTVEYCLSPYCQCPA

SEQ ID NO: 915926 - protein, 153 aa, Homo sapiens
MALCSLTLATVGVFAAETGKCCKVVTWWFHRVRSIPEYSVVDTKEAKRANSPSKADDLLWKIVKHMLWKFSLIFIPYAGSQDGATGRFFSSHEHILSLNPRAMICIIKDIGQASLRFFVLWDVLEAAVTLPRSVLWFLIIPLGSFGFQVIPLT

SEQ ID NO: 915927 - protein, 524 aa, Homo sapiens
MEFPEHSQQLLQSLREQRSQGFLCDCTVMVGSTQFLAHRAVLASCSPFFQLFYKERELDKRDLVCIHNEIVTAPAFGLLLDFMYAGQLTLRGDTPVEDVLAAASYLHMNDIVKVCKRRLQARALAEADSTKKEEETNSQLPSLEFLSSTSRGTQPSLASAETSGHWGKGEWKGSAAPSPTVRPPDEPPMSSGADTTQPGMEVDAPHLRAPHPPVADVSLASPSSSTETIPTNYFSSGISAVSLEPLPSLDVGPESLRVVEPKDPGGPLQGFYPPASAPTSAPAPVSAPVPSQAPAPAEAELVQVKVEAIVISDEETDVSDEQPQGPERAFPSGGAVYGAQPSQPEAFEDPGAAGLEEVGPSDHFLPTDPHLPYHLLPGAGQYHRGLVTSPLPAPASLHEPLYLSSEYEAAPGSFGVFTEDVPTCKTCGKTFSCSYTLRRHATVHTRERPYECRYCLRSYTQSGDLYRHIRKAHNEDLAKRSKPDPEVGPLLGVQPLPGSPTADRQSSSGGGPPKDFVLAPKTNI

SEQ ID NO: 915928 - protein, 232 aa, Homo sapiens
LPSYCQKVQRLTDRCHPCPACLWLFLCPVHRSLPCPYLALTKSASVVSQPPASLFPPPPSFLSPGLPASEVGTQRVQDAWSALWVLDGAPTSAKMTWRQAVLLSCFSAVVLLSMLREGTSVSVGTMQMAGEEASEDAKQKIFMQESDASNFLKRRGKRSPKSRDEVNVENRQKLRVDELRREYYEEQRNEFENFVEEQNDEQEERSREAVEQWRQWHYDGLHPSYLYNRHHT

SEQ ID NO: 915929 - protein, 162 aa, Homo sapiens
VSLRWWLKCGESLVKKLLAKGGGRMLGIKGCHYIPGSWSPYHSCPKGQEEPFGGDATPGLKDERRRWGILSDIYQQQTIQTSLVKYGPCQLGCQHQSGDGGGQTAAGHRGAQSCRPRVKALSDGPGFCSDTNVFGLFLSELKEPHMSDGFTRGRYKGQGRRA

SEQ ID NO: 915930 - protein, 162 aa, Homo sapiens; identical to SEQ ID NO: 915929

SEQ ID NO: 915931 - protein, 179 aa, Homo sapiens
MGIDSLGAQISAVQVQMSTLVKVTPTLIPSVGQGRDIWLVFGMLYPAYYSYKAVKTKNVKEYVRWMMYWIVFALYTVIETVADQTVAWFPLYYELKIAFVIWLLSPYTKGASLIYRKFLHPLLSSKEREIDDYIVQAKERGYETMVNFGRQGLNLAATAAVTAAVKDFWLTSAPLLQSI

SEQ ID NO: 915932 - protein, 189 aa, Homo sapiens
MSVQNAGPLWKGQAQRQGQVGKKEKQIEQSPTILPLLVGKQAQGRLLPRELFSSEGHCPRRLVSRASGILICHRSPEICAADCGGHGVCVGGTCRCEDGWMGAACDQRACHPRCAEHGTCRDGKCECSPGWNGEHCTIAPPRLHAEHSRSMRNICTMPKKQALPKRKDAYCHHLHPEVLKRKMQELMKS

SEQ ID NO: 915933 - protein, 151 aa, Homo sapiens
MITMTLEYLNNCITCTFSTLPPSTANYFIIYRVSVWLTLSHCKLCRSALSIFSDDLSAIGKFYAWKYITSHPLRRFLKCKNLHPEILIQWFGAKNLQNKMPRALDLTHFIINLSFLLVFSKEEADAEIVEKLAQVHIANKRQLVVFKPTGV

SEQ ID NO: 915934 - protein, 151 aa, Homo sapiens; identical to SEQ ID NO: 915933

SEQ ID NO: 915935 - protein, 463 aa, Homo sapiens
MPHKTCEESDGKLIEDSLIQLRCHFTWKLLIEAPEIPDLENRIWEEIQFLDTKYNVGIHNLLAYVKHLKGQNEEALVSLKKAEDLIQKEHANQADIRSLVTWGNFAWVYYHMGRLAEAQTYLDKVENTCKKFANPSRYRMECPEVDCEEGWALAKCGGKNYERAKTCFEKALEGNPENPEFNTGYAITVYRLDKFNTASGRNKAFSLHVLKRAVRLNPDDVYIRVLLALKLQDEGQEAEGEKYIEEALTSISSQAYVFQYAAKFYRRKGSVDKALELLKMALETTPTSAFLHHQMGLCYRAQMIQIKEATNWQPRGQDRETVDRLVQLAICKFEKTIMLKRTFEMAYVDLAETYAEIGHHRKAEEHFQKGLRMKIFEDQLKQEIHYHYGRFQEHHGKSQDKAITHYLKGLKIEKMSHSREKLLNALEKLAKRCIHQNVRVVESVSLLGLIHKLKGESLGVCIS

SEQ ID NO: 915936 - protein, 153 aa, Homo sapiens
ISSCLVKMPSSVPKSISWMTARQFCFCLKGLIYLPPMFMPSFPLACICLGFHGSDRKAPTELSESPEKGWQFPRDPAMYRVAVGSRKRQLLQDSQAPAGFLIHLPKKQGGVKGVEEMKCQGFTVRALTPGFNSQLQVRHCSGAPRIPQIFQER

SEQ ID NO: 915937 - protein, 269 aa, Homo sapiens
SRNQEVTVCPASHLTLDRDIKSPGSGGSTPAPPSHLLLYLLHPQSTRTMGCCGCSGGCGSGCGGLGSGCGGCGSGCGGRGSGCGGCGSGCGGCGSGCGGCGSGCGGCGGCGSGCCVPVCCCKPMCCCVPACSCSSCGKGGCGSCGGSKRGCVSCGVSKGACGSCGGSKGGCGSCGGSKGGCGSCGGSKGGCGSYGCSQCSCCKPCCCSSGCGSSCCQSSCCKPYCCQSSCCKPCSCFSGCGSSCCQSSCYKPCCCQSSCCVPVCCQCKI

SEQ ID NO: 915938 - protein, 154 aa, Homo sapiens
LGPPGRRGRGAGRPMPSHKCSWWRSWPGFRWGCITLPSGPLAYARTAGEETSQLPKKGGLVWVPSSLASTHRWPSIQKSLCCPLLPLEIFPCPWLAALASQGPPTCGLTDMQSPPGSSQREQMTYQSAGDAVSNTIARKLLSWKWCSHEDGKNT

SEQ ID NO: 915939 - protein, 154 aa, Homo sapiens; identical to SEQ ID NO: 915938

SEQ ID NO: 915940 - protein, 278 aa, Homo sapiens
PNCLRDNQPTPLSSLGVVLSRGHGEYILLGNTSVEEGLHDLLHPDLALAGDWIYCITDIDPDHRKLSQLEAMIRFLTRKDPDLECDEELVREVLFDAVVTAPMEAYWTALALNMSEESEHVVDMAFLGTRAGLLRSSLFVGSEKVSDRKFLTPEDEASVFTLDRFPLWYRQASEHPAGSFVFNLRWAEGPESAGEPMVVTASTAVAVTVDKRTAIAAAAGVQMKLEFLQRKFWAATRQCSTVDGPCTQSCEDSDLDCFVIDNNGFILISKRSRESDYV

SEQ ID NO: 915941 - protein, 441 aa, Homo sapiens
MKLEFLQRKFWAATRQCSTVDGPCTQSCEDSDLDCFVIDNNGFILISKRSRETGRFLGEVDGAVLTQLLSMGVFSQVTMYDYQAMCKPSSHHHSAAQPLVSPISAFLTATRWLLQELVLCVGVDTGLVEGCMRGWLRRVSLSRRLQGLQDNPLATRPRGRRAQSLGMDATSSLHAAPGRDLIAQPEPSSREEGVLEERGWAGGCQGYSSSLGTQVGRAQRSPRFSPVSDRFLLEWSVWGSWYDRGAEGECTELQGHVLKSSGILVTLKHRCSHLTLRGLLSSHPSLLALCVTSSWDTATPCAIITTTMTSCPHVPPCFPVPCPPCAGLMFRPAKSVFHHSHKHKKQDPLQPCDTEYPVFVYQPAIREANGIVECGPCQKRMPRTAAAPRTPQPRRPYSCCLCVPGGYCPNSCGDTTQPDLCFGKVILPEPSHKVSTDMGCS

SEQ ID NO: 915942 - protein, 508 aa, Homo sapiens
MKLEFLQRKFWAATRQCSTVDGPCTQSCEDSDLDCFVIDNNGFILISKRSRETGRFLGEVDGAVLTQLLSMGVFSQVTMYDYQAMCKPSSHHHSAAQPLVSPISAFLTATRWLLQELVLCVGVDTGLVEGCMRGWLRRVSLSRRLQGLQDNPLATRPRGRRAQSLGMDATSSLHAAPGRDLIAQPEPSSREEGVLEERGWAGGCQGYSSSLGTQVGRAQRSPRFSPVSDRFLLEWSVWGSWYDRGAEGECTELQGHVLKSSGILVTLKHRCSHLTLRGLLSSHPSLLALCVTSSWDTATPCAIITTTMTSCPHVPPCFPVPCPPCAGLMFRPAKSVFHHSHKHKKQDPLQPCDTEYPVFVYQPAIREANGIVECGPCQKVFVVQQIPNSNLLLLVTDPTCDCSIFPPVLQEATEVKYNASVKCDRMRSQKLRRRPDSCHAFHPEVRVEADRGWAGFSSPNPLCLGLCPSALRSQENAQDCGGASDTSASPPLLLLPVCAWGLLPQLLR

SEQ ID NO: 915943 - protein, 204 aa, Homo sapiens [sequence omitted]

SEQ ID NO: 915944 - protein, 267 aa, Homo sapiens
MKLEFLQRKFWAATRQDLDCFVIDNNGFILISKRSRETGRFLGEVDGAVLTQLLSMGVFSQVTMYDYQAMCKPSSHHHSAAQPLVSPISAFLTATRWLLQELVLFLLEWSVWGSWYDRGAEAKSVFHHSHKHKKQDPLQPCDTEYPVFVYQPAIREANGIVECGPCQKVFVVQQIPNSNLLLLVTDPTCDCSIFPPVLQEATEVKYNASVKCDRMRSQKLRRRPDSCHAFHPEENAQDCGGASDTSASPPLLLLPVCAWGLLPQLLR

SEQ ID NO: 915945 - protein, 286 aa, Homo sapiens
PNCLRDNQPTPLSSLGVVLSRGHGEYILLGNTSVEEGLHDLLHPDLALAGDWIYCITDIDPDHRKLSQLEAMIRFLTRKDPDLECDEELVREVLFDAVVTAPMEAYWTALALNMSEESEHVVDMAFLGTRAGLLRSSLFVGSEKVSDRKFLTPEDEASVFTLDRFPLWYRQASEHPAGSFVFNLRWAEGPESAGEPMVVTASTAVAVTVDKRTAIAAAAGVQMKLEFLQRKFWAATRQCSTVDGPCTQSCEDSDLDCFVIDNNGFILISKRSREPGIKLRKKPIQT

SEQ ID NO: 915946 - protein, 478 aa, Homo sapiens
MKLEFLQRKFWAATRQCSTVDGPCTQSCEDSDLDCFVIDNNGFILISKRSRETGRFLGEVDGAVLTQLLSMGVFSQVTMYDYQAMCKPSSHHHSAAQPLVSPISAFLTATRWLLQELVLCVGVDTGLVEGCMRGWLRRVSLSRRLQGLQDNPLATRPRGRRAQSLGMDATSSLHAAPGRDLIAQPEPSSREEGVLEERGWAGGCQGYSSSLGTQVGRAQRSPRFSPVSDRFLLEWSVWGSWYDRGAEGECTELQGHVLKSSGILVTLKHRCSHLTLRGLLSSHPSLLALCVTSSWDTATPCAIITTTMTSCPHVPPCFPVPCPPCAGLMFRPAKSVFHHSHKHKKQDPLQPCDTEYPVFVYQPAIREANGIVECGPCQKVFVVQQIPNSNLLLLVTDPTCDCSIFPPVLQEATEVKYNASVKCDRMRSQKLRRRPDSCHAFHPEENAQDCGGASDTSASPPLLLLPVCAWGLLPQLLR

SEQ ID NO: 915947 - protein, 504 aa, Homo sapiens
PNCLRDNQPTPLSSLGVVLSRGHGEYILLGNTSVEEGLHDLLHPDLALAGDWIYCITDIDPDHRKLSQLEAMIRFLTRKDPDLECDEELVREVLFDAVVTAPMEAYWTALALNMSEESEHVVDMAFLGTRAGLLRSSLFVGSEKVSDRKFLTPEDEASVFTLDRFPLWYRQASEHPAGSFVFNLRWAEGPESAGEPMVVTASTAVAVTVDKRTAIAAAAGVQMKLEFLQRKFWAATRQCSTVDGPCTQSCEDSDLDCFVIDNNGFILISKRSRETGRFLGEVDGAVLTQLLSMGVFSQVTMYDYQAMCKPSSHHHSAAQPLVSPISAFLTATRWLLQELVLFLLEWSVWGSWYDRGAEAKSVFHHSHKHKKQDPLQPCDTEYPVFVYQPAIREANGIVECGPCQKVFVVQQIPNSNLLLLVTDPTCDCSIFPPVLQEATEVKYNASVKCDRMRSQKLRRRPDSCHAFHPEENAQDCGGASDTSASPPLLLLPVCAWGLLPQLLR

SEQ ID NO: 915948 - protein, 263 aa, Homo sapiens
PNCLRDNQPTPLSSLGVVLSRGHGEYILLGNTSVEEGLHDLLHPDLALAGDWIYCITDIDPDHRKLSQLEAMIRFLTRKDPDLECDEELVREVLFDAVVTAPMEAYWTALALNMSEESEHVVDMAFLGTRAGLLRSSLFVGSEKVSDRKFLTPEDEASVFTLDRFPLWYRQASEHPAGSFVFNLRWAEGPESAGEPMVVTASTAVAVTVDKRTAIAAAAGVQMKLEFLQRKFWAATRQDLDCFVIDNNGFILISKRSRESDYV

SEQ ID NO: 915949 - protein, 495 aa, Homo sapiens
MKLEFLQRKFWAATRQCSTVDGPCTQSCEDSDLDCFVIDNNGFILISKRSRETGRFLGEVDGAVLTQLLSMGVFSQVTMYDYQAMCKPSSHHHSAAQPLVSPISAFLTATRWLLQELVLCVGVDTGLVEGCMRGWLRRVSLSRRLQGLQDNPLATRPRGRRAQSLGMDATSSLHAAPGRDLIAQPEPSSREEGVLEERGWAGGCQGYSSSLGTQVGRAQRSPRFSPVSDRFLLEWSVWGSWYDRGAEGECTELQGHVLKSSGILVTLKHRCSHLTLRGLLSSHPSLLALCVTSSWDTATPCAIITTTMTSCPHVPPCFPVPCPPCAGLMFRPAKSVFHHSHKHKKQDPLQPCDTEYPVFVYQPAIREANGIVECGPCQKVFVVQQIPNSNLLLLVTDPTCDCSIFPPVLQEATEVKYNASVKCDRMRSQKLRRRPDSCHAFHPEVRVEADRGWAGFSSPNPLCLGLCPCRQEHIGMPMNTPVPVLLGGNIRVYAL

SEQ ID NO: 915950 - protein, 133 aa, Homo sapiens
YTWTANPMLTGSTFCFACFRASPSGSKFLNVSRRMMKEMGPTLSELSTVEAEDTESSIAATVMDGIDRENPTKELDFSHESAVSSEKVKFYQMILGSPSKGFQRENATYQESCLSCCRVEVNKIKKSPMLTQF

SEQ ID NO: 915951 - protein, 133 aa, Homo sapiens; identical to SEQ ID NO: 915950

SEQ ID NO: 915952 - protein, 156 aa, Homo sapiens
MGKDSSRQQRKGASMRLTMAGSTPPCDAVRGQTNAGTENQIAHVLTYKWEPNDENTWTQRGTTHTGAHLRLEGGGGRGAEKITIGVAPAENLLQSPVQKEDVEPQPGPGKSIPPSHKPVAPTYSGQATPKGSRVVKSPGSPGKRFLDSTWGGIYLD

SEQ ID NO: 915953 - protein, 160 aa, Homo sapiens
WRRMEAVVQQPVHSGGAGAHGGPWRVRDRALLLPAAVAHAGGWRGCARAPAQAASLEVILRRLYFPGSSLRLPIQQPQSRRLGMANPALLPSSCRLPHLLCALPPARRPHGAGLEHASPGRGIGDPRAPPAGAPAARLPLIPRPRDFKRGFLASQTGPRH

SEQ ID NO: 915954 - protein, 141 aa, Homo sapiens
MRGAAFTIPSLKQRPCMVCPERRGRTKSSLAPPARSPDAGPQISKDLEPPPHGCQEADRGGSWGATTPRPFRQNLSDLGRHSVLPLKRNLCPGGSSLGAPPPRTPQRRVTLAAQRWLSRPQRRAVGLGELDQGARLAALGL

SEQ ID NO: 915955 - protein, 134 aa, Homo sapiens
MLWDEILALSGSVCDGPVGFRGDRLGSVGLQLLSQEDLGRSQSESLGLEFQGLWEWLPGNTEDCQETTGSYEEARQDSPTSAGGSVALLAPPFQTAGYQSHKTINFSGFKSPSFWTRGLLLIYIYGKVEGILQM

SEQ ID NO: 915956 - protein, 148 aa, Homo sapiens
MVMYFIKHSSQFKRQSPKTNRGYPFKTVSTLWKLCTFTLLNKACSFFSLSVHVSFTHCGQLPHHFFGVAWQEPQVLHLGEPDRRLQKRYLDHHADQSHQATNDLTNGTSNELSSRLLPRTPGSTRWSLNYPRKFPSGGHQTAGPLLHP

SEQ ID NO: 915957 - protein, 179 aa, Homo sapiens
MVMYFIKHSSQFKRQSPKTNRGYPFKTVSTLWKLCTFTLLNKACSFFSLSVHVSFTHCGQLPHHFFGVAWQEPQVLHLGEPDRRLQKRIKAIKLQMILQMEPQMSSAHGFYRGPLDQPAGPSITLENSPLEDTKLQGPFFTPNQQEVARTTATRFPTAVGVSCLEAGLRGGASWASWVK

SEQ ID NO: 915958 - protein, 128 aa, Homo sapiens
MVMYFIKHSSQFKRQSPKTNRGYPFKTVSTLWKLCTFTLLNKACSFFSLSVHVSFTHCGQLPHHFFGVAWQEPQVLHLGEPDRRLQKRGDFPVPVQCLQRKIIHLPFYCLVRMLEPARPTAEILFRNC

SEQ ID NO: 915959 - protein, 170 aa, Homo sapiens
AQDIQKFCSLSEDMLSQNMALWHIKCFKLKEFEKQQVKERFSDPPLMQAIKPSHEKYPPYAQRKGTSLSPKTQGHGDDEQALLSFLHSITLSLYLYPTTFFHDSPVFIKPGIKTLRLNHFFGSSFPYEGSSAGIVKGTTFQTLQFQCGTEGFQNSGDNEIRFAHCDNTGL

SEQ ID NO: 915960 - protein, 170 aa, Homo sapiens; identical to SEQ ID NO: 915959

SEQ ID NO: 915961 - protein, 395 aa, Homo sapiens
MHRQKADEAYLYRRGLAPVQAYLHIPDIIKVAKENNVDAVHPGYGFLSERADFAQACQDAGVRFIGQAQKWIRKMGDKVEARAIAIAAGVPVVPGTDAPITSLHEAHEFSNTYGFPIIFKAAYGGGGRGMRVVHSYEELEENYTRAYSEALAAFGNGALFVEKFIEKPRHIEVQILGDQYGNILHLYERDCSIQRRHQKVVEIAPAAHLDPQLRTRLTSDSVKLAKQVGYENAGTVEFLVDRHGKHYFIEVNSRLQVEHTVTEEITDVDLVHAQIHVAEGRSLPDLGLRQENIRINGCAIQCRVTTEDPARSFQPDTGRIEVGGARAEGDASSPVHRFCLVPGAAVPSCHSPAVREDPHVGSEVDIEYTEAGSAQRRGGASQGKRLLGAQVRRKP

SEQ ID NO: 915962 - protein, 273 aa, Homo sapiens
KTLSYYQARLLSLRMKTCTQAASHSGMAATHQKAVKIIAYKNGDGYRNGKLIVAGTFPMDKSLKLLSVALYNLVLWRRVAACQPATMVPTKSPVQPVVVEGGWTEQTQQEIKLMELIRHTEAHLSEIQEMESKINFPIATKRIAVKPSNLYKQPNTKRVWIYLNGGRPEDGTYAWGKTISELLQDCSSRLKMTHPARALYTPSGEPIQSWDDIERDMVICVSMGHGFKTPKELKQLMEIRANYARIRRQQGPQATDIVVSPSTKLLSLAHLHN

SEQ ID NO: 915963 - protein, 142 aa, Homo sapiens
MCPQECFHWCCDFLQAHYGNMTIRWAKKSTALQTGKNSRLKGKGGVAAGPVLESAKKLGEERLGEGLKTQNERPRLKTYNTPLKNNTIKVLEENIGSDVSYTFSREGLPKYHKKPNLKLEISKNKSNRLSQFCVCYKQNTID

SEQ ID NO: 915964 - protein, 220 aa, Homo sapiens
MKEKLSLTKVKLLERELLLRLSRLPPLLKARSLQLGDVSEFMSDASDFRAGSITGSRAGASSPFCGNSSLLETPNTNDNGANGHTRVYGAAQATRSSCHSPERAGFAKRQSHIPAAEPCRLFLYDVSCIHFPSGPTPKFRTILARAYIIATAIVFICFVLLYKEQTYLACGLGGWEIQDPGPHLLKAFLLYRNITGGITGERERAQERAKLAFIVNPLLQ

SEQ ID NO: 915965 - protein, 164 aa, Homo sapiens
MAWLSDMSLCCTRLCTLYSASEVACAGPCVIKGFVCFPTRLLAGPAYQPVAGACTAPGPCIPGLASCHALSTSLLLRGAASVAWGLPIVAQACSSDLSWHLVLQRSSPFCWPSAFAHLDLLRELGCPVCAYLCVPAPGTGRAQSGCLLEARGWVSSAVSCGVSA

SEQ ID NO: 915966 - protein, 242 aa, Homo sapiens
MMLPVSSPLRHKTLLSLSLGKTLLWRIPPVSPLLELNKTPIDQRQCSCGESFVIHEPAPGQLGKLWEIEQGPNENPSVFLKILREWLQDYTLWKPEDPEKLSSAWFPIHLSEYPRYSEETPKLVINPGTLPSQLIDIAFKINKNRDVASDKREDKKMERQAHFLAVALQTTSGEPGGRKKKAWISKQRPRHGTQRVPKLGPTQCAYCKQEGHWKRKCPDPPRRGKKEDKPKHQFPVNGEKTD

SEQ ID NO: 915967 - protein, 115 aa, Homo sapiens
MLETGFHHVGQAGLKLLISGDPLLSASQSAEITGVSHHAHLFKTFLRTVPDLPGNLGHQNPNIVLVLPKVPDTGFTHRHSDLIDDIANSGKTGWRWVVRSLLGPRLDFGNLEFIL

SEQ ID NO: 915968 - protein, 362 aa, Homo sapiens
MEIKKQITGMRRLLNDSTGRIYQRVGKEGEKLKEEPQDLDLVWPPRLNSSAEAPQSLHPSSRGVWNELPPQSGQFSGQYGTRSRTFQSQPHPTTSSNGELPVVNSSAGSNCCTCNCQSTLQAILQELKTMRKLMQIQAVGTQNRQQPPISLICSQRTAVSRKRNKKKKVPPKTVEPLTVKQKPSGSEMEKKSVVASELSALQAAEHTSPEESRVLGFGIVLESPSSDPEVQLAEGFDVFMPKSQLDSILSNYTRSGSLLFRKLVCAFFDDKTLANSLPNGKRKRGLNDNRKGLDQNIVGAIKVFTEKYCTANHVDKLPGPRDWVQILQDQIKLARRRLKRGSEIADSDERLDGIALPPTGLY

SEQ ID NO: 915969 - protein, 375 aa, Homo sapiens
MEIKKQITGMRRLLNDSTGRIYQRVGKEGEKLKEEPQDLDLVWPPRLNSSAEAPQSLHPSSRGVWNELPPQSGQFSGQYGTRSRTFQSQPHPTTSSNGMVVNKHSEGSHGGELPVVNSSAGSNCCTCNCQSTLQAILQELKTMRKLMQIQAVGTQNRQQPPISLICSQRTAVSRKRNKKKKVPPKTVEPLTVKQKPSGSEMEKKSVVASELSALQAAEHTSPEESRVLGFGIVLESPSSDPEVQLAEGFDVFMPKSQLDSILSNYTRSGSLLFRKLVCAFFDDKTLANSLPNGKRKRGLNDNRKGLDQNIVGAIKVFTEKYCTANHVDKLPGPRDWVQILQDQIKLARRRLKRGSEIADSDERLDGIALPPTGLY

SEQ ID NO: 915970 - protein, 278 aa, Homo sapiens
GLFGVCHSFLSCSGELPVVNSSAGSNCCTCNCQSTLQAILQELKTMRKLMQIQAVGTQNRQQPPISLICSQRTAVSRKRNKKKKVPPKTVEPLTVKQKPSGSEMEKKSVVASELSALQAAEHTSPEESRVLGFGIVLESPSSDPEVQLAEGFDVFMPKSQLDSILSNYTRSGSLLFRKLVCAFFDDKTLANSLPNGKRKRGLNDNRKGLDQNIVGAIKVFTEKYCTANHVDKLPGPRDWVQILQDQIKLARRRLKRGSEIADSDERLDGIALPPTGLY

SEQ ID NO: 915971 - protein, 139 aa, Homo sapiens
NGAVKALIIVKYQRETSTVCHMESVIYSFMNHTFIPAYYVPAVNGRRDLCPCFELAVLMNTGHCYFKKSLVNELRVMELVCIFPIHSYFATCVPVNPIHYCFVSCLQICGHSITRSAITLSESFPRYPLPPNNGSVCTQ

SEQ ID NO: 915972 - protein, 363 aa, Homo sapiens
MEIKKQITGMRRLLNDSTGRIYQRVGKEGEKLKEEPQDLDLVWPPRLNSSAEAPQSLHPSSRGVWNELPPQSGQFSGQYGTRSRTFQSQPHPTTSSNGELPVVNSSAGSNCCTCNCQSTLQAILQELKTMRKLMQIQAVGTQNRQQPPISLICSQRTAVSRKRNKKKKVPPKTVEPLTVKQKPSGSEMEKKSVVASELSALQAAEHTSPEESRVLGFGIVLESPSSDPEVQLAEGFDVFMPKSQLDSILSNYTRSGSLLFRKLVCAFFDDKTLANSLPNGKRKRGLNDNRKGLDQNIVGAIKVFTEKYCTANHVDKLPGPRDWVQILQDQIKLARRRLKRGSEIADSDERLDGIALPPTGKKA

SEQ ID NO: 915973 - protein, 139 aa, Homo sapiens; identical to SEQ ID NO: 915971

SEQ ID NO: 915974 - protein, 489 aa, Homo sapiens
MVQTDVLLPEPAPQTVSPCELPCKEYDVARNMGNCYARYHQAFADCNQSERELQGRESQQLAAETQALAQPTQQDSTCRVGERLQDTHSWKSELQHEVEVLAAETDLLLAQKQRLERALDAMEVPFSIATDNMQCSQRHQHANLVRDYVETELLKAYPPAPSQCLKNCCSSRKPSACNKGACEVMETLTVQEEANPGTEGCRTRALAHKEEAEPIRNIQELLKRAIVQAVSQIHLQHGGSPVGPSLATHQGPAPPRPRLNREHTEICEMDWLDKVEAYNLDETCGRHHSQSTEVQAHPALHHLPREGGPSSAPVLALAVVSPPSAWGPQRRSFPQPGPDAFPPDGFVGNPRSASTPETRTKFTQDNLCRAQRKRLDSANLWVLVDCILRDTSEDLGLQCDAMNLAFGRRCEELEDARHKLQHHLHKMLREITDQEHNVVALKEAIKDKEEPLHIAQTRLYLPSHRPNMQLCREAAQFSPSSHPPTPPSW

SEQ ID NO: 915975 - protein, 124 aa, Homo sapiens [sequence omitted]

SEQ ID NO: 915976 - protein, 98 aa, Homo sapiens
SHWSGPPSGHSPRSWVGPDWSPHSICPGMGALAQGALSCLQMLREITDQEHNVVALKEAIKDKEEPLHIAQTRLYLPSHRPNMQLCREAAQFRYCLGL

SEQ ID NO: 915977 - protein, 177 aa, Homo sapiens
SAVVELSSPGVWFYVPVAMFPVSSGCFQEQQETNKSLPRSASTPETRTKFTQDNLCRAQRKRLDSANLWVLVDCILRDTSEDLGLQCDAMNLAFGRRCEELEDARHKLQHHLHKMLREITDQEHNVVALKEAIKDKEEPLHIAQTRLYLPSHRPNMQLCREAAQFSPSSHPPTPPSW

SEQ ID NO: 915978 - protein, 195 aa, Homo sapiens
SAVVELSSPGVWFYVPVAMFPVSSGCFQEQQETNKSLPRSASTPETRTKFTQDNLCRAQRKRLDSANLWVLVDCILRDTSEDLGLQCDAMNLAFGRRCEELEDARHKLQHHLHKPQLTPPNTPKLVSEVEELYKSITVPREKLLQAEQSLCNLEDIHMSLEKDITAMTNSLFIDRQKCMAHRTCYPTILQLAGYQ

SEQ ID NO: 915979 - protein, 164 aa, Homo sapiens
TIFFHFLYFQLVWIQVMGQVKYIRGHQTLGHRPVHDLLATRPHSRRLFKARNENGPQTCEKIYSSLLIIIQMSIKIIPRIYQKPKNLTTSSVVWKQEYPCIAYGNATSFNAYGEEHSNIWKNFREFITLTQLATCRSLSQIYTSKLIKLLRHKIIIYGYICNAT

SEQ ID NO: 915980 - protein, 314 aa, Homo sapiens
MKRQNQSCVVEFILLGFSNFPELQVQLFGVFLVIYVVTLMGNAIITVIISLNQSLHVPMYLFLLNLSVVEVSFSAVITPEMLVVLSTEKTMISFVGCFAQMYFILLFGGTECFLLGAMAYDRFAAICHPLNYPVIMNRGVFMKLVIFSWISGIMVATVQTTWVFSFPFCGPNEINHLFCETPPVLELVCADTFLFEIYAFTGTILIVMVPFLLILLSYIRVLFAILKMPSTTGRQKAFSTCASHLTSVTLFYGTANMTYLQPKSGYSPETKKLISLAYTLLTPLLNPLIYSLRNSEMKRTLIKLWRRKVILHTF

SEQ ID NO: 915981 - protein, 406 aa, Homo sapiens
MVQEGDLEEEKSDIVCPGCHCRPPDYEKGVLILLLFCLLRGIIVMYNSWESWVCTAAEECGYGSWLCPKLKAHSWPDTVPVVSEEEGRKEAGSKKKAPDMLLLAKKFSFPDTLEPAELLGRYSVCPHPSPEWRSPGVQREPCAEGWCQIASRLWQHFPVSGPVSRMRASWEELLSSAEGRGEGAEARHCLENSGQWPEMALAIRSCVTLVKCDNSSKLWFPFLQSGVNSSTQEACCVVISLGSGADEPTSPKRPKSISEPQHSDAEGDAASPLPSEWTSVRISPGEEAAGQDVLAVRVLVTSEDSSSDTESDYGGSEGSHTEPCEEKPWRPGSPHLPHTSLGEALSRAVSPQCPEEPRAVHAALQRANSFQSPTPSKYQNWRREFWWSESLALWGWEAGAGQKISG

SEQ ID NO: 915982 - protein, 452 aa, Homo sapiens
MVQEGDLEEEKSDIVCPGCHCRPPDYEKGVLILLLFCLLRGIIVMYNSWESWVCTAAEECGYGSWLCPKLKAHSWPDTVPVVSEEEGRKEAGSKKKAPDMLLLAKKFSFPDTLEPAELLGRYSVCPHPSPEWRSPGVQREPCAEGWCQIASRLWQHFPVSGPVSRMRASWEELLSSAEGRGEGAEARHCLENSGQWPEMALAIRSCVTLVKCDNSSKLWFPFLQSGVNSSTQEACCVVISLGSGADEPTSPKRPKSISEPQHSDAEGDAASPLPSEWTSVRISPGEEAAGQDVLAVRVLVTSEDSSSDTESDYGGSEGSHTEPCEEKPWRPGSPHLPHTSLGEALSRAVSPQCPEEPRAVHAALQRANSFQSPTPSKYQNWRREFWWSLTPVNKRTMSPPKDPSPSLPLPSSSSHSSSPPSSSSTSVSGNAPDGSSPPQVSVPEGPAQVSGS

SEQ ID NO: 915983 - protein, 152 aa, Homo sapiens
NLILSANYNVEMQILKTHWGLVNQKLCSKGVLRHQPCTSTLLQHEREPCLGVEGSSGSATYFCYTEVRIYWDQSRTDTGSLGSPPHKCIPGKVICVLIDISVGCGPFLTPGRSHLYWPLPILLVHMVSPLMADTFPLKKPRFRGGLIKCTDV

SEQ ID NO: 915984 - protein, 162 aa, Homo sapiens
WSPELCRALLGSLLFPAGHLPAGAGMLYGEAFPSMTSFSVCLSLGAQELVRMDSSRQALGMFDPNAINSIDQRETCPQIPEAEVLEVSVIFGFLAVPGVDGPGDVFFPSLEFGCQTPGLAAAVWRGRRPAAEQPPHFLLSFLWCGPALSSLDPFTTERIWAS

SEQ ID NO: 915985 - protein, 366 aa, Homo sapiens
LHGGHEILRQPERLLFILDGFDELQRPFEEKLKKRGLSPKESLLHLLIRRHTLPTCSLLITTRPLALRNLEPLLKQARHVHILGFSEEERARYFSSYFTDEKQADRAFDIVQKNDILYKACQVPGICWVVCSWLQGQMERGKVVLETPRNSTDIFMAYVSTFLPPDDDGGCSELSRHRVLRSLCSLAAEGIQHQRFLFEEAELRKHNLDGPRLAAFLSSNDYQLGLAIKKFYSFRHISFQDFFHAMSYLVKEDQSRLGKESRREVQRLLEVKEQEGNDEMTLTMQFLLDISKKDSFSNLELKFCFRISPCLAQDLKHFKEQMESMKHNRTWDLEFSLYEAKIKNLVKEPLKRSMQETECYDFQCQE

SEQ ID NO: 915986 - protein, 416 aa, Homo sapiens
TLARKMVLDWATGTLYPGRFDYVFYVSCKEVVLLLESKLEQLLFWCCGDNQAPVTEILRQPERLLFILDGFDELQRPFEEKLKKRGLSPKESLLHLLIRRHTLPTCSLLITTRPLALRNLEPLLKQARHVHILGFSEEERARYFSSYFTDEKQADRAFDIVQKNDILYKACQVPGICWVVCSWLQGQMERGKVVLETPRNSTDIFMAYVSTFLPPDDDGGCSELSRHRVLRSLCSLAAEGIQHQRFLFEEAELRKHNLDGPRLAAFLSSNDYQLGLAIKKFYSFRHISFQDFFHAMSYLVKEDQSRLGKESRREVQRLLEVKEQEGNDEMTLTMQFLLDISKKDSFSNLELKFCFRISPCLAQDLKHFKEQMESMKHNRTWDLEFSLYEAKIKNLVKEPLKRSMQETECYDFQCQE

SEQ ID NO: 915987 - protein, 527 aa, Homo sapiens
MSLQMVTVSNNIALIQPGFSLMNFDGQVFFFGQKGWPKRSCPTGVFHLDVKHNHVKLKPTIFSKDSCYLPPLRYPATCTFKGSLESEKHQYIIHGGKTPNNEVSDKIYVMSIVCKNNKKVTFRCTEKDLVGDVPEARYGHSINVVYSRGKSMGVLFGGRSYMPSTHRTTEKWNSVADCLPCVFLVDFEFGCATSYILPELQDGLSFHVSIAKNDTIYILGGHSLANNIRPANLYRIRVDLPLGSPAVNCTVLPGGISVSSAILTQTNNDEFVIVGGYQLENQKRMICNIISLEDNKIEIREMETPDWTPDIKHSKIWFGSNMGNGTVFLGIPGDNKQVVSEGFYFYMLKCAEDDTNEEQTTFTNSQTSTEDPGDSTPFEDSEEFCFSAEANSFDGDDEFDTYNEDDEEDESETGYWITCCPTCDVDINTWVPFYSTELNKPAMIYCSHGDGHWVHAQCMDLAERTLIHLSAGSNKYYCNEHVEIARALHTPQRVLPLKKPPMKSLRKKGSGKILTPAKKSFLRRLFD

SEQ ID NO: 915988 - protein, 164 aa, Homo sapiens
MGRAIYRPPPLARSLHKGQGLRAALLLSAFPPLPAGFHPHVVHLTVTSWLLPFNITSKFTDRWATLNSQDTFRGASKGCTPSSSEQKTKVYKKGQRSGRDSAVGPRGPFALGAFHSLSGCVQGNKPHPHVSQKTWFLVCTLKPISCATLAFSLLILSSTYKRVG

SEQ ID NO: 915989 - protein, 237 aa, Homo sapiens
MPHNNQEIILKRAADIAEALYSVPRNHNQIPTLGNNPAHTGMMGVNSFSSQLAVNVSETSQANDQVGYSRNTSSVSPRGYVPSSTPQQSNYNTVSTSMNGYGSGAMASLGVPGSPGFLNGSSANSPYGIVPSSPTMAASSVTLPSNCSSTHGIFSFSPANVISAVKQKSAFAPVVRPQASPPPSCTSANGNGLQGSLLGAEDVAAEKTNWPFCEVGGIFHFDELMLKKGTGKLCLGW

SEQ ID NO: 915990 - protein, 237 aa, Homo sapiens; identical to SEQ ID NO: 915989

SEQ ID NO: 915991 - protein, 237 aa, Homo sapiens
MPHNNQEIILKRAADIAEALYSVPRNHNQIPTLGNNPAHTGMMGVNSFSSQLAVNVSETSQANDQVGYSRNTSSVSPRGYVPSSTPQQSNYNTVSTSMNGYGSGAMASLGVPGSPGFLNGSSANSPYGIVPSSPTMAASSVTLPSNCSSTHGIFSFSPANVISAVKQKSAFAPVVRPQASPPPSCTSANGNGLQGEGGAGPWASAGSSPGVGMGVGVGARPFSWHLCDCCMFSRGPP

SEQ ID NO: 915992 - protein, 194 aa, Homo sapiens
MPYDRYVAICNPLIYTAIMTQRVCRELVIGVYTYGFRNSVIQTALTFQLSFCNSDVIHHFYCADPPLLALSCSDTHNKEKQLMIFSAVNLTGSLLTIFISYICILFSIIKIQSSEGKCRAFSTRASHLTVVTIFYGTLFFMYLQQPKAGNSWKPNKVVSVFYSLVIPMLNPLIYRLRNTEVKDALKKMLEGKEL

SEQ ID NO: 915993 - protein, 147 aa, Homo sapiens
MAENDIIQNKKLAELLLIQICQGYGIPLAVAPHRLLLRRCSCLRVTHNKEILASTVSLGVEGYMLGGGSRINSSNLNDGEEECSPDSLLVWKKKSLLLWMSSLPSLGEKYFKRILRWREHWKSSGPIPLCNSKLLCKKNAPRSLFAS

SEQ ID NO: 915994 - protein, 120 aa, Homo sapiens
VVRSGVLGILRRCSCLRVTHNKEILASTVSLGVEGYMLGGGSRINSSNLNDGEEECSPDSLLVWKKKSLLLWMSSLPSLGEKYFKRILRWREHWKSSGPIPLCNSKLLCKKNAPRSLFAS

SEQ ID NO: 915995 - protein, 426 aa, Homo sapiens
MMDYPISGLDSNIGGSPNKFKARNQIPTGFESALFWWSTIKIVNWINYIYCNQQRFISYTWNALKGMVYVSCGELWINPDLSIAQQKKQIFLRNLESDIAKIQIFCSTHKIEEVQSDIVSGSKLAVHKPVAIFGEEKQVTEPEEKQMQEDPLTTENASSEILYAWQETSHDFDEDDSLPKKTEKGLFENVEPQKKHSCSPKHSKLHKHCHQQFEYRDGQIISHAAPQLVLGVQGPNLRSGMEVVLVEKKSDGSHQRWIHQEDSSNPDLVLAVSMTKTRNEVCGYPVIVQKYKPYNNGAANQKWHYMKNIKALVAFHSTALDKEITSANYAGVCTSSVIKEENIDQPGYCYLSPDGKRKTMLCLACGQSMRTEKGLKQLLPGVPFLCISGTKTQKPFLQGPFKVISVAEVCNDLSSANACMATIWKL

SEQ ID NO: 915996 - protein, 387 aa, Homo sapiens
VERRGGPPEPGRVGGGTRVRPGRARGEGLPGLRPGVVRGAQRPPGRAMGNRSTADADGLLAGRGPAAGASAGASAGLAGQGAAALVGGVLLIGAVLAGNSLVCVSVATERALQTPTNSFIVSLAAADLLLALLVLPLFVYSEVSRVRPHEHPHLLLGSPSLSLRRTRRDPAPFWCGASSWGGGRGAAPCPSAIHPPPPPRDLPPAALSVPRPSFLFSFPVCLGVCYPGDARPSIQGPRKQATLSSPVPSVAGFHLQGSQLDRQADAGSAPWLPWAHTHTHCHSHCPPHTPSADAGTPPEGGSQLAGETWAGQNPGEGRVCGDQAPAENPGGKPEGELGDGAHTPHQVWPSSGSALVPAPLRPEKSSLGLSWRRGVPDCGGGGLEVSP

SEQ ID NO: 915997 - protein, 500 aa, Homo sapiens
VERRGGPPEPGRVGGGTRVRPGRARGEGLPGLRPGVVRGAQRPPGRAMGNRSTADADGLLAGRGPAAGASAGASAGLAGQGAAALVGGVLLIGAVLAGNSLVCVSVATERALQTPTNSFIVSLAAADLLLALLVLPLFVYSEVQGGAWLLSPRLCDALMAMDVMLCTASIFNLCAISVDRCAALPARAPAPPRPARRPHRGLCAVRRPLGAPRRFVAVAVPLRYNRQGGSRRQLLLIGATWLLSAAVAAPVLCGLNDVRGRDPAVCRLEDRDYVVYSSVCSFFLPCPLMLLLYWATFRGLQRWEVARRAKLHGRAPRFPSGPGPPSPTPPAPRLPQDPCGPDCAPPAPGLPRGPCGPDCAPAAPSLPQDPCGPDCAPPAPGLPPDPCGSNCAPPDAVRAAALPPQTPPQTRRRRRAKITGRERKAMRVLPVVVGAFLLCWTPFFVVHITQALCPACSVPPRLVSAVTWLGYVNSALNPVIYTVFNAEFRNVFRKALRACC

SEQ ID NO: 915998 - protein, 340 aa, Homo sapiens
MDVMLCTASIFNLCAISVDRCAALPARAPAPPRPARRPHRGLCAVRRPLGAPRRFVAVAVPLRYNRQGGSRRQLLLIGATWLLSAAVAAPVLCGLNDVRGRDPAVCRLEDRDYVVYSSVCSFFLPCPLMLLLYWATFRGLQRWEVARRAKLHGRAPRFPSGPGPPSPTPPAPRLPQDPCGPDCAPPAPGLPRGPCGPDCAPAAPSLPQDPCGPDCAPPAPGLPPDPCGSNCAPPDAVRAAALPPQTPPQTRRRRRAKITGRERKAMRVLPVVVGAFLLCWTPFFVVHITQALCPACSVPPRLVSAVTWLGYVNSALNPVIYTVFNAEFRNVFRKALRACC

SEQ ID NO: 915999 - protein, 188 aa, Homo sapiens
PGGETMVLLTVSKRLYSPPVIVSNIQGMYTTLVILFLICRGKDNDITVRITGGVQQAPRDIIPNIHGKKEYYNITEVVNPLCDIVPNIKDRRYYKYRKGCTPLLILLLISVGGVDDITSNITGHVHPTCDIVPNILGGDYDITGNIAGCVHSRDIVPNVQQGRKYYSQYGGGVHFPCDIVPNIHGGKG

SEQ ID NO: 916000 - protein, 170 aa, Homo sapiens
VPFAMQKLFSLIKSQLFIFVFIAFAFGFLVMKSLRISRRFLEESIGFSKQKIISSATSDSLTSSLPIWISSISFFCLIALARTSSTMLKKSGESGLLVLFQFSKGMLSPFPHSVLCWLWVCIDGFYYIKGSWHKLQFPPCPWKMRSPWKMRSPLKMRSLLKMIPWRAGWW

SEQ ID NO: 916001 - protein, 87 aa, Homo sapiens
APAPALCDFARAELRSSQHRQGEHRQGGGIMAQVAVSTLPMEDEESMEDEESIEDEESVEDDSVESRMVVTFLISAPESTVRPSVLT

SEQ ID NO: 916002 - protein, 260 aa, Homo sapiens
AGQSMAGPIDPCNKLLRVSWMLKIACQVPSLLLSQQSTNSSLEEINCHGFSLAAYHWDTSDWMPGARLSDIEEVPNYENQDGGSAHQGSTRELESDYYLGGYDIDSEYPPPHEEEFLSQDQLPPPLPEDFPDQYEALPPSQPVSLASTLSPDCRRRPQFHPSQYLPPHPFPNETDLVGPPASCEFSTFAVSMNQGTEPTGPADSVSLSLHNSRGTSSSDVSANCGFDDSEVAMSDYESVGELSLASLHIPFVETQHQTQV

SEQ ID NO: 916003 - protein, 167 aa, Homo sapiens
MLNKEEELELLEALWSFSTSPAHSLLLPGRGGAGPIERRKPVSQAFSRPQQFLSRALLEFFGKSHPPPHRLFRKSLNVGLHYSHIPFLTTCLHFLRKRLQKGEVGLSVETSKPQVPVGGLSRKIPQEPWATVMEKRLQEAQLYKEEGNQRYREGKYRDALVSFRWSP

SEQ ID NO: 916004 - protein, 173 aa, Homo sapiens
MLNKEEELELLEALWSFSTSPAHSLLLPGRGGAGPIERRKPVSQAFSRPQQFLSRALLEFFGKSHPPPHRLFRKSLNVGLHYSHIPFLTTCLHFLRKRLQKGEVGLSVETSKPQVPVGGLSRKSSQPQSFTCSFTSQFRKNRGRQLWRSVCRRLSCTRRKGTSATGKGSTEML

SEQ ID NO: 916005 - protein, 171 aa, Homo sapiens
MEKRLQEAQLYKEEGNQRYREGKYRDAVSRYHRALLQLRGLDPSLPSPLPNLGPQGPALTPEQENILHTTQTDCYNNLAACLLQMEPVNYERVREYSQKVLERQPDNAKALYRAGVAFFHLQDYDQARHYLLAAVNRQPKDANVRRYLQLTQSELSSYHRKEKQLYLGMFG

SEQ ID NO: 916006 - protein, 171 aa, Homo sapiens; identical to SEQ ID NO: 916005

SEQ ID NO: 916007 - protein, 155 aa, Homo sapiens
MEKRLQEAQLYKEEGNQRYREGKYRDAVSRYHRALLQLRGLDPSLPSPLPNLGPQGPALTPEQACLLQMEPVNYERVREYSQKVLERQPDNAKALYRAGVAFFHLQDYDQARHYLLAAVNRQPKDANVRRYLQLTQSELSSYHRKEKQLYLGMFG

SEQ ID NO: 916008 - protein, 171 aa, Homo sapiens; identical to SEQ ID NO: 916005

SEQ ID NO: 916009 - protein, 171 aa, Homo sapiens; identical to SEQ ID NO: 916005

SEQ ID NO: 916010 - protein, 303 aa, Homo sapiens
MLNKEEELELLEALWSFSTSPAHSLLLPGRGGAGPIERRKPVSQAFSRPQQFLSRALLEFFGKSHPPPHRLFRKSLNVGLHYSHIPFLTTCLHFLRKRLQKGEVGLSVETSKPQVPVGGLSRKIPQEPWATVMEKRLQEAQLYKEEGNQRYREGKYRDAVSRYHRALLQLRGLDPSLPSPLPNLGPQGPALTPEQENILHTTQTDCYNNLAACLLQMEPVNYERVREYSQKVLERQPDNAKALYRAGVAFFHLQDYDQARHYLLAAVNRQPKDANVRRYLQLTQSELSSYHRKEKQLYLGMFG

SEQ ID NO: 916011 - protein, 130 aa, Homo sapiens [sequence omitted]

SEQ ID NO: 916012 - protein, 171 aa, Homo sapiens; identical to SEQ ID NO: 916005

SEQ ID NO: 916013 - protein, 173 aa, Homo sapiens
METKDQKKQRKKNSGPKDEKKKKRHLQDLQLGDEEDAQKRNPKAFAVQSAVWMARSFHRTQDLKTKKHRIPVVDRTPLEPPPIVVVVTGPPKLEEHFDIMPHSELHWQKLTEIRGPVMIVSGQGLRGLQGPPGKMGPPGNTGTSGIPGPRGQKGDRGDNSVAEAKLANLERKL

SEQ ID NO: 916014 - protein, 153 aa, Homo sapiens
CFSIKLSDFMQPDILKKKLTNSVITNLLATDSQDQKKQRKKNSGPKDEKKKKRHLQDLQLGDEEDAQKRNPKAFAVQSAVWMARSFHRTFCKHMKPGNCRKEEEGNHGSFGTLERNPSNPGAKAHTGNEFSSPLSGPLYPGLMDNPQALWAVK

SEQ ID NO: 916015 - protein, 176 aa, Homo sapiens
WDKDMNRQFSKEDIKVANKHKKKCSTSLIIREILLKELKVELPFDLAIPLLGIPQRKRSHYMKKTLAHACLEQYYLQFPKYGTSLNAYQSSLSLAQPYPKQGSKHCPSKRQQSKYLNLFNSVKSERSKEVWKKLIPTLMDDFEGFKISVEEVIVDMAEIAKEPEFELEPKDVTELL

SEQ ID NO: 916016 - protein, 319 aa, Homo sapiens
MTEVTAARRWLSRRRRNGCWAADGQELTRLACSELRLLCPGPGFSELSYIKYTEMKRKVVNTHKLRLSPNEEAFILKEDYERRRKLRLLQVREQERDIALQIREDIKQRRNQQFTRLAEELRAEWEESQTQKIQNLEKLYLASLRSMGEGHRQAKENEPDLDALAQRAAERKRKADLRHKEALKVQKNQKEILLKQKTCLWNQTRGFLEPMTYIFLTLLYYNIITERLIDDISCFLRHIKARKEALLVEKERSAKITSLPPPPPTLFENIEVKRISAVKTNSSTYHHLHTFVNRETDTKRVIDLLFLHALALLFLCALN

SEQ ID NO: 916017 - protein, 412 aa, Homo sapiens
RCSFWSRQSSRPRPGLCGRRRQGGVTRDGGQGSRWARRLAGVGAGPGLREREAVDGQVGAVGEDPRGRSLAAWDPVLTEDLRGASVTPTPQPRPPHRGPAPTSPLGLRSSVAQPRMERRGTGSRLEDARSGFLALRVASPQTWRGVERRVRGGRAGPSGPGSRAGAHRDVVPRGQQRARREAVQALREAAHQLLQHHAAQVGRALLRRVEDADELLPAAHSHDLQACRAGKRGDAVRRCGRSTRTAARPARKPAPVRRRRLGSLAPYLCRSSGLQWSGSVQGWGDRTGSPCLACGPPTRSGPAAGGRTSASSAARPPSPGACGWSAAAAPPGAPSPAPRGPVGPTPSTHLRPDLQAGLGGKGCIPLPWIPAPRRGGAVCYQEPPGRPQTRPLETGSCSAVQAGMLRCDDSAR

SEQ ID NO: 916018 - protein, 393 aa, Homo sapiens
RCSFWSRQSSRPRPGLCGRRRQGGVTRDGGQGSRWARRLAGVGAGPGLREREAVDGQVGAVGEDPRGRSLAAWDPVLTEDLRGASVTPTPQPRPPHRGPAPTSPLGLRSSVAQPRMERRGTGSRLEDARSGFLALRVASPQTWRGVERRVRGGRAGPSGPGSRAGAHRDVVPRGQQRARREAVQALREAAHQLLQHHAAQVGRALLRRVEDADELLPAAHSHDLQACRAGKRGDSCEEMRPVHPHSCAPRPETSSSPAPEAWVTRPLPLQEFRAPVVRVCAGLGRQDRLAVPGMRPTHEERASCRRQDFCKFCSSASISWSVRVVCSSRSSRCSFSCSERACGPYPQHSPEARPPSRPGREGLYTVAMDTSTQKGWGCLLPGASRETPDQAPR

SEQ ID NO: 916019 - protein, 850 aa, Homo sapiens
GRTHTMVVEGQMSEAMDQPAGGPGNPRPGEGDDGSMEPGTCQELLHRLRELEAENSALAQANENQRETYERCLDEVANHVVQALLNQKDLREECIKLKKRVFDLERQNQMLSALFQQKLQLTTGSLPQRWMPYPRSSEEGPDSGEPINGELCGPPQPEPSPWAPCLLLGPGNLGGLLHWERLLGGLGGEEDTGRPWGPSRGPPQAQGTSSGPNCAPGSSSSSSSDEAESYPYGSPQEKSLDKAGSESPHPGRRTPGNSSKKPSQGSGRRPGDPGSTPLRDRLAALGKLKTREGALGSEKNGVPARPGTEKTRGPGKSGESAGDMVPSIHRPLEQLEAKGGIRGAVALGTNSLKQQEPGLMGDPGARVYSSHSMGARVDLEPVSPRSCLTKVELAKSRLAGALCPQVPRTPAKVPTSAPSLGKPNKSPHSSPTKLPSKSPTKVVPRPGAPLVTKESPKPDKGKGPPWADCGSTTAQSTPLVPGPTDPSQGPEGGSHSAIEEKVMKGIEENVLRLQGQERAPGAEVKHRNTSSIASWFGLKKSKLPALNRRTEATKNKEGAGGGSPLRREVKMEARKLEAESLNISKLMAKAEDLRRALEEEKAYLSSRARQRLVAQPQGPTRGWGRVDGKELPSKSWREPKPEYGDFQPVSSDPKSPWPACGPGMAWWPSSGLRKTSWKGGHWSYTGTNPSLPSGYSPHLHPFPKPRADQATAAGSPTWVPPARPPPLTKVPRRAHTLEREVPGIEELLVSGRHPSMPAFPALLPAAPGHRGHETCPDDPCEDPGPTPPVQLAKNWTFPNTRAAGSSSDPLMCPPRQLEGLPRTPMVRIAAEERERTREQEGVMWGDQFLQ

SEQ ID NO: 916020 - protein, 153 aa, Homo sapiens
MGVKAGVWAASPVNQSAQPELSRHWDDQLQRGATNSRASSLLRDADVGMPSCRMEVPTPGHPLSCSVTQYSFSLLTLNLSVYLIIPGEERRKKELWLYGNPDLGAPEARAVTPAIGPYGSWSLQASRHEPPHPATHSYTTTFVSILAIGLSSP

SEQ ID NO: 916021 - protein, 169 aa, Homo sapiens
MLTFIPMVTTAEIGTGKDFMMKMPKSIATKAKIDKWDLIKLKSFCTAKETIIRVNRQPIEREKIFAIYPSDKEYGQKKQRFYQRDVQKANKNIKRQSTLLPIWEMEIKTPMRYQCISIRITKTVTPNVGQLKKLQALASWLALQSCIAQNMFGLDCGFKKNPQHILKKY

SEQ ID NO: 916022 - protein, 365 aa, Homo sapiens
CASIDVQLIMDGEVNEAQEGQDAKPQARARNILELSSLHKARTPERQMHLFMKMGTKALNRLNDAHLPWGGPSALLGPPVQMLISSGNILTDTPRNNVSSDIWASCCLVKLIHKINHHSKIVDISSNTVSPWFTHLEKGNNNTGLLEFMSSQAKAVIKTTDDYLQSQFGPNRLVHSAAVSEGSGLQDCSTHQTASDHSHDEISDLDSYKSNSKNNSCSISASKRNRPVSAPVGQLRVAEFSSLKFQSARNWQKLSQRHKLQPRVIKVTAYKNGSRTVFARVTVPTITLLLEECTEKLNLNMAARRVFLADGKEALEPEDIPHEADVYVSTGEPFLNPFKKIKGKKDLKNTLPPHILNCLRGAIKK

SEQ ID NO: 916023 - protein, 157 aa, Homo sapiens
ESRENFEDMLLLDFCFNSILRQEYTFRKGLSGSPLPHIQSFLFNLCTVSTASKAATPVVPGPQLPEDLMLVSGAMWVDVKQPIWYDVHFLYSKQTAGGLPSYCLLTGKSARKSRMWWAMQDHRKTADVIEVENRTVITKDWGEEGRWENGERLVNRR

SEQ ID NO: 916024 - protein, 176 aa, Homo sapiens
SGHLGRRAEARLPSLLFRADGSHAEVRDERQSVFGKAVQALSRISDEFWLDPSKKGLALRCVNSSRSAYGCVLFSPVFFQHYQWSALVKMSENELDTTLHLKCKLGMKSILPIFRCLNSLERNIEKCRIFTRSDKCKVVIQFFYRHATWMELEVTMLSEISQAWKVKYCMFSQCGR

SEQ ID NO: 916025 - protein, 393 aa, Homo sapiens
SGHLGRRAEARLPSLLFRADGSHAEVRDERQSVFGKAVQALSRISDEFWLDPSKKGLALRCVNSSRSAYGCVLFSPVFFQHYQWSALVKMSENELDTTLHLKCKLGMKSILPIFRCLNSLERNIEKCRIFTRSDKCKVVIQFFYRHGIKRTHNICFQESQPLQVIFDKNVCTNTLMIQPRLLADAIVLFTSSQEEVTLAVTPLNFCLKSSNEESMDLSNAVHSEMFVGSDEFDFFQIGMDTEITFCFKELKGILTFSEATHAPISIYFDFPGKSDLIEKKAGKNVTGQALECISKKAAPRRLYPKETLTNISALENCGSPAMKRVDGDVSEVSESSVSNTEEVPGSLCLRKFSCMFFGAVSSDQQEHFNHPFDSLARASDSEEDMNNGSFSIF

SEQ ID NO: 916026 - protein, 185 aa, Homo sapiens
FPSFTMGFGTSQSQSDAPSRNPVCLCIPAVQADCAVLFVAGGWAEAGIFKNPQTHELALLANWRDVTQLIVIFNEIDSTEPAYSGSRLQVITKEVSACIKKIGYNWLPGLQSISSWHGDSMLEPSTDASVARVGRDSRGGGERTTPRTHLPSTSRRCPGSSAGRRTDAKACILLPSLESLGISQV

SEQ ID NO: 916027 - protein, 179 aa, Homo sapiens
MTCLQKGATHCGSSLSWELSRCWDDLLAERSYPLQISCKLYCCSIKHLFALLTLQLSAYLILPACGTRTWDPPNGGTKKADLVEQLNWPVLAHHPSPGNIREILNLEMDKAGQEDHFGESRQHGVLTCKWEREREYFSFEPSKSGVLDLLESLTSIPGSEECEDWYGTCQKNFTEEQEG

SEQ ID NO: 916028 - protein, 179 aa, Homo sapiens; identical to SEQ ID NO: 916027

SEQ ID NO: 916029 - protein, 706 aa, Homo sapiens
MVYVSCGELWINPDLSIAQQKKQIFLRNLESDIAKIQIFCSTHKIEEVQSDIVSGSKLAVHKPVAIFGEEKQVTEPEEKQMQEDPLTTENASSEILTVSSASTGIVPEDFGNLIMLVVTSNYDKHLGDQSVPENFIYSCSPKHSKLHKHCHQQFEYRDGQIISHAAPQLVLGVQGPNLRSGMEVVLVEKKSDGSHQRWIHQEDSRTFHLVSNPDLVLAVSMTKTRNEVCGYPVIVQKYKPYNNGAANQKWHYMKNIKALVAFHSTALDKEITSANYAGVCTSSVIKEENIDQPGYCYLSPDGKRKTMLCLACGQSMRTEKGLKQLLPGVPFLCISGTKTQKPFLQGPFKVISVAEVDLSCDKAEKTLSYYQARLLSLRMKTCTQAASHSGMAATHQKAVKIIAYKNGDGYRNGKLIVAGTFPMLLTECTEQLGLARAASKVYTKDGTPIFTLRDLVLWALDESFLQRDSEKQKQDAAPVGKEQIIVESMEENPRMKVKNRLFAKSVTSDSLDGIDKSLLTLILRNPIAIWVSCGEPFLPPNALQKAEKLEKQNWLKKDRILADLDTMRHKMRQLKGRRVAACQPATMVPTKSPVQPVVVEGGWTEQTQQEIKLMELIRHTEAHLSEIQEMESKINFPIATKRIAVKPSNLYKQPNTKRVWIYLNGGRPEDGTYAWGKTISEVSLLYLKTWIFIWSRKVFFYFLITA

SEQ ID NO: 916030 - protein, 414 aa, Homo sapiens
MFSSLITADGKRKTMLCLACGQSMRTEKGLKQLLPGVPFLCISGTKTQKPFLQGPFKVISVAEVDLSCDKAEKTLSYYQARLLSLRMKTCTQAASHSGMAATHQKAVKIIAYKNGDGYRNGKLIVAGTFPMLLTECTEQLGLARAASKVYTKDGTPIFTLRDLVLWALDESFLQRDSEKQKQDAAPVGKEQIIVESMEENPRMKVKNRLFAKSVTSDSLDGIDKSLLTLILRNPIAIWVSCGEPFLPPNALQKAEKLEKQNWLKKDRILADLDTMRHKMRQLKGRRVAACQPATMVPTKSPVQPVVVEGGWTEQTQQEIKLMELIRHTEAHLSEIQEMESKINFPIATKRIAVKPSNLYKQPNTKRVWIYLNGGRPEDGTYAWGKTISEVSLLYLKTWIFIWSRKVFFYFLITA

SEQ ID NO: 916031 - protein, 1181 aa, Homo sapiens
MQMKETQPKELEKMVIQTPMTLSPRWKSVLKDVQRSYEGKEFQRNLKTLENLPDEKEPISITPPPSLQYSLPGALPISGQPLTKCIHLTPQQAQEVGITLTPQQAQAQGITLTLQQAQELGIPLTPQQAQALEILFTPQQAQALGIPLTPQQTQVQGITLTPQQDQAPGISLTTQQAHKLGIPLTPQQAQALGIPLTPQQAQELGIPLTPQQAQALRVSLTPQQAQELGIPLTPQQAQALGITLTLQQAQQLGIPLTPQQAQALGITLTPKQVQELGIPLTPQQAQALGITLTPKQAQELGIPLNPQQAQTLGIPLTPKQAQALGIPFTPQQAQALGIPLTPQQAQTQEITLTPQQAQALGMPLTTQQAQELGIPLTPQHAQALGMPLTTQQAQELGIPLTPQQAQALGMPLTTQQAQELGIPLTPQQAQELGIPFTPQQAQAQEITLTPQQAQALGMPLTAQQAQELGITLTPQQAQELGIPLTPQQAQALGIPLIPPQAQELGIPLTPQQAQALGILLIPPQAQELGIPLTPQQAQALGIPLIPPQAQELGIPLTPQQVQALGIPLIPPQAQELEIPLTPQQAQALGIPLTPQQAQELGIPLTPQQAQELGIPLTPQQAQAQGIPLTPQQAQALGISLTPQQAQAQGITLTPQQAQALGVPITPVNAWVSAVTLTSEQTHALESPMNLEQAQEQLLKLGVPLTLDKAHTLGSPLTLKQVQWSHRPFQKSKASLPTGQSIISRLSPSLRLSLASSAPTAEKSSIFGVSSTPLQISRVPLNQGPFAPGKPLEMGILSEPGKLGAPQTLRSSGQTLVYGGQSTSAQFPAPQAPPSPGQLPISRAPPTPGQPFIAGVPPTSGQIPSLWAPLSPGQPLVPEASSIPGDLLESGPLTFSEQLQEFQPPATAEQSPYLQAPSTPGQHLATWTLPGRASSLWIPPTSRHPPTLWPSPAPGKPQKSWSPSVAKKRLAIISSLKSKSVLIHPSAPDFKVAQVPFTTKKFQMSEVSDTSEETQILRDTFAIESFRTFQSHFTKYRTPVYQTPYTDERALLTLMKPTTSPSSLTTLLRTSQISPLEWYQKSRFPPIDKPWILSSVSDTKKPKVMVPPSSPQELEEKRYFVDVEAQKKNLILLNQAIKTCGLPSQLHTMARTLIIEILHMDTVQLGYLFRKYIAYRLIQHAR

SEQ ID NO: 916032 - protein, 122 aa, Homo sapiens
MPKILSFQHVTHIKIIGEMHSYFSHTKFSKAGKLRHRGVDDPRYTLRTVAPTTVPLALLELVKRSLARVVPALHSEPCSRERPQCSKVLAKNVHSASAELEAHHFWMTFCERSVLYEILRAI

SEQ ID NO: 916033 - protein, 104 aa, Homo sapiens
MTAWSRVFLPTGITTPHSCERETSVFLMRFLSFGCFCANTANPGPTYKVMCFSCEFFKLLQIFKHFSNKFTEKNPHISGTPTSLNLCCSRVSYFYEVFSKVYGK

SEQ ID NO: 916034 - protein, 430 aa, Homo sapiens
MGIRAPASWDMLGSQLSPGTHGHSLSSLPLGVFSGKPRPAVLRLYLGEEPGSGRACLSSHWRKWGHRQAPRPPVLSLLSVGLLAEWGPISGFSDESGMLQAELLLTPGGALVCGELPLLGCLERARMCGVVSVAQASTLPAPASLLLRPGGLWGKGPVLMGSRTQSRMWGQNMKSLHRPLGSSHRSCFSCPNHLDTLLLPRLVPKVALIPPSRALSLPRASSPWPAPIPAPAHSCPAQGTSVPDPQRLLGVSLGRHGWVTPISHHSTGAFLVDSEVQTPVSSSRWGHRGFWEVDSAGGTIRRSAARPGLMCSGTDWGPPAWPLGPLSPSLQPPVVWRATKLMVCNPSHFFSKSVNPDLCGHRHHCQNQVKGSSLVHRAGPLLLLTGGSPDALGSYQPHPCLHRRAVCAPLTLLMTRGSPDTEARYHHAHP

SEQ ID NO: 916035 - protein, 140 aa, Homo sapiens
CKQPKAPTMEAQLRSLCLENTTERKHSRNVICEWADLSGKAIGADPRMQLSAELSLPDFKQLKKGWENIKAWTKTIMAHERREKVKGSVSPLLSNQVLGKEITSMLLEQLYFLQSTPSTPPPGGGAQIPRHGPRIICCFK

SEQ ID NO: 916036 - protein, 473 aa, Homo sapiens
MELKKSPDGGWGWVIVFVSFLTQFLCYGSPLAVGVLYIEWLDAFGEGKGKTAWVGSLASGVGLLASSKVWNHWFMSQAVGVIKSLMSGLMRGGEGKEASEVVSPVCEMEGSSVGLFIYAALQRMLVEFYGLDGCLLIVGALALNILACGSLMRPLQSSDCPLPKKIAPEDLPDKYSIYNEKGKNLEENINILDKSYSSEEKCRITLANGDWKQDSLLHKNPTVTHTKEPETYKKKVAEQTYFCKQLAKRKWQLYKNYCGETVALFKNKVFSALFIAILLFDIGGFPPSLLMEDVARSSNVKEEEFIMPLISIIGIMTAVGKLLLGILADFKWINTLYLYVATLIIMGLALCAIPFAKSYVTLALLSGILGFLTGNWSIFPYVTTKTVGIEKLAHAYGILMFFAGLGNSLGPPIVGWFYDWTQTYDIAFYFSGFCVLLGGFILLLAALPSWDTCNKQLPKPAPTTFLYKVASNV

SEQ ID NO: 916037 - protein, 213 aa, Homo sapiens
MYYNSLKICVEHQCQPCLHEPAPRVPGSSPSPITGWPLQTQARGPSPVPGKPLWIQAPPNEPRLQAHPPTDLGTRPAHQQLCQSVHTESIDRLSGEGLSLPKLISKVWRRCLCLPMCRYQHKATRIKNNRVGNDFQRGCINVSHNFGSREGVSVLRKEKAMGLEDGENTNRDIPRSVSLEGILLPSHGYDLTENETNVEESKDKRGESKRTRV

SEQ ID NO: 916038 - protein, 322 aa, Homo sapiens
MALRGVGNGNAGVGNGNAAEGDGMQQRKMGLQQREMECRNGKWEYSRERECRSGKWDCSKGRWNSAVGNGNAGMVNGIAAEGNGNAAEGDGMQAWEMEMQENGKMKQREMECSSGKWECWNGKWDCSRGKWECSRGRWNAGVGDGNAAEGDGMQEWEMGMQQREMECSRGRWNAGVGDGNAAEGNGMQQREMECSRGRWNAAEGDGMQQREMECRSGRWECSRGRWNAAEGDGMQQREMECSRGRWNAAEGNGMQQREMECRSGRWECRSGKWNAAKGKENALERHGNPTGENGTAEEENSHAAVENAAEGKATGSVGSLAS

SEQ ID NO: 916039 - protein, 322 aa, Homo sapiens; identical to SEQ ID NO: 916038

SEQ ID NO: 916040 - protein, 135 aa, Homo sapiens
MRNFRLTTDPSSHLPSFPNSIFAIPSNAEVELRESVEEKKREETGGQSKDTGPGAVTVLLPSFHPHVNNSKQDDSVKPASALPFKKTQPAFLLLVSLSCFFFEHSLIPVAGVVSKLQTDTNIRDLEIRSKFSRIP

SEQ ID NO: 916041 - protein, 151 aa, Homo sapiens
MFWKTGKLISLNEQNLVDCSGPQGNEGCNGGFMDNPFRYVQENGGLDSEASYPYEGKVKTCRYNPKYSAANDTGFVDIPSQEKDLAKAVATVGPISVAAGASHVSFQFYKKGIYFEPRCDPEGLDHAMLLVGYSYEGADSDNNKYWLVKNS

SEQ ID NO: 916042 - protein, 187 aa, Homo sapiens
MDASHTSLTNSRGLSGLLQQPNIGTLDSSLPKAQAPVTLHPAHSLTCLLNALSCLLKLLFLLSGPIYNSRLEDFFFYCSSMKQSFSSLPSLAGQLTSSNPISERSQLVGGRAWPPGELEKVRGCGAKVPFPPAPHGIRHRHESSSSLVLPKSGNRNRKDFEDLADIIEESSLANGEVPDAHTCWSHR

SEQ ID NO: 916043 - protein, 281 aa, Homo sapiens
MDKILEAVVTSSYPVSVKQGLVRRVLEAARQPLEREQCLALLALGARLYVGGAEELPRRVGCQLLHVAGRHHPDVFAEFFSARRVLRLLQGGAGPPGPRALACVQLGLQLLPEGPAADEVFALLRREVLRTVCERPGPAACAQVARLLARHPRCVPDGPHRLLFCQQLVRCLGRFRCPAEGEEGAVEFLEQAQQLWRAQPAAILPCLKELFAVISCAEEEPPSSALASMVQHLPLELMDGVVRNLSNDDSVTDSQMLTAISRAFLDSLPLVGKSVGSRGLL

SEQ ID NO: 916044 - protein, 138 aa, Homo sapiens
MERFLNSKARRLGSCSHPAFYLLCVPDEDTSCSTIYLPLKRRADPDQLFSDLLGGTQRLWSNRFGNEESFPGRVRALVDTFCWIARAPPLGNPLRLEERIAWRIQRLKSGQTALIEKKKQKIEEDVRHQCQQTTCDRC

SEQ ID NO: 916045 - protein, 156 aa, Homo sapiens
MERFLNSKARRLGSCSHPAFYLLCVPDEDTSCSTIYLPLKRRADPDQLFSDLLGGTQRLWRYSSNAQVSGMYNLLLISSNRFGNEESFPGRVRALVDTFCWIARAPPLGNPLRLEERIAWRIQRLKSGQTALIEKKKQKIEEDVRHQCQQTTCDRC

SEQ ID NO: 916046 - protein, 158 aa, Homo sapiens
MNVLRCSFKISARECYLARPLRIYLKIILLVTQYETYSLYLSLKMILLVTSQQRHEGQERQWSLQGSSHTQHTLRETKQKQKQTKKHTKKRFSLYYPQTSLHQRIKGHSLGLLRIFFDCILLMCVQGRYNTFVEGSRDIFYKFYPGFRTTFSDLCGHA

SEQ ID NO: 916047 - protein, 428 aa, Homo sapiens
MGKKIKKEVEPPPKDVFDPLMIESKKAATVVLMLNSPEEEILAKACEAIYKFALKGEENKTTLLELGAVEPLTKLLTHEDKIVRRNATMIFGILASNNDVKKLLRELDVMNSVIAQLAPEEEVVIHEFASLCLANMSAEYTSKVQIFEHGGLEPLIRLLSSPDPDVKKNSMECIYNLVQDFQCRAKLQELNAIPPILDLLKSEYPVIQLLALKTLGVIANDKESRTMLRDNQGLDHLIKILETKELNDLHIEALAVIANCLEDMDTMVQIQQTGGLKKLLSFAENSTIPDIQKNAAKAITKAAYDPENRKLFHEQEVEKCLVALLGSENDGTKIAASQAISAMCENSGSKDFFNNQGIPQLIQLLKSDNEEVREAAALALANLTTCNPANAKVPFSNNARNCVFILTPSGRLGGRWGRGKKGNGRMVL

SEQ ID NO: 916048 - protein, 398 aa, Homo sapiens
IASFSRMGKKIKKEVEPPPKDVFDPLMIESKKAATVVLMLNSPEEEILAKACEAIYKFALKGEENKTTLLELGAVEPLTKLLTHEDKIVRRNATMIFGILASNNDVKKLLRELDVMNSVIAQLAPEEEVVIHEFASLCLANMSAEYTSKVQIFEHGGLEPLIRLLSSPDPDVKKNSMECIYNLVQVFIANDKESRTMLRDNQGLDHLIKILETKELNDLHIEALAVIANCLEDMDTMVQIQQTGGLKKLLSFAENSTIPDIQKNAAKAITKAAYDPENRKLFHEQEVEKCLVALLGSENDGTKIAASQAISAMCENSGSKDFFNNQGIPQLIQLLKSDNEEVREAAALALANLTTCNPANAKVPFSNNARNCVFILTPSGRLGGRWGRGKKGNGRMVL

SEQ ID NO: 916049 - protein, 318 aa, Homo sapiens
MTATHGEMRVQIGTQQLDLEQQDLQQLDWEQQGLQQLDREQQDLQQLDREHQDLQQLDREQQGLQQLDWEQKFVLEIPTLLFPGSISSRLDLWPLENRQRAALEDPGSQWWLRSWFLVITEQHWPGLVGSDLASQSAEGEEEDGPHPSAGNTMAVGWVPASRQGHLLHQGNMHFRSEEAEGRAQWRAEPWKEQQGLQQLDWQHTGTQQLDWQQQGLQQLDWQQDPQPEEQQQGLQQLHWEQPQEPQPPLEPPQEPQPPLEPPQEPQPPLEPPQEPQSPLEPPQEPQLEQEQAGTQQHTGLQQQTGTQQLEPQPPQPEP

SEQ ID NO: 916050 - protein, 237 aa, Homo sapiens
QKSMTVSDHIGNMAQSDFLYPENPKRREEVNRLHQQLLDCLSDSFDVTNKLTEVLNMHLGCRLASIEMKRDGTIKENCDLIIQAIMKIQKELQKVDEALKDKLEPTLYRKLQDIKEKETDKIAIVQKVISVILGEATSAASAVAVKLVGSNVTTGIINKLVTVLAQIGASLLGSIGVAVLGLGIDMIVRAILGAVEKTQLQAAIKSYEKHLVEFKSASEKYNHAITEVINTVKHQMK

SEQ ID NO: 916051 - protein, 358 aa, Homo sapiens
RPPESAALGGLGPGLCCWVSVFSCLSLACSYVGSLYVWKSELPRDHPAVIKRRFTSVLVVSSLSPLCVLLWRELTGIQVRRRRGKGNGGESSGVFRGGSKTDAPFPVAQPGTSLLTLMGFRLEGIFPAALLPLLLTMVSAPAVFFLLVFVISLMGSAVDSCFWFLVDGRQDFEMAPGSSAPRSWARCLTDMRWLRNQVIAPLTEELVFRACMLPMLAPCMGLGPAVFTCPLFFGVAHFHHIIEQLRFRQSSVGNIFLSAAFQFSYTAVFGAYTAFLFIRTGHLIGPVLCHSFCNYMGFPAVCAALEHPQRRPLLAGYALGVGLFLLLLQPLTDPKLYGSLPLCVLLERAGDSEAPLCS

SEQ ID NO: 916052 - protein, 325 aa, Homo sapiens
AARVGGAGRPGPRAVLLGVSVLLPQPRLLLRGQPLRLEERTAQGPSRGHQATLHQRPGGVQSLTPVRAALEGTHRHPGTSLLTLMGFRLEGIFPAALLPLLLTMVSAPAVFFLLVFVISLMGSAVDSCFWFLVDGRQAFEMAPGSSAPRSWARCLTDMRWLRNQVIAPLTEELVFRACMLPMLAPCMGLGPAVFTCPLFFGVAHFHHIIEQLRFRQSSVGNIFLSAAFQFSYTAVFGAYTAFLFIRTGHLIGPVLCHSFCNYMGFPAVCAALEHPQRRPLLAGYALGVGLFLLLLQPLTDPKLYGSLPLCVLLERAGDSEAPLCS

SEQ ID NO: 916053 - protein, 504 aa, Homo sapiens; identical to SEQ ID NO: 769574

SEQ ID NO: 916054 - protein, 130 aa, Homo sapiens
MGSVACTLLKPWAWVRSLGDLREKRGNRPEHFQGLTAGREERSLSKREGEPLPRDVWVLEVHRVLEVHRLERTEEAETEYVSGLTESIQEMGESHKIELRKECCALTEELGKMGSGALQEEVLPPCMHVY

SEQ ID NO: 916055 - protein, 331 aa, Homo sapiens
MRARLSKEGTLIFFSLSHSLSCVCRETGKHGGGTRRCVATGAQVSSTRAGVRSRRSCTAPPRRSKARRDQINAEIRNLKELLPLAEADKVRLSYLHIMSLACIYTRKGVFFAGGEHAGATADPSCQAPETLELREPAGAGSPVAFGALPMVLTAAGPPLAGPTGLLSAQELEDIVAALPGFLLVFTAEGKLLYLSESVSEHLGHSMVDLVAQGDSIYDIIDPADHLTVRQQLTLPSALDTDRLFRCRFNTSKSLRRQSAGNKLVLIRGRFHAHPPGAYWAGNPVFTAFCAPLEPRPRPGPGPGPCPASLFLAMFQSRHAKDLALLDISESG

SEQ ID NO: 916056 - protein, 200 aa, Homo sapiens
MTPTAEKQLEKPLENGSELQEGDSLTVPTKLSQYERQGEIKTSLHGKPKTDIAAFENGVNDVQPVKKPHFKGVKKRKWIYDEPQNFPNSGMQRAVQAPRPQNKMSYHRNNKNRNAENASYIHVQRDAVRTVALNAPSRSRPTHGSYNKVHANREPKPNLSPDKYTSTSYNDSAWRKRIPFSKTYSKSEKIYPEPRRNGSK

SEQ ID NO: 916057 - protein, 150 aa, Homo sapiens
MDLLRDLLSDMKYLGYPKFTSKPKRRAYRIKQLPQYLHYPLFFYSGPDFVLSDWYFPKHTSKLPWRNALGYCLTSHICPGAHHHLLQPKVKCINLSQQDVDRSASVKDARGAIQRVPPISVCVHPLNWNLLHKGISQVTSRPTKISLLRC

SEQ ID NO: 916058 - protein, 183 aa, Homo sapiens
MRDTSLFISDWLMQVTVYFLSPYDEMGTGSSCVAGGLVQVLDFAAQKKSYFESESNVKVSKRGYCKVNVHSDSRSEWAAQRYCPCDQHSQKDVGFPGQEVTCAMSSLSPDVPADSSGAWRVTRTPSNILSLLHMGPQAQQREPRDGGVHLLTPQPPPPPSDSPEDLWALLLTGSRLLAFSSSW

SEQ ID NO: 916059 - protein, 161 aa, Homo sapiens
HPSITSLFCRSQVQLGMAAAYFAQDVRGKRQGIGWFKFLSEGSGGIPNSKSIQVVCMIWFLSVKELVPRSSSASINVEVTLCCDAFFMSVYSHKNRAFQKRRLSLSYLQFSPQCLGCLAHGRFSIFPSDGLKVWHFLPHSLSLSCCIVKKLLASLSPSAVS

SEQ ID NO: 916060 - protein, 161 aa, Homo sapiens; identical to SEQ ID NO: 916059

SEQ ID NO: 916061 - protein, 161 aa, Homo sapiens; identical to SEQ ID NO: 916059

SEQ ID NO: 916062 - protein, 161 aa, Homo sapiens; identical to SEQ ID NO: 916059

SEQ ID NO: 916063 - protein, 161 aa, Homo sapiens; identical to SEQ ID NO: 916059

SEQ ID NO: 916064 - protein, 161 aa, Homo sapiens; identical to SEQ ID NO: 916059

SEQ ID NO: 916065 - protein, 161 aa, Homo sapiens; identical to SEQ ID NO: 916059

SEQ ID NO: 916066 - protein, 161 aa, Homo sapiens; identical to SEQ ID NO: 916059

SEQ ID NO: 916067 - protein, 161 aa, Homo sapiens; identical to SEQ ID NO: 916059

SEQ ID NO: 916068 - protein, 197 aa, Homo sapiens
MVKEGRNGGPKTAADGLEGTTAMPEVKAARMAMSIRRKHGHSEACADPILRELPASSKHSINAVGRVKQTVLTRYSGAIFGFSSNLAGTRKTNPDEVGMKEKNLGATQVPERTKSAGSKIIEEGFREEMREKDKQSFERQAEGCHETGKQQAQGEEEARQSPREDQAQGGDPTSGSAGTGSEGEATALWMAASRWMI

SEQ ID NO: 916069 - protein, 132 aa, Homo sapiens
PHRFAGGRESVPELILLQEEKVRFQLNLTIQILLKQGQVELENFQLVLEYSDAILINKNIIEDLNSVIRTQGQKKVASMMESKDVHKRILQIEWEHKKMEMEREDLNQKAWDIQMLFFSRDRQKVNSPYPPT

SEQ ID NO: 916070 - protein, 318 aa, Homo sapiens
MIVEVVGQNSVVTYEAVRKSREDLDVCKEHYDNLLAEDKVKQKAADLLEMATFLQKRVEEEEKVQQEIERVFHELILLQEEKVRFQLNLTIQILLKQGQVELENFQLVLEYSDAILINKNIIEDLNSVIRTQGQKKVASMMESKDVHKRILQIEWEHKKMEMEREDLNQKAWDIQMLFFSRDRQKYLNEPNYEALISIQIGIMEQTIAVLDKMHKKNVENCKKLLKKLGKFSNQKDIANYALSCNLREELVAVSERKDICNAMGSKLTCEKIVKERYENMMQQQKLTNISKQQAEQISILQTEVERLRMKTFPALVQM

SEQ ID NO: 916071 - protein, 117 aa, Homo sapiens
MCPKANGQLVFDDPRLVRTESVPCDINNPLRKPPRYSDLHISQTLPKTNKINKDHIPVPYQPDSSSNPSSTTSSTPSSPAPPLPPSATPPSPLHPSPQCTRQQKNFNLPGTSMLGET

SEQ ID NO: 916072 - protein, 788 aa, Homo sapiens
NFGKNGLSGMEPRTGSQCINRKVVYSLADSAGGVFSIDSSSGIIILEQPLDREQQSSYNISVRATDQSPGQSLSSLTTVTITVLDINDNPPVFERRDYLVTVPEDTSPGTQVLAVFATSKDIGTNAEITYLIRSGNEQGKFKINPKTGGISVSEVLDYELCKRFYLVVEAKDGGTPALSAVATVNINLTDVNDNPPKFSQDVYSAVISEDALVGDSVILLIAEDVDSQPNGQIHFSIVNGDRDNEFTVDPVLGLVKVKKKLDRERAVDSGIPAMSSTATVNIDISDVNDNSPVFTPANYTAVIQVLSVLYFSVFLGAESPTLGGSGNLAQENCQCRGLREDRVICMTWRATGGCGKQPKIRNMTLTDTNMFSEDKENKPVGTSILQLVVTDRDSFHNGPPFSFSILSGNEEEEFVLDPHGILRSAVVFQHTESLEYVLCVQAKDSGKPQQVSHTYIRVRVIEESTHKPTAIPLEIFIVTMEDDFPGGVIGKIHATDQDMYDVLTFALKSEQKSLFKVNSHDGKIIALGGLDSGKYVLNVSVSDGRFQVPIDVVVHVEQLVHEMLQNTVTIRFENVSPEDFVGLHMHGFRRTLRNAVLTQKQDSLRIISIQPVAGTNQLDMLFAVEMHSSEFYKPAYLIQKLSNARRHLENIMRISAILEKNCSGLDCQEQHCEQGLSLDSHALMTYSTARISFVCPRFYRNVRCTCNVKAIAAQSHMPVVIDEKHCPLSLFLRLTCGAINSLPPSKKIAARVFLASVNLVQRDHGQREAICKTSFSVQYSSMLYKPVA

SEQ ID NO: 916073 - protein, 666 aa, Homo sapiens
MKRYSLAVGPPKKDPKVKGVQSAAVQAFLKRKEEELRRKALEEKRRKEELVKKRIELKHDKKARAMAKRTKDNFHGYNGIPIEEKSKKRQATESHTSQGTDREYEMEEENEFLEYNHAESEQEYEEEQEPPKVESKPKVPLKSAPPPMNFTDLLRLAEKKQFEPVEIKVVKKSEERPMTAEELREREFLERKHRRKKLETDGKLPPTVSKKAPSQKESVGTKLSKGSGDRHPSSKGMPLPHAEKKSRPSMANEKHLALSSSKSMPGERIKAGSGNSSQPSLREGHDKPVFNGAGKPHSSTSSPSVPKTSASRTQKSAVEHKAKKSLSHPSHSRPGPMVTPHNKAKSPGVRQPGSSSSSAPGQPSTGVARPTVSSGPVPRRQNGSSSSGPERSISGSKKPTNDSNPSRRTVSGTCGPGQPASSSGGPGRPISGSVSSARPLASSRGPGGPVSSPHELRRPVSGLGPPGRSVSGPGRSISGSIPAGRTVSNSVPGRPVSSLGPGQTVSSSGPTIKPKCTVVSETISSKNIISRSSNGQMNGMKPPLSGYRAAQGPQRLPFPTGYKRQREYEEEDDDDDEYDSEMEDFIEDEGEPQEEISKHIREIFGYDRKKYKDESDYALRYMESSWKEQQKEEAKSLRLGMQEDLEEMRREEEEMQRRRAKKLKRR

SEQ ID NO: 916074 - protein, 303 aa, Homo sapiens
TRLKSQQTPKENIILFSVFMRSVFSHFMYRTLLYSFNICTFGLLSGTSFQYQDQMKYFSLHLINYINHCFFLSSFFLNAAGFSHMSNRLRVCLFLFKNEGWGSGIGISSDILVSSTDVQIGYSTKRKFCMLVVCLSCYNITSTRTGNLPVLFTVIPTPLPRKCLEIEELSKYFLEQKPQSFMNSQSIPFCDNRVEKNFLWVCNPIPAQKGCHHLTKREDQDRRTISQWFSLVCCQQNQNHLEAGDMDGLGSHYPQETHARTENQPLHVLTYKWELNDENIWMHQGEQDTLGPVGAWEEEEHQE

SEQ ID NO: 916075 - protein, 199 aa, Homo sapiens
LLQIKNIRLGAFEKCRLHLAVLPLPSSLGPVSSCGDTWLSPSSPWQTQMGLAVVAFFDFPQAPEQPHLLRGSHLVWLQGHGQRRGQRLLSMGVVPLALPSAGLPVEEAWLASETNSLSSAPCKPCGWKFVSTSTQVLAAWVLPWRESCWASMVFRGASLGCEEPGLGKSSRGWDESEQSFREATQGSAAYTDRRAPGHP

SEQ ID NO: 916076 - protein, 148 aa, Homo sapiens
MINVSNKYCGGTDDRLHWQGEGIREGFGRQQPLYRRPGQIHMAPFGAWMSGKLPAKEERSDKEQGLQNQVNLGVNFSPTTFYLWTDHPSNHSLISKCRYSTYAVPDAVTASLFEKEEELAKGDGREMPRILQEEGECSLTCWKDSGDV

SEQ ID NO: 916077 - protein, 145 aa, Homo sapiens
SITPMPSATKSFSGQGVVFRTQDPGPRTHHPFFWPRVAWMCVGSLDLHCKFLLQLLCFCHLRGTTTSPGPEILTITALFMMGVVDPLEPKTRTDMRDLYQLKVSPRSSLVRSCHAGPSTIWIPTTQGIEHCTFQKHLFLRGYTTS

SEQ ID NO: 916078 - protein, 152 aa, Homo sapiens
TEAGAAKMKFNPFVTSDRSKNRKRHFNAPSHIRRKIMSSLLSKELRQKYNERSMPIRKDDEVQVVRGHYEGQQIGKVVQVYRKKYVIYIEWVQREKANGTTVHIGIHSSKVVITRLKLDKDSKKILERKAKSRQVGKEKGKYKEETIEKMEE

SEQ ID NO: 916079 - protein, 173 aa, Homo sapiens
TEAGAAKMKFNPFVTSDRSKNRKRHFNAPSHIRRKIMSSLLSKELRQKYNERSMPIRKDDEVQVVRGHYEGQQIGKVVQVYRKKYVIYIEWVQREKANGTTVHIGIHSSKVVITRLKLDKDSKKILERKAKSRQVGKEKGKYKEEDPERKAKSRQVGKEKGKYKEETIEKMEE

SEQ ID NO: 916080 - protein, 359 aa, Homo sapiens
MGSQCPATLREIAGAEGPILVWVPFSMIDIQQCKEKLGSYSEDSGKFADGFQTLTLAFDLSWRDVQFTLATCCTSSEKERIFEAALREVDELFTQNRKLLMAQRFISQSTPDIRRKLQKLHMGPQTNQNQLLGTAFMVYNNRDLEEGEGKQSKEKRQAKIMLAITGDALNAQRLSKGNSKGHKDNASKGSCFKCNKSAIGHRNPLSPRQSPAVNVKAPVVAPGPGELTVPAPTKGLKIKGHIWMTGEMLTKYQPMLLDNPDITLKTCNTLNPASLLPTGPIIDHSCEQVIAHTYVSQPDLKDEALPDSEADRLTDGSSSLSNGEHRAGYAAVNHDTIIEAQPVGSKVTPEKANEVLRSS

SEQ ID NO: 916081 - protein, 245 aa, Homo sapiens
MDKNELVQKAKLAEQAERYDDMAACMKSVTEQGAELSNEERNLLSVAYKNVVGAHRSSWRVVSSIEQKTEGAEKKQQMAREYREKIETELRDICNDVLSLLEKFLIPSASQAESKVFYLKMEGDYYRYLAEVAAGDDKKGIVDQSQQAYQEAFEISKKEMQPTHPIRLGLALNFSVFYYEILNSPEKACSLAKTAFDEAIAELDTLSEESYKDSTLIMQLLRDNLTLWTSDTQADEGEAGEGTQL

SEQ ID NO: 916082 - protein, 380 aa, Homo sapiens
MSSTASSLACLVGVISDVIYSILIGDVLYGVLISDVVYSVLVSNALYSVLVSNVIYSVLISDGLYTVLISDVVYSILVSVPCTVSLAMSYTAALIGDVLYGAVISDVVYSVLVSDGLYGVLVSDVVYSVLITDALYGVLISDVVYSVLVSVPCTVSLVMSYTAPSLAMSYTESSLAMSCTVSADVIYNVLITDALYGVLISDVVYSVLVSVPCTVSLAMSYTAPSLAMSYTESSLAMSCTVSTLACLVGAISNVSVLVSDVIYNVLITNALYGVLISDVVYSVLVSVPCTVSLAMSYMASSLAMSDAVHGILVSNAVGSVLLGDAVGGVLLGDALDGVLVGDALGGVLVGDALGGVLVGDALVGGLVSDAVDSVLVSDIV

SEQ ID NO: 916083 - protein, 237 aa, Homo sapiens
AGRWLRRPPAPRRKRRAEGRGRRRPGGRHRAAGQAYRGSQFGSAAEMLSEQTAALGTGWESMNVQLDGAEPQVERGSQEERPWRTVPGPLEHLCCDLEEEPQSLQEKAQSAPWVPAIPQEGNTGDWEMAAALLAAGSQVSSASLGVSCGPITAAFVLLSHQPIDELAHMIINGPGNHQGCVTVLLSGGVAEPGPLSDRLLWRICHAGKLWDSSLSEISNSQTGHAFSTRRRRRTMGP

SEQ ID NO: 916084 - protein, 301 aa, Homo sapiens
AGRWLRRPPAPRRKRRAEGRGRRRPGGRHRAAGQAYRGSQFGSAAEMLSEQTAALGTGWESMNVQLDGAEPQVERGSQEERPWRTVPGPLEHLCCDLEEEPQSLQEKAQSAPWVPAIPQEGNTGDWEMAAALLAAGSQGLVTIKDVSLCFSQEEWRSLDPSQTDFYGEYVMQENCGIVVSLRFPIPKLDMLSQLEGGEEQWVPDPQDLEERDILRVTYTGDGSEHEGDTPELEAEPPRMLSSVSEDTVLWNPEHDESWDSMPSSSRGMLLGPPFLQEDSFSNLLCSTEMDSLLRPHTCPQC

SEQ ID NO: 916085 - protein, 138 aa, Homo sapiens
MGHHSGDNASEAQAPVSTSPLLSAYMHICFPRSLLKTFLGPTFSLSFNFNHLPFPLLPNFLKEYSVLAASTSLFTPSTAIWQRSLPTSIEIAQSTVSHGILTAKSNGLFQRSSTSSSLITLLTGDEKNVGQSLSRELA

SEQ ID NO: 916086 - protein, 292 aa, Homo sapiens
MGLGLIQLLQLSVLSDLIHLQLSVLSDLINLQLSVLWDLIHLLQLAVLPDLIYLQLSVLRDLIHLLQLSLSVLWDLIHLLQLAVLPDLIYLPLSVLQDLIHLLQLSVLQDLIHLLQLSLSVLPDLIYLQLSVLRDLIHLLQLAVLPDLIYLQLSVLRDLIHLLQLSVLRDLIHLQLSVLWDLIHLLQLSVLRDLIHLQLSVLWDLIHLLQLAVLPDLIYLQLSVLQDLIHLLQLSVLRDLIDLQLSVLWDLIHLLQLSVLPDIIHLQLSVFWDLIHLLQLVVLSDLIHLLHQ

SEQ ID NO: 916087 - protein, 366 aa, Homo sapiens
VKCFKDAIFIWGSQFQLPTLHMGITIQEPDKWTVLKPQVYWETGAQITSPHDKEILKCIEECVEPWNGSWNDNLVDTSPLKRDPLQDICRRYMEDLKKICFYRVKLFNPFVRFILAIFNYFGASLEKEHIWVQQDLGYWRVKVARLTYKKETLPGFKWIGSRIIDLLENGKEVLFAFEESIGFLCGTSVLDKDGVSAAVVVAEMASYLETMNITLKQQLVKVYEKYGYHISKTSYFLCYEPPTIKSIFERLRNFDSPKEYPKFCGTFAILHVRDVTTGYDSSQPNKKSVLPVSKNSQMITFTFQNGCVATLRTSGTEPKIKYYAEMCASPDQSDTALLEEELKKLIDALIENFLQPSKNGLIWRSV

SEQ ID NO: 916088 - protein, 366 aa, Homo sapiens; identical to SEQ ID NO: 916087

SEQ ID NO: 916089 - protein, 163 aa, Homo sapiens
FSLYVKIMWSQLGQPDIWIVGFIRGSLAVLCHNHLIKGCLVHPASQKWSPEKKMPSFVLVLSSLELEYHGGPTEECKGWGGRHSFSRCLLSTCYMPGYALGVREIMGNKKLEEFAITEHTFLECLRKRYWLKTVWAGQKMIVAFFFITNPDPKTSMGGWGMSY

SEQ ID NO: 916090 - protein, 435 aa, Homo sapiens
MNSRGSMGVGPSESCTGYNLLVCRLLRPLEKRSIRIGNVCWELYCLEHGIQPDGQMPSDKTIGGGDDSFNTFSETGAGKHVPRAVFVDLEPMVIDEVCTGTYRQLFHPEQLITGKEDAANNYARGHYTIGKEIIDLVLDRIRKLANQCTGFQGFLVFHSFGGGTGSGFTSLLIERLLVDYGKKSKLEFSNYPAPQVSTAVVEPYNSILTTHTTLEHSDCAFMVDNEAICDICCRNLNIERPTYTNLNHLISQIVSSITASLRFDGALNVDLTEFQTNLVPYSHIHFPLATYAPVISAEKAYHEQLSVAEITNASFEPANQMVKCDPRHGKYMACCLLCHGDVVPKDANAAIATIKTKRSIQFVDWCPTGFKAWARLDHKFDLMYAKRAFVHWYVGEGMEEGEFSEAREDMAALEKDYEEVGVDSVEGEEAEDEGK

SEQ ID NO: 916091 - protein, 368 aa, Homo sapiens
MSWHTSGMGGCPGLASSSPASSWPARASPWARAWRQSWKTSGPSSSSSLSCGGIVTAEDLNNYCAELIEHPLNISLGDAVLYMPSARLSGPVLALILNILKGYNFSRESVETPEQKGLTYHRIVEAFRFAYAKRTLLGDPKFVDVTEASSGVSAGGPNMTSEFFAAQLRSQISDHTTHPISYYKPEFYTLDDGGTAHLSVVAEDGSAVSATSTINLYFGSKVCSPVSGILFNNEVDDFSSPSITNEFGAPPSPANFIQPGKQPLLSMCPTIMVGQDGQVRMVVGAAGGTQITTDTALVCVTPFLPGPAHSAQPPSHADHTPMPQAIIYNLWFGYDVKRAVEEPRLHNKLLPNVTTVERNIDQLHLDAD

SEQ ID NO: 916092 - protein, 139 aa, Homo sapiens
MHPASLYKRGRETSPISTSQKMGNRITQGMARNDQRESSSSVQHALPAPFWKRTDLIDLTKTRIVFRQRKSKEQTRGSDHQRLHLLGNVAALLEEELDHDGQCLEVKKHLLPWKGLVRAIIVTGHVFSLTISWNFRVTK

SEQ ID NO: 916093 - protein, 142 aa, Homo sapiens
MLSGTELGRRPRETEAEIGGKWLQAKECLEPPDDEEGSPHKVWCSGPWGGQPLLKRGRLRPRDHFRPSLAAPRLGAADSSNSGQCLHLRPHLQAFPLVLPALHPPCSVRHCPPSSDWLPARQALVRAGVGSPAMPRVWVLRR

SEQ ID NO: 916094 - protein, 175 aa, Homo sapiens
MQNNLAFSLFFPLLPDSALHGGWGFSYLQPKKKKKKNKEEEEDEEEEEGRRRRGRRRRRKKKKRKRKRKKKKKKKRKQQQQKQQQQQQQLEGPLSFPKPYHYLESLLGIRTIEEGALTSNFSRVIKTKENLIFDLTRLKRAKQEKERRGGGGDREVEIKKKQKSWRRERIKAWEF

SEQ ID NO: 916095 - protein, 175 aa, Homo sapiens; identical to SEQ ID NO: 916094

SEQ ID NO: 916096 - protein, 505 aa, Homo sapiens
LTGNMSGRARVKARGIARSPSATEVGRIQASPLPRSVDLSNNEASSSNGFLGTSRISTNDKYGISSGDAGSTFMERGVKNKQDFMDLSICTREKLAHVRNCKTGSSGIPVKLVTNLFNLDFPQDWQLYQYHVTYIPDLASRRLRIALLYSHSELSNKAKAFDGAILFLSQKLEEKVTELSSETQRGETIKMTITLKRELPSSSPVCIQVFNIIFRKILKKLSMYQIGRNFYNPSEPMEIPQHNADVSYKVLRNETVLEFMTALCQRTGLSCFTQTCEKQLIGLIVLTRYNNRTYSIDDIDWSVKPTHTFQKRDGTEITYVDYYKQQYDITVSDLNQPMLVSLLKKKRNDNSEAQLAHLIPELCFLTGLTDQATSDFQLMKAVAEKTRLSPSGRQQRLARLVDNIQRNTNARFELETWGLHFGSQISLTGRIVPSEKILMQDHICQPVSAADWSKDIRTCKILNAQSLNTWLILCSDRTEYVAESFLNCLRRVAGSMGFNVDYPKM

SEQ ID NO: 916097 - protein, 511 aa, Homo sapiens
SWAPGESVRGADAQEGAEDARRVGGWVGPEPLKAEPPPALAIPELSRRRRWLLPDPEFPLSLDGAELWAARAAQLSGDRCTLSSLGKTQRRLGIFLGGRGPAPRRHHVPGDPVLRAAALGFWALSARRPLTMAGLPRAQRAPGAQSAAALLLGKRLSFSRAERVAGAGGGPGARVVAQARMPRGGGPTGRENGLPDGREVDPLPEQGAPEGWSSIPDPGARPRPEQGRPGSPPAALRLPPLCPADLLLSAEVSGGDRLDCVKASDQCLKEQSCSTKYRTLRQCVAGKETNFSLASGLEAKDECRSAMEALKQKSLYNCRCKRGMKKEKNCLRIYWSMYQSLQGTTAAGVCWADQHCWACCWKTHEEDGGWGEGHPRDPADLSETWSEHGRRIPLKGPKEPTTSFQGEPAWGFRWPLNNNRKACPASGNDLLEDSPYEPVNSRLSDIFRVVPFISGAWNMKRAGGHTGESAPVQEDVGGEAGTQKCPRIPEGRAVWALRGSEAEATVSGNKN

SEQ ID NO: 916098 - protein, 405 aa, Homo sapiens
MFLATLYFALPLLASGHSPPGGPLTMAGLPRAQRAPGAQSAAALLLGKRLSFSRAERVAGAGGGPGARVVAQARMPRGGGPTGRENGLPDGREVDPLPEQGAPEGWSSIPDPGARPRPEQGRPGSPPAALRLPPLCPADLLLSAEVSGGDRLDCVKASDQCLKEQSCSTKYRTLRQCVAGKETNFSLASGLEAKDECRSAMEALKQKSLYNCRCKRGMKKEKNCLRIYWSMYQSLQGTTAAGVCWADQHCWACCWKTHEEDGGWGEGHPRDPADLSETWSEHGRRIPLKGPKEPTTSFQGEPAWGFRWPLNNNRKACPASGNDLLEDSPYEPVNSRLSDIFRVVPFISGAWNMKRAGGHTGESAPVQEDVGGEAGTQKCPRIPEGRAVWALRGSEAEATVSGNKN

SEQ ID NO: 916099 - protein, 765 aa, Homo sapiens
MACKQKFIILLNHPRLQGEKELGELGQLQTQASDTSVVLSMDNNRYLDFSSIITEVRARYEEIARSSKAEAEALYQTKYQELQVSAQLHGDRMQETKVQISQLHQEIQRLQSQTENLKKQNASLQAAITDAEQRGELALKDAQAKVDELEAALRMAKQNLARLLCEYQELTSTKLSLDVEIATYRRLLEGEECRMSGECTSQVTISMRSSVSRQTYSTKGGFSSNSASGGSGSQARTSFSSVTVSRSSGSGGGAHCGPGTGGFGSRSLYNLGGHKSISVSVAGGALSGRALGGFGFGSRAFMGQGAGRQTFGPACPPGGIQEVTVNQSLLTPLHVEIDPEIQRVRTQEREQIKTLNNKFASFIDKVRFLEQQNKVLETKWALLQEQGQNLGVTRNNLEPLFEAYLGSMRSTLDRLQSERGRLDSELRNVQDLVEDFKNKYEDEINKHTAAENEFVVLKKDVDAAYMGRMDLHGKVGTLTQEIDFLQQLYEMELSQVQTHVSNTNVVLSMDNNRNLDLDSIIAEVKAQYELIAQRSRAEAEAWYQTKYEELQVTAGKHGDNLRDTKNEIAELTRTIQRLQGEADAAKKQCQQLQTAIAEAEQRGELALKDAQKKLGDLDVALHQAKEDLTRLLRDYQELMNVKLALDVEIATYRKLLESEESRWWPLLPDPESWVGPALGESPGSLLRAVTGNSTTVCGGGAASFGGGISLGGSGGATKGGFSTNVGYSTVKGGPVSAGTSILRKTTTVKTSSQSPHIQSARKIHT

SEQ ID NO: 916100 - protein, 444 aa, Homo sapiens
AARRGAAGRGPRAMAAELAMGAELPSSPLAIEYVNDFDLMKFEVKKEPPEAERFCHRLPPGSLSSTPLSTPCSSVPSSPSFCAPSPGTGGGGGAGGGGGSSQAGGAPGPPSGGPGAVGGTSGKPALEDLYWMSGYQHHLNPEALNLTPEDAVEALIGSGHHGAHHGAHHPAAAAAYEAFRGPGFAGGGGADDMGAGHHHGAHHAAHHHHAAHHHHHHHHHHGGAGHGGGAGHHVRLEERFSDDQLVSMSVRELNRQLRGFSKEEVIRLKQKRRTLKNRGYAQSCRFKRVQQRHILESEKCQLQSQVEQLKLEVGRLAKERDLYKEKYEKLAGRGGPGSAGGAGFPREPSPPQAGPGGAKGTADFFLYGAGPRARAAVAGDKFAQASRGLGSDSAVQDVDTRPGPAVLAPVPSLRARGWRPLRSRSPFARVGPGRRPEPPFPCLF

SEQ ID NO: 916101 - protein, 448 aa, Homo sapiens
AARRGAAGRGPRAMAAELAMGAELPSSPLAIEYVNDFDLMKFEVKKEPPEAERFCHRLPPGSLSSTPLSTPCSSVPSSPSFCAPSPGTGGGGGAGGGGGSSQAGGAPGPPSGGPGAVGGTSGKPALEDLYWMSGYQHHLNPEALNLTPEDAVEALIGSGHHGAHHGAHHPAAAAAYEAFRGPGFAGGGGADDMGAGHHHGAHHAAHHHHAAHHHHHHHHHHGGAGHGGGAGHHVRLEERFSDDQLVSMSVRELNRQLRGFSKEEVIRLKQKRRTLKNRGYAQSCRFKRVQQRHILESEKCQLQSQVEQLKLEVGRLAKERDLYKEKYEKLAGRGGPGSAGGAGFPREPSPPQAGPGGAKGTADFFLYGAGPRARAAVAGDKFAQASRGLGSDSAVQDVDTRPGPAVLAPVPSLRARGWRPLRSRSPFARVGPGRRPEVERRTVISKET

SEQ ID NO: 916102 - protein, 339 aa, Homo sapiens
AARRGAAGRGPRAMAAELAMGAELPSSPLAIEYVNDFDLMKFEVKKEPPEAERFCHRLPPGSLSSTPLSTPCSSVPSSPSFCAPSPGTGGGGGAGGGGGSSQAGGAPGPPSGGPGAVGGTSGKPALEDLYWMSGYQHHLNPEALNLTPEDAVEALIGSGHHGAHHGAHHPAAAAAYEAFRGPGFAGGGGADDMGAGHHHGAHHAAHHHHAAHHHHHHHHHHGGAGHGGGAGHHVRLEERFSDDQLVSMSVRELNRQLRGFSKEEVIRLKQKRRTLKNRGYAQSCRFKRVQQRHILESEKCQLQSQVEQLKLEGEGAKVRRLLHRESQTESCALIHLWNL

SEQ ID NO: 916103 - protein, 289 aa, Homo sapiens
MAAMVMLFMVVVVLVAVMVMIVVMLVVVLMAMMVVMLVVVVMVMVMVMMVLMLVVVVLVMMVVMLVVVVTVMIVVILVVVVLVMTVVMLVVVVVTVMIVVILVVVVMVMLVVMLVVVVVMVVMVMMVVMLVVVVMVMMVVMLLVVVVTAMIVVILVVVVMVMMLVMLVLVVVMLVVVMLVVVILVMVVMLVVVMVMMVVMLVVVVMVLMVMLMVVILVMMVMLVMVVVVMLVVMLVVVVMVMIVVMLFLLVMMVVILLMVIVMVIDGGSDVTSNDAGGDGVRGFKMIKG

SEQ ID NO: 916104 - protein, 171 aa, Homo sapiens
DIELRIRWFRHRTISASAGKQLWPGGLLLDLPMLTQQLKRIFGYKQCALKVKEPPGLQELDFYCCTFKYPPWTELGAEAKSQFLIWIGLTFEHEIGQSMGTGTKMNSKTLPSLPRLLAQQEWLVQACIHKWQSTPDFETCMVVISRVTTWAKESHCKEERPLGKWSRKRKQ

SEQ ID NO: 916105 - protein, 141 aa, Homo sapiens
MENYLNSFLYPIATRVPCRPHGCYPVGRCQTRNVTQMEPKEDFPEQPTLEMSRGSVSKVISMKMISHQSDVYCMSSRHISEKQTYSSPAQYTEDTDKHKSLDERRSWLQSTQYIEKRPVKNNLSSWQLKQEEFHWHAKTKL

SEQ ID NO: 916106 - protein, 224 aa, Homo sapiens
TRSGGDGAMSPLLGLRSELQDTCTSLGLMLSVVLLMGLARVVARQQLHRPVAHAFVLEFLATFQLCCCTHELQLLSEQHPAHPTWTLTLVYFFSLVHGLTLVGTSSNPCGVMMQMMLGGMSPETGAVRLLAQLVSALCSRYCTSALWSLGLTQYHVSERSFACKNPIRVDLLKAVITEAVCSFLFHSALLHFQEVRTKLRIHLLAALITFLVYAGGIDRFGYSY

SEQ ID NO: 916107 - protein, 183 aa, Homo sapiens
VNLGPIWTLLYVTVMILCSSMSSDLAPYFTSEPLSTVQKHGGPAELHCSAKPDNRNDVSCDRTENPEEFSRGDSCVYSETDSNNLHWNPLILPPISEDGAEKTTWPPPGVPLDSPSGVLQQPQETGGCANNQSSSDFKPGWKIQPVGNLGIATLDLLFRGGDSTLSVEVMKDRYTGKAAHRKP

SEQ ID NO: 916108 - protein, 128 aa, Homo sapiens
WRVLGKFRLSPEVNLYDLHAGLHMSSPGAAGGGWDGSTEKARHRLRSEPQDVGRLLQMTSLVASSSPPGGRRPYLEPRGMSVRNSYEVVGVQVGLPVVQPGGECSCGPWQQVSILRWHGVLGKRGSPP

SEQ ID NO: 916109 - protein, 122 aa, Homo sapiens
MKSIPEPAIFIPRSSLPVSSPGAAGGGWDGSTEKARHRLRSEPQDVGRLLQMTSLVASSSPPGGRRPYLEPRGMSVRNSYEVVGVQVGLPVVQPGGECSCGPWQQVSILRWHGVLGKRGSPP

SEQ ID NO: 916110 - protein, 146 aa, Homo sapiens
QVMTVPLMSHVTSGGHLFESKLFCGPEKKDAQVSLERVVLIYKNTWSLVSRQPSSLALTLSQQTGLTKSFPSDTCSWLGNECDRTQTLSFKGRIHKRSGMAIKLMTLLLLESHKKFPSCSSPEQIRALQLLVPWQGSSWGYYIPPS

SEQ ID NO: 916111 - protein, 158 aa, Homo sapiens
MSKALVAVSSSTVNTNNVQSAGCPFAFRHDCKFPEASPEAEQMLAACFMYSLQNLPRCDYEAAWDTDCVPWEPCPVVGTQAKEMLKNCAQWFSLLGPADSIPWEDVGPAKGSSGEMGSCRGLRLRPRTDHCRAQWIPPPGCNAPGGRAWSRHALNRCP

SEQ ID NO: 916112 - protein, 618 aa, Homo sapiens
MSASQATPQTQDSYKKEIVARPWGEHQHQFRGRANLHVFEDWCGSSIQQLRRNLHFPLYPHIRTTLRKLAVSPKWTNYGLRIFGYLHPFTDGKIQFAIAADDNAEFWLSLDDQVSGLQLLASVGKTGKEWTAPGEFGKFRSQISKPVSLSASHRYYFEVLHKQNEEGTDHVEVAWRRNDPGAKFTIIDSLSLSLFTNETFLQMDEVGHIPQTAASHVDSSNALPRDEQPPADMLRPDPRDTLYRVPLIPKSHLRHVLPDCPYKPSYLVDGLPLQRYQGLRFVHLSFVYPNDYTRLSHMETHNKCFYQENAYYQDRLRDTEWGRKVTLQRALREPGELPGPGFSFQEYIKIDQPEKQGLEQPEESQYGEVAEETPASNNQNARMLEGRQTPASTLEQDATDYRLRSLRKLLAQPREGLLAPFSKRNSTASFPGRTSHIPVQQPEKRKQKPSPEPSQDSPHSDKWPPGHPVKNLPQMRGPRPRPAGDSPRKTQWLNQVESYIAEQRRGDRMRPQAPGRGWHGEEEVVAAAGQEGQVEGEEEGEEEEEEEDMSEVFEYVPVFDPVVNWDQTFSARNLDFQALRTDWIDLSCNTSGNLLLPEQEALEVTRVFLKKLNQRSRG

SEQ ID NO: 916113 - protein, 161 aa, Homo sapiens
MGSPRAARPPLLLRPVKLLRRRFRLLLALAVVSVGLWTLYLELVASAQVGGNPLNRRYGSWRELAKALASRNIPAVDPHLQFYHPQRLSLEDHDIDQGVSSNSSYLKWNKPVPWLSEFRGRANLHVFEDWCGSSIQQLRRNLHFPLYPHSVHPDNSRDGTG

SEQ ID NO: 916114 - protein, 315 aa, Homo sapiens
MFLPGKRLLPRPVRDTEWGRKVTLQRALREPGELPGPGFSFQEYIKIDQPEKQGLEQPEESQYGEVAEETPASNNQNARMLEGRQTPASTLEQDATDYRLRSLRKLLAQPREGLLAPFSKRNSTASFPGRTSHIPVQQPEKRKQKPSPEPSQDSPHSDKWPPGHPVKNLPQMRGPRPRPAGDSPRKTQWLNQVESYIAEQRRGDRMRPQAPGRGWHGEEEVVAAAGQEGQVEGEEEGEEEEEEEDMSEVFEYVPVFDPVVNWDQTFSARNLDFQALRTDWIDLSCNTSGNLLLPEQEALEVTRVFLKKLNQRSRG

SEQ ID NO: 916115 - protein, 501 aa, Homo sapiens
MLVGSVDKTGKEWTAPGEFGKFRSQISKPVSLSASHRYYFEVLHKQNEEGTDHVEVAWRRNDPGAKFTIIDSLSLSLFTNETFLQMDEVGHIPQTAASHVDSSNALPRDEQPPADMLRPDPRDTLYRVPLIPKSHLRHVLPDCPYKPSYLVDGLPLQRYQGLRFVHLSFVYPNDYTRLSHMETHNKCFYQENAYYQDRLRDTEWGRKVTLQRALREPGELPGPGFSFQEYIKIDQPEKQGLEQPEESQYGEVAEETPASNNQNARMLEGRQTPASTLEQDATDYRLRSLRKLLAQPREGLLAPFSKRNSTASFPGRTSHIPVQQPEKRKQKPSPEPSQDSPHSDKWPPGHPVKNLPQMRGPRPRPAGDSPRKTQWLNQVESYIAEQRRGDRMRPQAPGRGWHGEEEVVAAAGQEGQVEGEEEGEEEEEEEDMSEVFEYVPVFDPVVNWDQTFSARNLDFQALRTDWIDLSCNTSGNLLLPEQEALEVTRVFLKKLNQRSRG

SEQ ID NO: 916116 - protein, 616 aa, Homo sapiens
GVCTARITGCRADLVPKARPWGEHQHQFRGRANLHVFEDWCGSSIQQLRRNLHFPLYPHIRTTLRKLAVSPKWTNYGLRIFGYLHPFTDGKIQFAIAADDNAEFWLSLDDQVSGLQLLASVGKTGKEWTAPGEFGKFRSQISKPVSLSASHRYYFEVLHKQNEEGTDHVEVAWRRNDPGAKFTIIDSLSLSLFTNETFLQMDEVGHIPQTAASHVDSSNALPRDEQPPADMLRPDPRDTLYRVPLIPKSHLRHVLPDCPYKPSYLVDGLPLQRYQGLRFVHLSFVYPNDYTRLSHMETHNKCFYQENAYYQDRLRDTEWGRKVTLQRALREPGELPGPGFSFQEYIKIDQPEKQGLEQPEESQYGEVAEETPASNNQNARMLEGRQTPASTLEQDATDYRLRSLRKLLAQPREGLLAPFSKRNSTASFPGRTSHIPVQQPEKRKQKPSPEPSQDSPHSDKWPPGHPVKNLPQMRGPRPRPAGDSPRKTQWLNQVESYIAEQRRGDRMRPQAPGRGWHGEEEVVAAAGQEGQVEGEEEGEEEEEEEDMSEVFEYVPVFDPVVNWDQTFSARNLDFQALRTDWIDLSCNTSGNLLLPEQEALEVTRVFLKKLNQRSRG

SEQ ID NO: 916117 - protein, 706 aa, Homo sapiens
MGSPRAARPPLLLRPVKLLRRRFRLLLALAVVSVGLWTLYLELVASAQVGGNPLNRRYGSWRELAKALASRNIPAVDPHLQFYHPQRLSLEDHDIDQGVSSNSSYLKWNKPVPWLSEFRGRANLHVFEDWCGSSIQQLRRNLHFPLYPHIRTTLRKLAVSPKWTNYGLRIFGYLHPFTDGKIQFAIAADDNAEFWLSLDDQVSGLQLLASVGKTGKEWTAPGEFGKFRSQISKPVSLSASHRYYFEVLHKQNEEGTDHVEVAWRRNDPGAKFTIIDSLSLSLFTNETFLQMDEVGHIPQTAASHVDSSNALPRDEQPPADMLRPDPRDTLYRVPLIPKSHLRHVLPDCPYKPSYLVDGLPLQRYQGLRFVHLSFVYPNDYTRLSHMETHNKCFYQENAYYQDRLRDTEWGRKVTLQRALREPGELPGPGFSFQEYIKIDQPEKQGLEQPEESQYGEVAEETPASNNQNARMLEGRQTPASTLEQDATDYRLRSLRKLLAQPREGLLAPFSKRNSTASFPGRTSHIPVQQPEKRKQKPSPEPSQDSPHSDKWPPGHPVKNLPQMRGPRPRPAGDSPRKTQWLNQVESYIAEQRRGDRMRPQAPGRGWHGEEEVVAAAGQEGQVEGEEEGEEEEEEEDMSEVFEYVPVFDPVVNWDQTFSARNLDFQALRTDWIDLSCNTSGNLLLPEQEALEVTRVFLKKLNQRSRG

SEQ ID NO: 916118 - protein, 92 aa, Homo sapiens
ETFLQMDEVGHIPQTAASHVDSSNALPRDEQPPADMLRPDPRDTLYRGKASASAWRPFWGHCTARSTADGGEGLRDLPSIPITVELFIVLVT

SEQ ID NO: 916119 - protein, 143 aa, Homo sapiens
MLSLQQLSGKKQSRVALKERTQMSLPWWMPFLPADGSAEPSGKPMDSQRRDEQEARGLVATAPATGSHFQHTSNITHDQNLARPGTLQGALKGHTPPSALVFFITLSAPDGFCLLPKKEKISHYKNSRTNEHQALKPVPKRRQ

SEQ ID NO: 916120 - protein, 179 aa, Homo sapiens
MRFLALPRKQFKGKLEVKVNRPGMVGVTTPFHGNDPTTQNCERRSAVDKMLPNSIACYGEIFCERKKLNVASFILGIRAKLHLKKKKKKEEIATATSAFSHHHPDQSAATNKTFHQQRDPNFLKPQVIAGTFYQYLSFLFVCFLIFETESHSLAQAGMYEPRSRHCTPAWMTEQDSVSK

SEQ ID NO: 916121 - protein, 137 aa, Homo sapiens
TSFSQYYMRFLALPRKQFKGKLEVKVNRPGMVGVTTPFHGNDPTTQNCERRSAVDKMLPNSIACYGEIFCERKKLNVASFILGIRAKLHLKKKKKKEEIATATSAFSHHHPDQSAATNKTFHQQRDPNFLKPQHYRG

SEQ ID NO: 916122 - protein, 505 aa, Homo sapiens
MLGWGMTRSACLLFPEMEQKEGKLSEDGTTVSPAADNPEMSGGGAPAEETKGTAGKAINEGPPTESGKQEKAPAEDGMSAELQGEANGLDEVKVESQREAGGKEDAEAELKKEDGEKEETTVGSQEMTGRKEETKSEPKEAEEKESTLASEKQKAEEKEAKPESGQKADANDRDKPEPKATVEEEDAKTASQEETGQRKECSTEPKEKATDEEAKAESQKAVVEDEAKAEPKEPDGKEEAKHGAKEEADAKEEAEDAEEAEPGSPSEEQEQDVEKEPEGGAGVIPSSPEEWPESPTGEGHNLSTDGLGPDCVASGQTSPSASDVPQSPPESPSSGEKKEKAPERRVSAPARPRGPRAQNRKAIVDKFGGAASGPTALFRNTKAAGAAIGGVKNMLLEWCRAMTKKYEHVDIQNFSSSWSSGMAFCALIHKFFPDAFDYAELDPAKRRHNFTLAFSTAEKLADCAQLLDVDDMVRLAVPDSKCVYTYIQELYRSLVQKGLVKTKKK

SEQ ID NO: 916123 - protein, 144 aa, Homo sapiens
RQVAFTANLIMVQLTVKSTCQRGGSRAMCVCHGGGGRMQGLFPVKKMKTDSNCEQCFVNMSHGKDDNDRDRKQPRVPSETPPSNLKQPEGWKIGLPPALLVFEPSAQMSLPGGAFLNGTECGIGAGNDDVRTGSKEAHHLSKNL

SEQ ID NO: 916124 - protein, 133 aa, Homo sapiens
MVSLPLILIQNLFIALSIPVDSSIAVDWSTTSTSQGGPLEGGRGHSWKTEKWASFGMDVRTILIATSQSAEERQQKGSMEKNKNFNNSVQNLQESMFMQCRDWQTSLKDQIINISGFANLYLQSSCNYSTLTS

SEQ ID NO: 916125 - protein, 174 aa, Homo sapiens
SDFLCHSEAKTLVMLTQCFEKGRIRCHQYWPEDNKPVTVFGDIVITKLMEDVQIDWTIRDLKIERHGDCMTVRQCNFTAWPEHGVPENSAPLIHFVKLVRASRAHDTTPMIVHCSAGVGRTGVFIALDHLTQHINDHDFVDIYGLVAELRSERMCMVQNLDQILDLKQATYPGD

SEQ ID NO: 916126 - protein, 212 aa, Homo sapiens [sequence omitted]

SEQ ID NO: 916127 - protein, 156 aa, Homo sapiens
MGSNYLCIIKQLRKGPWPKLMMLFRVCTLLLAHICWPSLETRKLPKVIESLEQLPLPGKECARFHSPSILQGPSTGRQGCLQTILQVSESPYSFCLSCPSWLCGRWRGEGTPQNASTRGACRIFQPTGIPGPKKQSDQPEAPGPALGRLDPRVTGS

SEQ ID NO: 916128 - protein, 131 aa, Homo sapiens
MSHCIAERKADPHIPFLKNKVTVIHAFSVLFITTKDRTLKTSFPIPENVCRTFCLRFLRPEKWKLIEQCHVISIQLALMSNECLLVCIMQNWPVCALHVGMGACPGREHQQAQGSVGEETYHGPTHIHLLI

SEQ ID NO: 916129 - protein, 159 aa, Homo sapiens
VLSFLHSKLQAGQEGTRECHWQTQMAFRARFSLRLGGYPSVAAGSSSAGSASGAQQKRGGYGLQEFKHSSQPALQGCQGRDLLLKTTEFFVSISARSGAHSPPRTHCCSLKAREPELRSRNPLSGLARAADRQSGQGRPQDQRQREEWSERDQCWTQDD

SEQ ID NO: 916130 - protein, 430 aa, Homo sapiens
QGMAALRDSLGEEDESSSSIQGGCGQPYGAVKSGGWMDMWLWSSEMAFPCRRSLTAKTLACLLVGVSFLALQQWFLQAPRSPREERSPQEETPEGPTDAPAADEPPSELVPGPPCVANASANATADFEQLPARIQDFLRYRHCRHFPLLWDAPAKCAGGRGVFLLLAVKSAPEHYERRELIRRTWGQERSYGGRPVRRLFLLGTPGPEDEARAERLAELVALEAREHGDVLQWAFADTFLNLTLKHLHLLDWLAARCPHARFLLSGDDDVFVHTANVVRFLQAQPPGRHLFSGQLMEGSVPIRDSWSKYFVPPQLFPGSAYPVYCSGGGFLLSGPTARALRAAARHTPLFPIDDAYMGMCLGARRPGAQRPRGHPGPSACSLPGAQQSSFDPCMYRELLLVHRFAPYEMLLMWKALHSPALSCDRGHRVS

SEQ ID NO: 916131 - protein, 130 aa, Homo sapiens
MLTWTLCQTCGVGRVGKRCRSAGPRPPGGRPCLHQTAASFDSGGLSKLRSFRGPVPGGGDLPVTSDSGPAQDEGTAEGAFDKCTVRVVNVATFAFRGPCGQEADEDECCRAQKTFETLTSATPATPSVEH

SEQ ID NO: 916132 - protein, 207 aa, Homo sapiens
MPRTLAGTGKGGQGWKGAGGCQAWRSGAGRGAAGRGGPGAAPASGRTHLARGAGCRRLRGAGHRSDVRTRRGLEPGGGLEGRGGPAKERGCDGEEVPTRRGPAGEGTRTGRGSGTGVKAALGEDGRGWRALVSRKPSWGPLRAAEPVRTLLPPPPSASVRLAAALERILLSPPRVRSAALPGAVGEKFAGVALSRARETTSEALIQP

SEQ ID NO: 916133 - protein, 132 aa, Homo sapiens [sequence omitted]

SEQ ID NO: 916134 - protein, 153 aa, Homo sapiens
MWSEEERGPADERVSKPTRLQGCFQSNQTKGLSRPSNRLSPCPWLPVSEPPAVEATFPHSSVFIMPRFPNAILHPNLQKWVQPLPQVTLKPASLEQQTQVRGQRRQPRASPFLRGPAFSKGCEADCSCLGSSLVLRKTPSLAQPSVLTPITSC

SEQ ID NO: 916135 - protein, 153 aa, Homo sapiens; identical to SEQ ID NO: 916134

SEQ ID NO: 916136 - protein, 141 aa, Homo sapiens
MARICVPSQISCRIVIPSVGGAPWEVMSCLFVTHPFLTGPSRNLGWVLVPLVLKLLECTLSARHQGGTVKETLLSQGSYSWGRLRSGPEAQGPSWDWATRHKSEAKDRAGVDLCLDLAGSREGFPRSSIWGDTSIDPGKRM

SEQ ID NO: 916137 - protein, 387 aa, Homo sapiens
MRKLTGVNLPQGGQALWGYQTEAAMPVVWPTLLDLSRDECKRILRKLELEAYAGVISALRAQGDLTKEKKDLLGELSKVLSMSGPNSSSEWSIEGRRLVPLMPRLVPQTAFTVTANAVANAAIQHNASLPVPAETGSKEVVVCYSYTSTTSTPTSTPVPSGSIATVKSPRPASPASNVVVLPSGSTVYVKSVSCSDEDEKPRKRRRTNSSSSSPVVLKEVPKAVVPVSKTITVPVSGSPKMSNIMQSIANSLPPHMSPVKITFTKPSTQTTNTTTQKVIIVTTSPSSTFVPNILSKSHNYAAVTKLVPTSVIASTTQKPPVVITASQSSLVSNSSSGSSSSTPSPIPNTVAVTAVVSSTPSVVMSTVAQVPKSNPQNQVCSEKSVYL

SEQ ID NO: 916138 - protein, 402 aa, Homo sapiens
MPVVWPTLLDLSRDECKRILRKLELEAYAGVISALRAQGDLTKEKKDLLGELSKVLSISTERHRAEVRRAVNDERLTTIAHKMNLSLYLGERPSYSMSGPNSSSEWSIEGRRLVPLMPRLVPQTAFTVTANAVANAAIQHNASLPVPAETGSKEVVVCYSYTSTTSTPTSTPVPSGSIATVKSPRPASPASNVVVLPSGSTVYVKSVSCSDEDEKPRKRRRTNSSSSSPVVLKEVPKAVVPVSKTITVPVSGSPKMSNIMQSIANSLPPHMSPVKITFTKPSTQTTNTTTQKVIIVTTSPSSTFVPNILSKSHNYAAVTKLVPTSVIASTTQKPPVVITASQSSLVSNSSSGSSSSTPSPIPNTVAVTAVVSSTPSVVMSTVAQVPKSNPQNQVCSEKSVYL

SEQ ID NO: 916139 - protein, 388 aa, Homo sapiens
MPVVWPTLLDLSRDECKRILRKLELEAYAGVISALRAQGDLTKEKKDLLGELSKVLSISTERHRAEVRRAVNDERLTTIAHNMSGPNSSSEWSIEGRRLVPLMPRLVPQTAFTVTANAVANAAIQHNASLPVPAETGSKEVVVCYSYTSTTSTPTSTPVPSGSIATVKSPRPASPASNVVVLPSGSTVYVKSVSCSDEDEKPRKRRRTNSSSSSPVVLKEVPKAVVPVSKTITVPVSGSPKMSNIMQSIANSLPPHMSPVKITFTKPSTQTTNTTTQKVIIVTTSPSSTFVPNILSKSHNYAAVTKLVPTSVIASTTQKPPVVITASQSSLVSNSSSGSSSSTPSPIPNTVAVTAVVSSTPSVVMSTVAQVPKSNPQNQVCSEKSVYL

SEQ ID NO: 916140 - protein, 229 aa, Homo sapiens
SSSSTPSPIPNTVAVTAVVSSTPSVVMSTVAQGVSCSDEDEKPRKRRRTNSSSSSPVVLKEVPKAVVPVSKTITVPVSGSPKMSNIMQSIANSLPPHMSPVKITFTKPSTQTTNTTTQKVIIVTTSPSSTFVPNILSKSHNYAAVTKLVPTSVIASTTQKPPVVITASQSSLVSNSSSGSSSSTPSPIPNTVAVTAVVSSTPSVVMSTVAQVPKSNPQNQVCSEKSVYL

SEQ ID NO: 916141 - protein, 137 aa, Homo sapiens
MTLFSRLVVLRLQQDQNQRGAQIAETDSSSDSAGQSEARESAFNRFPGDADVAGPKMTLGATDLIYLIRQLGGATDLGQTCRVSAGLTQLLWLQPLATWVEGCLVQAVISLDHLSLLYAVSHLPVENCACPHDMRGF

SEQ ID NO: 916142 - protein, 357 aa, Homo sapiens
MPEPGPDAAGTASAQPQPPPPPPPAPKESPFSIKNLLNGDHHRPPPKPQPPPRTLFAPASAAAAAAAAAAAAAKGALEGAAGFALSQVGDLAFPRFEIPAQRFALPAHYLERSPAWWYPYTLTPAGGHLPRPEASEKALLRDSSPASGTDRDSPEPLLKADPDHKELDSKSPDEIILEESDSEESKKEGEAAPGAAGASVGAAAATPGAEDWKKGAESPEKKPACRKKKTRTVFSRSQVFQLESTFDMKRYLSSSERAGLAASLHLTETQVKIWFQNRRNKWKRQLAAELEAANLSHAAAQRIVRVPILYHENSAAEGAAAAAAGAPVPVSQPLLTFPHPVYYSHPVVSSVPLLRPV

SEQ ID NO: 916143 - protein, 142 aa, Homo sapiens
MALFPHERNGGHKRSAARGRRVPPGKRGSRARGRRLPSTGAGPTPPSRCVLSLQVGRCRPSRSLCLQTARALTWIGCWTKLSPGGRLQQLLLSSPGQHRTGGAGASEQGGRRAASAEGECWQPVARDVKHCGEKRRKKLLEL

SEQ ID NO: 916144 - protein, 381 aa, Homo sapiens
MLVWGQRLPREGVSNGEHVSESTASMKKHHNEEHVSESMASMGKHCNEEHVSESTASMRRHHNEEHVSESTASMRKHHNEEHVLESMASMRKHHNEEHVSESTASMGKHRNEEHVSESTASMRRYHNEEHVSESTASMRKHHNEEHVSESTASMGKHHNEEHVSESTASMGKHHNEEHVSESTASMGKHRNEEHVSESMASMGKHHNEEHVSESMASMGKHHNEEHVSESTASMGKHHNEEHVLESMASMGKHHNEEHVLESMASMGKHHNEDHVLESMASMGKHHNEEHVSESTASMGKHHNEEHVSESTASMGKHHNEEHVLESMASVGKHHNEEHVLESMASMGKHHNEEHVSESTASMGKHHNEEHASHAIMAPFLL

SEQ ID NO: 916145 - protein, 314 aa, Homo sapiens
SPSDFLPAPPHCLPAAPPSTQITQIVSKGSSWFPSISYEPRMGSKEDAGKGCPAAGGVSSFTIQSILGGGPSEAPREPVGWPARKRSLSVSSEEEEPDDGWKAPACFCPDQHGPKEQGPKHHPPIPFPCLGTPKGSGGSGPGGLERTPFLSPSHSDFKEEKERLLPAGSPSPGSERPRDGGAERQAGAAKKKTRTVFSRSQVYQLESTFDMKRYLSSSERACLASSLQLTETQVKTWFQNRRNKWKRQLSAELEAANMAHASAQTLVSMPLVFRDSSLLRVPVPRSLAFPAPLYYPGSNLSALPLYNLYNKLDY

SEQ ID NO: 916146 - protein, 133 aa, Homo sapiens
VKMSYPPQSRCGCGGMGAAGPPSLTVHQELCGAYSPDGTTEALPLASWPRARPSPAKAPAYDTAKLPALIGCGSRRPPGVNPGASSLKPGACVSEGAGPTGHLNQQAHDPPPPCPRLVFALDLQLGLTTNSVM

SEQ ID NO: 916147 - protein, 236 aa, Homo sapiens
PAAGIRHDVLYFCECLQNKKLKKKYKTSTHETEVCLVVFCNRFTIVNPSSVLLLPIQVAITGQLGVKPQTGNSIPLTATNFRIQGKDVLRLPPSSITTDAKGQTVLRITPDMMATLAKSQVTTVKLTQDLFGTGGNTTGKGISATLHVTSNPVHAADSPAKASSASAPSSTPTGTTVVKVTPDLKPTEASSSAFRLMPALGVSVADQKGQWLSEHTLPVTYAAGASCGLTAYYVAT

SEQ ID NO: 916148 - protein, 673 aa, Homo sapiens
YLLHLFSFWVSGTVRCWGTQWLLRQCAPLVGPKERYRYSQPHKAFTFRMHGFESVVGPVKGVFDKETSLNKAREHSLLRSDRPAYVTILSLVRDAAARLPNGEGTRAEICELLKDSQFLAPDVTSTQVNTVVSGALDRLHYEKDPCVKYDIGRKLWIYLHRDRSEEEFERIHQAQAAAAKARKALQQKPKPPSKVVRVVAQPSLPAVPQQSGGPAQTLPQMPAGPQIRVPATATQTKVVPQTVMATVPVKAQTTAATVQRPGPGQTGLTVTSLPATASPVSKPATSSPGTSAPSASTAAVIQNVTGQNIIKQVAITGQLGVKPQTGNSIPLTATNFRIQGKDVLRLPPSSITTDAKGQTVLRITPDMMATLAKSQVTTVKLTQDLFGTGGNTTGKGISATLHVTSNPVHAADSPAKASSASAPSSTPTGTTVVKVTPDLKPTEASSSAFRLMPALGVSVADQKGKSTVASSEANQLHDRIVQGLGVMPPKAGQTITVATHAKQGASVASGSGNCPYFSGVLTHISTGAPTVRQVPVSTTVVSTSQAGKLPTRITVPLSVISQPMKGKSVVTAPIIKGNLGANLSGLGRNIILTTMPAGTKLIAGNKPVSFLTAQQLQQLQQQGQATQKCNFGTIQPVGGMAIAENGNFLLELFTVTAQDLCHTCFLHMLASGF

SEQ ID NO: 916149 - protein, 212 aa, Homo sapiens
MFFKPLSLGYIFGVCYIGKLMSHGFVVQIMSSPRKFTVIKTNGQGLRWPLGAINCFLEAFKLMNYEMQKSMETYFKKETASIISDVRTSLWSRRLCLEAAQPSGGGRSLQAQIPSTDIPDLLLTGSVHGAKLTPLSTDSLAAEVGMTTAYLFSLFCRLANLKQRKTADFSCIALVPKIPTAQPFALHGEENLTQIPRKDELGPLFHYLFENI

SEQ ID NO: 916150 - protein, 333 aa, Homo sapiens
MRSHSRARILATMGSSVSTLAGASWRPSVQPQPTLTEQLEHRHPGHSFQIMKCYFTDHRGEQSPTDGTTLSLTSPESTEESVEVFWPGTIQREGSSPRPGPAIPREEGLYFAARDRGMRDWSSSPSSESSEYQSYSQYQSCCSCMCDEDNAAPQSVCAFYTHVQTVRGVAVAWETEAGFEPVTRKPRIHEAQFIKRQRWNGSSFEMASNTDMRWDLEACKSNCSPEPEDIDLLECCLQELREPPDWLVTTNYGVRCVACCRVLPSLDALLEHAQHGIREGFSCQIFFEEMLERRRAQGQAHDQQLEEEQSPSDNSECSRPQGEVLSAQQQEKQ

SEQ ID NO: 916151 - protein, 163 aa, Homo sapiens [sequence omitted]

SEQ ID NO: 916152 - protein, 193 aa, Homo sapiens
CCTFFQLEQLVPFTMGLHMLVAQNSQKSPVLSAMVNPTVFFDTEPLGRISFELFADKFPKTAGNFHALSTGEKGFGYKGSCFHRIVPGFMCQGGDFTCHDGTGGKSIYREKFDDKNFIRKHTVSGILSMANAGPNANSSQFFICAAKTEWLDGKHVVFSKVKEGMNIVETMECFGSRNGKTSKKITIADCGQL

SEQ ID NO: 916153 - protein, 255 aa, Homo sapiens
MVKGEKGPKGKKITLKVARNCIKITFDGKKRLDLSKMGITTFPKCILRLSDMDELDLSRNLIRKIPDSISKFQNLRWLDLHSNYIDKLPESIGQMTSLLYLNVSNNRLTSNGLPVELKQLKNIRAVNLGLNHLDSVPTTLGALKELHEVGLHDNLLNNIPVSISKLPKLKKLNIKRNPFPKPGESEIFIDSIRRLENLYVVEEKDLCAACLRKCQNARDNLNRIKNMATTTPRKTIFPNLISPNSMAKDSWEDWR

SEQ ID NO: 916154 - protein, 187 aa, Homo sapiens
RHCHHGPFSMSCWVHLPDRVVAGQRGSSLPSRGGRAEAPLTSRTGRLAGRGADPSPPSGTGWLPGGDAPHFPDGVAAGRRGSSLLRRGGCWAEGLLTSQMGWLPGRGLLISQTGRLGRDGPHLPDGVAAGQRRSSHPRRGGGAEALPTSQTMETGLALSLKLEYGGVILAHCILELLGSSNPPASVS

SEQ ID NO: 916155 - protein, 152 aa, Homo sapiens
MPVSINLWVPARGQSRDSCDHYKVMKKLHLKSLSDLPGLGYISRKFREVYGYRITSTQNIRPPKQKLPGFKHFAIDHSEEPEDAAPPHHFLIYTDWANHYLAKSGHKRLIRDLQQDVTDGVLLAQIIQVVANEKIEDINGCPKNRSQMVSGA

SEQ ID NO: 916156 - protein, 131 aa, Homo sapiens
MLLMVDEVISRAGIGKKDKYIHGGAIEVYLMEHVEVHIGSFLDGGKRAMAIPGFMSAPSRRREREEKFAQVSYFPTPPENFLLALKQSRDLRDPGGHQTYDHTGYCWDVTVSPCVVFKRLPSPAFVLASGV

SEQ ID NO: 916157 - protein, 648 aa, Homo sapiens
MEDRVAREDTEDCGARRCVSSVCSVSHRAGACDCSVNSQMQLSMMLLNICSDSQGLEGLLSGSELQSLLIATTCLREHSCCFWKEPTFCVLRAISKAQNLSIIQYLQATDCVRLSLQNLSRLTDTLPAPEVSEAVSLILGFVKDSYPVSSALFLEFENSEGYPLLLKVLLRYDGLTQSEVDPHLEELLGLVVWLTTCGRSELKVFDSITYPQLEGFKFHHEASGVTVKNLQAFQVLQNVFHKASDSVLCIQVLSVIRTMWAWNARNFFLLEWTLQPISQFVEIMPLKPAPVQEHFFQLLEALVFELHYVPHEILRKVQHLIKESPGPSCTLMALQSILSIAGGDPLFTDIFRDSGLLGLLLAQLRKQAKIMRKSGNKVSTPGVQDPERELTCVMLRIVVTLLKGSVRNAVVLKDHGMVPFIKIFLDDECYREASLSILEQLSAINAEEYMSIIVGALCSSTQGELQLKLDLLKSLLRILVTPKGRAAFRVSSGFNGLLSLLSDLEGSLQEPPLQAWGAVSPRQTLELVLYTLCAVSAALHWDPVNGYFFRRNGLFEKLAEDLCLLGCFGALEEEGNLLRFGGSLPPRIQSCLQILGFLDSMASGTLHLRGDLKESLRTKQGPVVDVQKGETGSDPQRNFKQWPDLEER

SEQ ID NO: 916158 - protein, 129 aa, Homo sapiens
MIGNTSGPWLLVFSIDYKAANIHINVYTVNEPWLFSLAWCSRINSVTTDNIGLLSQLDHPHFFMGQDQGKRDPESRHSLTGPVTASRPSGRQEKSLTSYYGGLVSFLEMTLKGALDGRSLSTGGAFPPT

SEQ ID NO: 916159 - protein, 183 aa, Homo sapiens
RSSPFTDAPERPPSCPAASFLGKWDQQAAGDLGDILLLQESCAEQRREQFGKCRGPTLLLVGGREQVGPNLGGQCLPPFCAFCIGLNWFSRDSHESPTFVPEKNTEPQRGQAIGPRSHSLQETEMGLRPWSIWLPCALLLCYTHPSSLLLGHQLGWEANSPNQKSFIEKQMTNKSCIYSRYTM

SEQ ID NO: 916160 - protein, 150 aa, Homo sapiens
MWQHQGSQRLGQDPGAAFWGAGLVEPGGRNQALFPMGTRLERRTSSNEETHQTLVSFGGPELRKAQGGSCQHHVSLYAAADELTLREAEGEPDEVGVDCTQLTFFPALHESLHSEDFLELCRERQVILQELLDKEKSRTDLSSSPNLATY

SEQ ID NO: 916161 - protein, 273 aa, Homo sapiens
LWHSVVCVYRAASQDLVRDSSFQTSAVLKRKLSLADCVAMEESPEKGARPRTATLWVSVLLIHSLPLPVGDWYCVPRVDHNVVFLSFASVPIYVPFLIVGSVFVAFIILGSLVAACCCRCLRPKQDPQQSRAPGGNRLMETIPMIPSASTSRGSSSRQSSTAASSSSSANSGARAPPTRSQTNCCLPEGTMNNVYVNMPTNFSVLNCQQATQIVPHQGQYLHPPYVGYTVQHDSVPMTAVPPFMDGLQPGYRQIQSPFPHTNSEQKMYPAVTV

SEQ ID NO: 916162 - protein, 632 aa, Homo sapiens
MSGLDSVAQVSGMCGVGWAKPQGNSETLIYLPRMSWPIDLAIYLWALLALTRVWKAGQLFPVVHRLLRAEAAHAEARSRPSVFGVSSFWWVRGLAGSGVKLQTFAVSVTALKISFEDVAVDFTLEEWQLLNPTQKNLYRDVMLENYSNLVFLGFQILKPDAMFKLEQQDPWIIGQEILNQNFSGEKPYQCSECGKAFSQKSLLTVHQRTHSGEKPHGCSECQKAFSRKSLLILHQRIHTGEKPYGCSECGKAFSRKSQLKRHQITHTIEKPYSCSECGKAFSQKLKLITHQRAHTGEKPYPCSHCGKAFFWKSQLITHQRTHTGKKPYGCGECQKAFSRNSLLIRHQRIHTGEKPYECNECGEAFIRKPQLIKHQITHTGEKNYRCSDCEEAFFKKSELIRHQKIHLGEKPYGCIQCGKTFFGKSQLLTHHRTHTGEKPYECSECGKAFTQKSSLISHQRTHTGEKPYECSECRKTFSEKSSLIHHQRTHTGEKPFECSECRKAFAWKPQLLRHQRIHTGEKPYECSECGKAFVQKVQLIKHQRNHTGEKTYGCSDCAKAFFEKAQLIIHQRIHTGERPYKCGECGKSFTRKSHLMRHQRIHTGDKYYGCNECGTTFNRKSQLMIHQRNHII

SEQ ID NO: 916163 - protein, 152 aa, Homo sapiens
VFGTMCTHPYANFSDLMLKNFLPDSILAQVFLAKSSIVYRGYVLWVKLSCPLQVAFSKADIWWLGSPVSLEEALEGSWVLPPPDPRGLEPGSSGSQLCLGTSAFTSRAPSHAEEEGAQRHNNLTMPPQWQRQEPGSTSLLRGEGKALLVSGG

SEQ ID NO: 916164 - protein, 213 aa, Homo sapiens
MPGGRRLVCFQAYWESGFAYESPSSDGLFGAVGKGMQTWAQTLTLALSRHIQGPGYLHTNCFELSIYVGCDKYPHESQLPEEWENNRESLIVFMEQVHRGIKGLVRDSHGKGIPNAIISVEGINHDIRTANDGDYWRLLNPGEYVVTAKAEGFTASTKNCMVGYDMGATRCDFTLSKTNMARIREIMEKFGKQPVSLPARRLKLRGRKRRQRG

SEQ ID NO: 916165 - protein, 213 aa, Homo sapiens; identical to SEQ ID NO: 916164

SEQ ID NO: 916166 - protein, 213 aa, Homo sapiens; identical to SEQ ID NO: 916164

SEQ ID NO: 916167 - protein, 213 aa, Homo sapiens; identical to SEQ ID NO: 916164

SEQ ID NO: 916168 - protein, 213 aa, Homo sapiens; identical to SEQ ID NO: 916164

SEQ ID NO: 916169 - protein, 216 aa, Homo sapiens
MPEPPTPSVGSCAAQASSTSPTPCSMVSSPINDPRVEECRHRARDWQAAPSAAPVRDPLGEASWAPESAGDLKVCEHTNQHPVSSSGFVNAPIDILYLATLVGPWRTFVCSFTPEARETRSPPGGTSNSRRAALRAVTLTTKVCSFTPEPARSRTHQKEETPNTSEHQKEQTLDTPPLRTVTLTARVRGFILEEELVVFKSLVQNTVSTASLDQGS

SEQ ID NO: 916170 - protein, 159 aa, Homo sapiens
MALFSSPSQGKGVLPVLFKLRLVGGQLPHLNAESSEKYTKSHETLMVVVDLSVLSNKILILRRINSQLKHGSQNLIVKRSEIEKQGKKSVSWSIFCCYNRMPQIRKPVPRLLYQSKEETIVVETRDVALEGLAHADMVAEKFHNQLSATAVSGMSLSAV

SEQ ID NO: 916171 - protein, 137 aa, Homo sapiens
MKADKNIYSRALFALSSSVSNAGGFFCINLVKLKQLIPEFLLYIFPSSSSDTWLQTHRGYSCIEATFPMVLQDAPFMVDFRDWTQSQIVHWLLTHILFLQLVAWTSATQFLLNCVRSNCHHKHLTHTYHDSDSLAES

SEQ ID NO: 916172 - protein, 432 aa, Homo sapiens
MYSPLKKSPCTNIRNSSEGPDQTLMCTAQDPLIHNVALLALSSAQNLNEGNPQGAPPQGGNKPQGPPSPPGKPQGPPPQGGNQPQGPPPPPGKPQGPPPQGGNKPQGPPPPGKPQGPPPQGDKSRSPRSPPGKPQGPPPQGGNQPQGPPPPPGKPQGPPPQGGNKPQGPPPPGKPQGPPPQGDNKSRSSRSPPGKPQGPPPQGGNQPQGPPPPPGKPQGPPPQGGNKPQGPPPPGKPQGPPPQGDNKSQSARSPPGKPQGPPPQGGNQPQGPPPPPGKPQGPPPQGGNKPQGPPPPGKPQGPPPQGGSKSRSSRSPPGKPQGPPPQGGNQPQGPPPPPGKPQGPPPQGGNKPQGPPPPGKPQGPPPQGGSKSRSARSPPGKPQGPPQQEGNNPQGPPPPAGGNPQQPQAPPAGQPQGPPRPPQGGRPSRPPQ

SEQ ID NO: 916173 - protein, 170 aa, Homo sapiens
FQLPEAAHMPLLMAPSIFKASHSNLSFRGHSTFSHPLISLLSGPFLLEECKGILEKPDSHSKELELSRRRRKRPRESGHSSREPGDVLLHVSRSGSKQAWNLSPGKQGESTLLRNQPRRQSRQEPRLRKCNGKTTPDSDATQEMSLLWPNSCFLSIFSCQIAKVELLEEV

SEQ ID NO: 916174 - protein, 822 aa, Homo sapiens
WWRMPVVLPTQKAEEGVIFPHPNPMRHLQCLETFLGCHNWERATGIWSKKDTEIQGSLYQPSSKPKSDTSISDFLSEEDDIVPSKKISQSTALARSSKVLESSDHKLKKRSAGKRNRNLVEQQMLSETPEDAQTMTLSVDRLALLGRTHSVRIIIETMGVPPDSPQMTPGKKSYAGPPPKVTTAKKRTFFVEYHFPVGFSESGLGKTALITEVVRLASSKITDGKVKFQQRFVFPVQFGGPMIEHWWNSNLTFQIYVKKTPQKKPEVIGSVSLSLRAVIQSELLSFSDQLPVQQENGQSPFGPLKVTMELITDNKDFTGINTKLSGNTHYTPLCAPTSPNKALPELNQDMTCTKNPQNLNQIHEETAKKAQNLVLPNRKSPSPVAPHPSTFVATPASHNLVNQTNGTTKESALLLHVLLMVPDGKDFISGESEKQSPCNVYLNCKLFSTEEVTRSVIAWGTTQPVFNFSQVIPVSLSSKYLERLKNNVMVIETWNKVRSPGQDKLLGLVKLPLHQFYMSFKDAKISRLLLDAQYPVVAVDSYMPVIDVFSGHQNGSLRVFLAMGSSNQIMALQRLKNEEGTLPPFSPRPAHFLDQPTAASVAMAEDRGNGLMEHCFEIHIEMVKGLAPLQATVWGEADCYVQYYFPVQHSQSSVLKGPEFLENDPIFNSEHHHSLLLPAEVPVQRLLLSAFSAQGLVPGGGVQFEIWCRYYYPNVRDQKVAKGTLPLSRICAMVTTQHREDVGIQTFNLPLTPRIENRKELRNQSSGLLDVGLRYRRSPRTAEGVLAARTVSISVQIIRACGLQAAAKHNIYFMVYYCMDAH

SEQ ID NO: 916175 - protein, 163 aa, Homo sapiens
MSNHYNPSGIHKCQSICPKKQPGTKVIVDFHIHSLTTWCNRPLRRRRPTDGCCPAAVSQHTGSFRFSWTEAQPGRREDSEGLSAEDRPLRPRRLHPGRKGHWGVGARSTCSPLRPHTRSLMLKLVQPPVQCPRKMKYPHDRHEAEFKFPLLSHLPEEEEKWYR

SEQ ID NO: 916176 - protein, 339 aa, Homo sapiens
ATMNSWNAGLAGLLVGTIGVSLLSNALVLLCLLHSADIRRQAPALFTLNLTCGNLLCTVVNMPLTLAGVVAQRQPAGDRLCRLAAFLDTFLAANSMLSMAALSIDRWVAVVFPLSYRAKMRLRDAALMVAYTWLHALTFPAAALALSWLGFHQLYASCTLCSRRPDERLRFAVFTGAFHALSFLLSFVVLCCTYLKVLKVARFHCKRIDVITMQTLVLLVDLHPSVRERCLEEQKRRRQRATKKISTFIGTFLVCFAPYVITRLVELFSTVPIGSHWGVLSKCLAYSKAASDPFVYSLLRHQYRKSCKEILNRLLHRRSIHSSGLTGDSHSQNILPVSE

SEQ ID NO: 916177 - protein, 854 aa, Homo sapiens
MWRAKLRRGTCEPAVKGSPSACYSPSSPVQVLEDSTYFSPDFQLYSGRHETSALTVEATSSIREKVVEDPLCNFHSPNFLRISEVEMRGSEDAAAGTVLQRLIQEQLRYGTPTENMNLLAIQHQATGSAGPAHPTNNFSSTENLTQEDPQMVYQSARQEPQGQEHQVDNTVMEKQVRSSSLQQNNEELPTYEEAKAQSQFFRGQQQQQQQQGAVGHGYYMAGGTSQKSRTEGRPTVNRANSGQAHKDEALKELKQGHVRSLSERIMQLSLERNGAKQHLPGSGNGKGFKVGGGPSPAQPAGKVLDPRGPPPEYPFKTKQMMSPVSKTQEHGLFYGDQHPGMLHEMVKPYPAPQPVRTDVAVLRYQPPPEYGVTSRPCQLPFPSTMQQHSPMSSQTSSASGPLHSVSLPLPLPMALGAPQPPPAASPSQQLGPDAFAIVERAQQMVEILTEENRVLHQELQGYYDNADKLHKFEKELQRISEAYESLVKSTTKRESLDKAMRNKLEGEIRRLHDFNRDLRDRLETANRQLSSREYEGHEDKAAEGHYASQNKEFLKEKEKLEMELAAVRTASEDHRRHIEILDQALSNAQARVIKLEEELREKQAYVEKVEKLQQALTQLQSACEKREQMERRLRTWLERELDALRTQQKHGNGQPANMPEYNAPALLELVREKEERILALEADMTKWEQKYLEESTIRHFAMNAAATAAAERDTTIINHSRNGSYGESSLEAHIWQEEEEVVQANRRCQDMEYTIKNLHAKIIEKDAMIKVLQQRSRKDAGKTDSSSLRPARSVPSIAAATGTHSRQTSLTSSQLAEEKKEEKTWKGSIEWDNGESTLEEVLSRIRIAAGEGAP

SEQ ID NO: 916178 - protein, 854 aa, Homo sapiens; identical to SEQ ID NO: 916177

SEQ ID NO: 916179 - protein, 96 aa, Homo sapiens
LGKEHHEHASAPLLPPPPTSALSSIASTTAASSAHAKTGSKDSSTQTDKSAELFWPSMASLPSRGRLSTTPAHSPVLKHPAAKGTAEKLGMWATPP

SEQ ID NO: 916180 - protein, 956 aa, Homo sapiens
MWRAKLRRGTCEPAVKGSPSACYSPSSPVQVLEDSTYFSPDFQLYSGRHETSALTVEATSSIREKVVEDPLCNFHSPNFLRISEVEMRGSEDAAAGTVLQRLIQEQLRYGTPTENMNLLAIQHQATGSAGPAHPTNNFSSTENLTQEDPQMVYQSARQEPQGQEHQVDNTVMEKQVRSSSLQQNNEELPTYEEAKAQSQFFRGQQQQQQQQGAVGHGYYMAGGTSQKSRTEGRPTVNRANSGQAHKDEALKELKQGHVRSLSERIMQLSLERNGAKQHLPGSGNGKGFKVGGGPSPAQPAGKVLDPRGPPPEYPFKTKQMMSPVSKTQEHGLFYGDQHPGMLHEMVKPYPAPQPVRTDVAVLRYQPPPEYGVTSRPCQLPFPSTMQQHSPMSSQTSSASGPLHSVSLPLPLPMALGAPQPPPAASPSQQLGPDAFAIVERAQQMVEILTEENRVLHQELQGYYDNADKLHKFEKELQRISEAYESLVKSTTKRESLDKAMRNKLEGEIRRLHDFNRDLRDRLETANRQLSSREYEGHEDKAAEGHYASQNKEFLKEKEKLEMELAAVRTASEDHRRHIEILDQALSNAQARVIKLEEELREKQAYVEKVEKLQQALTQLQSACEKREQMERRLRTWLERELDALRTQQKHGNGQPANMPEYNAPALLELVREKEERILALEADMTKWEQKYLEESTIRHFAMNAAATAAAERDTTIINHSRNGSYGESSLEAHIWQEEEEVVQANRRCQDMEYTIKNLHAKIIEKDAMIKVLQQRSRKDAGKTDSSSLRPARSVPSIAAATGTHSRQTSLTSSQLAEEKKEEKTWKGSIGLLLGKEHHEHASAPLLPPPPTSALSSIASTTAASSAHAKTGSKDSSTQTDKSAELFWPSMASLPSRGRLSTTPAHSPVLKHPAAKGTAEKLENSPGHGKSPDHRGRVSSLLHKPEFPDGEMMEVLI

SEQ ID NO: 916181 - protein, 368 aa, Homo sapiens
MWRAKLRRGTCEPAVKGSPSACYSPSSPVQVLEDSTYFSPDFQLYSGRHETSALTVEATSSIREKVVEDPLCNFHSPNFLRISEVEMRGSEDAAAGTVLQRLIQEQLRYGTPTENMNLLAIQHQATGSAGPAHPTNNFSSTENLTQEDPQMVYQSARQEPQGQEHQVDNTVMEKQVRSSSLQQNNEELPTYEEAKAQSQFFRGQQQQQQQQGAVGHGYYMAGGTSQKSRTEGRPTVNRANSGQAHKDEALKELKQGHVRSLSERIMQLSLERNGAKQHLPGSGNGKGFKVGGGPSPAQPAGKVLDPRGPPPEYPFKTKQMMSPVSKTQEHGLFYGDQHPGMLHEMVKPYPAPQPVRTDVAVLRYHATP

SEQ ID NO: 916182 - protein, 139 aa, Homo sapiens
MGQNWKRQQKLWNVPQLPFIRVPPSIYDTSLLKALNQGQQRYFYSIMRIYNSRPQWEALQTRYIHSLQHQQLLGYITQREALSYALVLRDSTKRASAKVAPQRTIPRKTSAMTRRCPSVLPVSVVLPRAQSKRRQVLRN

SEQ ID NO: 916183 - protein, 169 aa, Homo sapiens
MAHRPQITDAARRPQITDVARRLQITDTARRPQITDAAHRPQITDAACRPQITNTAYRPQITDAARRPQITDVARRPQITDMARRPQITDAARRPQITDTARRPQITDAACRPQITDAARRPQITDTAWTGELWRRHLESWTLLDVFSLVGPVVYPSVETNHTQERRRC

SEQ ID NO: 916184 - protein, 1101 aa, Homo sapiens
VACSFCPEFSHHVEFTCNLVTQHCSGEACFLAELLEFAEVIFAVYHENTKSASDIISIESCKEYLLGVVKVPTKELLIKRSGITGWYPIILPEDGGLPHGLELMQKIVGGLELSISFTHRGDRERVLEAAEHLGWSFENSLKDFVRMDEGEPATVTISTPRLWLPIHCVLLAGHNHIHKNTYCYLRYKFYDHEAFWTPLKKPKESVNKKQIMVTFKASKRAEVTRGPSLLWYFREERLEIQVWRAYGNDSVERPHQTDSWIGSAYVDLARLGERSARTLTVSGVYPLFGRNASNLSGAALRVHVVLSSLSSHLEPTHELDSMDCSSHSESEQLPRRNDEVQLSPPEVISCHQKSPASTQVPCSSTTAEVRLTQEGPADLDGTFAVSILVERAMHLSLKGSPLTERKVSIPSCCVSFATADESSPVYTQVVENTDSPIWNFQQQSRLSKELLLDPQQTLVFKVWHKGDEERVIGFASVDLSPLLSGFQFVCGWYNITDFSGECQGQIKVAVSPLESLIHFKEERQARRGVETSKSLIPIYSPFSFPASDTYAAFSSHMARQTLDQLAHASSKELDFSSPGRSDTTRSQASRHEEHVQNIRRFHESLHLQGEAPLPCDDKLTTSPLSSQTSILTSLRKNLSELDQIQRYFRQKLTKPFLPLSPQTQTAISQHQESCRDHLGPGASSLDPGSQCILEKSSNLVLQVSSLITDLQTITRDSQAALSSHRARSRSNKATTLPDAQDTEALQERCTMPDEPLVRAPDKGTDSPSPPPLEETSNGGRMLHESLRHAVPITRMQSSEDTEAGPAYSDEDYEEDIIEPRTLNEITTVTDKTSPWSSVISDTSEVISPQPDEVQREGPSCPSPGPFCREELMVKSSFLSSPERAVNPHLPRQGSPSQSLVACECEASKARVGGESASANPQPIPCPTLSGAQQSSTFVGWSSPQTDQNKEPKSEAPAENEAATSELGDSADSFKKLPLNLASQSRRENHKGPPIDSSDIRQRQVTTGSETSTKQSLLLPGPIVVPNFFLPPQQLEASLRMLSLSATLPPAATTDQDKSEATRGALSQRPCRPRPNSLPLNLPEEETLRIARIFSSQYSQKD

SEQ ID NO: 916185 - protein, 998 aa, Homo sapiens
MQKIVGGLELSISFTHRGDRERVLEAAEHLGWSFENSLKDFVRMDEGEPATVTISTPRLWLPIHCVLLAGHNHIHKNTYCYLRYKFYDHEAFWTPLKKPKESVNKKQIMVTFKASKRAEVTRGPSLLWYFREERLEIQVWRAYGNDSVERPHQTDSWIGSAYVDLARLGERSARTLTVSGVYPLFGRNASNLSGAALRVHVVLSSLSSHLEPTHELDSMDCSSHSESEQLPRRNDEVQLSPPEVISCHQKSPASTQVPCSSTTAEVRLTQEGPADLDGTFAVSILVERAMHLSLKGSPLTERKVSIPSCCVSFATADESSPVYTQVVENTDSPIWNFQQQSRLSKELLLDPQQTLVFKVWHKGDEERVIGFASVDLSPLLSGFQFVCGWYNITDFSGECQGQIKVAVSPLESLIHFKEERQARRGVETSKSLIPIYSPFSFPASDTYAAFSSHMARQTLDQLAHASSKELDFSSPGRSDTTRSQASRHEEHVQNIRRFHESLHLQGEAPLPCDDKLTTSPLSSQTSILTSLRKNLSELDQIQRYFRQKLTKPFLPLSPQTQTAISQHQESCRDHLGPGASSLDPGSQCILEKSSNLVLQVSSLITDLQTITRDSQAALSSHRARSRSNKATTLPDAQDTEALQERCTMPDEPLVRAPDKGTDSPSPPPLEETSNGGRMLHESLRHAVPITRMQSSEDTEAGPAYSDEDYEEDIIEPRTLNEITTVTDKTSPWSSVISDTSEVISPQPDEVQREGPSCPSPGPFCREELMVKSSFLSSPERAVNPHLPRQGSPSQSLVACECEASKARVGGESASANPQPIPCPTLSGAQQSSTFVGWSSPQTDQNKEPKSEAPAENEAATSELGDSADSFKKLPLNLASQSRRENHKGPPIDSSDIRQRQVTTGSETSTKQSLLLPGPIVVPNFFLPPQQLEASLRMLSLSATLPPAATTDQDKSEATRGALSQRPCRPRPNSLPLNLPEEETLRIARIFSSQYSQKD

SEQ ID NO: 916186 - protein, 553 aa, Homo sapiens
VACSFCPEFSHHVEFTCNLVTQHCSGEACFLAELLEFAEVIFAVYHENTKSASDIISIESCKEYLLGVVKVPTKELLIKRSGITGWYPIILPEDGGLPHGLELMQKIVGGLELSISFTHRGDRERVLEAAEHLGWSFENSLKDFVRMDEGEPATVTISTPRLWLPIHCVLLAGHNHIHKNTYCYLRYKFYDHEAFWTPLKKPKESVNKKQIMVTFKASKRAEVTRGPSLLWYFREERLEIQVWRAYGNDSVERPHQTDSWIGSAYVDLARLGERSARTLTVSGVYPLFGRNASNLSGAALRVHVVLSSLSSHLEPTHELDSMDCSSHSESEQLPRRNDEVQLSPPEVISCHQKSPASTQVPCSSTTAEVRLTQEGPADLDGTFAVSILVERAMHLSLKGSPLTERKVSIPSCCVSFATADESSPVYTQVVENTDSPIWNFQQQSRLSKELLLDPQQTLVFKVWHKGDEERVIGFASVDLSPLLSGFQFVCGWYNITDFSGECQGQIKVAVSPLESLIHFKEERQARRGVETSKSLQPPLPCAVLRSPASPASR

SEQ ID NO: 916187 - protein, 162 aa, Homo sapiens
LPPPSSIKGESGTFMLIPSLTFVIQEYFGWIASLKYEDFEVIYPNQPDHFLRVNIPWKTCPAFSSVTMDYILYKAVWEANICHKTNMVPAPMELIFEWRKCQQVSHGVNTSKGEAQVRKSNLDTVEETIAVIQAQDGGASSLRITNGDRFKRHLESAANRAE

SEQ ID NO: 916188 - protein, 855 aa, Homo sapiens
AAPPQGRPGRASPGCGGAPCRPRRAERGEGTRAGLPPCPNRCRRRSFSGPRVLAERPPRRPPRPGALRSRRAARAHLKRPGQALPRSSARPPRPAPAFTLERPRQPQQGRRRRIEELSRSSRERLLQSRDRMFSKFTSILQHAVEALAPSLPLQEDFVYHWKAITHYYIETSDDKAPVTDTNIPSHLEQMLDILVQEENERESGETGPCMEYLLHHKILETLYTLGKADCPPGMKQQVLVFYTKLLGRIRQPLLPHINVHRPVQNKMKSLASKGVPNVISEDTLKGQDSLSTDTGQSRQPEELSGATGMEQTELEDEPPHQMDHLSTSLDNLSVTSLPEASVVCPNQDYNLVNSLLNLTRSPDGRIAVKACEGLMLLVSLPEPAAAKCLTQSTCLCELLTDRLASLYKALPQSVDPLDIETVEAINWGLDSYSHKEDASAFPGKRALISFLSWFDYCDQLIKEAQKTAAVALAKAVHERFFIGVMEPQLMQTSEMGILTSTALLHRIVRQVTSDVLLQEMVFFILGEQREPETLAEISRHPLRHRLIEHCDHISDEISIMTLRMFEHLLQKPNEHILYNLVLRNLEERNYTEYKPLCPEDKDVVENGLIAGAVDLEEDPLFTDISPENTLPNQEWLSSSPPATPDHPKNDGKTEVHKIVNSFLCLVPDDAKSSYHVEGTGYDTYLRDAHRQFRDYCAICLRWEWPGSPKALEKCNLEAAFFEGHFLKVLFDRMGRILDQPYDVNLQVTSVLSRLSLFPHPHIHEYLLDPYVNLAPGCRSLFSVIVRVVGDLMLRIQRIQDFTPKLLLVRKRLLGLEPEGPIIDHITLLEGVIVLEEFCKELAAIAFVKYHASSTP

SEQ ID NO: 916189 - protein, 855 aa, Homo sapiens; identical to SEQ ID NO: 916188

SEQ ID NO: 916190 - protein, 836 aa, Homo sapiens
AAPPQGRPGRASPGCGGAPCRPRRAERGEGTRAGLPPCPNRCRRRSFSGPRVLAERPPRRPPRPGALRSRRAARAHLKRPGQALPRSSARPPRPAPAFTLERPRQPQQGRRRRIEELSRSSRERLLQSRDRMFSKFTSILQHAVEALAPSLPLQEDFVYHWKAITHYYIETSDDKAPVTDTNIPSHLEQMLDILVQEENERESGETGPCMEYLLHHKILETLYTLGKADCPPGMKQQVLVFYTKLLGRIRQPLLPHINVHRPVQNKMKSLASKGVPNVISEDTLKGQDSLSTDTGQSRQPEELSGATGMEQTELEDEPPHQMDHLSTSLDNLSVTSLPEASVVCPNQDYNLVNSLLNLTRSPDGRIAVKACEGLMLLVSLPEPAAAKCLTQSTCLCELLTDRLASLYKALPQSVDPLDIETVEAINWGLDSYSHKEDASAFPGKRALISFLSWFDYCDQLIKEAQKTAAVALAKAVHERFFIGVMEPQLMQTSEMGILTSTALLHRIVRQVTSDVLLQEMVFFILGEQREPETLAEISRHPLRHRLIEHCDHISDEISIMTLRMFEHLLQKPNEHILYNLVLRNLEERNYTEYKPLCPEDKDVVENGLIAGAVDLEEDPLFTDISPENTLPNQEWLSSSPPATPDHPKNDGKTEVHKIVNSFLCLVPDDAKSSYHVEGTGYDTYLRDAHRQFRDYCAICLRWEWPGSPKALEKCNLEAAFFEGHFLKVLFDRMGRILDQPYDVNLQVTSVLSRLSLFPHPHIHEYLLDPYVNLAPGCRSLFSVIVRVVGDLMLRIQRIQDFTPKLLLVRKRLLGLEPEGPISDLEPVEALTVSSIC

SEQ ID NO: 916191 - protein, 306 aa, Homo sapiens
AAPPQGRPGRASPGCGGAPCRPRRAERGEGTRAGLPPCPNRCRRRSFSGPRVLAERPPRRPPRPGALRSRRAARAHLKRPGQALPRSSARPPRPAPAFTLERPRQPQQGRRRRIEELSRSSRERLLQSRDRMFSKFTSILQHAVEALAPSLPLQEDFVYHWKAITHYYIETSDDKAPVTDTNIPSHLEQMLDILVQEENERESGETGPCMEYLLHHKILETLYTLGKADCPPGMKQQVLVFYTKLLGRIRQPLLPHINVHRPVQKLIRLCGEVLATPTENEEIQFLCIVCAKLKQDPYLVNFFLEV

SEQ ID NO: 916192 - protein, 828 aa, Homo sapiens
AAPPQGRPGRASPGCGGAPCRPRRAERGEGTRAGLPPCPNRCRRRSFSGPRVLAERPPRRPPRPGALRSRRAARAHLKRPGQALPRSSARPPRPAPAFTLERPRQPQQGRRRRIEELSRSSRERLLQSRDRMFSKFTSILQHAVEALAPSLPLQEDFVYHWKAITHYYIETSDDKAPVTDTNIPSHLEQMLDILVQEENERESGETGPCMEYLLHHKILETLYTLGKADCPPGMKQQVLVFYTKLLGRIRQPLLPHINVHRPVQNKMKSLASKGVPNVISEDTLKGQDSLSTDTGQSRQPEELSGATGMEQTELEDEPPHQMDHLSTSLDNLSVTSLPEASVVCPNQDYNLVNSLLNLTRSPDGRIAVKACEGLMLLVSLPEPAAAKCLTQSTCLCELLTDRLASLYKALPQSVDPLDIETVEAINWGLDSYSHKEDASAFPGKRALISFLSWFDYCDQLIKEAQKTAAVALAKAVHERFFIGVMEPQLMQTSEMGILTSTALLHRIVRQVTSDVLLQEMVFFILGEQREPETLAEISRHPLRHRLIEHCDHISDEISIMTLRMFEHLLQKPNEHILYNLVLRNLEERNYTEYKPLCPEDKDVVENGLIAGAVDLEEDPLFTDISPENTLPNQEWLSSSPPATPDHPKNDGKTEVHKIVNSFLCLVPDDAKSSYHVEGTGYDTYLRDAHRQFRDYCAICLRWEWPGSPKALEKCNLEAAFFEGHFLKVLFDRMGRILDQPYDVNLQVTSVLSRLSLFPHPHIHEYLLDPYVNLAPGCRSLFSVIVRVVGDLMLRIQRIQDFTPKLLLVRKRLLGLEPEGPMQTLPSWW

SEQ ID NO: 916193 - protein, 423 aa, Homo sapiens
MGPGARLAALLAVLALGTGDPERAAARGDTFSALTSVARALAPERRLLGLLRRYLRGEEARLRDLTRFYDKVLSLHEDSTTPVANPLLAFTLIKRLQSDWRNVLLKDGYEKVEQDLPAFEDLEGAARALMRLQDVYMLNVKGLARGVFQRVTGSAITDLYSPKRLFSLTGDDCFQVGKVAYDMGDYYHAIPWLEEAVSLFRGSYGEWKTEDEASLEDALDHLAFAYFRGRKCFVCPQPLSGVSSLQYVMDKREASHSISFWDALRVMQRGQQATGSSANAWGILQPKWVQTGPDNKRMARNVLKYERLLAESPNHVVAEAVIQRPNIPHLQTRDTYEGLCQTLGSQPTLYQIPSLYCSYETNSNAYLLLQPIRKEVIHLEPYIALYHDFVSDSEAQKIRELAEPWGRGTCGCMHLSKLTKWST

SEQ ID NO: 916194 - protein, 434 aa, Homo sapiens
MGPGARLAALLAVLALGTGDPERAAARGDTFSALTSVARALAPERRLLGLLRRYLRGEEARLRDLTRFYDKVLSLHEDSTTPVANPLLAFTLIKRLQSDWRNVVHSLEASENIRALKDGYEKVEQDLPAFEDLEGAARALMRLQDVYMLNVKGLARGVFQRVTGSAITDLYSPKRLFSLTGDDCFQVGKVAYDMGDYYHAIPWLEEAVSLFRGSYGEWKTEDEASLEDALDHLAFAYFRGRKCFVCPQPLSGVSSLQYVMDKREASHSISFSDALRVMQRGQQATGSSANAWGILQPKWVQTGPDNKRMARNVLKYERLLAESPNHVVAEAVIQRPNIPHLQTRDTYEGLCQTLGSQPTLYQIPSLYCSYETNSNAYLLLQPIRKEVIHLEPYIALYHDFVSDSEAQKIRELAEPWGRGTCGCMHLSKLTKWST

SEQ ID NO: 916195 - protein, 383 aa, Homo sapiens
MGPGARLAALLAVLALGTGDPERAAARGDTFSALTSVARALAPERRLLGLLRRYLRGEEARLRDLTRFYDKVLSLHEDSTTPVANPLLAFTLIKRLQSDWRNVVHSLEASENIRALKDGYEKVEQDLPAFEDLEGAARALMRLQDVYMLNVKGLARGVFQRVTGSAITDLYSPKRLFSLTGDDCFQVGKVAYDMGDYYHAIPWLEEAVSLFRGSYGEWKTEDEASLEDALDHLAFAYFREEMLRVTTEFLYSPDNKRMARNVLKYERLLAESPNHVVAEAVIQRPNIPHLQTRDTYEGLCQTLGSQPTLYQIPSLYCSYETNSNAYLLLQPIRKEVIHLEPYIALYHDFVSDSEAQKIRELAEPWGRGTCGCMHLSKLTKWST

SEQ ID NO: 916196 - protein, 154 aa, Homo sapiens
TAARLNHLTESAHALMSLIPWVKEAPCQRTLEVLRMELPRIPMGHVTRQLETSPNALKETFPNLREKSLLHFHGKQEKGKPQQQSPRRDAIHHGQDGWSPQYPTMEQGAPAGTHPCCHSSSYQQASSDISEHGLSLLTLSYAEREKVQPSERSA

SEQ ID NO: 916197 - protein, 398 aa, Homo sapiens
TGKTETTKDLAKALGLLCVVTNCGEGMDYRAVGKIFSGLAQCGAWGCFDEFNRIDASVLSVISSQIQTIRNALIHQLTTFQFEGQEISLDSRMGIFITMNPGYAGRTELPESVKALFRPVVVIVPDLQQICEIMLFSEGFLEAKVGGLGSARSCSADFTRVCFQTGDLGRTLAKKMTVLYKLAREQLSKQYHYDFGLRALKSVLVMAVTVLNVARTHARTHTHTHGHTHAHTHTDTCTRTHDVVLMRALRDMNLPKFVFEDVPLFLGLISDLFPGLDCPRVRYPDFNDAVEQVLEENGYAVLPIQVDKVVQMFETMLTRHTTMVVGPTRGGKSVVINTLCQAQTKLGLTTKLYILNPKAVSVIELYGILDPTTRDWTDGVLSNIFREINKPTDKKERK

SEQ ID NO: 916198 - protein, 261 aa, Homo sapiens
MAQASLLACEGLAGVSLVPTAASKKMMLSQIASKQAENGERAGSPDVLRWFTLIYEFCLRAALGLISCSEMGYEFRFDLSSKGHRKDSDKSRSRKDDDSLSEASHSKKTVKKADSIREVPFSNSWKWTQSRTVSPGRGQWWPHDMPDYCPQVVVVEQNGSFQVKIPKNFVCEHCFGAFRSSYHLKRHILIHTGEKPFECDICDMRFIQKYHLERHKRVHSGEKPYQCERCHQCFSRTDRLLRHKRMCQGCQSKTSDGQFSL

SEQ ID NO: 916199 - protein, 156 aa, Homo sapiens
SHNSFLGFLWDITLLSFNMCRLIEDDFIFGSKESLMTQNRIIRALNFLVHTYWFRGGIFSAIALLNPTELTIKKKFGLGNGQMKIRGQKLKAHRSQTEKHQIVPPNIMKSAGLKALHSLLICSANKGFAVVQEALIFPQNVLSSLLGTRDAKRKSL

SEQ ID NO: 916200 - protein, 147 aa, Homo sapiens
MSLLIAVVGSLCSGAKLDLSPLCQPEIWKADHSRQLEIPSPLFFNVFAVEVSAPEKGFSTERIKNWIILDLKVEWSSGKSCGGERAKSSQCLVFEGTCGCHVDSTRGYVSAAGRELLAADSCTARYLDAKTRTKDPFPLGELSASRT

SEQ ID NO: 916201 - protein, 172 aa, Homo sapiens
MEIQRQQRDCTVALDCKAFTKSRRNNIQYAVFTLGALHWKMQQILFLIFEKDKRAACLESLFPLSINKRPLYLQGFHMMLPKKKKEKACKVFHSKCAHQIWLYRLITEDPEGKPRVLENVVSGCAAAGRRVKAKATADGVSLLLPRLVCNGVLSTHCNLHFSGSSDSPASTC

SEQ ID NO: 916202 - protein, 172 aa, Homo sapiens; identical to SEQ ID NO: 916201

SEQ ID NO: 916203 - protein, 686 aa, Homo sapiens
MNAPGPGLPGAPGDGPAPPSAPSPALALGIARRLAGPGSCAHPAATPAARPPGLLPSPNEEEAGPAPAIPTIYASLDGPLVRPPAGAALGRELLLLPGQPQTPVFPSTHDPRTVTLDFRNAGIPAPPPPLPPQPPPPPPPPPVEPTKLPFKELDNQWPSEAIPPGPRGRDEVTEEYMELAKSRGPWRRPPKKRHEDLVPPAGSPELSPPQPLFRPRSEFEEMTILYDIWNGGIDEEDIRFLCVTYERLLQQDNGMDWLNDTLWVYHPYILLAWGALHLLGCRKSLLTSLGPTTQSVAARGAHEAKKKKRDDGIREHVTGCARSEGFYTIDKKDKLRYLNSSRASTDEPPADTQDTGDDRDPEPRVGPPRTRPAPLSPAHRPLQGMSIPAQPHASTRAGSERRSEQRRLLSSFTGSCDSDLLKFNQLKFRKKKLKFCKSHIHDWGLFAMEPIAADEMVIEYVGQNIRQVIADMREKRYEDEGIGSSYMFRVDHDTIIDATKCGNFARFINHSCNPNCYAKVITVESQKKIVIYSKQHINVNEEITYDYKFPIEDVKIPCLCGSENCRGTLNWPRHQTQRMSAVALGLPSVEPLAPGPAPAPAPISGAVLYPAAIQGLAPTLPPGAPGSAPPRERASLSFSPRLSHFNKRPFQDFCLTPASASLSPSLLPSLSSLSLLSPTITLGLFL

SEQ ID NO: 916204 - protein, 143 aa, Homo sapiens
MLKIWKPKFMFFQSAPLFWEKMLKRVLMGKTPWILLPSQIFRRFSKNNSISDSLNFDEETDGEEEEGKKIRSQATYSEKERPNSTSSLHSTTDANASGSYAAAQPAGNELGEVEELEDFASVFDFAAQPLHNRLREVEGLEDF

SEQ ID NO: 916205 - protein, 128 aa, Homo sapiens
MAENEEQVYLANLPTYKHSTWTSPTKRKLRNKIGITTVLWEAKSATNNHSSKNLKMRADEGFSETCCRCSAGLEEVKTVAERKAVKLHHKIQVRKQTHTEVKQLPQRRMAKSGYLSPCHAVLREGFLH

SEQ ID NO: 916206 - protein, 128 aa, Homo sapiens; identical to SEQ ID NO: 916205

SEQ ID NO: 916207 - protein, 236 aa, Homo sapiens
VLITMTFAVIYYNSSRKQTVLMMSTCHEWRDPDHWIRAHRSSLRITSGKTLFPNKVHSVFPETHGFLRGKETSSDDGSDDGDDDGDDGEHDGDDGEDGDDDGDGDVMMVVMMVMVVMVTVVMMMVMVIDDGDGGDDGDDGDGGDDDGDGDDGNNDGGSDGDDDQIKDWLKNRKEVKAALHKTRPPVQCQFTIAMGTPIRHAYQCYVSLPLPWQHPEVTAPFARQRPRSSHPFSRNF

SEQ ID NO: 916208 - protein, 426 aa, Homo sapiens
MVLSVPVIALGATLGTATSILALCGVTCLCRHMHPKKGLLPRDQDPDLEKAKPSLLGSAQQFNVKKSTEPVQPRALLKFPDIYGPRPAVTAPEVINYADYSLRSTEEPTAPASPQPPNDSRLKRQVTEELFILPQNGVVEDVCVMETWNPEKAASWNQAPKLHYCLDYDCQKAELFVTRLEAVTSNHDGGCDCYVQGSVANRTGSVEAQTALKKRQLHTTWEEGLVLPLAEEELPTATLTLTLRTCDRFSRHSVAGELRLGLDGTSVPLGAAQWGELKTSAKEPSAGAGEVLLSISYLPAANRLLVVLIKAKNLHSNQSKELLGKDVSVKVTLKHQARKLKKKQTKRAKHKINPVWNEMIMFELPDDLLQASSVELEVLGQDDSGQSCALGHCSLGLHTSGSERSHWEEMLKNPRRQIAMWHQLHL

SEQ ID NO: 916209 - protein, 426 aa, Homo sapiens; identical to SEQ ID NO: 916208

SEQ ID NO: 916210 - protein, 426 aa, Homo sapiens; identical to SEQ ID NO: 916208

SEQ ID NO: 916211 - protein, 391 aa, Homo sapiens
MGAAIGWMGRWMEEFNVKKSTEPVQPRALLKFPDIYGPRPAVTAPEVINYADYSLRSTEEPTAPASPQPPNDSRLKRQVTEELFILPQNGVVEDVCVMETWNPEKAASWNQAPKLHYCLDYDCQKAELFVTRLEESPTPVLFSLPAAVTSNHDGGCDCYVQGSVANRTGSVEAQTALKKRQLHTTWEEGLVLPLAEEELPTATLTLTLRTCDRFSRHSVAGELRLGLDGTSVPLGAAQWGELKTSAKEPSAGAGEVLLSISYLPAANRLLVVLIKAKNLHSNQSKELLGKDVSVKVTLKHQARKLKKKQTKRAKHKINPVWNEMIMFELPDDLLQASSVELEVLGQDDSGQSCALGHCSLGLHTSGSERSHWEEMLKNPRRQIAMWHQLHL

SEQ ID NO: 916212 - protein, 426 aa, Homo sapiens; identical to SEQ ID NO: 916208

SEQ ID NO: 916213 - protein, 426 aa, Homo sapiens; identical to SEQ ID NO: 916208

SEQ ID NO: 916214 - protein, 424 aa, Homo sapiens
CGYYLFGCDHHLLRCGYHLPGFTTSLVMVITPPFAVITSLGVVITSLVVIITCLVLVITALGVVITSLGVVVTSLVMVITPLVAVITPLGVVITSLVVVITSLVMVITSLTVVITSSIVVITPLVMVITSLTVIITSLFVVITPLVMVITFLIVVNTSLVVVLITLIVSLVVVITFLVVAITSLVVVITSLVVVITSLVVVIPPSLWLSLPWVWSSFPWLWFSPPWLWFLPLLFVVTTSLVVVLTSLIVSITSLFVVIIPLVVVITSLIVVITSLVVVLIAVIVVTPSLIVVISSLVVVIASLVVVFISLIVVISSLIVVITSLVVVITSLVVVITSLIVVITSLVVVITSLVVVITSLIVVIIPLVVVITSFVVRESWLQGLLFPRMLQQKPIINGEATCKGHVASTAITMKTDTARTAGGHI

SEQ ID NO: 916215 - protein, 424 aa, Homo sapiens; identical to SEQ ID NO: 916214

SEQ ID NO: 916216 - protein, 145 aa, Homo sapiens
SQKPDSDMDNKVQAEVVSDGDEELVGNWSKSDSVIVLEAAVSLGGEDLTPFYGLLSGGREGKFYRELEDYFYYSQLRSQGIDTMETRKVSEHICLSELPFVMRAIGFYPSEEKVLMGHLWKLGACLDCGARRVQPSLMTVLQKHP

SEQ ID NO: 916217 - protein, 192 aa, Homo sapiens
MPWAKPTISGLSLWAVIAMELGTIVALLSFLNAKPTISGLSPWAVIAMELGTIVALLSFLNAKPTISGLSPWAVIAMELGTTSPRNSGKGARVVNTDAVNTSCVPSRVLVTEGHIEGLCRRAVNDLEHHFSKVARCSMKSTGLRAQSSEFQVWFIHTSTHVGYDSTKEGVKTQFRRDKVKETSKMRNDCTGP

SEQ ID NO: 916218 - protein, 192 aa, Homo sapiens; identical to SEQ ID NO: 916217

SEQ ID NO: 916219 - protein, 192 aa, Homo sapiens; identical to SEQ ID NO: 916217

SEQ ID NO: 916220 - protein, 192 aa, Homo sapiens; identical to SEQ ID NO: 916217

SEQ ID NO: 916221 - protein, 192 aa, Homo sapiens; identical to SEQ ID NO: 916217

SEQ ID NO: 916222 - protein, 826 aa, Homo sapiens
PRAAACHLLELLEMQVLRSPLDQKLGVEPSVQQALLVILMRTITLKRKELRLRDGAYITTPQCILWSSTRLSGWRTAEHGDCLEALKKKVLEREGDKGTPVLRGFSSVSGSWSRRMPPFLLLTCLFITGTSVSPVALDPCSAYISLNEPWRNTDHQLDESQGPPLCDNHVNGEWYHFTGMAGDAMPTFCIPENHCGTHAPVWLNGSHPLEGDGIVQRQACASFNGNCCLWNTTVEVKACPGGYYVYRLTKPSVCFHVYCGHFYDICDEDCHGSCSDTSECTCAPGTVLGPDRQTCFGKKLIKDENECEQNNGGCSEICVNLKNSYRCECGVGRVLRSDGKTCEAMLLVQGAHLDWPGNRGSSITTGRQLCFPNFPAAEKHLGLLRLAPPRPSPGALASEELRWGLRVCVFNKLFPFLLVSTADVEGCHNNNGGCSHSCLGSEKGYQCECPRGLVLSEDNHTCQVPVLCKSNAIEVNIPRELVGGLELFLTNTSCRGVSNGTHVNILFSLKTCGTVVDESSQGTNTGAVKTSGTWIQVEVCVWFTQQRGKERAFQIGNNFLIIFIIIIIIFIIIFIFFIVIIIIIIIFLSSKFVEDQRVVVNDKIVASNLVTGLPKQTPGSSGDFIIRTSKLLIPVTCEFPRLYTISEGYVPNLRNSPLEIMSRNHGIFPFTLEIFKDNEFEEPYREALPTLKLRDSLYFGIEPVVHVSGLESLVESCFATPTSKIDEVLKYYLIRDGCVSDDSVKQYTSRDHLAKHFQVPVFKFVGKDHKEVFLHCRVLVCGVLDERSRCAQGCHRRMRRGAGGEDSAGLQGQTLTGGPIRIDWED

SEQ ID NO: 916223 - protein, 147 aa, Homo sapiens
HFLFSEARPVLRMLQGPSLIPDTRPTWTVPPNNVSSLLSSVQSYSYSPFSIHTKPYPGHHQSFYTTNVSSNNLTISPLTTRSSFSLISPTLGSHTATNPARSSPEKHRPFSLHTTPKNLRHPNTSTLFCFIFLINSIRCGMGLNQAN

SEQ ID NO: 916224 - protein, 173 aa, Homo sapiens
MFSLIIYFYDMIFFFIPSLFPLVSERQDYVYSVFSESKQPSCEAGWPKSSSLWHTKDHTWLCIYLKDNENAAYNTGISINHGLLHNVTNTAKMMCFNWMLLAQDTCDWKIGVGGKKIELVYAHRTNVPPLAAKLLLFTIFSTLREITVLTKLEVVSIVILSMQTEVEDRSSSS

SEQ ID NO: 916225 - protein, 142 aa, Homo sapiens
MAAAAGRSLLLLLSSRGGGGGGAGGCGALTAGCFPGLGVSRHRQQQHHRTVSERARRLRGGRGGAGVWEPPAGRPPGQQASYLNSRPLRRLPGTEEPPTGDTRAGKARDLNLSPTRPQSRSLPSSFLTALPQGSLNGARWKL

SEQ ID NO: 916226 - protein, 174 aa, Homo sapiens
MLCLWRPNSATHSGKQSQAPDASFLGLPRVQRKFTNSLVAEAKNKFSGSHRLLCCFLRNRDGTWCRRKRQRLGRRRKSAERRKTHRKERRVAKRKSQGDGSRRRKESQLLSEIRWEVYPVNSTFRVLVSGATRTETLLQRPTTDDNHQAQELKRNGANVAEGLGFYIYCRVWFS

SEQ ID NO: 916227 - protein, 171 aa, Homo sapiens
MVFKIRSMVNPGRCHQQCSVSMMAKSWYLMKPQEDHLSEQTRNKDRAFLLRRSNIQITLPCAVGYPAEVSGSRLVLGSVCKEPCDVTCYQLPHSLHPERLVSLLLCSCNSTKYISRQLVSRAENLPQTTSLPAEKAQLLSCPTEPAVAIHLLQKFCEFSQLSWNTSYRMGQ

SEQ ID NO: 916228 - protein, 189 aa, Homo sapiens
MQSRLLLLGAPGGHGGPASRRMRLLLRQVVQRRPGGDRQRPEVRLLHAGSGADTGDTVNIGDVSYKLKIPKNPELVPQNYNLPLGPAGNLSVNSGAYSYPPNPHYTAWCPGYTAEIGVCRKGILEYRIKLFGIILTSVYYYVDSWKELTKREVEYIALSRDTTETDLKQRREIRAGTAFYIDQASSVTL

SEQ ID NO: 916229 - protein, 91 aa, Homo sapiens
MQSRLLLLGAPGGHGGPASRRMRLLLRQVVQRRPGGDRQRPEVRLLHAGSGADTGDTVNIGDVSYKLKIPKNPELVPQNYISDSLAQSVVQ

SEQ ID NO: 916230 - protein, 156 aa, Homo sapiens
MQQHHGWKGPEGKSQGSSSFLNSSFAFFLSLALISSKETQKRSLITSHMVMLPKSLLVAQSGIKVPQGGQHCSETRNNLPGSMCRSSALAGGLSKSFRESTAVLCLGVCDTGQREWLNMQQQRRLQPWSQGQGTAVLILTNATDKQCDLGQVTLPL

SEQ ID NO: 916231 - protein, 168 aa, Homo sapiens
MLKKCHLQREVTMQQHHGWKGPEGKSQGSSSFLNSSFAFFLSLALISSKETQKRSLITSHMVMLPKSLLVAQSGIKVPQGGQHCSETRNNLPGSMCRSSALAGGLSKSFRESTAVLCLGVCDTGQREWLNMQQQRRLQPWSQGQGTAVLILTNATDKQCDLGQVTLPL

SEQ ID NO: 916232 - protein, 142 aa, Homo sapiens
MKTSTMPDVPALLQACQGARGSGAEPGHLSLGSAVNCCANEQVIHLLNKYWLGRGHHVKCQGSRDDNNRVPTLRGSYPTRGDREVNKQDKYRLTSAKREVRGCGNREEEYLTSLEYLEDFLKEEKTPGLNLKGRPEATQGKK

SEQ ID NO: 916233 - protein, 142 aa, Homo sapiens; identical to SEQ ID NO: 916232

SEQ ID NO: 916234 - protein, 134 aa, Homo sapiens
MVCSLGSERLHVLVTWPLTSPRGSDPQREQEGDYPDFHDLVTEVTHHCFCHALFLRSESLSLAHTQGGGISFHLLKGGTSNNALYFKATRDLFRKWGSTLACGASELVKGSASTPEAGGTCGNSARSHDVHIST

SEQ ID NO: 916235 - protein, 173 aa, Homo sapiens
MLGISLLAISTEGRTLILEGLEKAERNVLPVLNNLLENREMQLEDGRFLMSAEPLTDPCVYGVRVKRVLFQEDGVVLVKQHHVFGELQLGDGLEHRDHTKKELDSWKIVRVSENFRVIALGLPVPRYSGNPLDPPLRSRFQARDIYYLPFKKDLQQLLLEEKARRHKRECKQI

SEQ ID NO: 916236 - protein, 604 aa, Homo sapiens
FPQNSRHPQNTQSKSNNLCKCNLQTSPPTLPGRDRFWRRRGTAKGAATDPERPCEPAMSRSGTPHAGRGGAHAHARPRLPGVGRGGRRGGAVTSVARVALAAQEQLVPPRAVGERAGVGRWGAGRAALREQAAGTAALHHRIMSGQLERCEREWHELEGEFQELQVGPGPPGPATLLPAVQRLALPEPPGPGGGDSQGLGSAPERPWGRTGGMDQPPPITRRFSSSSTWGAGSQPPLPPPSHWLSAPRTPFAAESWSVASEASSRRVHLWGWFKENSPAPTSAGSPQISPRPLPSAFGSSAPTPCSGGAALSCSSVLGGVLKSCSPGTSRLCLGIRDPYFLSLGALTLLQADFGVESICQFGQLSSLTQLIGETPSSILLARSLTRGGVRAGVRRGSPERMALLLVTGLFFGGLALPEITLHTITPVLSFGAVTLSLSMYLFDARALKAMVKILAFTANDMYIRLAAVYRIDIRETGSKQEDQHYFINNPMKLILESLFYRVTVALIGQVTVTYLLLKPKSGISATTLHETSWGGMVPGRKIKKLGYGIQFFGPKEYYEGDWCGSQRSDVGRMYYSNGDIYEGQWENDKPNGEGMLRLSQNPRP

SEQ ID NO: 916237 - protein, 122 aa, Homo sapiens
MIDFGRDEAPEPTQFPIPEVKILDPDGVLAEPWPCSGRQRKEIDAREHKRFRRNSSLCHPIAQTSAALAGGVSSSSRHDPGTLIGPLTTPSTGSFLANRKAGASLPGCPRDPLHSLISSWNA

SEQ ID NO: 916238 - protein, 189 aa, Homo sapiens
MVFRIDLKRERLALYLCALPSRTCTCSHMHIGPQYLANCQATVWHLNYNVLRELYLPLHVLVALPQLSYHLGENNVWLVVPWHQHCAIVGQAFNGLWVMRLGGAGVGDAHTVTLPWILPSVNIDLPLFPLGTWLGRYRIDAVTAEKEKNIQSIHVVPAECQYCMLWGFHSCPYGRGVNFSKTSSSRGRS

SEQ ID NO: 916239 - protein, 141 aa, Homo sapiens
MSRSLSFPNERDTQHQLSISQDFRGETVDFHKSRKTAGSVKKKLLQQLESRRTNRYTDYIFIVHQSHSTHYHSSSPSHEFCPFIQQPSSSVLSCSLGQEWANVEAICLLPPSLSQDSASLKYTPAICSTGSHLREETRTSH

SEQ ID NO: 916240 - protein, 75 aa, Homo sapiens
HGLILSILKSRKGVLNSFFNLECCVSGTHSMDLVALAPFGEYTVLPGLDCTFSKCVPEPLPRQSSHQAPQGTGAG

SEQ ID NO: 916241 - protein, 536 aa, Homo sapiens
AAARDLELAPDLPATQKPSDCPDRAMESTGSVGEAPGGPRVLVVGGGIAGLGAAQRLCGHSAFPHLRVLEATARAGGRIRSERCFGGVVEVGAHWIHGPSRGNPVFQLAAEYGLLGEKELSQENQLVETGGHVGLPSVSYASSGASVSLQLVAEMATLFYGLIDQTREFLHAAETPVPSVGEYLKKEIGQHVAGWTEDEETRKLKLAVLNSFFNLECCVSGTHSMDLVALAPFGEYTVLPGLDCTFSKGYQGLTNCMMAALPEDTVVFEKPVKTIHWNGSFQEAAFPGETFPVSVECEDGDRFPAHHVIVTVPLGFLREHLDTFFDPPLPAEKAEAIRKIGFGTNNKIFLEFEEPFWEPDCQLIQLVWEDTSPLEDAAPELQDAWFRKLIGFVVLPAFASVHVLCGFIAGLESEFMETLSDEEVLLCLTQVLRRVTGNPRLPAPKSVLRSRWHSAPYTRGSYSYVAVGSTGGDLDLLAQPLPADGAGAQLQILFAGEATHRTFYSTTHGALLSGWREADRLLSLWAPQVQQPRPRL

SEQ ID NO: 916242 - protein, 351 aa, Homo sapiens
SLRLRPPPRAPDLPATQKPSDCPDRAMESTGSVGEAPGGPRVLVVGGGIAGLGAAQRLCGHSAFPHLRVLEATARAGGRIRSERCFGGVVEVGAHWIHGPSRGNPVFQLAAEYGLLGEKELSQENQLVETGGHVGLPSVSYASSGASVSLQLVAEMATLFYGLIDQTREFLHAAETPVPSVGEYLKKEIGQHVAGWTEDEETRKLKLAVLNSFFNLECCVSGTHSMDLVALAPFGEYTVLPGLDCTFSKGYQGLTNCMMAALPEDTVVFEKPVKTIHWNGSFQEAAFPGETFPVSVECEDGDRFPAHHVIVTVPLGLSTFSVGSLPDLSLSSWRLCRMKKYFCVSPKCSGE

SEQ ID NO: 916243 - protein, 239 aa, Homo sapiens
SLRLRPPPRAPDLPATQKPSDCPDRAMESTGSVGEAPGGPRVLVVGGGIAGLGAAQRLCGHSAFPHLRVLEATARAGGRIRSERCFGGVVEVGAHWIHGPSRGNPVFQLAAEYGLLGEKELSQENQLVETGGHVGLPSVSYASSGASVSLQLVAEMATLFYGLIDQTREFLHAAETPVPSVGEYLKKEIGQHVAGWTEDEETRKLKLAVLNSFFNLECCGLSRTHKLHDGRPAGGHCSF

SEQ ID NO: 916244 - protein, 537 aa, Homo sapiens
SLRLRPPPRAPDLPATQKPSDCPDRAMESTGSVGEAPGGPRVLVVGGGIAGLGAAQRLCGHSAFPHLRVLEATARAGGRIRSERCFGGVVEVGAHWIHGPSRGNPVFQLAAEYGLLGEKELSQENQLVETGGHVGLPSVSYASSGASVSLQLVAEMATLFYGLIDQTREFLHAAETPVPSVGEYLKKEIGQHVAGWTEDEETRKLKLAVLNSFFNLECCVSGTHSMDLVALAPFGEYTVLPGLDCTFSKGYQGLTNCMMAALPEDTVVFEKPVKTIHWNGSFQEAAFPGETFPVSVECEDGDRFPAHHVIVTVPLGFLREHLDTFFDPPLPAEKAEAIRKIGFGTNNKIFLEFEEPFWEPDCQLIQLVWEDTSPLEDAAPELQDAWFRKLIGFVVLPAFASVHVLCGFIAGLESEFMETLSDEEVLLCLTQVLRRVTGNPRLPAPKSVLRSRWHSAPYTRGSYSYVAVGSTGGDLDLLAQPLPADGAGAQLQILFAGEATHRTFYSTTHGALLSGWREADRLLSLWAPQVQQPRPRL

SEQ ID NO: 916245 - protein, 537 aa, Homo sapiens; identical to SEQ ID NO: 916244

SEQ ID NO: 916246 - protein, 537 aa, Homo sapiens; identical to SEQ ID NO: 916244

SEQ ID NO: 916247 - protein, 512 aa, Homo sapiens
SLRLRPPPRAPDLPATQKPSDCPDRAMESTGSVGEAPGGPRVLVVGGGIAGLGAAQRLCGHSAFPHLRVLEATARAGGRIRSERCFGGVVEVGAHWIHGPSRGNPVFQLAAEYGLLGEKELSQENQLVETGGHVGLPSVSYASSGASVSLQLVAEMATLFYGLIDQTREFLHAAETPVPSVGEYLKKEIGQHVAGWTEDEETRKLKLAVLNSFFNLECCVSGTHSMDLVALAPFGEYTVLPGLDCTFSKGYQGLTNCMMAALPEDTVVFEKPVKTIHWNGSFQEAAFPGETFPVSVECEDGDRFPAHHVIVTVPLGFLREHLDTFFDPPLPAEKAEAIRKIGFGTNNKIFLEFEEPFWEPDCQLIQLVWEDTSPLEDAAPELQDAWFRKLIGFVVLPAFASVHVLCGFIAGLESEFMETLSDEEVLLCLTQVLRRVTAPDPVCGGSHTSHVLLHDARGSAVGMEGGRPPPQSVGPAGAAAQAEALAGPSLLCSTRVGGRLGPSFLLTDFSLA

SEQ ID NO: 916248 - protein, 314 aa, Homo sapiens
MRGFNCRGGQTGPLPVAGWLPGTRCRGYQGLTNCMMAALPEDTVVFEKPVKTIHWNGSFQEAAFPGETFPVSVECEDGDRFPAHHVIVTVPLGFLREHLDTFFDPPLPAEKAEAIRKIGFGTNNKIFLEFEEPFWEPDCQLIQLVWEDTSPLEDAAPELQDAWFRKLIGFVVLPAFASVHVLCGFIAGLESEFMETLSDEEVLLCLTQVLRRVTGNPRLPAPKSVLRSRWHSAPYTRGSYSYVAVGSTGGDLDLLAQPLPADGAGAQLQILFAGEATHRTFYSTTHGALLSGWREADRLLSLWAPQVQQPRPRL

SEQ ID NO: 916249 - protein, 304 aa, Homo sapiens
MIKVWNYENKQYLFSRVFEKGLGVQSLTYNPEGALLGAGFTEGTVYILDAMSLENESPEPFKYSRTSVTHISFSHDSQYMATADRSFTVAVYMLVVRNGQRVWEYLARLRSHRKSIRSLLFGVYLDSNEPRLLSLGTDRLLIEYDLLRSYKDHLEVLDIHHTDQGCYPTCMVWYPPLTRELFLLICNSGYKVKLFNATTKMCRKTLLGPAYGSPIEQTQVLPVRSMAELQKRYLVFINRDKLGLQILPVDGNPHKTSAIVCHPNGVAGMAVSYDGCYAFTAGGHDRSVVQWKITLRVTPSLGWS

SEQ ID NO: 916250 - protein, 486 aa, Homo sapiens
PVSRVSPAVNFNSLYTRDTLDGKLVVWDIHRPPSSASTFLGFPYIKPCKLVHLQKEGITVLTTIDSYIVTGDIKGNIKFYDHTLSIVNWYSHLKLGAIRTLSFSKTPATPPTEKSNYPPDCTLKGDLFVLRNFIIGTSDAAVYHLTTDGTKLEKLFVEPKDAICAISCHPYQPLIAIGSICGMIKVWNYENKQYLFSRVFEKGLGVQSLTYNPEGALLGAGFTEGTVYILDAMSLENESPEPFKYSRTSVTHISFSHDSQYMATADRSFTVAVYMLVVRNGQRVWEYLARLRSHRKSIRSLLFGVYLDSNEPRLLSLGTDRLLIEYDLLRSYKDHLEVLDIHHTDQGCYPTCMVWYPPLTRELFLLICNSGYKVKLFNATTKMCRKTLLGPAYGSPIEQTQVLPVRSMAELQKRYLVFINRDKLGLQILPVDGNPHKTSAIVCHPNGVAGMAVSYDGCYAFTAGGHDRSVVQWKITLRVTPSLGWS

SEQ ID NO: 916251 - protein, 481 aa, Homo sapiens
SLQDLNLTQILSATMEGKLVVWDIHRPPSSASTFLGFPYIKPCKLVHLQKEGITVLTTIDSYIVTGDIKGNIKFYDHTLSIVNWYSHLKLGAIRTLSFSKTPATPPTEKSNYPPDCTLKGDLFVLRNFIIGTSDAAVYHLTTDGTKLEKLFVEPKDAICAISCHPYQPLIAIGSICGMIKVWNYENKQYLFSRVFEKGLGVQSLTYNPEGALLGAGFTEGTVYILDAMSLENESPEPFKYSRTSVTHISFSHDSQYMATADRSFTVAVYMLVVRNGQRVWEYLARLRSHRKSIRSLLFGVYLDSNEPRLLSLGTDRLLIEYDLLRSYKDHLEVLDIHHTDQGCYPTCMVWYPPLTRELFLLICNSGYKVKLFNATTKMCRKTLLGPAYGSPIEQTQVLPVRSMAELQKRYLVFINRDKLGLQILPVDGNPHKTSAIVCHPNGVAGMAVSYDGCYAFTAGGHDRSVVQWKITLRVTPSLGWS

SEQ ID NO: 916252 - protein, 145 aa, Homo sapiens; identical to SEQ ID NO: 874740

SEQ ID NO: 916253 - protein, 532 aa, Homo sapiens
MLEFWLLFHRTVAVCWGSTAVLSHFGFSSTYLKGLQAGTAESSKQQRWWPLLPTGTLSQVGVTLLPLVSWNSKPVGLILCGAMEVGSADRYCLLPWIQPPSQGSFLVGADTRQTGQCGDRGGALPVGATGLSEVAQALAAALVGGEFDLEMNFIIQDAESITCMTELLEHCDVTCQAEIWSMFTAILRKSVRNLQTSTEVGLIEQVLLKMSAVDDMIAVDMLGVLASYSITVKELKLLFSMLRGESGIWAIALPPIAKWPYQNGFTLNTWFRMDPLNNINVDKDKPYLYCFRTSKGVGYSAHFVGNCLIVTSLKSKGKGFQHCVKYDFQPRKWYMISIVHIYNRWRNSEIRCYVNGQLVSYGDMAWHVNTNDSYDKCFLGSSETADANRVFCGQLGAVYVFSEALNPAQIFAIHQLGPGYKSTFKFKSESDIHLAEHHKQVLYDGKLASSIAFTYNAKATDAQLCLESSPKENASIFVHSPHALMLQDVKAIVTHSIHSAIHSIGGIQVLFPLFAQLDNRQLNDSQVETTVW

SEQ ID NO: 916254 - protein, 724 aa, Homo sapiens
CFSASESMVSGPAIMEDDDQEVDSADESVSNDMMTATDEPSKMSSATGRRIRRFKQEWLKKFWFLRYSPTLNEMWCHVCRQYTVQSSRTSAFIIGSKQFKIHTIKLHSQSNLHKKCLQLYKLRMHPEKTEEMCRNMTLLFNTAYHLALEGRPYLDFRPLAELLRKCELKVVDQYMNEGDCQILIHHIARALREDLVERIRQSPCLSVILDGQSDDLLADTVAVYVQYTSSDGPPATEFLSLQELGFSSTESYLQALDRAFSALGIRLQDEKPTVGLGVDGANITASLRASMFMTIRKTLPWLLCLPFMVHRPHLEILDAISGKELPCLEELENNLKQLLSFYRYSPRLMCELRSTAATLCEETEFLGDIRAVRWIIGEQNVLNALIKDYLEVVAHLKEVSSQTQRADASAIALALLQFLMDYQSIKLIYFLLDVIAVLSRLAYIFQGEYLLVSQVDDKIEEAIQEISRLADSPGEYLQEFEENFRESFNGIAMKNLRVAEAKFQSIREKICQKTQVILAQRFDSRSRIFVKACQVFDLAAWPRSSEELMSYGKEDMVQIFDHLEAIPTFSRDVCREGLDPRGSLLMEWRELKADYYTKNGFKDLISHICKYKQRFPLLNKIIQVLKVLPTSTACCEKGRNALQRVRKNHRSRLTLEQLSDLLTIAVNGPPITNFDAKRALDSWFEEKSGNSYALSAEVLSRMSALEQKPALQTMDHGTEFYPDI

SEQ ID NO: 916255 - protein, 112 aa, Homo sapiens
MGVEGGGRRRRRRQRAGWGREGRRRTSAQSHEGTASQSWVKLTLPGKWRAGIPVSQPPSGRQQPGRGTHSVIPSWLEGSGLVDPASSLMEKVAPDADPYRPGPQALAGSACF

SEQ ID NO: 916256 - protein, 776 aa, Homo sapiens
MHLEPCSHLPEHGSGALALGAGAGGRCARVPSHCGFSLSIARSGLFGLPPLAPLPQVDESPVNDSHGRAPEEGDAEVMQLGSSSPPPARGVQPPETTRPEPPPPLVPPLPAGSLPPYPPYFEGAPFPHPLWLRDTYKLWVPQPPPRTIKRTRRRLSRNRDPGRLILSTIRLRPRQVLCEKCKSTLSPPEASPGPPAAPRARRRLGSGPDRELRKPEEPENGEPTAAATARRSKRERREEDRAPAEQVPRSPVIKISYSTPQGKGEVVKIPSRVHGSLEPFRPQQAPQDDGSQDPEVLDRESRDRPSCAPSASIPKLKLTRPVPAGADLPPPKIRLKPHRLGDSEHEPVYRAELVGELNGYLRDSSPAPCADGPAGGLADLSSGSSGEDDDFKSCPQGPQGREGLAFLVSCPEGRADCASESACSSDSLDEARSSGSEGTPADTGDLSPGHGASAPSVSREARQTVPPLTVRLHTQSVSECITEDGRTVAVGDIVWGKIHGFPWWPARVLDISLGQKEDGEPSWREAKVSWFGSPTTSFLSISKLSPFSEFFKLRFNRKKKGMYRKAITEAANAARHVAPEIRELLTQFESNWFPDQVTDDEGAPAVLELPISVRGPCEPSGRLRAEPTGHGGRPGVRPPGDRQCVQGGDGPEPSGSSLLSVFLPTTQRMAALAHEAVGTRDLLAAGCCCLARWGSMEELGLPPRPHLLPACWGPMEEPGLAPRPRPAAGVGSCSLPRSVLEAAVSQTQLGLPQASEKPNCTCGILPQPLGAGSLCT

SEQ ID NO: 916257 - protein, 178 aa, Homo sapiens
HLLVAPGIPWFMAASLQSLPLFSHGFLLCFCVSNLPLLILIKSSVIGFRALPKSRIMCQTSESSTEKQLLKVITDPPSDYFPGVLRCLLPCGCTEGSTGTSGSGPVWVVHLCKTSAALKENWCPYERRKRQVHKVWSCEDRGRDWCYAATNQGVPEATRSWKKQKQETLISDFWLLEL

SEQ ID NO: 916258 - protein, 126 aa, Homo sapiens
MFLYNYIGQDGIASSIVMLIICGGLVNGPYALITTAVSADLGTHKSLKGNAKALSTVTAIIDGTGSIGAALGPLLAGLISPTGWNNVFYMLISADVLACLLLCRLVYKEILAWKVSLSRGSGYKEI

SEQ ID NO: 916259 - protein, 513 aa, Homo sapiens
ADAVPSCRFRGLILLLTFLIYACYHMSRKPISIVKWLSSPGAPFEFIPQDSCVGGCGWNKRAGPLGYVDAAHGSDVAAFPCSQFLQEESRLHQNCSEQIKPINDTHSLNDTMWCSWAPFDKDNYKELLGGVDNAFLIAYAIGMFISGVFGERLPLRYYLSAGMLLSGLFTSLFGLGYFWNIHELWYFVVIQVCNGLVQTTGWPSVVTCVGNWFGKGKRGFIMGIWNSHTSVGNILGSLIAGIWVNGQWGLSFIVPGIITAVMGVITFLFLIEHPEDVDCAPPQHHGEPAENQDNPEDPGNSPCSIRESGLETVAKCSKGPCEEPAAISFFGALRIPGVVEFSLCLLFAKLVSYTFLYWLPLYIANVAHFSAKEAGDLSTLFDVGGIIDVPVQLHWQDGIASSIVMLIICGGLVNGPYALITTAVSADLGTHKSLKGNAKALSTVTAIIDGTGSIGAALGPLLAGLISPTGWNNVFYMLISADVLACLLLCRLVYKEILAWKVSLSRGSGYKEI

SEQ ID NO: 916260 - protein, 269 aa, Homo sapiens
SCVSPMQRNRCNGEPAENQDNPEDPGNSPCSIRESGLETVAKCSKGPCEEPAAISFFGALRIPGVVEFSLCLLFAKLVSYTFLYWLPLYIANVAHFSAKEAGDLSTLFDVGGIIGGIVAGLVSDYTNGRATTCCVMLILAAPMMFLYNYIGQDGIASSIVMLIICGGLVNGPYALITTAVSADLGTHKSLKGNAKALSTVTAIIDGTGSIGAALGPLLAGLISPTGWNNVFYMLISADVLACLLLCRLVYKEILAWKVSLSRGSGYKEI

SEQ ID NO: 916261 - protein, 171 aa, Homo sapiens
MEKTESFCPEVPPQDCGASPRPSLRSLPKNQGSLLQFDRQAPGRISTSPTLRRLRTRGCGTRQDAWQVTTWGSWGAPVGFPCYLSKSLPGSPKDSSHLLSPLRLHSRLTSEPERALNAADSLEPQTRPTDKYLPPELQPVNEGSLHQASLRQQEGHFLPSPTLRHPSPQAL

SEQ ID NO: 916262 - protein, 197 aa, Homo sapiens
MCPRRVCVHAGYVSTQGLCPRRLCVHAGYVSTQVLCPRRFCVHTGYVSTQVLCPRRLCVHAGSVSTQVLCPRRFCVHTGYVSTQGYVSMQVLCPRRLCVHAGYVSMQVLCPRRFCVHTGYVSTQVLCPRRFCVHAGYVSTQASGLSGGCFYDALPPTSPAGRDDCSEAVRVPGALKVPEPKEHLSGKCSAAWALSDR

SEQ ID NO: 916263 - protein, 157 aa, Homo sapiens
LFPQSLMPCLAQDFYSWLTIAVNSLVLLSSGEGGSGIGSQNCCCRCRFEILREILQLTPEKLARTCLKMGNILEAEVLSGKEFNVMSSRFIHVVAFVRIFFLLKAEEQSVVCTYRILFIHSSIDRHLSCFHIFAIAHNAAMNMGISCSCFFSKKMTS

SEQ ID NO: 916264 - protein, 161 aa, Homo sapiens
DEHPAAGHMLPPPLRACGSRLSLPCAALSPRFPREPSNRFSAREKDGSGGKSEGVEREVRAFAFSPHSSGGVRSSGWNVLAAAVTAATAREAPEPYTLQLERKGWPRRKSQGREATTEIRPGKAFSTLGTLSGGGGKRQEVADPTARLPHSSLALPSGDDK

SEQ ID NO: 916265 - protein, 193 aa, Homo sapiens
MDLGLLWLWTRLFRLGTYLTHTGAPWDMRGGPAISIPFPNRALSFQRASLGGGRAEEAVSLLQWLCSHVSTVAIVDSRTLLLLQLLRPPGRPHLSLRTVSPPPFSPHSQAPGTLSFGCIYHSQGEPGPLATGPSLLLFPTCSCPSLEPSNHKKMNPASNLNELGADTSQSLQKGAQPLDISTAACETLRGGRG

SEQ ID NO: 916266 - protein, 135 aa, Homo sapiens
MDEAGNHHSQQTIARTKNQTPHVLTHRSMNPVVNCAYGKSRLCAPYENLTNTWRKKSKLFPVILTSKHLGDDIFVTFIVKNKISHFILHFEKGDRRREESWTPWAQHRRWLCQFSQPRAAPAPALSLHVSSGDLA

SEQ ID NO: 916267 - protein, 135 aa, Homo sapiens; identical to SEQ ID NO: 916266

SEQ ID NO: 916268 - protein, 386 aa, Homo sapiens
EPSFLPGEPLGRPTCWSTATMGDQFIMLSCEWPGGEPPATLGWLDEQQQPLGGSSSSMAVHLLQAQEDLAGREFTCRGTHLLRTPDPHCHLQLGSKGTNRGVPEKMLRHRQALKHQPPPQVWILHKKPGFSSECHHHSDCNTIRPKEEDANRLREGRWDLGRALLSDFGHKTNVAKTPTTTSLNTQSSQLVQGPAAVSLSDMVTREALAHLVEDRGGRTRKRTHNGETGISGCGGGRQGASRGEMWTSGRRSHKQSSARGGQRAASLAAELEPRRNSTAGIDHSIRNGTGSIQRVNHNAFGKQYGKMGGAQIMAPDKLDELWGLNELTVTSTEHSAWYTVVIQHVLVLSPTLYHVLSFPGEVTLGRTVWVPVQGRANSRLGRTHTA

SEQ ID NO: 916269 - protein, 179 aa, Homo sapiens
MAASEAAVVSSPSLKTDTSPVLETAGTVAAMAATPSARAAAAVVAAAARTGSEARVSKAALATKLLSLSGVFAVHKPKGPTSAELLNRLKEKLLAEAGMPSPEWTKRKKQTLKIGHGGTLDSAARGVLVVGIGSGTKMLTSMLSGSKRYTAIGELGKATDTLDSTGRVTEEKPYGMKLI

SEQ ID NO: 916270 - protein, 349 aa, Homo sapiens
MAASEAAVVSSPSLKTDTSPVLETAGTVAAMAATPSARAAAAVVAAAARTGSEARVSKAALATKLLSLSGVFAVHKPKGPTSAELLNRLKEKLLAEAGMPSPEWTKRKKQTLKIGHGGTLDSAARGVLVVGIGSGTKMLTSMLSGSKRYTAIGELGKATDTLDSTGRVTEEKPYDKITQEDIEGILQKFTGNIMQVPPLYSALKKDGQRLSTLMKRGEVVEAKPARPVTVYSISLQKFQPPFFTLDVECGGGFYIRSLVSDIGKELSSCANVLELTRTKQGPFTLEEHALPEDKWTIDDIAQSLEHCSSLFPAELALKKSKPESNEQVLSCEYITLNEPKREDDVIKTC

SEQ ID NO: 916271 - protein, 349 aa, Homo sapiens; identical to SEQ ID NO: 916270

SEQ ID NO: 916272 - protein, 349 aa, Homo sapiens; identical to SEQ ID NO: 916270

SEQ ID NO: 916273 - protein, 84 aa, Homo sapiens
SEARVSKAALATKLLSLSGVFAVHKPKGPTSAELLNRLKEKLLAGTAARVGTRLRRSLREGKHIRLFATLVIQETKGGERETDH

SEQ ID NO: 916274 - protein, 150 aa, Homo sapiens
LCMRKRSGPGQPPPRRPAAGSRAPRGPIPPGLQPSLRGAQRLVPPASPASPGTARLARGALRAATLPGSPARLSSPSLCLASNFASRYPLRRRPLSRRSPGWSPAPRGRRGYGKFGDWREKGFGGGPRRGARGASSLPFMGCHTCVSLLP

SEQ ID NO: 916275 - protein, 143 aa, Homo sapiens
MNTIWSLLLGNSLFWSGGSQRDDWVPGALRILSAKLSWDQGLPGAIGGRPGDQGLFPGVKLTVPQPAQWGVTVIPTVESQPDWIHGSEALNLHCGTTWGATGTSPTEKPGHAPKDGPRRLSLPHIRTDTKINKISEKMTKILN

SEQ ID NO: 916276 - protein, 216 aa, Homo sapiens
AWTRVMVEERAHKSDSSYMLEVKLTGPCDRWDVVDEEGEGVRMVSCGADWLGEPFTEATINATVKEDILLSVEYSCHGVPTIEWTYSSNWGTQKIVEWKPGTQANISQSHKDRVCTFDNGSIQLFSVGVRDSGYYVITVTERLGSSQFGTIVLHVSEILYEDLHFVAVILAFLAAVAAVLISLMWVCNKCAYKFQRKRRHKLKGNPLGLVIIHEWF

SEQ ID NO: 916277 - protein, 205 aa, Homo sapiens
AALLLLFGRPRKLPWTLHLMDQLAPPRSLRVAPTQQLTQCKRTALTPYDFISDPTNQYSHPRHPTSQTILKNSDPRIFRETDLIFQWIFRELMSEVHLRAAPADASPDSPGNLIALRYEMVDEFVYANVGGKTLIGHTPRYIKTLQQMYGNASALGLGEIAAPAPGGKDSLLIKGVTVSAACTESEYLREMPTPTLPSAMSKKAP

SEQ ID NO: 916278 - protein, 155 aa, Homo sapiens
MLRSHSNKEINVCSHYCAFLSLKARNQLTLSLPAPHLPRQQGQEPWACSPIPDTSLLFQTGAVALPWGSCSGRARTQDGETGAGHPEVESAAGSPHFISIGTSKGDRRRFPVWGVGESNEWPVCTGHQGQSNLTLRDHLPFCSIAELGGKGNSRP

SEQ ID NO: 916279 - protein, 172 aa, Homo sapiens
MYRNWKKNGDCQGLVKGRNKELLLIVVEFPFYQMKKFWRLVIQQCWKGTLLGVAMATVNAMIAEYGCSLEDIVVVLGPSVGPCCFTLPRESAEAFHNLHPACVQLFDSPNPCIDIRKATRILLEQGGILPQNIQDQNQDLNLCTSCHPDKFFSHVRDGLNFGTQIGFISIKE

SEQ ID NO: 916280 - protein, 172 aa, Homo sapiens; identical to SEQ ID NO: 916279

SEQ ID NO: 916281 - protein, 172 aa, Homo sapiens; identical to SEQ ID NO: 916279

SEQ ID NO: 916282 - protein, 354 aa, Homo sapiens
QIVSGRGKMPPVSLLKHNKSHLYSSSQQKIECVRNLEVYRLSFLSFEKRPNSHPASPGNPAQPTSLHYMNPYQLNAYGMALKAVGEIVQDYDSDKMFPALGFGAKLPPDGRISHEFALILLSTVKLSDDCSPVPQKIMSVNVYYSHLFQLIFMEIYFFTVVLFCFAYKFLQNGNPQNPYCDGIEGVMEAYYRSLKSVQLYGPTNFAPVINHVARYASSVKDGSQYFVLLIVTDGVISDMAQTKESIVNASKLPMSIIIVGVGPAEFDAMVELDGDDVRVSSRGKYAERDIVQFVPFRDYIDRSGNHILSMARLAKDVLAEIPEQFLSYMRARGIKPSPAPPPYTPPPAIKCSIG

SEQ ID NO: 916283 - protein, 287 aa, Homo sapiens
KYTNSGTVTLLSFLVETEVSFLDYIKGGTQINFTVAIDFTASNGNPAQPTSLHYMNPYQLNAYGMALKAVGEIVQDYDSDKMFPALGFGAKLPPDGRISHEFALNGNPQNPYCDGIEGVMEAYYRSLKSVQLYGPTNFAPVINHVARYASSVKDGSQYFVLLIVTDGVISDMAQTKESIVNASKLPMSIIIVGVGPAEFDAMVELDGDDVRVSSRGKYAERDIVQFVPFRDYIDRSGNHILSMARLAKDVLAEIPEQFLSYMRARGIKPSPAPPPYTPPPAIKCSIG

SEQ ID NO: 916284 - protein, 240 aa, Homo sapiens
KYTNSGTVTLLSFLVETEVSFLDYIKGGTQINFTVAIDFTASNGNPAQPTSLHYMNPYQLNAYGMALKAVGEIVQDYDSDKMFPALGFGAKLPPDGRISHEFALNGNPQNPYCDGIEGVMEAYYRSLKSVQLYGPTNFAPVINHVARYASSVKDGSQYFVLLIVTDGVISDMAQTKESIVNASKLPMSIIIVGVGPAEFDAMVELDGDDVRVSSRGKYAERDIVQFVPFSSNSRGILIEQ

SEQ ID NO: 916285 - protein, 152 aa, Homo sapiens
MAAPRWSASGPWIRGNGQGCGSLFTLVSKPFCAAAAASTAINAQRLAEKLRAQKREQDTKKEPVSTNAVQRRVQEIVRFTRQLQRVHPNVLAKALTRGILHQDKNLVVINKPYGLPVHGKDHAGKVEGPAAAFCYNRGKLRHVACSCQGQLK

SEQ ID NO: 916286 - protein, 84 aa, Homo sapiens
VLSTALLRGQSGNEFGTSKHAMQPGKLLLYSSHEDLHTPEPNRHLSILMVPDNCIAFDRVLSILLVYFHFSKYSFFSLSRPPPI

SEQ ID NO: 916287 - protein, 140 aa, Homo sapiens
MGLCYLPQRVSVMIVKMHIKYLPHNSFSKNSRNITMGDASPSNPAHSLDSPPGAFQPRQTVLFLLECQSDGVEASGLFTYSTCAVGSQKAKRRNFGSIQKPAVQGSLVDEGPRSQNKYLTFILKHCPCVAVTIVLDKMWS

SEQ ID NO: 916288 - protein, 300 aa, Homo sapiens [sequence omitted]

SEQ ID NO: 916289 - protein, 163 aa, Homo sapiens
LPGLGREAGGFSGYKAAEMWSFLPGAESVSMGPVPGVSSLGACWTHDQDSGRAEDRPQAPRITQYTWVLSFLFTEKPQTRSTSPISHQGQPQTTRALSLRQPQHPSAPASGRPRPPHSSGPDLAEAAPVVDQASQAAGRASSGLGLWEQASVSQGFRNAAFEA

SEQ ID NO: 916290 - protein, 192 aa, Homo sapiens
MRDCVLRDCAIWPRYYTFSMVFATHRPGDSLGCLHHQGSGFQAQNWAAVWADANGTWNPSETEPFTPLERGLKPGSQVVLLSRSHPHRAQQAKYPLARNSHCQRRNLKSTWYTQGQSFQRKEQAAIFAVLQPLLVIPRQTGSGVDLQQTPADLEKRGLTVRRKTNKQKAITSTKRMPTQKPHPKVISIKDQR

SEQ ID NO: 916291 - protein, 145 aa, Homo sapiens
WEIQEAPMGQGILGYKPSVSTPLLLQKGLKETMNWRGSAAPESHVLESSGRHRAGSRQVPPGVSRHLVAACPEAPISTGAPQGVRAGATVRSQKVHHPQLQSSCHPRVETSSSTLLHCELGCKDCMVRVKSPSTQEATLLKRGLP

SEQ ID NO: 916292 - protein, 140 aa, Homo sapiens
ADLRGGMNERETPGQLGLGNASGVSDAEARQPGKSPPFSMNWVVGSADLEIINATTGRRSCGGPSRLCKHVLSARWARLYGRLSTRTPSPGDTPSMYCEAKLGAHTYQSVKQQLFKAFQKAGLGTWVRKPPEQQQFLLTL

SEQ ID NO: 916293 - protein, 221 aa, Homo sapiens
SGEKRAAFVSTHGPVEPSPRQQCPQSPSDGWVGSGALPGSSPRWNVLGLQGALLSHFVEPVYLQSIVVGSLHHTGHLARVMSHRMEGVGQLPASYRHNRPLLSGVSDAEARQPGKSPPFSMNWVVGSADLEIINATTGRRSCGGPSRLCKHVLSARWARLYGRLSTRTPSPGDTPSMYCEAKLGAHTYQSVKQQLFKAFQKAGLGTWVRKPPEQQQFLLTL

SEQ ID NO: 916294 - protein, 267 aa, Homo sapiens
GFDQNADSNMDNKVQAEVVSDGKEELVGNSSKGDYCYVLAKRLVTFCPCPGDLWNFELEGDNSGEKSKPAAEICISNEELNINHQDNGNNIFSACQRLLQQALSSQAWKMYGNAWMPRQKFAAGAGPSWRNSAKAMWKRNVGLESLHRVPTEALPSGAVRRGPPFSRPQNGRSTKGLHCVTGKATDTQHQPLKATGEVWGAIPCKVTRAELPNVMEAHLVHQHDLDVRHGFKGDRFGVLKFDCLTGFWTCMGPWMTSKTRANQNETK

SEQ ID NO: 916295 - protein, 149 aa, Homo sapiens
MCFVKQVLEGSMLVKNPIEMKKTKRKFNGSPSPPHSPPGLLARREQVLQPPQLPVDCRNAGGSIMIASNTYRPWFIALGSPAQAGERKFHHISEQGDQVYTLEKFDSMGQQTCLAHPAQFSPDDKYSRHRITIKKRLKVLMTQQPRPVL

SEQ ID NO: 916296 - protein, 192 aa, Homo sapiens
MNTNEQAVAEACHLLPSASGEASGSCQSWRKVKGSQCITRQEQEQERCQAPSNNQLSSELTEQDLTHLQGASPCRPAGVQGTTSAHCNFHLSSSSNSPASASRVAGITDTHDHTCLIFVFLDSIAQTPVTRYAEQRYGQQQTTCTMVVWVNPVYDVHTTTKSPKDTLLRKCLLIVKQCMMNFVQNICFRFDQ

SEQ ID NO: 916297 - protein, 404 aa, Homo sapiens
LDWSASWMLIVGNERLQDGDSLQGVGPERVSLQILQASPHPQLFASPRKALLNSPTPVERRVLRGTSGGFLSMDPTTPAWGTESTTVNGNDQALLLLCGKETLIPVFLILFIALVGLVGNGFVLWLLGFRMRRNAFSVYVLSLAGADFLFLCFQIINCLVYLSNFFCSISINFPSFFTTVMTCAYLAGLSMLSTVSTERCLSVLWPIWYRCRRPRHLSAVVCVLLWALSLLLSILEGKFCGFLFSDGDSGWCQTFDFITAAWLIFLFMVLCGSSLALLVRILCGSRGLPLTRLYLTILLTVLVFLLCGLPFGIQWFLILWIWKDSDVLFCHIHPVSVVLSSLNSSANPIIYFFVGSFRKQWRLQQPILKLALQRALQDIAEVDHSEGCFRQGTPEMSRSTPTYK

SEQ ID NO: 916298 - protein, 107 aa, Homo sapiens
MIVSGKKLRLTIIECGCDINMMIDLAEVADLVLMLIDASFGFEMETFEFLNICQVHGFPKIMGVLTHLDFFKHNKQLKKTKKRLKHRFWTEVYLAGVQWRDLGSLQP

SEQ ID NO: 916299 - protein, 107 aa, Homo sapiens; identical to SEQ ID NO: 916298

SEQ ID NO: 916300 - protein, 110 aa, Homo sapiens
MIVSGKKLRLTIIECGCDINMMIDLAEVADLVLMLIDASFGFEMETFEFLNICQVHGFPKIMGVLTHLDFFKHNKQLKKTKKRLKHRFWTEVYLVAKLFCLSGMVHGEYQ

SEQ ID NO: 916301 - protein, 163 aa, Homo sapiens
SSGMVGCGPSLPRPAGPACCSECGPAPTPTRNWHWPAIAARSPDSRPHLSLHTSPQAEGASSGLGQPRKGLPQCSGGLKGSSSMARVGVKAEEVPRVSEGSLKAVRPLISHFTPLYFCVYVLNSSSSIGLESPRASWSRQVASIRGGSNPGQRVAGATVGMEN

SEQ ID NO: 916302 - protein, 230 aa, Homo sapiens
MLFHCLSNVIAASFAYCALPNVVCLAPVVLPWLTSHACVDQNPAEDFTWARCTAQEFLLGATFLIFVNSACKYQLPWPPPESLLHGTSSGSSPGFNWRSSQGPARLPLVARHQLRHKTTLDPGECGAWNANKHLATRTGYQGLENQEASLGNKVLPKHSLAFHPGNKTAPGFTLARQEAVCCQNDQQGAQRPRQAPAGLRENRKGTRKPTPAVLSLQGNVPGHCSPDSRQ

SEQ ID NO: 916303 - protein, 132 aa, Homo sapiens
MPYFSCRGRGLEALGTAHAAGLNASGAGTCGGQSPLHELVKNSIIEGHKTEGLDSELFRGTLEWGSGPVAFDLILSPLQQMLWRHLKVMLGLRLPTDQEQFREFAEQMNRDLWNEQNALWEHWGAVRSHDSE

SEQ ID NO: 916304 - protein, 188 aa, Homo sapiens
MWDGGSLTWTRGLCSLPEGRGKPTEPHRVLLGVMRGGCSDPTGRHGLKVVLGCSDLDLRAKSSGFNTSPSISAEVAQPLQAHPGLWESWDLGLPGTPGAVGILGPGPPKHSWGCGNPGTQLFRELLGLWESWDPGLPGTPGAVGILGLGPPKHSWGCGNPGTRVFQAHLGLWESWDLAPSGTPGTVES

SEQ ID NO: 916305 - protein, 159 aa, Homo sapiens
LQLVSSQWPLKMGRCHHQFEVSGSSCDITFYDTILAYKAGDATLLPPARAAGLLEFARGPLQTLFAWVSAAVSAEQQIFVNCECCCLIVTLEVLSQRSTRPCEVSVCPYWDLQLRAGRTTALFKAVRQGHLSLQRLLLSFCLSVPCRPVVEPTEAGRPP

SEQ ID NO: 916306 - protein, 159 aa, Homo sapiens; identical to SEQ ID NO: 916305

SEQ ID NO: 916307 - protein, 159 aa, Homo sapiens; identical to SEQ ID NO: 916305

SEQ ID NO: 916308 - protein, 159 aa, Homo sapiens; identical to SEQ ID NO: 916305

SEQ ID NO: 916309 - protein, 142 aa, Homo sapiens
GVELPKSMGTHILYQHDLVVRREVKGEHFGALRFAFPAGFQTCMGPVAPLFWPIFPIQNGCIYPLPVTPLYLQAWDTRREKLVLQRLGLNPLSGSLSGSRVTYGRKGMKKDHAAAQVSREPQAISQGQAQAKCIWRTRRNLA

SEQ ID NO: 916310 - protein, 137 aa, Homo sapiens
MAQVAVSTLPMEDEESMEDEESVEDDSVESRMVVTFLVSALESTPVKNSHSSGCEFRTLDFYHSFSYYFSCARIMAQVAVSTLPIEDEESVEDEESLESRMVVTFLSALDSMVRPSVLTFCSSVGLGATQTFSNSSC

SEQ ID NO: 916311 - protein, 172 aa, Homo sapiens
ANKLENLEEMIKYLDTCQSGKIELGKNKKLKETYNIIRLNQILSPLGENLSSVLTAMLSDSLLDDLGPIQLYPILAENFTNFKTFSVEKANGEEVKIDSFIIINGNHNTQANQWLANTKQGEESHPYVKIVARVLFKDNFNLMFKEISMKIQLDFKFQEFIRSGKILTSVVK

SEQ ID NO: 916312 - protein, 161 aa, Homo sapiens [sequence omitted]

SEQ ID NO: 916313 - protein, 209 aa, Homo sapiens
GPHPEPWEGRGTMGPPAAARITTQGTRPSVALARLRIWPKTNLLGAASQYLGPVHSRQELGCVPPLGLQSKHRGFYSTVGFSGAKRQTTGHLEEDSGKSFLVYVDDVQNVGLVLSQALELDQAIHFSIDAFHSVSELFASQSRKDLDPAMDLLVLSQGHQTNILDIIHIHKEALTKVMESRQHVAEGKTEVQRLMMSESQEQDFFGHFG

SEQ ID NO: 916314 - protein, 185 aa, Homo sapiens
MGSRRFGCLAFPACSNPNPCLRCFVTVALAVHCTVDGNMFSGSGEWDVDIFGGLLVCLPQVGSVKKRPCSSCLHLAGSTATEFAAVPAQKREFPAQGHRRASQLECGQRQTLGLQGSGPQGAGAGAKVLRQDLSRCRCKGPEAGPEQEPPAYFPHVSGQKWITGLPRITQAQRVQCGPHYMVDRI

SEQ ID NO: 916315 - protein, 146 aa, Homo sapiens
MCIVILNFYCAQVEKGAWRAKAVTGRVYVFCWVPRCSMDNCGSRGLDDSCSWLLSPPDDDRLELLQNPDWDSHFPDADHLPDYAFGRWLFQQTPLEETACACQQAGCIYMFSHKTRSSSTLKSKSSKPVATESNLYSITQQERGEL

SEQ ID NO: 916316 - protein, 78 aa, Homo sapiens
LMIRMWLKCKCVSLWFLLCSPLDCLPQGLPVTRALKLPAERPIRGASKVPPTAGTNLPTIREEDPPAPVKLANGCGSG

SEQ ID NO: 916317 - protein, 134 aa, Homo sapiens
MSKSGGQRMTRRGAERPSSAWRFGEHSQHAHTSFFRCSYDRRMVLSHPYTCEASVLPLSPVVALEGKASSSESAARWRFFHLISFVLDKTQWGQEPKAVVKEPEDPCPQTLPIGKRPQSYVSAPRLGRPLQARV

SEQ ID NO: 916318 - protein, 139 aa, Homo sapiens
QFCMHRTRLSMNMPNEVHKDSYYPNRDIPLVLDSHRWKFSLPPGNEDKLFSFFSHEDCCPPLRHFLLYEPKLVKGSGLLTSSLLSSRGKFKEICERPNGSCRDFCLETEIHVGRCLNSQPCCLPLGHQPRIESTTPKKD

SEQ ID NO: 916319 - protein, 209 aa, Homo sapiens
FLTQSSDMASKHPGIYYKYAEVTLALPEEDRKIWNSLELPRDLLNGFEQVADNDTGNEIQAEVVSDGDEELVGNWSKGDPFLCFHKKTGSIFAPAIEAVGAQRLSTEALPSGAVRRGPLSSRLQNGRSTNSLHHATGKDADTQTQPLKASGSCTLQVTGAELPKIMGIHFLHQHDLDDSTLHTSAQCSLATPAVADAAPGGAHATVPEG

SEQ ID NO: 916320 - protein, 209 aa, Homo sapiens; identical to SEQ ID NO: 916319

SEQ ID NO: 916321 - protein, 209 aa, Homo sapiens; identical to SEQ ID NO: 916319

SEQ ID NO: 916322 - protein, 163 aa, Homo sapiens
MNASGCQQEQNSVQPCSSIWRVPLTPGPPEVKPGVPMGTGWGHGGGQDGFGKGNIRAGKQECMFLLWATGPGLRVDINIMDADRKHKIPGSETKDFVTHNTVCLFITSPTLNSHGYEAMWAQEETVHTVGLRRGGSSQMRNTMLGEPTPFAQKESHFIVCREM

SEQ ID NO: 916323 - protein, 167 aa, Homo sapiens
MVLCFPILVHFIKRGAEVCQHAAVPASKSKRLLTLLHWAVQRNVCDHAPATGVGKCCDPRAMLKEPGGCVLKKCAEVNSQLKKENEEIIPGRWKSDSKAPEKGGCRTYLWSRKKTSVAQSTDEDSFSKKHSIHNTYPFTTQPSVVNGASTAYEIAKTEKTPKLNDNC

SEQ ID NO: 916324 - protein, 88 aa, Homo sapiens
GGRGNLSHFNTTAVAACGCHKKKNPFFGTAEAGLFSLFSRAPALPLLTQWGCQHHSLPLLLCLGGRKMPALVLTPASPSISGFLYLPS

SEQ ID NO: 916325 - protein, 180 aa, Homo sapiens
MMRTVSRVLAPYLTWAYAKDVKCGIDAQALMLQGAELLADAVAITMGSKGRAVIIQQSCGDPKVTKDGVTVEKSIDLKDEYNSIGVKLVQDVANNTSEEAGDDTTTVLFWHALLPRMASRRLSIVPALEVANAHHKTLVIIVEDIDGEALSTFVLNRLKVGLHIIAVKAPGFDEQLKEPA

SEQ ID NO: 916326 - protein, 345 aa, Homo sapiens
SPASLAIGCELSSLKRRRRRRRRRRRRQQRGSVSGPFTPRFLQPPLQPRGGGSLLAASRRSSLVPLQRKGERGDVFEVVSARISRAPLTPWSPCLPAVAPLVLGSLAHPLPLQGAVLGGVGSVLFLAGRNGVPKRGSLVGLAPPSPAPMSARAPKELRLALPPCLLNRTFASPNASGSGNTGARGPGAVGSGTCITQVGQQLFQSFSSTLVLIVLVTLIFCLIVLSLSTFHIHKRRMKKRKMQRAQEEYERDHCSGSRGGGGLPRPGRQAPTHAKETRLERQPRDSPFCAPSNASSLSSSSPGLPCQGPCAPPPPPPASSPQGAHAASSCLDTAGEGLLQTVVLS

SEQ ID NO: 916327 - protein, 140 aa, Homo sapiens
MCNLGRLGSPATSSEKPHHPWSGACPPSLGYLAHPAEPATLLLNLLSRKHPSTLPSPPPASHSFPNHPDWMTKGAEQREGFGPFISALHAASKGPILPSLIYTREKDLQSAELCANVGKTCLSCVSVSETYQKVFNSASC

SEQ ID NO: 916328 - protein, 235 aa, Homo sapiens
MPPNPIPPPSLQTLSYDPCPRDTSLHHATLMTGTPLQQLSHEAPTGPAGTTYSAANCLLSDLMKTTNHQTPETATGSSPQTEPVAKTKLIFRISQCLVICSAKELPITQAFDGDHPSILRKSIPWPKSADRPLPGARLLSRALTVGKIGEDPPEYDSPQATGARTVNRNYMCGAQGGGGGQNSEDQIQTHSRSYASASGSSWKRPPLTSSPHTAASWPGTDTSGAGWGQEKETAP

SEQ ID NO: 916329 - protein, 153 aa, Homo sapiens
MPNIPISYGLDFKDSQPEAVHLASFEWVTVPPSLFIVNFRPTCVAARSLFLLPASAHGAQAVALHLPGHLHRRLTAHSGLPVGQRTPEAIRSSPSRSSPSVAHRSTATSVTICRPVPRPEPQRNWAAASGGQGRLACLVRTRRAQRESWGIPG

SEQ ID NO: 916330 - protein, 125 aa, Homo sapiens
MPNKSPHLPRRGRTDSPPDTVPGSQGKPDGQVPSCQLPGGGRERPGPPGVLGANAAGPARELGNPGMSQAPRARCCLSSSGSGRSADKRNGASWGTGYDGRRGPFYLHCCSFVNLTYFCWVFPKY

SEQ ID NO: 916331 - protein, 125 aa, Homo sapiens; identical to SEQ ID NO: 916330

SEQ ID NO: 916332 - protein, 114 aa, Homo sapiens
MPNKSPHLPRRGRTDSPPDTVPGSQGKPDGQVPSCQLPGGGRERPGPPGVLGANAAGPARELGNPGMSQAPRARCCLSSSGSGRSAESASRSPGGVRGTGTRAARGLSPGSQAG

SEQ ID NO: 916333 - protein, 152 aa, Homo sapiens
MIKYNAYYAKIKAHKNSLGEVESKWSFMTELHEKRDFVKKLKTMKEELMQDLQNPGGNRITQVQEDITNLKDKIITVKESIIEKTCFLEEEKKTHEKLRKEIEVQHKRYDAILKRLHCQVNKLQSNRRQWQWNIQQLEKTAAELRKCIGMQE

SEQ ID NO: 916334 - protein, 106 aa, Homo sapiens
MPNKSPASAHGAQAVALHLPGHLHRRLTAHSGLPVGQRTPEAIRSSPSRSSPSVAHRSTATSVTICRPVPRPEPQRNWAAASGGQGRLACLVRTRRAQRESWGIPG

SEQ ID NO: 916335 - protein, 190 aa, Homo sapiens [sequence omitted]

SEQ ID NO: 916336 - protein, 340 aa, Homo sapiens
MLPEIFLALPPRGSILEDEKPSNGVLVHMVKLLIKTFLDGIFDDLMENNVLNTDEIHLIGKCLKFVVSNAENLVDDITETAQTAGKIFREHLWNSKKQLSSAFLEIQGAQPSGKLKLCPHAHFHELKTKRADEVICFEIRRHKITHSDKTLGTYWNDISSDGEREANMPGLNIRNKEFNYLHNRNGSELDLLGMRDLLENLGYSVVIKENLTAQEMETALRQFAAHPEHQSSDSTFLVFMSHSILNGICGTKHWDQEPDVLHDDTIFEIFNNRNCQSLKDKPKVIIMQACRGSLGLVQDIGCTIKAANLTHKVESENKKVHKEYALSDFNVNERSGEEHL

SEQ ID NO: 916337 - protein, 124 aa, Homo sapiens
QSEPFFSAVRKDGGCYLWQIYPIKERKDRIRLVLIICNKEFDHLPPRNGADFAIMEMKKLLEDLGYSVDVEENLTARQTMGNSGSETVQHLWESCLHSHLRTWRMQFARHTREGLHCFLLFNLI

SEQ ID NO: 916338 - protein, 107 aa, Homo sapiens
QSEPFFSAVRKDGGCYLWQIYPIKERKDRIRLVLIICNKEFDHLPPRNGADFAIMEMKKLLEDLGYSVDVEENLTARITCPGETAQGAPSSSHNSSHASRDIPGAAT

SEQ ID NO: 916339 - protein, 88 aa, Homo sapiens
QSEPFFSAVRKDGGCYLWQIYPIKERKDRIRLVLIICNKEFDHLPPRNGADFAIMEMKKLLEDLGYSVDVEENLTARNMKSLLWAFAA

SEQ ID NO: 916340 - protein, 130 aa, Homo sapiens
MGPNPMWLCPNKKEQLDTYTLPGRARCEDEAEIRVMHPLIKECQRLPENHQKLRHSMEQTFPHSTLILDFQPQKPVRQDCDKCCKEIQDSRNMDNRIPSIESYSLLISSLKPELGFRSTFQNIMYFANSI

SEQ ID NO: 916341 - protein, 151 aa, Homo sapiens
MRRLLLVTSLVVVLLWEAGAVPAPKVPIKMQVKHWPSEQDPEKAWGARVVEPPEKDDQLVVLFPVQKPKLLTTEEKPRGQGRGPILPGTKAWMETEDTLGRVLSPEPDHDSLYHPPPEEDQGEERPRLWVMPNHQVLLGPEEDQDHIYHPQ

SEQ ID NO: 916342 - protein, 142 aa, Homo sapiens [sequence omitted]

SEQ ID NO: 916343 - protein, 151 aa, Homo sapiens; identical to SEQ ID NO: 916341

SEQ ID NO: 916344 - protein, 387 aa, Homo sapiens
MATSMAAASGRFESAKSIEERKEQTRNARAEVLRQAKANFEKEERRKELKRLRGEDTWMLPDVNERIEQFSQEHSVKKKKKKDKHSKKAKKEKKKKSKKQKYEKNNESSDSSSSSEDEWVEAVPSQTPDKEKAWKVKDEKSGKDDTQIIKRDEWMTVDFMSVKTVSSSSLKAEKETMRKIEQEKNQALEQSKLMERELNPYWKDGGTGLPPEDCSVSSITKEAELLQIQEEKRKFLESTDSLNNELKRLCGLTVEVDMEKVAAEIAQAEEQTGKKQEEREKEAAEQAECSQGSIIPEEEQAPNKGEEKKDEENIPMETEETHLEETTESQQNGEEGTSTTEDKENGQEGVDSMAEEGTSDSNTGSESNSTTVEEPPTDPLPEDEKKE

SEQ ID NO: 916345 - protein, 239 aa, Homo sapiens
YHIAFLGEDPETRRMRTVKNIADLRQNLEETMSSLRGTQISHSTLETTFDSTVTTEVNGRTIPNLTSRPTPMTWRLGQACPRLQAGDAPSLGAGYPRSGTSRFIHTDPSRFMYTTPLRRAAVSRLGNMSQIDMSEKASSDLDMSSEVDVGGYMSDGDILGKSLRTDDINSGYMTDGGLNLYTRSLNRIPDTATSRDIIQRGVHDVTVDADSIERVNKGRTTIGETEKSALTQRSKDNQG

SEQ ID NO: 916346 - protein, 542 aa, Homo sapiens
MAHVYICNKPARCAQIENVDVCLSFLAARGVNVQGLSAEEIRNGNLKAILGLFFSLSRYKQQQHHQQQYYQSLVELQQRVTHASPPSEASQAKTQQDMQSRLPGPSRVPAAGSSSKVQGASNLNRRSQSFNSIDKNKPPNYANGNEKEFVSLLNPCYSKYDLCVSSNGIIQKIVGNAEPQGPLQTCYSSKGPQSSSGVNGNVQPPSTAGQPPASAIPSPSASKPWRSKSMNVKHSATSTMLTVKQSSTATSPTPSSDRLKPPVSEGVKTAPSGQKSMLEKFKLVNARTALRPPQPPSSGPSDGGKDDDAFSESGEMEGFNSGLNSGGSTNSSPKVSPKLAPPKAGSKNLSNKKSLLQPKEKEEKNRDKNKVCTEKPVKEEKDQVTEMAPKKTSKIASLIPKGSKTTAAKKESLIPSSSGIPKPGSKVPTVKQTISPGSTASKESEKFRTTKGSPSQSLSKPITMEKASASSCPAPLEGREAGQASPSGSCTMTVAQSSGQSTGNGAVQLPQQQQHSHPNTATVAPFIYRSVLIPSETSINAS

SEQ ID NO: 916347 - protein, 376 aa, Homo sapiens
MVILIFQAKKGNYAFLWDVAVVEYAALTDDDCSVTVIGNSISSKGYGIALQHGSPYRDLFSQRILELQDTGDLDVLKQKWWPHMGRCDLTSHASAQADGKSLKLHSFAGVFCILAIGLLLACLVAALELWWNSNRCHQETPKEDKEVNLEQVHRRMNSLMDEDIAHKQISPASIELSALEMGGLAPTQTLEPTREYQNTQLSVSTFLPEQSSHGTSRTLSSGPSSNLPLPLSSSATMPSMQCKHRSPNGGLFRQSPVKTPIPMSFQPVPGGTRPGVLFKQQSNPEQGPSPLRHLITSEISRPIPVQSSYRPQAINLIFHPQMCVLFSRPLKKSPGFSDFVGDSPAVGLKLSKADLRRLSDMIKISSSRNQKEDAQP

SEQ ID NO: 916348 - protein, 163 aa, Homo sapiens
PSPVAAVALRAMALCWEMYYTAQYSPHKNTINGPASGQQSDDSNPVVFLEGPLWKQSWEDGTEIFGIRGPCKEAKEREIHPPLITRDCNYSDIDWDNEFAKTLEKERYSCRYFAFAEFAELSCEVKGKAGDHTCVCDITDTLRSTNVSLAHQVGTERLHLKVI

SEQ ID NO: 916349 - protein, 214 aa, Homo sapiens
VRASLPPVPLLLHSSHIHVSCTLQSGGHCQKLEISSRAAKGLRMDSWLLVHCHSLPPSSLSSIFSWWRQALLRVPTGASGAGTALTAYNLGLVVLLGCLWEVMVTPLLANCSYFCQPVDYRWRKHGMRVAKASHQLIWMLSHWMLVMGSCPVTQSMILGPAASFGSLLEMQNLCSTPGTLIKNLLFNEQDAHMLIRFQGSGLGHIWRVLLWSLQ

SEQ ID NO: 916350 - protein, 143 aa, Homo sapiens
MSGWMEERRPLGCGKLLCITAAIDAAPHGACEPGCLSDGPDFEQSWATAVPCLGPSEAPLLSLRTPPPWRETQEILARGCYEESLGFCVLGLMGPRLWRGQEKVLTPVSSAAASVLLSERGLVAPLVGQRLMHQVNRQQQHCF

SEQ ID NO: 916351 - protein, 911 aa, Homo sapiens [sequence omitted]

SEQ ID NO: 916352 - protein, 728 aa, Homo sapiens [sequence omitted]

SEQ ID NO: 916353 - protein, 283 aa, Homo sapiens
MEVNCLTLKDLISPRQPRLDFAVEDGENAQKENIFVDRSRMAPKTPIKNEPIDLSKQKKFTPERNPITPVKLVDRQQAEPWTPTANLKMLISAASPDIRDREKKKGLFRPIENKDDAFTDSLQLDVVGDSAVDEFEKQRPSRKQKSLGLLCQKFLARYPSYPLSTEKTTISLDEVAVSLGVERRRIYDIVNVLESLHLVSRVAKNQYGWHGRHSLPKTLRNLQRLGEEQKYEEQMAYLQQKELDLIDYKFGERKKDGDPDSQEQQLLDFSEPDCPSCESIVTS

SEQ ID NO: 916354 - protein, 911 aa, Homo sapiens [sequence omitted]

SEQ ID NO: 916355 - protein, 251 aa, Homo sapiens
PAHRWAPGTPGRVLGAQARGRRQSAPASMEGLVFLNALATRLLFLLHSLVGVWRVTEVKKEPRYWLLALLNLLLFLETALTLKFKRGRGYKWFSPAIFLYLISIVPSLWLLELHHETQYCSIQAEGTSQNTSRKEDFNQTLTSNEQTSRADDLIETAKVFVNNLSTVCEKVWTLGLHQTFLLMLIIGRWLLPIGGGITRDQLSQLLLMFVGTAADILEFTSETLEEQNVRLCWKNSTNRRHTNPKWQLVLF

SEQ ID NO: 916356 - protein, 154 aa, Homo sapiens
SGSVLTSVCNNYTPRVMRKLRHRVIKSSLLGPVSCQLREKSEDSRLPILLTPAVQRRKDMLQNIGSGTGNLTAFELSQEEWVRAASGERKVETVNQPEPYRITKCLWRAHHMPDTLEGAEKLEEEHCYMNTVGRMASKREQEVGRALSGQHLVV

SEQ ID NO: 916357 - protein, 287 aa, Homo sapiens
PAHRWAPGTPGRVLGAQARGRRQSAPASMEGLVFLNALATRLLFLLHSLVGVWRVTEVKKEPRYWLLALLNLLLFLETALTLKFKRGRGYKWFSPAIFLYLISIVPSLWLLELHHETQYCSIQAEGTSQNTSRKEDFNQTLTSNEQTSRADDLIETAKVFVNNLSTVCEKVWTLGLHQTFLLMLIIGRWLLPIGGGITRDQLSQLLLMFVGTAADILEFTSETLEEQNVRNSPALVYAILVIWTWSMLQFPLDLADPCIRTSEDIGAVKIVLIGGPWNPTGLTLIKT

SEQ ID NO: 916358 - protein, 152 aa, Homo sapiens
QPLQSLTDSSPAPGMATSSREHSLHSNWILRAPRRHSEDIAAHTVHTVDGQFRRSTEHRTVGTQRRLERHPIYLPKAVEGAFNTWKFKPKACKKDLGSSRQILFNFSGEDMEWDAELFALEPQLSPGEDYYETENPKGQWLLRERLWERTVP

SEQ ID NO: 916359 - protein, 1194 aa, Homo sapiens
IFFMEAMSPQQETLGGQPGRSSSLTGVSRLAGGSCTKKKMKTLAERRRSAPSLILDKALQKRPTTRDSPSASVDTCTFLSSLVCSNRTLLIDGRAELKRGLQRQERHLFLFNDLFVVAKIKYNNNFKIKNKIKLTDMWTASCVDEVGEGNTNAMKSFVLGWPTVNFVATFSSPEQKDKWLSLLQRYINLEKEKDYPKSIPLKIFAKDIGNCAYSKTITVMNSDTANEVINMSLPMLGITGSERDYQLWVNSGKEEAPYPLIGHEYPYGIKMSHLRDSALLTPGSKDSTTPFNLQEPFLMEQLPREMQCQFILKPSRLAAAQQLSDSGHKTFKRRRSIINWAFWRGSSTHLDNLPSSPTSPMPGQLFGISLPNICENDNLPKPVLDMLFFLNQKGPLTKGIFRQSANVKSCRELKEKLNSGVEVHLDCESIFVIASVLKDFLRNIPGSIFSSDLYDHWVSVMDQGNDEEKINTVQRLLDQLPRANVVLLRYLFGVLHNIEQHSSSNQMTAFNLAVCVAPSILWPPASSSPELENEFTKKVSLLIQFLIENCLRIFGEEITSLFREVSVRCDTRENASDISCFQLNDSSYDSLENELNEDVDAPCSDLVKKLGQGSRSMDSVLTLSDYDLDQPEVEGLLTLSDFDLAHSKDEDVQMKRPLESKPVNILVYTKIPLRDHARAPSAMCTPSYLSTAAANAAKSLRRHRRCSEPSIDYLDSKLSYLREFYQKKLRKSSCDAILSQKDEDYLKQNQPLQEEGKTCFKQSLVTGTDVSKKNATTQNTKKKSLSGSEGNHVKLFPKSKPVAISVASYSPMSSQDHSKNQPFDVNTSGYSPPHTADALKGPRTHRRCSEPNIEDQNRKLTYLRGIYSKKQHKTSCEAGLLHGEEDYLKRHKSLQMEGQKLINQSLVMGIEVGKSSATNQNTEKVLPPRLNLCPRTSYSSLSSPGTSPSGSSVSSQDSAFSQISEHSVFTPTETSSPIDCTFQAQRKREDLSPDFSNASHVSGMPGPSSGQACSRPAYTKKDTMEWHSQMHSVTLHPSTWLRNGVASLKNWSLKKKAKAARPEEEKIASPKGPLEPPPHASGVPEANSLQEEQKDLPLRAAEGLSPVQSAQRCSSSPFQDSERHCSSPFSLVESRLKLCMKSHEEIEPGSQSSSGSLPWERASASSWTLEDATSPDSGPTVVCDIEDRYLTKDI

SEQ ID NO: 916360 - protein, 734 aa, Homo sapiens
MDQGNDEEKINTVQRLLDQLPRANVVLLRYLFGVLHNIEQHSSSNQMTAFNLAVCVAPSILWPPASSSPELENEFTKKVSLLIQFLIENCLRIFGEEITSLFREVSVRCDTRENASDISCFQLNDSSYDSLENELNEDVDAPCSDLVKKLGQGSRSMDSVLTLSDYDLDQPEVEGLLTLSDFDLAHSKDEDVQMKRPLESKPVNILVYTKIPLRDHARAPSAMCTPSYLSTAAANAAKSLRRHRRCSEPSIDYLDSKLSYLREFYQKKLRKSSCDAILSQKDEDYLKQNQPLQEEGKTCFKQSLVTGTDVSKKNATTQNTKKKSLSGSEGNHVKLFPKSKPVAISVASYSPMSSQDHSKNQPFDVNTSGYSPPHTADALKGPRTHRRCSEPNIEDQNRKLTYLRGIYSKKQHKTSCEAGLLHGEEDYLKRHKSLQMEGQKLINQSLVMGIEVGKSSATNQNTEKVLPPRLNLCPRTSYSSLSSPGTSPSGSSVSSQDSAFSQISEHSVFTPTETSSPIDCTFQAQRKREDLSPDFSNASHVSGMPGPSSGQACSRPAYTKKDTMEWHSQMHSVTLHPSTWLRNGVASLKNWSLKKKAKAARPEEEKIASPKGPLEPPPHASGVPEANSLQEEQKDLPLRAAEGLSPVQSAQRCSSSPFQDSERHCSSPFSLVESRLKLCMKSHEEIEPGSQSSSGSLPWERASASSWTLEDATSPDSGPTVVCDIEDRYLTKDI

SEQ ID NO: 916361 - protein, 1225 aa, Homo sapiens
LHPPPVLQPGSSLSLGARAVVGDRLSPTPRRAPGPPEVAWASTDCPLAVSAPKSGPAMSARERQPALKKKMKTLAERRRSAPSLILDKALQKRPTTRDSPSASVDTCTFLSSLVCSNRTLLIDGRAELKRGLQRQERHLFLFNDLFVVAKIKYNNNFKIKNKIKLTDMWTASCVDEVGEGNTNAMKSFVLGWPTVNFVATFSSPEQKDKWLSLLQRYINLEKEKDYPKSIPLKIFAKDIGNCAYSKTITVMNSDTANEVINMSLPMLGITGSERDYQLWVNSGKEEAPYPLIGHEYPYGIKMSHLRDSALLTPGSKDSTTPFNLQEPFLMEQLPREMQCQFILKPSRLAAAQQLSDSGHKTFKRRRSIINWAFWRGSSTHLDNLPSSPTSPMPGQLFGISLPNICENDNLPKPVLDMLFFLNQKGPLTKGIFRQSANVKSCRELKEKLNSGVEVHLDCESIFVIASVLKDFLRNIPGSIFSSDLYDHWVSVMDQGNDEEKINTVQRLLDQLPRANVVLLRYLFGVLHNIEQHSSSNQMTAFNLAVCVAPSILWPPASSSPELENEFTKKVSLLIQFLIENCLRIFGEEITSLFREVSVRCDTRENASDISCFQLNDSSYDSLENELNEDVDAPCSDLVKKLGQGSRSMDSVLTLSDYDLDQPEVEGLLTLSDFDLAHSKDEDVQMKRPLESKPVNILVYTKIPLRDHARAPSAMCTPSYLSTAAANAAKSLRRHRRCSEPSIDYLDSKLSYLREFYQKKLRKSSCDAILSQKDEDYLKQNQPLQEEGKTCFKQSLVTGTDVSKKNATTQNTKKKSLSGSEGNHVKLFPKSKPVAISVASYSPMSSQDHSKNQPFDVNTSGYSPPHTADALKGPRTHRRCSEPNIEDQNRKLTYLRGIYSKKQHKTSCEAGLLHGEEDYLKRHKSLQMEGQKLINQSLVMGIEVGKSSATNQNTEKVLPPRLNLCPRTSYSSLSSPGTSPSGSSVSSQDSAFSQISEHSVFTPTETSSPIDCTFQAQRKREDLSPDFSNASHVSGMPGPSSGQACSRPAYTKKDTMEWHSQMHSVTLHPSTWLRNGVASLKNWSLKKKAKAARPEEEKIASPKGPLEPPPHASGVPEANSLQEEQKDLPLRAAEGLSPVQSAQRCSSSPFQDSERHCSSPFSLVESRLKLCMKSHEEIEPGSQSSSGSLPWERASASSWTLEDATSPDSGPTVVCDIEDRYLTKDI

SEQ ID NO: 916362 - protein, 228 aa, Homo sapiens
GETMERRVEQLGPSRGGGIQTPGGGGGGGAAGRWEREPSLAARGTAPPAPPRQCLPTPCPPLGHGLRPRPPPGTPPPRCPRTLAPGPRGLFPAPPPAPARTGPAGKAAADRGRPGPAAGRRVRRSPSFPPFLLAQTRLGRTGSLALCLLLLLHGAMRLGGGSREKLACGRAGRAARTGRGEGGRQAEEEAAGRRRRRPGRTRGIPRAAGGLSRAGTRVLRYPSSHRRQ

SEQ ID NO: 916363 - protein, 149 aa, Homo sapiens
MTPYIFPVCPELAAVHHMPPIRDSALGKMETKISASGDHWMHQPRALLHCSRNSLENGGAASLVPQGQSTLHITVPGAHFHLQNALNPTLELEWIVLMYQHGILFPGSFLKSAGSARDHVPLSPSPNLSLKQNLFKATIERLTEFPQPC

SEQ ID NO: 916364 - protein, 526 aa, Homo sapiens
MNCRSEVLEVSVEGRQVEEAMLAVLHTVLLHRSTGKFHYKKEGTYSIGTVGTQDVDCDFIDFTYVRVSSEELDRALRKVVGEFKDALRNSGGDGLGQMSLEFYQKKKSRWPFSDECIPWEVWTVKVHVVALATEQERQICREKVGEKLCEKIINIVEVMNRHEYLPKMPTQSEVDNVFDTGLRDVQPYLYKISFQITDALGTSVTTTMRRLIKDTLASERRWISGSSLMAPRPWLLGIDYWAFGLWNLLWVIGETWKGQPPLASWFCGCQPQVILLIFADGSVLPLLSLHSPGGVPLLSPLYRRATTGMGNKVENMSLAEPSLPCLVSARRVNTFWHSCEDTGVPLGPLCEGEGLLGTGLLVLADWTCMGVPVGLGDEKKYSRPGVRAYGERAPPARPPVWAPAHLAIPPHLGSRRWSMNGSQAGAAAQAAWLSSCCNQSASPPEPPEGPRAVQAVVLGVLSLLVLCGVLFLGGGLLLRAQGLTALLTREQRASREPEPGSASGEDGDDDSSAPGCARWSRPPGSP

SEQ ID NO: 916365 - protein, 526 aa, Homo sapiens
MNCRSEVLEVSVEGRQVEEAMLAVLHTVLLHRSTGKFHYKKEGTYSIGTVGTQDVDCDFIDFTYVRVSSEELDRALRKVVGEFKDALRNSGGDGLGQMSLEFYQKKKSRWPFSDECIPWEVWTVKVHVVALATEQERQICREKVGEKLCEKIINIVEVMNRHEYLPKMPTQSEVDNVFDTGLRDVQPYLYKISFQITDALGTSVTTTMRRLIKDTLPSERRWISGSSLMAPRPWLLGIDYWAFGLWNLLWVIGETWKGQPPLASWFCGCQPQVILLIFADGSVLPLLSLHSPGGVPLLSPLYRRATTGMGNKVENMSLAEPSLPCLVSARRVNTFWHSCEDTGVPLGPLCEGEGLLGTGLLVLADWTCMGVPVGLGDEKKYSRPGVRAYGERAPPARPPVWAPAHLAIPPHLGSRRWSMNGSQAGAAAQAAWLSSCCNQSASPPEPPEGPRAVQAVVLGVLSLLVLCGVLFLGGGLLLRAQGLTALLTREQRASREPEPGSASGEDGDDDSSAPGCARWSRPPGSP

SEQ ID NO: 916366 - protein, 757 aa, Homo sapiens
SLPGEWWHLRGWSWTVVGGGGSCFNRVPPLLCRRGHPPGQWNAGAPTFPRLPGRFQAQAWGWRWSPALQRTAPEEVPGSLPRVVSPVGNLVVEGVVVLRFGLGAPSWAQVGREEFRKGWIPLAGKWGPATLSGSVAPAERKGARTAALLRGSEPFEPGNSPVGSKELLTTSKAVWAPMRRSGLGRFAACSFYSLWFTHHRLGCWRKTAVPWIESLVGICDVIARDAMLRAGHGSRPWLRRTGPCLGLVRWHTVWLRGTRQPHGESIHGTKKGRGTYSIGTVGTQDVDCDFIDFTYVRVSSEELDRALRKVVGEFKDALRNSGGDGLGQMSLEFYQKKKSRWPFSDECIPWEVWTVKVHVVALATEQERQICREKVGEKLCEKIINIVEVMNRHEYLPKMPTQSEVDNVFDTGLRDVQPYLYKISFQITDALGTSVTTTMRRLIKDTLASERRWISGSSLMAPRPWLLGIDYWAFGLWNLLWVIGETWKGQPPLASWFCGCQPQVILLIFADGSVLPLLSLHSPGGVPLLSPLYRRATTGMGNKVENMSLAEPSLPCLVSARRVNTFWHSCEDTGVPLGPLCEGEGLLGTGLLVLADWTCMGVPVGLGDEKKYSRPGVRAYGERAPPARPPVWAPAHLAIPPHLGSRRWSMNGSQAGAAAQAAWLSSCCNQSASPPEPPEGPRAVQAVVLGVLSLLVLCGVLFLGGGLLLRAQGLTALLTREQRASREPEPGSASGEDGDDDSSAPGCARWSRPPGSP

SEQ ID NO: 916367 - protein, 155 aa, Homo sapiens
KDKIVWVFKSRSKWEGVRVMGTDGEETQVLHWHLARMPHADFLPLAPSLVPLASEPDLNKKVNLHNHSGPINNQTKNLLTYFFPSFPKHNLIHVPPAHKSHGIFPNYSAYVNLLCLLKGSLSSNGFCRQPISSHYSGHFLPTKYSVVVTKNISIG

SEQ ID NO: 916368 - protein, 486 aa, Homo sapiens
MVHGMPTQKTQGCDAGYLNLGAGDWICRIELFELRTQEGLAIAEGLSAELQVAQQENHHLNLDLKEAKSWQEEQSAQAQRLKDKVAQMKDTLGQAQQRVAELEPLKEQLRGAQELAASSQQKATLLGEELASAAAARDRTIAELHRSCLEVAEVNGRLAELGLHLKEEKCQWSKERAGLLQSVEAEKDKILKLSAEILRLEKAVQEERTQNQVFKTELAREKDSSLVQLSESKRELTELRSALRVLQKEKEQLQEEKQELLEYMRKLEARLEKVADEKWNEDATTEDEEAAVGLSCPAALTDSEDESPEDMRLPPYGLCERGDPGSSPAGPREASPLVVISQPAPISPHLSGPAEDSSSDSPWLLFPYLSQCAAPPSWDTTPKPNPVSLASRRLKMRQSVLMAAVQSGGEEANLLLPELASAFYDMASGFTVGTLSETSTGGPATPTWKECPICKERFPAESDKDALEDHMDGHFFFSTQDPFTFE

SEQ ID NO: 916369 - protein, 520 aa, Homo sapiens
MGISRSHGEITEERDILDRQQGDHVARILELQDDIQTISEKVLTKEVELDRLRDTVKALTREQEKLLGQLKEVQADKEQSEAELQVAQQENHHLNLDLKEAKSWQEEQSAQAQRLKDKVAQMKDTLGQAQQRVAELEPLKEQLRGAQELAASSQQKATLLGEELASAAAARDRTIAELHRSCLEVAEVNGRLAELGLHLKEEKCQWSKERAGLLQSVEAEKDKILKLSAEILRLEKAVQEERTQNQVFKTELAREKDSSLVQLSESKRELTELRSALRVLQKEKEQLQEEKQELLEYMRKLEARLEKVADEKWNEDATTEDEEAAVGLSCPAALTDSEDESPEDMRLPPYGLCERGDPGSSPAGPREASPLVVISQPAPISPHLSGPAEDSSSDSPWLLFPYLSQCAAPPSWDTTPKPNPVSLASRRLKMRQSVLMAAVQSGGEEANLLLPELASAFYDMASGFTVGTLSETSTGGPATPTWKECPICKERFPAESDKDALEDHMDGHFFFSTQDPFTFE

SEQ ID NO: 916370 - protein, 188 aa, Homo sapiens
AASMWCWACRFTKVQSLGAVQRGNVGPEPPHRVPTGALPNGAVRRGPMSSRPQNGRSSDSLHHAPEKARDTQCQPLKELSKAVGSHSLHHCALIVRCGVKGNYSGALKFNDCPTGFWTCMGPVAPLFWQISHIWNRVQLMTLYMRAILLGMLENSACAKTKPECVGSDFQGIQTLRVTLVGLGGVVNI

SEQ ID NO: 916371 - protein, 188 aa, Homo sapiens; identical to SEQ ID NO: 916370

SEQ ID NO: 916372 - protein, 240 aa, Homo sapiens
NALSPPQPLSPDWPWCVFLPIMSMCSHCSTRNYEYIPSNAIAGSNGISDSRSLRNLHVVFQFTLPPTVISNRTNQENHKRDCGYSEKDAGGQDFQDKDFGENQKLMEMKTEDLTGDDLMQMNASKSGPDDEEEENKSLLSVKITRIKIFIKMIHFHLTNTMAGAVATGMQGAVSQSCAGQWGRNHSVLLGLWACDKKAAEVSNFPSSCYLLLHPPHSSNLCTLSSSKVASTFSVNKSHEI

SEQ ID NO: 916373 - protein, 85 aa, Homo sapiens
GVAVLEDPRWTGENMSLPSNLQLNDLTPDSRAVKPADRQMAQNNSRPELLDPEPGGLLTSQGFIRLPVLGYIYRVSSVSSDEIWL

SEQ ID NO: 916374 - protein, 322 aa, Homo sapiens
MALPPGPAALRHTLLLLPALLSSGWGELEPQIDGQTWAERALRENERHAFTCRVAGGPGTPRLAWYLDGQLQEASTSRLLSVGGEAFSGGTSTFTVTAHRAQHELNCSLQDPRSGRSANASVILNVQFKPEIAQVGAKYQEAQGPGLLVVLFALVRANPPANVTWIDQDGPVTVNTSDFLVLDAQNYPWLTNHTVQLQLRSLAHNLSVVATNDVGVTSASLPAPGPSRHPSLISSDSNNLKLNNVRLPRENMSLPSNLQLNDLTPDSRAVKPADRQMAQNNSRPELLDPEPGGLLTSQGFIRLPVLGYIYRVSSVSSDEIWL

SEQ ID NO: 916375 - protein, 367 aa, Homo sapiens
MALPPGPAALRHTLLLLPALLSSGWGELEPQIDGQTWAERALRENERHAFTCRVAGGPGTPRLAWYLDGQLQEASTSRLLSVGGEAFSGGTSTFTVTAHRAQHELNCSLQDPRSGRSANASVILNVQFKPEIAQVGAKYQEAQGPGLLVVLFALVRANPPANVTWIDQDGPVTVNTSDFLVLDAQNYPWLTNHTVQLQLRSLAHNLSVVATNDVGVTSASLPAPGLLATRVEVPLLGIVVAAGLALGTLVGFSTLVACLVCRKEKKTKGGGHGYGDMHPSDSNNLKLNNVRLPRENMSLPSNLQLNDLTPDSRAVKPADRQMAQNNSRPELLDPEPGGLLTSQGFIRLPVLGYIYRVSSVSSDEIWL

SEQ ID NO: 916376 - protein, 156 aa, Homo sapiens
MGTALRVLGCPPASFLFQASLQQPFDLDLSPHEWTPLARDQLGQGDPNPATTEVEIKKKGPGSLLVSMDQLASYGRKDRINSIMSVVTNTLVEDKGEKEKGKKMMTQGGKEEEAVERKRKAKDESRKGQRGKKEGDRRRQNKEGKVKRGEECDLYF

SEQ ID NO: 916377 - protein, 140 aa, Homo sapiens
CGRMGRAVCKAPEFSQSICRAPRVLGKLKSCSVALRQEHKPVVGTVYCCLGVWGLHTQAPMPWHRRDNSLARNAQMKWDPAWPFLASHCQCSWTTWPDFMYASHARSPCQAQWTHSAYRAMLPGFGAEGTDKRDNSKEDD

SEQ ID NO: 916378 - protein, 145 aa, Homo sapiens [sequence omitted]

SEQ ID NO: 916379 - protein, 238 aa, Homo sapiens
MPCIQAQYGTPAPSPGPRDHLASDPLTPEFIKPTMDLASPEAAPAAPIQELVLPHFGKEDAGDVQQFYDLLSGSLEVIRKWAEKIPGFAELSPADQDLLLESAFLELFILRLAYRSKPGEGKLIFCSGLVLHRLQCARGFGDWIDSILAFSRSLHSLLVDVPAFACLSALVLITDPAWASRETAGGVGRSCKNRNSQSWPEGSTVDRLVGEAEPPSQDKLGMVHVWIGGTPARKLRGT

SEQ ID NO: 916380 - protein, 611 aa, Homo sapiens
MWLAKACWSIQSEMPCIQAQYGTPAPSPGPRDHLASDPLTPEFIKPTMDLASPEAAPAAPTALPSFSTFMDGYTGEFDTFLYQLPGTVQPCSSASSSASSTSSSSATSPASASFKFEDFQVYGCYPGPLSGPVDEALSSSGSDYYGSPCSAPSPSTPSFQPPQLSPWDGSFGHFSPSQTYEGLRAWTEQLPKASGPPQPPAFFSFSPPTGPSPSLAQSPLKLFPSQATHQLGEGESYSMPTAFPGLAPTSPHLEGSGILDTPVTSTKARSGAPGGSEGRCAVCGDNASCQHYGVRTCEGCKGFFKRTVQKNAKYICLANKDCPVDKRRRNRCQFCRFQKCLAVGMVKEVVRTDSLKGRRGRLPSKPKQPPDASPANLLTSLVRAHLDSGPSTAKLDYSKFQELVLPHFGKEDAGDVQQFYDLLSGSLEVIRKWAEKIPGFAELSPADQDLLLESAFLELFILRLAYRSKPGEGKLIFCSGLVLHRLQCARGFGDWIDSILAFSRSLHSLLVDVPAFACLSALVLITDRHGLQEPRRVEELQNRIASCLKEHVAAVAGEPQPASCLSRLLGKLPELRTLCTQGLQRIFYLKLEDLVPPPPIIDKIFMDTLPF

SEQ ID NO: 916381 - protein, 868 aa, Homo sapiens
RGSPRGARDPRPPGMGAPAVQSSSGPAGARPRKAGVERRAEPAGPGEGLPGWREARREPEGPGAVGSREQLESEEILIRGSPAAASLQRPFSGSGPPAGYSGPGGPQLGPESGAGSLVGLGAAIFSGRGGREEPIYRSNNPRSLRQWNPACVTRADIPGPPSSPRPLGLPGPHLPLAASRRNRTAPRALVWPKLDGRPASVAPPPLPVQEGRARPGSPSGGGYETWGSAQKNFGSARGTRDQAETRGASPGRGSGSRPEMPCIQAQYGTPAPSPGPRDHLASDPLTPEFIKPTMDLASPEAAPAAPTALPSFSTFMDGYTGEFDTFLYQLPGTVQPCSSASSSASSTSSSSATSPASASFKFEDFQVYGCYPGPLSGPVDEALSSSGSDYYGSPCSAPSPSTPSFQPPQLSPWDGSFGHFSPSQTYEGLRAWTEQLPKASGPPQPPAFFSFSPPTGPSPSLAQSPLKLFPSQATHQLGEGESYSMPTAFPGLAPTSPHLEGSGILDTPVTSTKARSGAPGGSEGRCAVCGDNASCQHYGVRTCEGCKGFFKRTVQKNAKYICLANKDCPVDKRRRNRCQFCRFQKCLAVGMVKEVVRTDSLKGRRGRLPSKPKQPPDASPANLLTSLVRAHLDSGPSTAKLDYSKFQELVLPHFGKEDAGDVQQFYDLLSGSLEVIRKWAEKIPGFAELSPADQDLLLESAFLELFILRLAYRSKPGEGKLIFCSGLVLHRLQCARGFGDWIDSILAFSRSLHSLLVDVPAFACLSALVLITDRHGLQEPRRVEELQNRIASCLKEHVAAVAGEPQPASCLSRLLGKLPELRTLCTQGLQRIFYLKLEDLQEDPGIWRPSPSRQEDCTEVPTCARVPT

SEQ ID NO: 916382 - protein, 857 aa, Homo sapiens
RGSPRGARDPRPPGMGAPAVQSSSGPAGARPRKAGVERRAEPAGPGEGLPGWREARREPEGPGAVGSREQLESEEILIRGSPAAASLQRPFSGSGPPAGYSGPGGPQLGPESGAGSLVGLGAAIFSGRGGREEPIYRSNNPRSLRQWNPACVTRADIPGPPSSPRPLGLPGPHLPLAASRRNRTAPRALVWPKLDGRPASVAPPPLPVQEGRARPGSPSGGGYETWGSAQKNFGSARGTRDQAETRGASPGRGSGSRPEMPCIQAQYGTPAPSPGPRDHLASDPLTPEFIKPTMDLASPEAAPAAPTALPSFSTFMDGYTGEFDTFLYQLPGTVQPCSSASSSASSTSSSSATSPASASFKFEDFQVYGCYPGPLSGPVDEALSSSGSDYYGSPCSAPSPSTPSFQPPQLSPWDGSFGHFSPSQTYEGLRAWTEQLPKASGPPQPPAFFSFSPPTGPSPSLAQSPLKLFPSQATHQLGEGESYSMPTAFPGLAPTSPHLEGSGILDTPVTSTKARSGAPGGSEGRCAVCGDNASCQHYGVRTCEGCKGFFKRTVQKNAKYICLANKDCPVDKRRRNRCQFCRFQKCLAVGMVKEVVRTDSLKGRRGRLPSKPKQPPDASPANLLTSLVRAHLDSGPSTAKLDYSKFQELVLPHFGKEDAGDVQQFYDLLSGSLEVIRKWAEKIPGFAELSPADQDLLLESAFLELFILRLAYRSKPGEGKLIFCSGLVLHRLQCARGFGDWIDSILAFSRSLHSLLVDVPAFACLSALVLITDRHGLQEPRRVEELQNRIASCLKEHVAAVAGEPQPASCLSRLLGKLPELRTLCTQGLQRIFYLKLEDLVPPPPIIDKIFMDTLPF

SEQ ID NO: 916383 - protein, 273 aa, Homo sapiens
IELVPGQAQKVVRTDSLKGRRGRLPSKPKQPPDASPANLLTSLVRAHLDSGPSTAKLDYSKFQELVLPHFGKEDAGDVQQFYDLLSGSLEVIRKWAEKIPGFAELSPADQDLLLESAFLELFILRLAYRSKPGEGKLIFCSGLVLHRLQCARGFGDWIDSILAFSRSLHSLLVDVPAFACLSALVLITDRHGLQEPRRVEELQNRIASCLKEHVAAVAGEPQPASCLSRLLGKLPELRTLCTQGLQRIFYLKLEDLVPPPPIIDKIFMDTLPF

SEQ ID NO: 916384 - protein, 405 aa, Homo sapiens
LCRMSGVLCSRNLFTFKFSLFQLDSGASGEPGHSLGLTLGFSHCGNCQTAVVSAQPEGMASNGAYPALGPGVTANPGTSLSVFTALPFTTPAPGPAHGPLLVTAGAPPGGPLVLSTLPSTPLVTEQDGCGPSGAGASNVFVQMRTEVGPVKAAQAQTLVLTQAPLVWQAPGALCGGVVCPPPLLLAAAPVVPVMAAQVVGGTQACEGGWSQGLPLPPPPPPAAQLPPIVSQGNAGPWPQGAHGEGSLASSQAKAPPDDSCNPRSVYENFRLWQHYKPLARRHLPQSPDTEALSCFLIPVLRSLARRKPTMTLEEGLWRAMREWQHTSNFDRMIFYEMAEKFLEFEAEEEMQIQKSQWMKGPQCLPPPATPRLEPRGPPAPEVVKQPVYLPSKAGPKAPTACLPPP

SEQ ID NO: 916385 - protein, 1004 aa, Homo sapiens
LCRMSGVLCSRNLFTFKFSLFQLDSGASGEPGHSLGLTLGFSHCGNCQTAVVSAQPEGMASNGAYPALGPGVTANPGTSLSVFTALPFTTPAPGPAHGPLLVTAGAPPGGPLVLSTLPSTPLVTEQDGCGPSGAGASNVFVQMRTEVGPVKAAQAQTLVLTQAPLVWQAPGALCGGVVCPPPLLLAAAPVVPVMAAQVVGGTQACEGGWSQGLPLPPPPPPAAQLPPIVSQGNAGPWPQGAHGEGSLASSQAKAPPDDSCNPRSVYENFRLWQHYKPLARRHLPQSPDTEALSCFLIPVLRSLARRKPTMTLEEGLWRAMREWQHTSNFDRMIFYEMAEKFLEFEAEEEMQIQKSQWMKGPQCLPPPATPRLEPRGPPAPEVVKQPGMASHIPTGAMAKAKGAKGGHCPHTPCFPSRGGFAPSNRTVSRSICSVLTWSSFLATLSPRLSKTPHMLCPGSRDERGEYTAYWWLQTSSQAMLSQMCPSCLLRGRCGSGGPDPAGTHFTSPSPALPCVVPAGGAALTTPRPVTKARRPPPRPHRRAETKARLPPPRPQRPAETKVPEEIPPEVVQEYVDIMEELLGPSLGATGEPEKQREEGEVKQPQEEDWTPPDPGLLSYTDKLCSQKDFVTKVEAVIHPQFLEELLSPDPQMDFLALSQELEQEEGLTLAQVPQGQEGPGTQGPPDCLIPPAGDARLLGEPLWSGKMQLVEKRLLPLKEKQHARAAPSRGTARLDSSSSKFAAGQGAERDVPVPQQGVGMETCPPQTTARDSQGRGRAHTGMARSKDSVVLLGCQDSPGLRAARPTSPPQDHRPTCPGVGTKDALDLPGGSPVRESHGLAQGSSEEEELPSLAFLLGSQHKLLPWWLPQSPVPASGLLSPEKWGPQGTHQFPSAERRGLNLAPSPANKAKKRPLFGSLSPAEKTPHPGPGLRVSGEQSLTWGLGGPSQSQKRKGDPLVSRKEKKQRSGSLGPIPKDGALASDAPKRSKASSPPVLILLGLSFGG

SEQ ID NO: 916386 - protein, 219 aa, Homo sapiens
MEIVICVTISIFHRKVSNHPAGTNTSVTVHWNINILFCPLIVPVLEVLTKALRQDKEIKGIQFGKEKVKLFHFTDNATLFLEKPEDSPKRLFILIYDFSTVTGYKINIQKSFPSRLSVMLKQIVCDAHHILVSLFTFFSNLVGRFSEFTGDFVFTYISICLVTRTGCLGLPKLNGAAKNLCSHNNQKNHAFPMWIISKAEDIGKQLRIASLQLFWMCTG

SEQ ID NO: 916387 - protein, 219 aa, Homo sapiens; identical to SEQ ID NO: 916386

SEQ ID NO: 916388 - protein, 545 aa, Homo sapiens
FSPDPIPRMKVLVLSKPAFMGFDFHPAYHLLMPAGYGSHREVQALCQQKNGRWVFTGIFTAEMFLKLIAMDPYYYFQEGWNIFDGFIVSLSLMELSLADVEGLSVLRSFRLLRVFKLAKSWPTLNMLIKIIGNSVGALGNLTLVLAIIVFIFAVVGMQLFGKSYKECVCKINQDCELPRWHMHDFFHSFLIVFRVLCGEWIETMWDCMEVAGQAMCLIVFMMVMVIGNLVVLNLFLALLLSSFSADNLAATDDDGEMNNLQISVIRIKKGVAWTKLKVHAFMQAHFKQREADEVKPLDELYEKKANCIANHTGADIHRNGDFQKNGNGTTSGIGSSVEKYIIDEDHMSFINNPNLTVRVPIAVGESDFENLNTEDVSSESDPEGSKDKLDDTSSSEGSTIDIKPEVEEVPVEQPEEYLDPDACFTEGCVQRFKCCQVNIEEGLGKSWWILRKTCFLIVEHNWFETFIIFMILLSSGALAFEDIYIEQRKTIRTILEYADKVFTYIFILEMLLKWTAYGFVKFFTNAWCWLDFLIVAVPLNLSGLI

SEQ ID NO: 916389 - protein, 484 aa, Homo sapiens
PPTMRRLPRALLLQLRLALLVAAGAPEVLVSAPRSLVWGPGLQAAVVLPVRYFYLQAVNSEGQNLTRSPAGETPFKVVVKSLSPKELVRIHVPKPLDRNDGTFLMRYRMYETVDEGLKIEVLYGDEHVAQSPYILKGPVYHEYCECPEDPQAWQKTLSCPTKEPQIAKDFASFPSINLQQMLKEVPKRFGDERGAIVHYTILNNHVYRRSLGKYTDFKMFSDEILLSLTRKVLLPDLEFYVNLGDWPLEHRKVNGTPSPIPIISWCGSLDSRDVVLPTYDITHSMLEAMRGVTNDLLSIQGNTGPSWINKTERAFFRGRDSREERLQLVQLSKENPQLLDAGITGYFFFQEKEKELGKAKLMGFFDFFKYKYQVNVDGTVAAYRYPYLMLGDSLVLKQDSPYYEHFYMALEPWKHYVPIKRNLSDLLEKVKWAKENDEEAKKIAKEGQLMARDLLQPHRLYCYYYQVLQVHCQLEGNCYKQLFG

SEQ ID NO: 916390 - protein, 159 aa, Homo sapiens
MSVRKRTNCATRTRVGRRAGQGTEGEANRSQAPLDLTASPKSAAVGSDGGGSRVMGSERGCKSSGGSSSPQLGNLLFVYKSSEFNNSSSMCPKQFSGRKDLGRTQQHSHQQAWVCRACSQSKAIQKWLALGSGVDQWARGEPWERVCAVFTVKTLLVHT

SEQ ID NO: 916391 - protein, 167 aa, Homo sapiens
MLDKLTSMFAPCPSTSPHNIDKTEENFSLIYDTKSLFAVHHITPEEAKYKLCKVRKIFLGTKGIPHLVTHDGRTIRYTDPLIKVNDTIQIDLETGKITDFIKFDTGHLCMVTGGANLGRIGVITNRERHPGSFDIVHMEDANGNSFATQLSNIFVIGKGNKLWISLP

SEQ ID NO: 916392 - protein, 149 aa, Homo sapiens
LLTTATNITMLKGTIISPLDYRSSLLTVGILISSQCKIMALLFSKLPDSFPLARAKAKVSGVAKSSCIIYVLLFCPSGGLPCFALPCSLRFSHIGLVAVPHTHRACPATHALPVAPVGSFAWSTLPQECPPCLQVFAKCCLLCFIYLFI

SEQ ID NO: 916393 - protein, 149 aa, Homo sapiens; identical to SEQ ID NO: 916392

SEQ ID NO: 916394 - protein, 149 aa, Homo sapiens; identical to SEQ ID NO: 916392

SEQ ID NO: 916395 - protein, 277 aa, Homo sapiens
MADGLIPKGCVQGPKVQAASTVTGNHAGTSVNSDPTASTVTGDHAGTGVNPDSTASTVTGDHAGTGVNSDPTASTVTGDHAGTGVNPDSTASTVTGDHAGTGVNPDSTASTVTGDHAGTGVNSDPTASTVTGDHAGTGVNPDSTASTVTGDHAGTGVNPDSTASTVTGDHAGTGVNPDPTASTVTGDHAGTGVNPDSTASTVTGDHAGTGVNPDSTASTVTGDHAGTGVNPDSTASTVTGDHTGTGVNSDATAPSWAAPATTRTRSAAELEADSGRN

SEQ ID NO: 916396 - protein, 277 aa, Homo sapiens; identical to SEQ ID NO: 916395

SEQ ID NO: 916397 - protein, 173 aa, Homo sapiens
MVQTIYQPTGHKLVNSPAKLVCAVRNTSIPRTTGWGIGAALLQGQNAGHLVQNPGHPSIALDSDSPYYCSKLDMRNHSYLNVTTCALARILAILGTLTTNMNSPGLAGIGPKILGYGQQVLFVTSMELGQNCHDKHSVLICQNTSPIVMVVKRTSGERVTRITGNMCLMWAML

SEQ ID NO: 916398 - protein, 238 aa, Homo sapiens
ASTLSPLNMMAPLHSSLGNRTGVANPWTMNLSIASSQQEVRGGQESEASSVFTATPHRLHYCRSSSSCQISVALDSQRSANPTVSCAYPSWHSCGATLLPGYRTVKAGHCASTNFQEKHKDKTMKVAEMTVEDDGGPALVEAVAAAKETEVEKMALETMTKEMTADMITIDPMAAEAEVREHRPGGGALAEDLPFSTQNFPDPPPVSNPMATAGEVAAAQGQQALLLLGRQQLLVRRR

SEQ ID NO: 916399 - protein, 163 aa, Homo sapiens
QLVKMCVIMLLNQWHNIVYPLENSLYHVSFIKFKCIAFKIAKAEIVLNCFSECCHFYSIYTHLIHLGCRFHFYASLQPFLFFNTCKKNNKNVHIYYLNIYLASSKNSFSCIPIFVICYTNKSRSSEKRAQNSPEELLQLPHEPIDYVSEEHYCKQIKEDLWEV

SEQ ID NO: 916400 - protein, 115 aa, Homo sapiens
MLYWPIKIVPSPKSALRGEWIRGGNLRQGVRKTDSSNVVIQEPRMVAKGKMCPHPPLPWKASPSHGRSGVEKEPSDFPWISLVTEYSPSNEAGSPIPGSICLLETFTLHSKCSPL

SEQ ID NO: 916401 - protein, 241 aa, Homo sapiens
MEDCCMLPYYTAQSSPAMGMFNTSMGKLQRQLYKGEYTIFRYAPMFESDFIQISKRGEVIDVHNRARMVTMGIVRTSPCLTLPDVMLLARPAAVCDNARCGPATQKRESPPAEILELTRLLPLMFVKITIHNSVKKQLHLKLATGRSFYLQLCPPSDASEDLFVHWENLVYILRPPVEAYSDTRAILAGNTLDSSVLEEVQRSPVGYAMKFCEEKEQFRISRLHMNAEMFGSTYCDYTIEI

SEQ ID NO: 916402 - protein, 163 aa, Homo sapiens
MYFLTYCFPSISSLCYRWEVGTGLQGAGNQLRSQERLQTPEDRVLRETHTDLGPGVTRRELRARDPPAQGRPWKRPRVSGKTLTRTRPPRVERCHRDRRALDATPTQPRTLGLFWAAPAAPGRNSIPFPHPAELPKPCGGSGQELRAAPASVPAPPAPRGQRS

SEQ ID NO: 916403 - protein, 784 aa, Homo sapiens
MSYFAHPEELALEHQPPQAGLPPLALSQLFNPDACGRRVQTVVLYGTVGTGKSTLVRKMVLDWCYGRLPAFELLIPFSCEDVSSVGRAPASMCQLVAQRYTPLKEVLPLMAAAGSHLLFVLHGLEHLNLDFRLAGTGLCSDPEEPQEPAAIIVNLLRKYMLPQASILVTTRPSAIGRIPSKYVGRYGEICGFSDTNLQKLYFQLRLNQPYCGYAVGGSRVSATPAQRDHLVQMLSRNLEGHHQIAAACFLPSYCWLVCATLHFLHAPTPAGQTLTSIYTSFLRLNFSGETLDSTDPSNLSLMAYAARTMGKLAYEGVSSRKTYFSEEDVCGCLEAGIRTEEEFQLLHIFRPDALRFSLAPCEYLAALYIVLGLRKTTLQKVGKEVAELVGLVGEDVSLVLGIMAKLLPLPALPLLFNLIKVVPRVFGRMVGKSREAVAQAMVLEMFREEDYYNDDVLDQMGASILGVEGPRRHPDEPPEDEVFELFPMFMGGLLSAHNRAVLAQLGCPIKNLDALENAQAIKKKLGKLGRQVLPPSELLDHLFFHYEFQNQRFSAEVLSSLRQLNLAGVRMTPVKCTVVAAVLGSGRHALDEVNLASCQLDPAGLRTLLPVFLRARKLGLQLNSLGPEACKDLRDLLLHDQCQITTLRLSNNPLTAAGVAVLMEGLAGNTSVTHLSLLHTGLGDEGLELLAAQLDRNRQLQELNVAYNGAGDTAALALARAAREHPSLELLQGVAIQMCWKLPLLPYAHLWTPRMPSHWCFLLILMPPLPQWYDGLVAPRGRCT

SEQ ID NO: 916404 - protein, 156 aa, Homo sapiens
MSLESLFQHIIFTEHQAEESRRLMREVRSEITRCREKIKKATEELNEEKIKLESKLLKAHENALEKQYSEITNHRNMLLQTFEAIKKQMIEEEDKFIKEITDFNNDYEITKKRELLMKENVKIEISDLENQANMLKSGMNKYHLICLALMKITYFE

SEQ ID NO: 916405 - protein, 412 aa, Homo sapiens
MSLESLFQHIIFTEHQAEESRRLMREVRSEITRCREKIKKATEELNEEKIKLESKVQQFFEKSFFLQLLKAHENALEKQYSEITNHRNMLLQTFEAIKKQMIEEEDKFIKEITDFNNDYEITKKRELLMKENVKIEISDLENQANMLKSEMKSMEHDSSQLNELQKQKSELIQELFTLQRKLKVFEDEENESICTTKYLEAEKIKISEKPQNDTECLSFIIAGLHKRKPVGSTATFNEEEKKEEEEKEEEEEVEEKEEEEGRRGEEEGGEKKEEKRRRRRRRRRRRRRKEKRRRKEVVQICVKLTLYYEILLSFAFKVNISICRYFTLFKMVIWWLSNEADVQFYSGPAFPVWPWAGYLTLMDFSFLIGNKINKMTPILLGCNSCSIILKISTCSVNPDHFNYCWAKTVWNR

SEQ ID NO: 916406 - protein, 168 aa, Homo sapiens
MSLESLFQHIIFTEHQAEESRRLMREVRSEITRCREKIKKATEELNEEKIKLESKVQQFFEKSFFLQLLKAHENALEKQYSEITNHRNMLLQTFEAIKKQMIEEEDKFIKEITDFNNDYEITKKRELLMKENVKIEISDLENQANMLKSGMNKYHLICLALMKITYFE

SEQ ID NO: 916407 - protein, 157 aa, Homo sapiens
MGVMSLERLTRRFIRNIFRDSSDAAPISEWSKPRRSGRREPRHSASPGLVNKPPRRRNGNRTVTWVAANGLFRRVKSGKAKQNAGSKVINWLTSSIFTFLKNFVSEEVVVRPSGPRRDLLRGIPRPQRNAASLAQKFQNFPPSERRSDLALGECPSR

SEQ ID NO: 916408 - protein, 354 aa, Homo sapiens
MPPEWINPRINEYSQKGNWWLYKQRKKDLSQHISKLNSLAMQISALTQGSAESLTNNKTLPRCDPWTMVFSNMRSLDLGLSPHNCVESSKENCKEHKSTERKYSHYFLDWAGTCEANLLLLQDLDPAFVEEDMAMATEYHKGVCSSLMAELAGNLLSRVPEKATHGSISHWWHFTPNHFTPKLPKKECQRNLLASEFCPGEIACSARTQESHICCQCGALDKACISLKAPENPPGAKGSTLEPGEKVQQAPTVRNLGQDRHTCFPAQTSHFPRPPWLSMPPFWAYKNPRPLQADTQVAGRPNEQHIRGRRHKRWSSIGAPQQKDTLTGTRKPPREGEEGAFAFSTGDIDRDPGR

SEQ ID NO: 916409 - protein, 1983 aa, Homo sapiens
AFDFSFLNDEEARKILQVLERNEELQRAEKDRISKLQKTKRDIRWLQGVTGEWFEEIQRKKFCNETDVSQMLKQPLTYRLSKEMAKNDPIELPTSRSKNVTNQKKPTPFSSRMSFRSSFASLFSFRKSGKETSKLPSLGQKGCDGHAGPPMPVRGAAVQAKIYNSPLENHLVDSTFVPKPAVMREESGMPPPWDASLLENEFFQVLDDLDSKLAQEQSASSVNTRTPLNYGSRTQFGHFYSSGNRHGNITERHKKHYNETSNMSIYDILRPGTPREGFKTFSPRTSTIYDMYRTREPRVFKEDYVQKNTFGSTSLCFDSRQRSALPATGHFTARSLHFPATTQSKSGFIPPRHQQSPKRTPLSSIIWNRSDSSRDRENQEEFLRAPSPMEIDPADKYVYPRGFQENKRYESYHSQNVYQRVSLNAPMENAMSPDTFENSENMPFYHQSNTFTRSFFSNTFGRSGEQRRFGQGPFWGQEKGHSFWSDFHRSRKSFSSSDRDFEMISMEANSVSAIHGHNVSSEHWESFSSGYGTDVSRGQEEPHPWQFDFQRSTLDSMVVSHGNETQLTPHFGTPNVCSMTGSSYHVKSSELVSQQDSSPVEVHINKEASSFGIAQTLASSFKTSFSQISDDRRNPQSPNLQNPTVTLQKIFPNKPASHPMRSHTEVTVTSSNSVDSLPLAKSQPNILVTEVNNEKDLNESISEEDKQLSKMDQTNKAGEIPQPVSQTGISNSLPDFQNPLSQDSAKSNGFGFNASTIISSKKSPRVFSRKDTSKMYIPHTDKSNDIKQDKRFTENRKLGSTASLPFIQEHRTPPSFPRTDQGCHQELTVNNEDISRIITNNHWSSALTDTQNAQYSKCKLTPGHKTSCDSLDLSSAALPDSSPSKNSSLDAPVVPSTTVFSRRSPSDKDPSLGEREEKDNAGKNQKNQFIVSHSENQERNDSPVPTHDEVVDVKCHSHSPFRNERGKGKIRHHISCIEKLSKTESISVPTSDHRSLIEANQSNSKVSELDTIYCTLPRKSSSFLIHGRQSGSKIMAASLRNGPPPFQIKNNVEDAMGNYMLNKFSPSSPESANECSKVLSDSALEAPEATERMTNVKSSGSTSVRKGPLPFLINRAMSCPSGEPHASTGREGRKKPLTSGMDASELTPRAWERIISPVESDSSVRDCSLTKRQHQKENFQEYTEKEGKMAASRRSVFALSNEDPLPFCSDLSGKERGKTLHKVKTTSTFSVSGDEDNVKCLEVVSIYYTLPRKPSKKFCNLLQQYTQNTNLLIESPQVETETFPNALEKDKQNYSTREQSGTPSCENLKMSVNSDQTLTTENMTAFRLSNRGPLAPTLQEMASVEAAVSLPEEESKAREIFSDNLAKTPLGDSENKKERGKKLQSETLHTSLMLQRKNVSEEKSENCQQSINSSNSGPSSLPALSEVNIGNSQTRRSSWECTGSGRAIPFTGSGKCPQKDHTSTAVGDGSSGSQPREGRGDIGTNCQKMTNKTLSHSESQVFALTPALHKLQLGEETQSDEPNLESLQSEPRELPQRSQEANMTESRKAEDEMQKSAWDQPSLPEGNKNKTNLDDLVKGENRSSVKHRLAAMSKASRKFPAKDVSPRRHVATIFPQSGSRSGFDHLSLGTVECNPLFPEPTPKSAESIGESRLSENRKHVKKSENLLPITVLPNREPSTHVSNQKSNSISQRHQNEFKNVSESPSKHENSKDVTAAQNLVRESGAPSPITFTSLREAEFSDNQRRLSPPFPLEPAQKSRVSSPLASFLQQQRSASSLEWEPEPHLYRSKSLKSINVHGDLLRKSHPPKVRERHFSESTSIDNALSRLTLGNEFSVNNGYSRRFRSFSELPSCDGNESWAYRSGTKTGPRSAISIYRPIDYGIFGKEQQLAFLENVKRSLTQGRLWKPSFLKNPGFLKDDLRNPPNPSESLSSNSPSSQVPEDGLSPSEPLNIYEDDPVDSDCDTDTTTDDEYYLDENDKESEL

SEQ ID NO: 916410 - protein, 1463 aa, Homo sapiens
KQFFHLSLSSSWDYSKLQKTKRDIRWLQGVTGEWFEEIQRKKFCNETDVSQMLKQPLTYRLSKEMAKNDPIELPTSRSKNVTNQKKPTPFSSRMSFRSSFASLFSFRKSGKETSKLPSLGQKGCDGHAGPPMPVRGAAVQAKIYNSPLENHLVDSTFVPKPAVMREESGMPPPWDASLLENEFFQVLDDLDSKLAQEQSASSVNTRTPLNYGSRTQFGHFYSSGNRHGNITERHKKHYNETSNMSIYDILRPGTPREGFKTFSPRTSTIYDMYRTREPRVFKEDYVQKNTFGSTSLCFDSRQRSALPATGHFTARSLHFPATTQSKSGFIPPRHQQSPKRTPLSSIIWNRSDSSRDRENQEEFLRAPSPMEIDPADKYVYPRGFQENKRYESYHSQNVYQRVSLNAPMENAMSPDTFENSENMPFYHQSNTFTRSFFSNTFGRSGEQRRFGQGPFWGQEKGHSFWSDFHRSRKSFSSSDRDFEMISMEANSVSAIHGHNVSSEHWESFSSGYGTDVSRGQEEPHPWQFDFQRSTLDSMVVSHGNETQLTPHFGTPNVCSMTGSSYHVKSSELVSQQDSSPVEVHINKEASSFGIAQTLASSFKTSFSQISDDRRNPQSPNLQNPTVTLQKIFPNKPASHPMRSHTEVTVTSSNSVDSLPLAKSQPNILVTEVNNEKDLNESISEEDKQLSKMDQTNKAGEIPQPVSQTGISNSLPDFQNPLSQDSAKSNGFGFNASTIISSKKSPRVFSRKDTSKMYIPHTDKSNDIKQDKRFTENRKLGSTASLPFIQEHRTPPSFPRTDQGCHQELTVNNEDISRIITNNHWSSALTDTQNAQYSKCKLTPGHKTSCDSLDLSSAALPDSSPSKNSSLDAPVVPSTTVFSRRSPSDKDPSLGEREEKDNAGKNQKNQFIVSHSENQERNDSPVPTHDEVVDVKCHSHSPFRNERGKGKIRHHISCIEKLSKTESISVPTSDHRSLIEANQSNSKVSELDTIYCTLPRKSSSFLIHGRQSGSKIMAASLRNGPPPFQIKNNVEDAMGNYMLNKFSPSSPESANECSKVLSDSALEAPEATERMTNVKSSGSTSVRKGPLPFLINRAMSCPSGEPHASTGREGRKKPLTSGMDASELTPRAWERIISPVESDSSVRDCSLTKRQHQKENFQEYTEKEGKMAASRRSVFALSNEDPLPFCSDLSGKERGKTLHKVKTTSTFSVSGDEDNVKCLEVVSIYYTLPRKPSKKFCNLLQQYTQNTNLLIESPQVETETFPNALEKDKQNYSTREQSGTPSCENLKMSVNSDQTLTTENMTAFRLSNRGPLAPTLQEMASVEAAVSLPEEESKAREIFSDNLAKTPLGDSENKKERGKKLQSETLHTSLMLQRKNVSEEKSENCQQSINSSNSGPSSLPALSEVNIGNSQTRRSSWECTGSGRAIPFTGSGKCPQKDHTSTAVGDGSSGSPPGLFRILD

SEQ ID NO: 916411 - protein, 1960 aa, Homo sapiens
KQFFHLSLSSSWDYSKLQKTKRDIRWLQGVTGEWFEEIQRKKFCNETDVSQMLKQPLTYRLSKEMAKNDPIELPTSRSKNVTNQKKPTPFSSRMSFRSSFASLFSFRKSGKETSKLPSLGQKGCDGHAGPPMPVRGAAVQAKIYNSPLENHLVDSTFVPKPAVMREESGMPPPWDASLLENEFFQVLDDLDSKLAQEQSASSVNTRTPLNYGSRTQFGHFYSSGNRHGNITERHKKHYNETSNMSIYDILRPGTPREGFKTFSPRTSTIYDMYRTREPRVFKEDYVQKNTFGSTSLCFDSRQRSALPATGHFTARSLHFPATTQSKSGFIPPRHQQSPKRTPLSSIIWNRSDSSRDRENQEEFLRAPSPMEIDPADKYVYPRGFQENKRYESYHSQNVYQRVSLNAPMENAMSPDTFENSENMPFYHQSNTFTRSFFSNTFGRSGEQRRFGQGPFWGQEKGHSFWSDFHRSRKSFSSSDRDFEMISMEANSVSAIHGHNVSSEHWESFSSGYGTDVSRGQEEPHPWQFDFQRSTLDSMVVSHGNETQLTPHFGTPNVCSMTGSSYHVKSSELVSQQDSSPVEVHINKEASSFGIAQTLASSFKTSFSQISDDRRNPQSPNLQNPTVTLQKIFPNKPASHPMRSHTEVTVTSSNSVDSLPLAKSQPNILVTEVNNEKDLNESISEEDKQLSKMDQTNKAGEIPQPVSQTGISNSLPDFQNPLSQDSAKSNGFGFNASTIISSKKSPRVFSRKDTSKMYIPHTDKSNDIKQDKRFTENRKLGSTASLPFIQEHRTPPSFPRTDQGCHQELTVNNEDISRIITNNHWSSALTDTQNAQYSKCKLTPGHKTSCDSLDLSSAALPDSSPSKNSSLDAPVVPSTTVFSRRSPSDKDPSLGEREEKDNAGKNQKNQFIVSHSENQERNDSPVPTHDEVVDVKCHSHSPFRNERGKGKIRHHISCIEKLSKTESISVPTSDHRSLIEANQSNSKVSELDTIYCTLPRKSSSFLIHGRQSGSKIMAASLRNGPPPFQIKNNVEDAMGNYMLNKFSPSSPESANECSKVLSDSALEAPEATERMTNVKSSGSTSVRKGPLPFLINRAMSCPSGEPHASTGREGRKKPLTSGMDASELTPRAWERIISPVESDSSVRDCSLTKRQHQKENFQEYTEKEGKMAASRRSVFALSNEDPLPFCSDLSGKERGKTLHKVKTTSTFSVSGDEDNVKCLEVVSIYYTLPRKPSKKFCNLLQQYTQNTNLLIESPQVETETFPNALEKDKQNYSTREQSGTPSCENLKMSVNSDQTLTTENMTAFRLSNRGPLAPTLQEMASVEAAVSLPEEESKAREIFSDNLAKTPLGDSENKKERGKKLQSETLHTSLMLQRKNVSEEKSENCQQSINSSNSGPSSLPALSEVNIGNSQTRRSSWECTGSGRAIPFTGSGKCPQKDHTSTAVGDGSSGSQPREGRGDIGTNCQKMTNKTLSHSESQVFALTPALHKLQLGEETQSDEPNLESLQSEPRELPQRSQEANMTESRKAEDEMQKSAWDQPSLPEGNKNKTNLDDLVKGENRSSVKHRLAAMSKASRKFPAKDVSPRRHVATIFPQSGSRSGFDHLSLGTVECNPLFPEPTPKSAESIGESRLSENRKHVKKSENLLPITVLPNREPSTHVSNQKSNSISQRHQNEFKNVSESPSKHENSKDVTAAQNLVRESGAPSPITFTSLREAEFSDNQRRLSPPFPLEPAQKSRVSSPLASFLQQQRSASSLEWEPEPHLYRSKSLKSINVHGDLLRKSHPPKVRERHFSESTSIDNALSRLTLGNEFSVNNGYSRRFRSFSELPSCDGNESWAYRSGTKTGPRCQKMAYLQVNRLISMRMTQWTQIVTQTQPQMMNTTWMKMTKSQNSEIPGPILKTMPQNWTCQGGCCLCYDQEDAESRHQVGRYPESLPSFGPEIAPIEIKTLKLSNFQCH

SEQ ID NO: 916412 - protein, 154 aa, Homo sapiens
MALHTHTECKSVTQPENVYPPMSTRIAPRKGQKTNSHGHPQGTQSPRPPRPLLKAYLQIRQQAVIYLYFGRHKKKCLAWDVNHTSYATKDMFCWCLRNLPNVQNSIFIRAQKWEKCKCLSNGEWIQNMVYHTMECRSIIKSSKVQEYITMQTSR

SEQ ID NO: 916413 - protein, 394 aa, Homo sapiens
KPDDKEQSKEMNNKLAEAKESLAQPVSDSSKTQGPVATEPDKDQGSVVPGLLKGQGPMVQEPLKKQGSVVPGPPKDLGPMIPLPVKDQDHTVPEPLKNESPVISAPVKDQGPSVPVPPKNQSPMVPAKVKDQGSVVPESLKDQGPRIPEPVKNQAPMVPAPVKDEGPMVSASVKDQGPMVSAPVKDQGPIVPAPVKGEGPIVPAPVKDEGPMVSAPIKDQDPMVPEHPKDESAMATAPIKNQGSMVSEPVKNQGLVVSGPVKDQDVVVPEHAKVHDSAVVAPVKNQGPVVPESVKNQDPILPVLVKDQGPTVLQPPKNQGRIVPEPLKNQVPIVPVPLKDQDPLVPVPAKDQGPAVPEPLKTQGPRDPQLPTVSPLPRVMIPTAPHTEYIESSP

SEQ ID NO: 916414 - protein, 394 aa, Homo sapiens; identical to SEQ ID NO: 916413

SEQ ID NO: 916415 - protein, 337 aa, Homo sapiens [sequence omitted]

SEQ ID NO: 916416 - protein, 389 aa, Homo sapiens
KPDDKEQSKEMNNKLAEAKESLAQPVSDSSKTQGPVATEPDKDQGSVVPGLLKGQGPMVQEPLKKQGSVVPGPPKDLGPMIPLPVKDQDHTVPEPLKNESPVISAPVKDQGPSVPVPPKNQSPMVPAKVKDQGSVVPESLKDQGPRIPEPVKNQAPMVPAPVKDEGPMVSASVKDQGPMVSAPVKDQGPIVPAPVKGEGPIVPAPVKDEGPMVSAPIKDQDPMVPEHPKDESAMATAPIKNQGSMVSEPVKNQGLVVSGPVKDQDVVVPEHAKVHDSAVVAPVKNQGPVVPESVKNQDPILPVLVKDQGPTVLQPPKNQGRIVPEPLKNQVPIVPVPLKDQDPLVPVPAKDQGPAVPEPLKTQGPRDPQLPTVSPLPRVVGRKGSLESP

SEQ ID NO: 916417 - protein, 191 aa, Homo sapiens
LQPAMPEPPTHSMGSCAARASPTSTTPCSTAPSPNDHPRAEECERTAQDWQAAPPAASVWDPLGEASWAPESGGDLKICKHTNQHPVFSSRFVNAPIDTLSSCSGEALENLCVETLYLTNLMGTWRTFASSSGIVNAPISALTKTGHWALPISRMWVGPDKRIKAGCPSQHWQPTRVSFNAMEALLFCSLQ

SEQ ID NO: 916418 - protein, 267 aa, Homo sapiens
MSNTLHVQKEESYKLLLMCTNESQSCSDYNCRSELGFHGDNVTLTVRHKHVTHIPMEAEEVEPTIKLSLNSKPKLKYGLLLIRVTLPGLYNEMPGRESPAIFFALRVPVWKRNLRTSWWCPIGWDGVGIRMSLSGGDGNLKCQPLNDEWVLKPESGFVKVDRRLGKKVIFSHSNSDKLIGLAQVFGKTTTQGCSVSDSRYWSKLCLSMEMRKPAAPEGHGCCWSHEEEPSAQGDPEGQGISMDELRVLLDSSNPSWTSLCSENPFCC

SEQ ID NO: 916419 - protein, 132 aa, Homo sapiens
SSNRMLVNAEISLESFSHKFKVRSVNKVMHFSSALCRCFSIDIKISKSQFSSELGFSSPGESSDAIQEPRTRAKNLKNYLVSYCAAAELALTLQDAVIATLLSPFHRQRRLTACLPPHRPMESIDGLSSVFT

SEQ ID NO: 916420 - protein, 174 aa, Homo sapiens
MGVKDGKRLALQSLNSLLGSARPINLLSMAWDPSNPGRRERLGSCENLLSQVRFFSKIISGFLLPQLVSGGLFCLTWLRNVLETGQKSVCKSPCVTALESRTENQKTSVEVIGPSGQSTKLKKKVKSPRTDKALAKALFLVGVHMNSEGGSHDVSCLFPLSSLLDSGCLRWAIC

SEQ ID NO: 916421 - protein, 314 aa, Homo sapiens
PTSFSRAMLSALEHRTPSSSVLGLGLALLSPLLADILLWELVIMVSKPLHNRRWDRATTTWDSKKVERLRMGILLEDATSGLPVSIYVNENFFRHRIFKTQGIGANTDSGIGQLWFAGFLEGMQGEGFYRVKKGIKGVDKTVVGDEVVKTAYGTREIERIVCNSLGENDEDLKQYFSSEDGQKVFQNLLLFFPTQPICQAAYQNDFGQVWRWVKEDSSYANVQDGFNGDTPLICACRRGHVRIVSFLLRRNANVNLKNQVSKTKQNEALVRMLLDAGVEVNATDCGMGSRAKPVLIAKVLEIVVYQWFADYFSA

SEQ ID NO: 916422 - protein, 158 aa, Homo sapiens
MGILYSEPICQAAYQNDFGQVWRWVKEDSSYANVQDGFNGDTPLICACRRGHVRIVSFLLRRNANVNLKNQKERTCLHYAVKKKFTFIDYLLIILLMPVLLIGYFLMVSKTKQNEALVRMLLDAGVEVNATDCHGESSLDIARRLKFSQIELMLRKAL

SEQ ID NO: 916423 - protein, 191 aa, Homo sapiens
MGILYSEPICQAAYQNDFGQVWRWVKEDSSYANVQDGFNGDTPLICACRRGHVRIVSFLLRRNANVNLKNQKERTCLHYAVKKKFTFIDYLLIILLMPVLLIGYFLMVSKTKQNEALVRMLLDAGVEVNATDCYGCTALHYACEMKNQSLIPLLLEARADPTIKNKHGESSLDIARRLKFSQIELMLRKAL

SEQ ID NO: 916424 - protein, 833 aa, Homo sapiens
MTSSWQWPELRRWGVERAAPARSSRPDTGITSPAAAQRRPDQTLCTPTSVRPEATAARSASPRDVTRGGTSGRRSLTVQAGAGSPARSRPRPPVVLLRRGEVPEALRSAGPRPPRPRTLPILRPAPSPSEGGAAVLGLCAPGAVAGRGRGGALGWEVSGEARAGVAHLPEPCGVCCLRKVCLVSTSLSPFLSTSSTFLLAGTWMHFTGAVMQENLRFASSGDDIKIWDASSMTLVDKFNPHTSPHGISSICWSSNNNFLVTASSSGDKIVVSSCKCKPVPLLELAEGQKQTCVNLNSTSMYLVSGGLNNTVNIWDLKSKRVHRSLKDHKDQVTCVTYNWNDCYIASGSLSGEIILHSVTTNLSSTPFGHGSNQSVRHLKYSLFKKSLLGSVSDNGIVTLWDVNSQSPYHNFDSVHKAPASGICFSPVNELLFVTIGLDKRIILYDTSSKKEAPATSIATVLPQPMTSAMGKGTVAVQEKAGLPRSINTDTLSKETDSGKNQDFSSFDDTGKSSLGDMFSPIRDAKLVTSGAESGNLNTSPSSNQTRNSEKFEKPENEIEAQLICEPPINGSSTPNPKIASSVTAGVASSLSEKIADSIGNNRQNAPLTSIQIRFIQNMIQETLDDFSRPRDLSAGATLKSLCISALLPAFGVAGACFSLSNLFLAFCASGEVCLSHFQPCRAAAARLVKTYSQCLLVLLPCAACLHLGVASSLQDLGSYSLGYLGRPKLLILPHPARLSQPPGHCFSSVSSPHCGISTYSRRKNREKDMKKHFKEEEWYMNTGKIFNFTINQRTKNAMRYRVTPSKWENIKNLVILSLDDIEQEELCYTGDIH

SEQ ID NO: 916425 - protein, 177 aa, Homo sapiens
MQENLRFASSGDDIKIWDASSMTLVDKFNPHTSPHGISSICWSSNNNFLVTASSSGDKIVVSSCKCKPVPLLELAEGQKQTCVNLNSTSMYLVSGGLNNTVNIWDLKSKRVHRSLKDHKDQVTCVTYNWNDCYIASGSLSGEIILHSVTTNLSSTPFGHGSNQASSSRLHLNTTIKL

SEQ ID NO: 916426 - protein, 534 aa, Homo sapiens
MYLVSGGLNNTVNIWDLKSKRVHRSLKDHKDQVTCVTYNWNDCYIASGSLSGEIILHSVTTNLSSTPFGHGSNQSVRHLKYSLFKKSLLGSVSDNGIVTLWDVNSQSPYHNFDSVHKAPASGICFSPVNELLFVTIGLDKRIILYDTSSKKEAPATSIATVLPQPMTSAMGKGTVAVQEKAGLPRSINTDTLSKETDSGKNQDFSSFDDTGKSSLGDMFSPIRDAKLVTSGAESGNLNTSPSSNQTRNSEKFEKPENEIEAQLICEPPINGSSTPNPKIASSVTAGVASSLSEKIADSIGNNRQNAPLTSIQIRFIQNMIQETLDDFSRPRDLSAGATLKSLCISALLPAFGVAGACFSLSNLFLAFCASGEVCLSHFQPCRAAAARLVKTYSQCLLVLLPCAACLHLGVASSLQDLGSYSLGYLGRPKLLILPHPARLSQPPGHCFSSVSSPHCGISTYSRRKNREKDMKKHFKEEEWYMNTGKIFNFTINQRTKNAMRYRVTPSKWENIKNLVILSLDDIEQEELCYTGDIH

SEQ ID NO: 916427 - protein, 725 aa, Homo sapiens
MTSSWQWPELRRWGVERAAPARSSRPDTGITSPAAAQRRPDQTLCTPTSVRPEATAARSASPRDVTRGGTSGRRSLTVQAGAGSPARSRPRPPVVLLRRGAVMQENLRFASSGDDIKIWDASSMTLVDKFNPHTSPHGISSICWSSNNNFLVTASSSGDKIVVSSCKCKPVPLLELAEGQKQTCVNLNSTSMYLVSGGLNNTVNIWDLKSKRVHRSLKDHKDQVTCVTYNWNDCYIASGSLSGEIILHSVTTNLSSTPFGHGSNQSVRHLKYSLFKKSLLGSVSDNGIVTLWDVNSQSPYHNFDSVHKAPASGICFSPVNELLFVTIGLDKRIILYDTSSKKEAPATSIATVLPQPMTSAMGKGTVAVQEKAGLPRSINTDTLSKETDSGKNQDFSSFDDTGKSSLGDMFSPIRDAKLVTSGAESGNLNTSPSSNQTRNSEKFEKPENEIEAQLICEPPINGSSTPNPKIASSVTAGVASSLSEKIADSIGNNRQNAPLTSIQIRFIQNMIQETLDDFSRPRDLSAGATLKSLCISALLPAFGVAGACFSLSNLFLAFCASGEVCLSHFQPCRAAAARLVKTYSQCLLVLLPCAACLHLGVASSLQDLGSYSLGYLGRPKLLILPHPARLSQPPGHCFSSVSSPHCGISTYSRRKNREKDMKKHFKEEEWYMNTGKIFNFTINQRTKNAMRYRVTPSKWENIKNLVILSLDDIEQEELCYTGDIH

SEQ ID NO: 916428 - protein, 623 aa, Homo sapiens
MQENLRFASSGDDIKIWDASSMTLVDKFNPHTSPHGISSICWSSNNNFLVTASSSGDKIVVSSCKCKPVPLLELAEGQKQTCVNLNSTSMYLVSGGLNNTVNIWDLKSKRVHRSLKDHKDQVTCVTYNWNDCYIASGSLSGEIILHSVTTNLSSTPFGHGSNQSVRHLKYSLFKKSLLGSVSDNGIVTLWDVNSQSPYHNFDSVHKAPASGICFSPVNELLFVTIGLDKRIILYDTSSKKEAPATSIATVLPQPMTSAMGKGTVAVQEKAGLPRSINTDTLSKETDSGKNQDFSSFDDTGKSSLGDMFSPIRDAKLVTSGAESGNLNTSPSSNQTRNSEKFEKPENEIEAQLICEPPINGSSTPNPKIASSVTAGVASSLSEKIADSIGNNRQNAPLTSIQIRFIQNMIQETLDDFSRPRDLSAGATLKSLCISALLPAFGVAGACFSLSNLFLAFCASGEVCLSHFQPCRAAAARLVKTYSQCLLVLLPCAACLHLGVASSLQDLGSYSLGYLGRPKLLILPHPARLSQPPGHCFSSVSSPHCGISTYSRRKNREKDMKKHFKEEEWYMNTGKIFNFTINQRTKNAMRYRVTPSKWENIKNLVILSLDDIEQEELCYTGDIH

SEQ ID NO: 916429 - protein, 623 aa, Homo sapiens; identical to SEQ ID NO: 916428

SEQ ID NO: 916430 - protein, 534 aa, Homo sapiens; identical to SEQ ID NO: 916426

SEQ ID NO: 916431 - protein, 154 aa, Homo sapiens
MEPSKTFMRNLPITPGYSGFVPFLSCQGMSKEDDMNHCVKTFQEKTQRYKEQLRELCCAVATAPKLKPVNSEETVLQALHQYNLQYHPLILECKYVKKPLQEPPIPGWAGYLPRAKVTEFGCGTRYTVMAKNCYKDFLEITERAKKAHLKPYEE

SEQ ID NO: 916432 - protein, 154 aa, Homo sapiens; identical to SEQ ID NO: 916431

SEQ ID NO: 916433 - protein, 234 aa, Homo sapiens
MEPSKTFMRNLPITPGYSGFVPFLSCQGMSKEDDMNHCVKTFQEKTQRYKEQLRELCCAVATAPKLKPVNSEETVLQALHQYNLQYHPLILECKYVKKPLQEPPIPGWAGYLPRAKVTEFGCGTRYTVMAKNCYKDFLEITERAKKAHLKPYEEIYGVSSTKTSAPSPKVLQHEELLPKYPDFSIPDGSCPALGRPLREDPKTPLTCGCAQRPSIPCSGKMYLEPLSSAKYAEG

SEQ ID NO: 916434 - protein, 192 aa, Homo sapiens
MDGILSGVGFCLVFSAAGTPMPLNWMELAVSGDTDVNMTNNVHALSNTFIFNCLNLTVKQSENMSKNQKAKNKECNFSLRDYLGMERVASPRGQANEEGTPRASFTGKGAAGEKSTNISLAYWKSAYAVSQTGAWLASERGNNMSSDLEGTLINLTKMNFTRKPKDLCLAYINVWEREFQENVSANIACRNK

SEQ ID NO: 916435 - protein, 144 aa, Homo sapiens
TAATWAHMNPWELWIARLPSKTVMICRPHFRDTSQDPLTWNSSKPLVAALHLSEGAPRVRGGCHLSCFSVLAIVAFGALGSPRRPGNEALPSTVQQFYREAARLIFRASPLCCFSLLGRISKPRTTTTPIDVFRQANRITYAYD

SEQ ID NO: 916436 - protein, 78 aa, Homo sapiens
AAVCFLIPDMLAGCGGARVPGAETEGRRDGGGGGGSSSSSSSSSGCLDSREGDARVKEKSYKTVSAPKVLQSIGEANT

SEQ ID NO: 916437 - protein, 143 aa, Homo sapiens
MHIALNTLLSTLHILTNLTFITTMKQMAGKVLLLGVSVRVLSAEIDSRVGGLEEEDPPSMPTRGNLPLTPVHKAYQRQFAFSQQGQQCLAHRDFDHFSLPQDITLVHCISDTMLIGPNARVKEKSYKTVSAPKVLQSIGEANT

SEQ ID NO: 916438 - protein, 142 aa, Homo sapiens
MQLSGLEVALAGTLWSPKAGSLTETASPGDLTTVRTWGHGGWLLDRTPPLRLCFLFFLAEEPSSGRYVKELPMRSERLLRTPRSSGLHQALGNSALSFTFCLSSAERREIWTWTHREDSHVETEAEVDLLPQNHRAPSTVGH

SEQ ID NO: 916439 - protein, 125 aa, Homo sapiens
MGYETIRMNILYTLNCVGYLYFLKFVYTYGYFLKFVYIYEYKYNFVIYCIVMKSRHLVYTSLNEEQAKARSWKILASGRITESRLERGEKKVKRGLTNQEKMNGITKWKNLSKEHNLKFPAAHFL

SEQ ID NO: 916440 - protein, 125 aa, Homo sapiens; identical to SEQ ID NO: 916439

SEQ ID NO: 916441 - protein, 137 aa, Homo sapiens
EIPMDGMNTREINWIQMTNIRKLHNGKPLQAPSKKPHYRSSFWILSHRGYQNPVNEDCILTQSSKKIIALFSVLGIEKKRLSIIPPLSLVVKVLLPEKLCSQSANNQLVKGDNDLKQSSNRGGGEKQSASECRIKSH

SEQ ID NO: 916442 - protein, 493 aa, Homo sapiens
WYNPPERSHFGMSGFQLLADGGVGGEWVGEIRSCWVESPTGETLLCKPHQYFHQIELLDAKIPWAPEVVMLLWAATLGKEYIPPSEEEEDGKKKFDKESEKYYSILEKHLNLSAKKKESHLQEADTQIDREHQNFYEASLEYVFKIQEVQEKKKFEFVEPKFQLGITILGLYRIGGVNSKVQKLMNTTFSPKSPPDIDIDIELWDNKTITSGLKNYLRCLAEPLMTYKLHKDFIIAVSDSYSSSPDSTPMGSIESLSSHSSEQNSTTKSASCQPREKSGGIPWIATPSSSNGQKSLGLWTTSPESSSREDATKTDAESDCQSVASVTSPGDVSPPIDLVKKEPYGLSGLKRASASSLRSISAAEGNKSYSGSIQSLTSVGSKETPKASPNPDLPPKMCRRLRLDTASSNGYQRPGSVVAAKAQLFENVGSPKPVSSGRQAKAMYSCKAEHSHELSFPQGAIFSNVYPSVEPGWLKATYEGKTGLVPENYVVFL

SEQ ID NO: 916443 - protein, 493 aa, Homo sapiens; identical to SEQ ID NO: 916442

SEQ ID NO: 916444 - protein, 493 aa, Homo sapiens; identical to SEQ ID NO: 916442

SEQ ID NO: 916445 - protein, 189 aa, Homo sapiens
MRPPHDVPLLTPPHHASTDNVLLTTPPSRRPRHHAPPSRRPPQDTPLTTSPSRRPPHTTAPLGSLTFNPPGFLFDLCFPSKLSRLWNKRVAEQRKASGMGCFADATHHVFPALRGLFVPILPPLDSGHAWLHCLLVCIETCGTEAAGRRWWGPSQRPQFRPLRPQERMWHKEANHAVLLGAVTGKTDVP

SEQ ID NO: 916446 - protein, 265 aa, Homo sapiens
QGWAWQLTPVIPVLREARSGASRKGGLQQASLSWAPRHCRGDASYLDHHLCPLHCTSPPPAPSSKGEASQGPGRKRPPGVLRSIFVPKAAPSRLAAASVSPACALVSVMRRHSTGTGVQHMESQMGFLPGLKGRSLLGTAIGSFSKPPRDVSVGVSATHPCLRDLPEHRAGPGVCSSDSTQGMRIGPHFEEDWTVTCLSQRKEGQAGVEARSRDKASLLPASHRVVQGLPQSSQCTPTLPPDQLGQTPREPSTPALQFSQVVLSH

SEQ ID NO: 916447 - protein, 246 aa, Homo sapiens
MKLFGFGSRRGQTVLGSIHHVYTGSGYRIRDSELQKIHKAAVRGDATEVERCLARRSGDLDALGKQQRTALHLACASGHVKVVTLLVSRKCQIDICDKENRTPLIQAVHCQEEACAVILLEHGANPNLKDIYRNTALHYATYSESTSLAEKLLSHDADIEALDKKYAGHLEIRTALMLAVHYDSPGIVNILLKQNINVFTQDVWTRCRRLHYFSLFDKAEDLKIGDFCGALQKWNLEVGAHRKTDT

SEQ ID NO: 916448 - protein, 212 aa, Homo sapiens
RPLQLCRTLAKAEEAERASAVSTAVQWVNSTITHELQGMAPSDQAEVDHLLRIFFASKVQEDKGRKELEKSLEYSTVPTPLPPVPPPPPPPPPTKKKGQKPGRKDTITEKPIAPAEPVEPVLSGSMAIGAVSLAVAKACAMLLNKPLYLNIALLKHNQEQPTTLSMPLLMVSLVSCGKSSSGKLNLMKEVICIPHPELTTKQVPYIILNYLF

SEQ ID NO: 916449 - protein, 209 aa, Homo sapiens
MHVPWRQPMMQACTFRARRKLLSLSWMTMTTESCNFSSKWTWLWEPSASWPVTKTKPLMPSSLPCSGDNSRSLAGCSPGRTGQGRPLRRWQGLNAEHKEGSKAPLLIWFSVSWNSVLSLGLELGKREVKKRKIFNYYWACFRLDPRLTAFAARSRNCLVTSCSHVPRKNMNNHSFSFLGLSSLFCLFVFVCFFRDRVSSLLPRLECRGA

SEQ ID NO: 916450 - protein, 135 aa, Homo sapiens
MIAISPSDLVAGGASGLDSIERRESVPPPSDSASIEQGLFRAQYATSRQGKSRYCSQVTIQHPDGLNGMPNTAISNIKKPGRPGDGVRSDSKGGTGLDVLVTSQPIPTLCPLHPTVRVRNELLFEPPLRLCVASV

SEQ ID NO: 916451 - protein, 144 aa, Homo sapiens
MCCNYYGNSCGYGSSYGCGYGSGYGYGYGSSYGCGYGTGYSCGYGCGYGSGYGCGYGSSYGCGYGTGYSCGYGSGYSCGYGSGSGCGYGTGFGCGYGCGYGTGYGCGCGSGSGYCLCKYTVKSAWQTSLPYDTFLKFSEHIPVV

SEQ ID NO: 916452 - protein, 165 aa, Homo sapiens
ALLGMHTMASWERAWRCCPYPGLTARWYIWKATGWGLLTHSYPGYRCVLVWRLQSLGHHGKLEKICKQMTKVCMELGTGEVTVKSQLNLSCDFSWHSDFDQCLQILWALVSLFLCPHHETMPRLVCWKEVRGTRKRATFSQGHSRPVVPCHFTNWPQHKVLLKIE

SEQ ID NO: 916453 - protein, 152 aa, Homo sapiens
MESCSCRTRWWSAMVLSFLVVEGRPLHCRMLSSIPGPDPLDTSSNVPVETIKKSLQTLPDVPWGNTEGRIMCNEDGGENDPLLAQVQDPMSLKHKKQRDSRGTQPHETRAAARRKGCLSGMREKTDEQGAHLPTYDAAVITYNAVSVSMQLV

SEQ ID NO: 916454 - protein, 273 aa, Homo sapiens
MGGGAPYTGLFLLPVTLSLEVSVGKATDIYAVNGTEILLPCTFSSCFGFEDLHFRWTYNSSDAFKILIEGTVKNEKSDPKVTLKDDDRITLVGSTKEKMNNISIVLRDLEFSDTGKYTCHVKNPKENNLQHHATIFLQVVDRLEEVDNTVTLIILAVVGGVIGLLILILLIKKLIIFILKKTREKKKECLVSSSGNDNTENGLPGSKAEEKPPSKVRRISFGRCPCQLCFLQPSAIETVRCTSALNGFTTRVPHAATFLSSGITDLCCLMPCV

SEQ ID NO: 916455 - protein, 64 aa, Homo sapiens
GENRTMPGAGDGGKAPARWLGTGLLGLFLLPVTLSLEVSVGKATDIYAVGLVGDCRASRGGTEL

SEQ ID NO: 916456 - protein, 138 aa, Homo sapiens
MLERGSPHSYYVTPNDVTAGNGKEDINYQRQIFSPNSAKASDEARLPLFSGYTKVTNSPKNMVSEKLNVDSLAPSVSVKDIDEAGNHHSQQTNTETENQTVHVLTHKWDLNNENTWTQGGEHHTPGPVWGVGLGEGQH

SEQ ID NO: 916457 - protein, 491 aa, Homo sapiens
RRGRSINAMRRLQERMGRLRSGRGLDGAVDMGARGAAACDLVQRFVREAQSQGAQVFQAGDVPSERPFYPPTLVSNLPPASPCAQVEVPWPVVVASPFRTAKEALLVANGTPRGGSASVWSERLGQALELGYGLQVGTVWINAHGLRDPSVPTGGCKESGCSWHGGPDGLYEYLRPSGTPARLSCLSKNLNYDTFGLAVPSTLPAGPEIGPSPAPPYGLFVGGRFQAPGARSSRPIRDSSGNLHGYVAEGGAKDIRGAVEAAHQAFPGWAGQSPGARAALLWALAAALERRKSTLASRLERQGAELKAAEAEVELSARRLRAWGARVQAQGHTLQVAGLRGPVLRLREPLGVLAVVCPDEWPLLAFVSLLAPALAYGNTVVMVPSAACPLLALEVCQDMATVFPAGLANVVTGDRDHLTRCLALHQDVQAMWYFGSAQGSQFVEWASAGNLKPVWASRGCPRAWDQEAEGAGPELGLRVARTKALWLPMGD

SEQ ID NO: 916458 - protein, 363 aa, Homo sapiens
MELEATNIVVRAVLLFPRTTGQPLSTRRRAPIEGILPSSSVLLQLDKDKKFEYSPSKVHLIGHSLGAHLAGEAGSRIPGLGRITGLDPAGPFFHNTPKEVRLDPSDANFVDVIHTNAARILFELGVGTIDACGHLDFYPNGGKHMPGCEDLITPLLKFNFNAYKKEMASFFDCNHARSYQFYAESILNPDAFIAYPCRSYTSFKAGNCFFCSKEGCPTMGHFADRFHFKNMKTNGSHYFLNTGSLSPFARWRHKLSVKLSGSEVTQGTVFLRVGGAIGKTGEFAIVSGKLEPGMTYTKLIDADVNVGNITSVQFIWKKHLFEDSQNKLGAEMVINTSGKYGYKSTFCSQDIMGPNILQNLKPC

SEQ ID NO: 916459 - protein, 363 aa, Homo sapiens; identical to SEQ ID NO: 916458

SEQ ID NO: 916460 - protein, 149 aa, Homo sapiens
RLNEIMCVNEICTPQTKQLCGENLPISLDIHSHAAGSVFCSHFHRPKSYTVIQLLVLQLHVTKRSELAQSVIGVFLQAIPYPGSTCMACEPYKYIPPIPSQSQIPPKCSPDPPRSQSRKGEKCDNELQLCRIRTTWNLSGLASQPISEL

SEQ ID NO: 916461 - protein, 437 aa, Homo sapiens
MRKEWSLMLYNSLICIIPFGLMTASIRRYHTCATDGEPDSSVLVGGDGDLTLLVAALGLDLGLTLSLLPCRDPTPGLTLSLLPHRPFMLLPPLMEWMRVAITYAEHRRSLTVDSGDIRQAARLLLPGLDCEPRQLKPEHCFSSFRRLDARAATEKFNQDLGFRMLNCGRTDLINQAIEALGPDGVNTMDDQGMTPLMYACAAGDEAMVQMLIDAGANLDIQVPSNSPRHPSIHPDSRHWTSLTFAVLHGHISVVQLLLDAGAHVEGSAVNGGEDSYAETPLQLASAAGNYELVSLLLSRGADPLLSMLEAHGMGSSLHEDMNCFSHSAAHGHRNVLRKLLTQPQQAKADVLSLEEILAEGVEESDASSQGSGSEGPVRLSRTRTKALQEAMYYSAEHGYVDITMELRALGEASRACTPMSMHAYGHTRSLPAALQQA

SEQ ID NO: 916462 - protein, 152 aa, Homo sapiens
MGREDPPLFHKEGRRLNPREVRPENRAWAWFSQLWPRAASTRRAKTFHTKWERTAIEACVTAANRRIPIPGRCFQLEGSAHTKEQVPRSWVRHVQRNKYQEALCPENRESLVWERKTEREFERSDVGARCREEKKIWALEAGRLTQNDRHSF

SEQ ID NO: 916463 - protein, 143 aa, Homo sapiens
STWKVWMGVFFVWTDSTDCMPSPSGGDAQHAGHAQSFQRRRTARRARPVLPEGTHSTPGTPSPSGGDAQHAGHAQSFRRGRTARRARPVLPEETHSMPGMSRPLFFGTNHLEKELEWSPSVVLHCFRKMHGSAGHTGLSRSQP

SEQ ID NO: 916464 - protein, 522 aa, Homo sapiens
MQAVVKPSPSVLTAVHGEQLLPSARLAPSTLLTLISGCHCVSPPATTPGGGYAPLPPQHASLRLTLGGTQQVERHDMNTLSLPLNIRRGGSDTNLNFDVPDGILDFHKVKLTADSLKQKILKVTEQIKIEQTSRDGNVAEYLKLVNNADKQQAGRIKQVFEKKNQKSAHSIAQLQKKLEQYHRKLREIEQNGASRSSKDISKDHLKDIHRSLKDAHVKSRTAPHCMESSKSGMPGVSLTPPVFVFNKSREFANLIRNKFGSADNIAHLKNSLEEFRPEASARAYGGSATIVNKPKYGSDDECSSGTSGSADSNGNQSFGAGGASTLDSQGKLAVILEELREIKDTQAQLAEDIEALKVQFKREYGFISQTLQEERYRYERLEDQLHDLTDLHQHETANLKQELASIEEKVAYQAYERSRDIQEALESCQTRISKLELHQQEQQALQTDTVNAKVLLGRCINVILAFMTVILVCVSTIAKFVSPMMKSRCHILGTFFAVTLLAIFCKNWDHILCAIERMIIPR

SEQ ID NO: 916465 - protein, 477 aa, Homo sapiens
MPGSDTALTVDRTYSDPGRHHRCKSRVERHDMNTLSLPLNIRRGGSDTNLNFDVPDGILDFHKVKLTADSLKQKILKVTEQIKIEQTSRDGNVAEYLKLVNNADKQQAGRIKQVFEKKNQKSAHSIAQLQKKLEQYHRKLREIEQNGASRSSKDISKDHLKDIHRSLKDAHVKSRTAPHCMESSKSGMPGVSLTPPVFVFNKSREFANLIRNKFGSADNIAHLKNSLEEFRPEASARAYGGSATIVNKPKYGSDDECSSGTSGSADSNGNQSFGAGGASTLDSQGKLAVILEELREIKDTQAQLAEDIEALKVQFKREYGFISQTLQEERYRYERLEDQLHDLTDLHQHETANLKQELASIEEKVAYQAYERSRDIQEALESCQTRISKLELHQQEQQALQTDTVNAKVLLGRCINVILAFMTVILVCVSTIAKFVSPMMKSRCHILGTFFAVTLLAIFCKNWDHILCAIERMIIPR

SEQ ID NO: 916466 - protein, 395 aa, Homo sapiens
TLARYPVLKNVAEYLKLVNNADKQQAGRIKQVFEKKNQKSAHSIAQLQKKLEQYHRKLREIEQNGASRSSKDISKDHLKDIHRSLKDAHVKSRTAPHCMESSKSGMPGVSLTPPVFVFNKSREFANLIRNKFGSADNIAHLKNSLEEFRPEASARAYGGSATIVNKPKYGSDDECSSGTSGSADSNGNQSFGAGGASTLDSQGKLAVILEELREIKDTQAQLAEDIEALKVQFKREYGFISQTLQEERYRYERLEDQLHDLTDLHQHETANLKQELASIEEKVAYQAYERSRDIQEALESCQTRISKLELHQQEQQALQTDTVNAKVLLGRCINVILAFMTVILVCVSTIAKFVSPMMKSRCHILGTFFAVTLLAIFCKNWDHILCAIERMIIPR

SEQ ID NO: 916467 - protein, 477 aa, Homo sapiens; identical to SEQ ID NO: 916465

SEQ ID NO: 916468 - protein, 477 aa, Homo sapiens; identical to SEQ ID NO: 916465

SEQ ID NO: 916469 - protein, 446 aa, Homo sapiens
MNTLSLPLNIRRGGSDTNLNFDVPDGILDFHKVKLTADSLKQKILKVTEQIKIEQTSRDGNVAEYLKLVNNADKQQAGRIKQVFEKKNQKSAHSIAQLQKKLEQYHRKLREIEQNGASRSSKDISKDHLKDIHRSLKDAHVKSRTAPHCMESSKSGMPGVSLTPPVFVFNKSREFANLIRNKFGSADNIAHLKNSLEEFRPEASARAYGGSATIVNKPKYGSDDECSSGTSGSADSNGNQSFGAGGASTLDSQGKLAVILEELREIKDTQAQLAEDIEALKVQFKREYGFISQTLQEERYRYERLEDQLHDLTDLHQHETANLKQELASIEEKVAYQAYERSRDIQEALESCQTRISKLELHQQEQQALQTDTVNAKVLLGRCINVILAFMTVILVCVSTIAKFVSPMMKSRCHILGTFFAVTLLAIFCKNWDHILCAIERMIIPR

SEQ ID NO: 916470 - protein, 440 aa, Homo sapiens
GDLEDPKSLMGILNFDVPDGILDFHKVKLTADSLKQKILKVTEQIKIEQTSRDGNVAEYLKLVNNADKQQAGRIKQVFEKKNQKSAHSIAQLQKKLEQYHRKLREIEQNGASRSSKDISKDHLKDIHRSLKDAHVKSRTAPHCMESSKSGMPGVSLTPPVFVFNKSREFANLIRNKFGSADNIAHLKNSLEEFRPEASARAYGGSATIVNKPKYGSDDECSSGTSGSADSNGNQSFGAGGASTLDSQGKLAVILEELREIKDTQAQLAEDIEALKVQFKREYGFISQTLQEERYRYERLEDQLHDLTDLHQHETANLKQELASIEEKVAYQAYERSRDIQEALESCQTRISKLELHQQEQQALQTDTVNAKVLLGRCINVILAFMTVILVCVSTIAKFVSPMMKSRCHILGTFFAVTLLAIFCKNWDHILCAIERMIIPR

SEQ ID NO: 916471 - protein, 477 aa, Homo sapiens; identical to SEQ ID NO: 916465

SEQ ID NO: 916472 - protein, 358 aa, Homo sapiens
MPGSDTALTVDRTYSDPGRHHRCKSRVERHDMNTLSLPLNIRRGGSDTNLNFDVPDGILDFHKVKLTADSLKQKILKVTEQIKIEQTSRDGNVAEYLKLVNNADKQQAGRIKQVFEKKNQKSAHSIAQLQKKLEQYHRKLREIEQNGASRSSKDISKDHLKDIHRSLKDAHVKSRTAPHCMESSKSGMPGVSLTPPVFVFNKSREFANLIRNKFGSADNIAHLKNSLEEFRPEASARAYGGSATIVNKPKYGSDDECSSGTSGSADSNGNQSFGAGGASTLDSQGKLAVILEELREIKDTQAQLAEDIEALKVQFKREYGFISQTLQEERYRYERLEDQLHDLTDLHQHSSARGTELE

SEQ ID NO: 916473 - protein, 271 aa, Homo sapiens
GIPHSITSDQGTYFMAKEEWQWAHAHGIHGSYHAPYHPEAAGLTEWWIGLVMSQLQHQLGDNTLQGWGKVPQKAVYALNLCPIHGAVSPIARIHGSRNQEVEVEREECATRRHSNNAIELRLPPGHFGLLLPLRQQTKKGVTVLAKVTDSDYQDEISRLLHDAGMKVWVTPPGKQQQQQQQQQQPRPAEVLAEGKGNTEWVVEGQCPSSGESGIETVNRHQEKSTAVFGITNVTSALNTILCIGYFSNNLKASEDVSPEFLFQTSWALTYC

SEQ ID NO: 916474 - protein, 176 aa, Homo sapiens
MYLQRPVRPTDDSNTTPQGCPYALPLLKIKSSGVTYGNQWNLALSPRLECNGMISGHYNLCLPGSSNSPASTSCVAGITGSGVSAPAAWPLSALGLLQSLSKVGAKSWDHEWQWEADRFLGGRGWVPRKAPPSGQGGPEGWGIHPYCSMDPYFILFNDQIIFCYMDEFIYVYTVID

SEQ ID NO: 916475 - protein, 107 aa, Homo sapiens
MYLQRPVRPTDDSNTTPQGCPYALPLLKIKSSGVTYGNQWNLALSPRLECNGMISGHYNLCLPGSSNSPASTSCVAGITGGSVVAQSRLTATSASQVPAILLPQLPK

SEQ ID NO: 916476 - protein, 251 aa, Homo sapiens
MQAGARFQRRRRQLQQQQPRRRQPLLWPMDAEPPPPPPWVWMVPGSAGLLRLSAGVVVPPVLLASAPPPAAPLLPGLPGWPAPSEPVLPLLPLPSAPDSAAAAAAHPFPALHGQWLFGGHSPSLGLPPSSTVELVPVFPHLCPSALATPIGKSWIDKRIPNCKCYACIIFRQIFFNNSFALDSTWIHPEESRFFHGHEKPRLLANQVAVSLSRPAPASRPLPTVVLAPQPIPGWCPNNIDNVCFIFASIIN

SEQ ID NO: 916477 - protein, 463 aa, Homo sapiens
ATLSSLTGDPVFEDVARVALMRLWESRSDIGLVGNHIDVLTGKWVAQDAGIGAGVDSYFEYLVKGAILLQDKKLMAMFLEYNKAIRNYTRFDDWYLWVQMYKGTVSMPVFQSLEAYWPGLQSLIGDIDNAMRTFLNYYTVWKQFGGLPEFYNIPQGYTVEKREGYPLRPELIESAMYLYRATGDPTLLELGRDAVESIEKISKVECGFATIKDLRDHKLDNRMESFFLAETVKYLYLLFDPTNFIHNNGSTFDAVITPYGECILGAGGYIFNTEAHPIDPAALHCCQRLKEEQWEVEDLMREFYSLKRSRSKFQKNTVSSGPWEPPARPGTLFSPENHDQARERKPAKQKVPLLSCPSQPLTSKLALLGQECVTTHLPNQLALKMDGAGASGPYPAVAGSREWTGAAGAGRRARVWCASEGGGGGGGGGVWGPPPPPPPRLLPSSRPRPAPRPRSPADVRRDE

SEQ ID NO: 916478 - protein, 364 aa, Homo sapiens
MYKGTVSMPVFQSLEAYWPGLQSLIGDIDNAMRTFLNYYTVWKQFGGLPEFYNIPQGYTVEKREGYPLRPELIESAMYLYRATGDPTLLELGRDAVESIEKISKVECGFATIKDLRDHKLDNRMESFFLAETVKYLYLLFDPTNFIHNNGSTFDAVITPYGECILGAGGYIFNTEAHPIDPAALHCCQRLKEEQWEVEDLMREFYSLKRSRSKFQKNTVSSGPWEPPARPGTLFSPENHDQARERKPAKQKVPLLSCPSQPLTSKLALLGQECVTTHLPNQLALKMDGAGASGPYPAVAGSREWTGAAGAGRRARVWCASEGGGGGGGGGVWGPPPPPPPRLLPSSRPRPAPRPRSPADVRRDE

SEQ ID NO: 916479 - protein, 147 aa, Homo sapiens
MCSSSFRAGGLSFSGWNPKPWQSLSACPRCPLQPSSVSLSARPWAALASAPPAPWSNQVLRSPWYSHPLLRVFPLTQIPVYPTPCFLLTQPVARPCDLALLFLTLPLSSNTTIIFLGNQWFVSRFVNNGALSSLEIWSRKWEESRKG

SEQ ID NO: 916480 - protein, 149 aa, Homo sapiens
MEGHFFSTSHICCVNFVKSPNFNTGCLICKKGMIIILPHKSYFIRFKLHDEIKLLTQCLARSNSLQIPDVVHTNRIPDAEEKTGKLIRGADEGYPLQDNDSYLNCYAGSIMNIILTGTHSTDQDIIALKVDEKNAAETFIKLLEAKCEH

SEQ ID NO: 916481 - protein, 151 aa, Homo sapiens
AGIMKRVFCILITTMKKYYYYPHFTDEKTKKFSDSPKATWELVELGFKFGQPHFWMFLLTNAAFFFNWYMIKNQISSKSIESFITPGTQREGDDGLDSPAVSMLLTGAASHHSCLALSVSSAPWSRWSDPPAVRNVVCCLDINTRDSDSTR

SEQ ID NO: 916482 - protein, 112 aa, Homo sapiens
MPLSPLSLQHKSTEQAASKPQTLTSVLEAGSPRWRVPQIPCLVFFYRNIGKIIFIVHRLLQQIQLKDTPTILIGHKRTGCPHLTTTHNNRTLIRHKRTGCHLTTTHNNRRAG

SEQ ID NO: 916483 - protein, 112 aa, Homo sapiens; identical to SEQ ID NO: 916482

SEQ ID NO: 916484 - protein, 281 aa, Homo sapiens
MVRIEFSDLFLWPGLETRGTQSQWAVAHNLLFCTGPDYEPNLWMWVNPNIVYPPGKLEVSGRRKREDLTSTLPSSQPPQKEEDASCSEAAGVESLSQSSSKRSPPRKRFAFSPSTWELTEEEEAEDQEDSSSMALPSPHKRAPLQSRRLRQASSQAGRLWSRPPLNYFHLIALALRNSSPCGLNVQQIYSFTRKHFPFFRTAPEGWKNTVRHNLCFRDSFEKVPVSMQGGASTRPRSCLWKLTEEGHRRFAEEARALASTRLESIQQCMSQPDVMPFLFDL

SEQ ID NO: 916485 - protein, 244 aa, Homo sapiens [sequence omitted]

SEQ ID NO: 916486 - protein, 271 aa, Homo sapiens
APAARAQEHDKRDPVVAYYCRLYAMQTGMKIDSKTPECRKFLSKLMDQLEALKKQLGDNEAITQEIVGCAHLENYALKMFLYADNEDRAGRFHKNMIKSFYTASLLIDVITVFGELTDENVKHRKYARWKATYIHNCLKNGETPQAGPVGIEEDNDIEASSTYDPSNMPSGNYTGIQIPPGAHAPANTPAEVPHSTGVASNTIQPTPQTIPAIDPALFNTISQGDVRLTPEDFARAQKYCKYAGSALQYEDVSTAVQNLQKALKLLTTGRE

SEQ ID NO: 916487 - protein, 171 aa, Homo sapiens
HGIKAGSMSRVQPAGPGRQNKPSRCKQNPSRATGGHRSCWLVNLLYMNLIYQIDRIQEMISGKISKDLYFSSEHKNSLSCILLSCHKMCSTLTFPTSEVINCLGKTAGAIEVRVKDLKGLDFSEMKIWITPSGKQRRPDEMLLEGLAYLELVVEISLLESLLKKHHAYLTS

SEQ ID NO: 916488 - protein, 1306 aa, Homo sapiens
MTDSAQVVTLLRGGIDAFGLGDLPNLLGLVGDQLGDTERKRRHAKPGSYSIEVLLVVDDSVVRFHGKEHVQNYVLTLMNIAWCQLVLSVAGDPAVMVEKLFSTLLCSVLEGFYVSSTPTDEQGRAPREREQTCSVKLPAGDLRPAEDVEGKAEQVSCPRELSNDEKLPTIQCIYGCQEGPWLKPDTGCSEVCPFMNWGSCQFWALRKVAWDWGLVMHAASAAHSFVLTAWLPPWLAQKGVDKQRLSVRLMNTVQELPGRGVQRAAFFDELCRALAHSPGPEAWGGAQDSAFLTSSQVLLLLQGPGVCLLEECPLLPPQGRGTVGQTLCQWQLERYTGMLGRVACGSLSQVDEIYHDESLGVHINIALVRLIMVGYRQSLSLIERGNPSRSLEQVCRWAHSQQRQDPSHAEHHDHVVFLTRQDFGPSGYAPVTGMCHPLRSCALNHEDGFSSAFVIAHETGHVLGMEHDGQGNGCADETSLGSVMAPLVQAAFHRFHWSRCSKLELSRYLPSYDCLLDDPFDPAWPQPPELPGINYSMDEQCRFDFGSGYQTCLAVVGGQGSVLLWPMLTIHEVPSAQLASGPGDGPTDTVPATMQGCRVNTCGGSAMEKGGVPGGCRYLELSKLEAAAAAQGDLMPSALPQWCFKGHCIWKSPEQTYGQDGGWSSWTKFGSCSRSCGGGVRSRSRSCNNPSPAYGGRLCLGPMFEYQVCNSEECPGTYEDFRAQQCAKRNSYYVHQNAKHSWVPYEPDDDPGPYRNLVPVDEIQGGLGGCGFRCCLESCLPGSGSCLSWVGAPPDPGPYRNLVPVDEIQGGLGGCGSRLESFMLETRSYQLCWSPGTRAEPKNAQKCELICQSADTGDVVFMNQVVHDGTRCSYRDPYSVCARGECVPVGCDKEVGSMKADDKCGVCGGDNSHCRTVKGTLGKASKQAVVKNQVTGSFILNPKGKEATSRTFTAMGLEWEDAVEDAKESLKTSGPLPEAIAILALPPTEGGPRSSLAYKYVIHEDLLPLIGSNNVLLEEMDTYEWALKSWAPCSKACGGGPRQPAHPIGIQFTKYGCRRRRDHHMVQRHLCDHKKRPKPIRRRCNQHPCSQPVWVTEEWGACSRSCGKLGVQTRGIQCLLPLSNGTHKVMPAKACAGDRPEARRPCLRVPCPAQWRLGAWSQCSATCGEGIQQRQVVCRTNANSLGHCEGDRPDTVQVCSLPACGGNHQNSTVRADVWELGTPEGQWVPQSEPLHPINKISSTEPCTGDRSVFCQMEVLDRYCSIPGYHRLCCVSCIKKASGPNPGPDPGPTSLPPFSQSLITSEF

SEQ ID NO: 916489 - protein, 1672 aa, Homo sapiens
MTDSAQVVTLLRGGIDAFGLGDLPNLLGLVGDQLGDTERKRRHAKPGSYSIEVLLVVDDSVVRFHGKEHVQNYVLTLMNIAWCQLVLSVAGDPAVMVEKLFSTLLCSVLEGFYVSSTPTDEQGRAPREREQTCSVKLPAGDLRPAEDVEGKAEQVSCPRELSNDEKLPTIQCIYGCQEGPWLKPDTGCSEVCPFMNWGSCQFWALRKVAWDWGLVMHAASAAHSFVLTAWLPPWLAQKGVDKQRLSVRLMNTVQELPGRGVQRAAFFDELCRALAHSPGPEAWGGAQDSAFLTSSQVLLLLQGPGVCLLEECPLLPPQGRGTVGQTLCQWQLERYTGMLGRVACGSLSQVDEIYHDESLGVHINIALVRLIMVGYRQSLSLIERGNPSRSLEQVCRWAHSQQRQDPSHAEHHDHVVFLTRQDFGPSGYAPVTGMCHPLRSCALNHEDGFSSAFVIAHETGHVLGMEHDGQGNGCADETSLGSVMAPLVQAAFHRFHWSRCSKLELSRYLPSYDCLLDDPFDPAWPQPPELPGINYSMDEQCRFDFGSGYQTCLAVVGGQGSVLLWPMLTIHEVPSAQLASGPGDGPTDTVPATMQGCRVNTCGGSAMEKGGVPGGCRYLELSKLEAAAAAQGDLMPSALPQWCFKGHCIWKSPEQTYGQDGGWSSWTKFGSCSRSCGGGVRSRSRSCNNPSPAYGGRLCLGPMFEYQVCNSEECPGTYEDFRAQQCAKRNSYYVHQNAKHSWVPYEPDDDPGPYRNLVPVDEIQGGLGGCGFRCCLESCLPGSGSCLSWVGAPPDPGPYRNLVPVDEIQGGLGGCGSRLESFMLETRSYQLCWSPGTRAEPKNAQKCELICQSADTGDVVFMNQVVHDGTRCSYRDPYSVCARGECVPVGCDKEVGSMKADDKCGVCGGDNSHCRTVKGTLGKASKQAVVKNQVTGSFILNPKGKEATSRTFTAMGLEWEDAVEDAKESLKTSGPLPEAIAILALPPTEGGPRSSLAYKYVIHEDLLPLIGSNNVLLEEMDTYEWALKSWAPCSKACGGGPRQPAHPIGIQFTKYGCRRRRDHHMVQRHLCDHKKRPKPIRRRCNQHPCSQPVWVTEEWGACSRSCGKLGVQTRGIQCLLPLSNGTHKVMPAKACAGDRPEARRPCLRVPCPAQWRLGAWSQCSATCGEGIQQRQVVCRTNANSLGHCEGDRPDTVQVCSLPACGGNHQNSTVRADVWELGTPEGQWVPQSEPLHPINKISSTEPCTGDRSVFCQMEVLDRYCSIPGYHRLCCVSCIKKASGPNPGPDPGPTSLPPFSTPGSPLPGPQDPADAAEPPGKPTGSEDHQHGRATQLPGALDTSSPGTQHPFAPETPIPGASWSISPTTPGGLPWGWTQTPTPVPEDKGQPGEDLRHPGTSLPAASPRGGRKTKIRESPNRRYLSKLPPAGLTLSGPLLVSPAKTRPTREGGSGHPGPQVLSIQGFPNWRSPPDSTRMATSIITLSLEGDSVGHRGNTISQAVPSIIALLRRSLLLESDIFIFYLAQAGPECVVLPGPGPGDDKGHPGQVPQGRVPAPGLVLEWGRHTHPRCCKGLSCAQLPAMLPPRDRFKRMYGNAWMSRQKSAAGAEPSWITSTRAVQKGNVGLESPHRVLTGALPSGAVRRVRHPPDPRMVDPLTACTTLLEKLQALNAGL

SEQ ID NO: 916490 - protein, 699 aa, Homo sapiens
MEAPRATPQPYWGLVLEEPRRVMAALTEGRRPDSNPYGLPWELVICAAVVGFFAVPFFLWRSFRSVRSRLYVGREKKLAVALSGLIEEKCRLLEKFSLVQKEYESYEIESSLDDSSFEKEATEAQSLEATCEKLSRSNSELEHEIPCLEKELKEEKSKHSEQDEVMADISKRIQSLEDESKSLKSHVAEAKMTFKRFQMNEERMKIGIQYALNENSQLQESQKQLLQEAEAWKEQVSELNKQQKITFEDSKAAVLEEDITDDGNLELEMNSESEDGAYVDNPPKGALKKLLHAAKLNASLTTLEGERNQIYIQLSEVDKTKEELRGHIKNLQTEQVSLQLENTHFESENQKLQQKLKVMTELYQENEMKLYRKLIVEENNRLEKEKLSKVDEMISHAAEELETCRKQANDLEEEFQRKKDPYALDVPNTAFGREHSSYGPSPLGRPSSEMRAFLYLPSLLEGPLRLSPLLPGGGGRGPRGPGNPLDHQITKERGESSCDRFTDPHRAPSDTGFLSPPWEQDCRMMSPPPGQSYPDSALPPQRQDRFYSNYARRSGPAELRSFNKPPLDKMDGSMPSEMESSRNDTKDNLGNLNVADSSLPAGNEVTGPGFVPPPLAPIRGPLFPVDMRGPFMRRGPPFPPPPPGTMFGASPDYFPPRDVPGPPRASICNEKCLSTEGFSSLPSPKTWISPHHPHILKIE

SEQ ID NO: 916491 - protein, 1652 aa, Homo sapiens
MHWHNLSMVRSYCRAQGEVTIREALRELDLWGVGAVFTLIDYEDSQSRTMKLIKDWKDIVNQVGDNRCLLQSLKDSPYYKGFEDKVSIWERKLAELDEYLQNLNHIQRKWVYLEPIFGRGALPKEQTRFNRVDEDFRIYNTVVPYPSIPPMGSSKHWSWQELSSLQLTSRPLSSQILCLAEQIKFTEDVENAIKDHSLHQIETQLVNKLEQYTNIDTSSEDPGNTESGILELKLKALILDIIHNIDVVKQLNQIQVHTTEDWAWKKQLRFYMKSDHTCCVQMVDSEFQYTYEYQGIDVKSMGRIFVGLVKCGAWGCFDEFNRLEESVLSAVSMQIQTIQDALKNHRTVCELLGKEVEVNSNSGIFITMNPAGKGYGGRQKLPDNLKQLFRPVAMSHPDNELIAEVILYSEGFKDAKVLSRKLVAIFNLSRELLTPQQHYDWGLRALKTVLRGSGNLLRQLNKSGTTQNANESHIVVQALRLNTMSKFTFTDCTRFDALIKDVFPGIELKEVEYDELSAALKQVFEEANYEIIPNQIKKALELYEQLCQRMGVVIVGPSGAGKSTLWRMLRAALCKTGKVVKQYTMNPKAMPRYQLLGHIDMDTREWSDGVLTNSARQVVREPQDVSSWIICDGDIDPEWIESLNSVLDDNRLLTMPSGERIQFGPNVNFVFETHDLSCASPATISRMGMIFLRGLGGNLNMKSRLEFTKEVFHWARESPPDFHKPMDTYYDSTRGRLATYVLKKPEDLTADDFSNGLTLPVIQTPDMQRGLDYFKPWLSSDTKQPFILVGPEGCGKGMLLRYAFSQLRSTQIATVHCSAQTTSRHLLQKLSQTCMVISTNTGRVYRPKDCERLVLYLKDINLPKLDKWGTSTLVAFLQQVRAKFTVDDYSHYFFTPCILTQWVLGLFRYDLEGGSSNHPLDYVLEIVAYEARRLFRDKIVGAKELHLFDIILTSVFQGDWGSDILDNMSVDPDFLKSFLLIHESCKAYGATPSRYMTFLHVYSAISSSKKKELLKRQSHLQAGVSKLNEAKALVDELNRKAGEQSVLLKTKQDEADAALQMITVSMQDASEQKTELERLKHRIAEEVVKIEERKNKIDDELKEVQPLVNEAKLAVGNIKPESLSEIRSLRMPPDVIRDILEGVLRLMGIFDTSWNAKRASTAAAPLAAWVKANIQYSHVLERIHPLETEQAGLESNLKKTEDRKRKLEELLNSVGQKVSELKEKFQSRTSEAAKLEAEVSKAQETIKAAEVLINQLDREHKRWNAQCPGLGDKLYDLILVNSVDNGKYNKAVRNYGEGSRVCPFLIDPSSQATEWLKTHLKDSRLEVINQQDSNFITALELAVRFGKTLIIQEMDGVEPVLYPLLRRDLVAQGPRYVVQIGDKIIDYNEEFRLFLSTRNPNPFIPPDAASIVTEVNFTTTRSGLRGQLLALTIQHEKPDLEEQKTKLLQQEEDKKIQLAKLEESLLETLATSQGNILENKDLIESLNQTKASSALIQESLKESYKLQISLDQERDAYLPLAESASKMYFIISDLSKINNMYRFSLAAFLRLFQRALQNKQEHCSWHLVRAPLGRSFQRKEQAAIFAVLQTLLVIPRQTGSGVDLLQSPADLQQRGLTVRRKTNKQKGIASTSTKRTSIQKPHPKVTKIKDQR

SEQ ID NO: 916492 - protein, 310 aa, Homo sapiens
MSSAEMPHTETVSPLPSSMDLPIQDSHDSSTSPKGKQPTTAEKSATKKEDKVPVKKQKTRTVFSSTQLCVLNDRFQRQKYLSLQQMQELSNILNLSYKQVKTWFQNQRMKSKRWQKNNWLKNSNGVTQGCLVNPTGNLPMWSNQTWNNSTWSNQTQNIQSWSNHSWNTQTWCTQSWNNQAWNSPFYNCGEESLQSCMQFQPNSPASDLEAALEAAGEGLNDFSCMETTCSGFHDAYPVNLMEGGSQPHAAAGLLGGGWSRPQRQVGLAGSVLAGGRAANWRKRVDVGENRSFSHASAAKAPDQKDRFVTR

SEQ ID NO: 916493 - protein, 148 aa, Homo sapiens
MRSKSFAPGGTLPVALPHVALDKVPSPAMQQVLEPAVKTGCSPTAGARCQATIPNVFRICFRIYDNLPEVKKKKEEQRKRVILQSNRLRAEVFKKRGLIQASLFTSLGNLLHQTFGIQIHLLLNFNLSTCQLCKCQNVGHHIVYLKPF

SEQ ID NO: 916494 - protein, 134 aa, Homo sapiens
MKTCCLPQIATLAPVLKIKGIQWKLLLLPLRTISSLSRALLHGNTTGGVQQENGLDLSIHSIKCPRFHTIFSIKEEFQTLCCSNLWISTLLYFISKFVDLFEEFRESMEDGSACCEAKKPGTFSRTSEVDVRSS

SEQ ID NO: 916495 - protein, 312 aa, Homo sapiens
MEVKNCCMVTEFILLGIPHTEGLEMTLFVLFLPFYACTLLGNVSILVAVMSSARLHTPMYFFLGNLSVFDMGFSSVTCPKMLLYLMGLSRLISYKDCVCQLFFFHFLGSIECFLFTVMAYDRFTAICYPLRYTVIMNPRICVALAVGTWLLGCIHSSILTSLTFTLPYCGPNEVDHFFCDIPALLPLACADTSLAQRVSFTNVGLISLVCFLLILLSYTRITISILSIRTTEGRRRAFSTCSAHLIAILCAYGPIITVYLQPTPNPMLGTVVQILMNLVGPMLNPLIYTLRNKEVKTALKTILHRTGHVPES

SEQ ID NO: 916496 - protein, 248 aa, Homo sapiens
MLVEKMGHEAVELGHGEANITGLEENTLIASLCDLLERIWSHGLQVKQGKSALWSHLIQFQDREEKQEHLAESPVALGPERRKSDSGVMLPTLRVSLIQDMRHIQNMSEIKTDVGRARAWIRLSLEKKLLSQHLKQLLSNQPLTKKLYKRYAFLRCEEEREQFLYHLLSLNAVDYFCFTSVFTTIMIPYRSVIIPIKKLSNAIITSNPWICVSGELGDTGVMQIPKNLLEMTFEVGSANTFPRRMYHV

SEQ ID NO: 916497 - protein, 148 aa, Homo sapiens [sequence omitted]

SEQ ID NO: 916498 - protein, 465 aa, Homo sapiens
MATDVQLADYPLMSPKAELKLEKKSGRKPRSPRDSGPQKELVIPGIVDFERIRRALRTPKPQTPGTYCFGRLSHHSFFSRHHPHPQHVTHIQASNPLQISPGSLSVSSGIFQPPCLSQLSFPAVKWGYPPSLSPLETHSLIGTPSFLLVEAWKKELKELASRVAFLTKEDELKKKEGTEEFRAEAPSTAAQKLANAGHHQKPGYKWAAMGKAPGLSGTDLGAAELGIKVGGGPLVQDAVFKSLMGVGRSSREDLPGRENENHPRASSDRPCITEFQEEELLLQKEQKEEPLREQGAKYSAETGRLIPASTRAVGRRRSHQGQQSQSSSRHEGVQAFLLQDQELLVLELLCQILETDLLSAIQFWLLYAPPKEKDLALGLLQTAVAQLLPQPLVSIPTEKLLSQLPEVHEPPQEKQEPPCSQSPKKTKISPFTKSEKPEYIGEAQVLQMHSSQNTEKKTSKPRAES

SEQ ID NO: 916499 - protein, 128 aa, Homo sapiens
SPFTKSEKPAPTMESFGGGGGNFPTFEKEKNFFSKDKFLLSRNLHPSKEEYRQQIKTPGEEWRQILVHWRSSSPPDAFKPEHREEDIEAEGRELRGPNTCTCLAQEQPQGFRGVSVSTTFTAVPDSLP

SEQ ID NO: 916500 - protein, 166 aa, Homo sapiens
ILVPSANVYLVSIMFSPCFYDQQKAKQRTLSLAEEAKTLLSSLCSGTDGSLRYAKTELQQICYGTQHQARTSAGQSSVQGSYHREQHSTSSFKLCPERQDLQASGYTWEEIKLLDSSCGWGNHREISPLQLSLGTLTELLDCQVLLAPHLNTGTKFKLVCLLLRSL

SEQ ID NO: 916501 - protein, 292 aa, Homo sapiens
ARAPAAPLPPVLRNLCGHSEQPELQLRLFLLFLGIYVVTVVGNLSMITLIGLSSHLHTPMYYFLSGLSFIDICHSTIITPKMLVNFVTEKNIISYPECMTQLYFFLIFAIAECHMLAVTAYDRYVAICSPLLYNVIMSYHHCFWLTVGVYILGILGSTIHTGFMLRLFLCKTNVINHYFCDLFPLLGLSCSSTYINELLVLVLSAFNILTPALTILASYIFIIASILRIRSTEGRSKAFSTCSSHILAVAVFFGSAAFMYLQPSSVSSMDQGKVSSVFYTIVVPMLNPQSIA

SEQ ID NO: 916502 - protein, 92 aa, Homo sapiens
MARTKQTARKSTGGKAPRKQLATKAARKSTPSTCGVKPHRYRPGTVALREIRRYQKSTELLIRKLPFQRLVREIAQDFKTAQYTPDPPVWSA

SEQ ID NO: 916503 - protein, 135 aa, Homo sapiens
MARTKQTARKSTGGKAPRKQLATKAARKSTPSTCGVKPHRYRPGTVALREIRRYQKSTELLIRKLPFQRLVREIAQDFNTDLRFQSAAVGALQEASEAYLVGLLEDTNLCAIHAKRVTIMPKDIQLARRIRGERA

SEQ ID NO: 916504 - protein, 173 aa, Homo sapiens
MDLAPSRPPRGGPAPIPPPCSGPPPLGVRSSRAAPGNKVSTLSSPAAETRKINPSAQSIAGDHLMLPPCSVANELKTLTPVGIAIIMVADVKEGRLFSRSWHLTIEDASRSRKDGRRSWKLVLFIQGNAMSGTPIIRGTCQFAETPDYNGHNYEENYNKCEGSDNNIISLIIS

SEQ ID NO: 916505 - protein, 161 aa, Homo sapiens
MSNVEETTNRPSGMLSIYQHSYWNPNKETFQNDNRALPLNCRTSHAARKPCRLITHTTLTWTQRPPGTEDCVSRKYFPEKLQRTSVLQLTQRLFFVAGTGPHALWGTSLSASTLLSPSSHPGTVPTGHCLAMPHISHKGEPPEGSWGCGILEAQKFSPPVL

SEQ ID NO: 916506 - protein, 368 aa, Homo sapiens
IARMYAFSSWMSRRRGRVDAGWGELYGRSGYNYFFSGGADDAWADVEDVTEEDCALRSGDTHLFDKVRGYDIKLLRYLSVKYICDLMVENKKVKFGMNVTSSEKVDKAQRYADFTLLSIPYPGCEFFKEYKDRDYMAEGLIFNWKQDYVDAPLSIPDFLTHSLNIDWSQYQCWDLVQQTQNYLKLLLSLVNSDDDSGLLVHCISGWDRTPLFISLLRLSLWADGLIHTSLKPTEILYLTVAYDWFLFGHMLVDRLSKGEEIFFFCFNFLKHITSEEFSALKTQRRKSLPARDGGFTLEDICMLRRKDRGSTTSLGSDFSLEVRSAFLAAYSSTVGLRAVAPSPSGAIGGLLEQFARGVGLRSISSNAL

SEQ ID NO: 916507 - protein, 587 aa, Homo sapiens
MGNILTCRVHPSVSLEFDQQQGSVCPSESEIYEAGAEDRMAGAPMAAAVQPAEVTVEVGEDLHMHHVRDREMPEGEEVIGAIYPRVTLEIPHHITQRDADRSLSIPDEQLHSFAVSTVHITKNRNGGGSLNNYSSSIPSTPSTSQEDPQFSVPPTANTPTPVCKRSMRWSNLFTSEKGSDPDKERKAPENHADTIGSGRAIPIKQGMLLKRSGKWLKTWKKKYVTLCSNGVLTYYSSLGDYMKYIHKKEIDLQTSTIKVPGKWPSLATLACTPISSSKSDGLSKDMDTGLGDSICFSPSISSTTIPKLNPPPSPHANKKKHLKKKSTNNFMIVSATGQTWHFEATTYEERDAWVQAIQSQILASLQSCESSKSKSQLTSQSEAMALQSIQNMRGNAHCVDCETQNPKWASLNLGVLMCIECSGIHRSLGTRLSRVRSLELDDWPVELRKVMSSIGNDLANSIWEGSSQGRTKPTELFLAPLPCTELSLGQQLLRATADEDLQTAILLLAHGSREEVNETCGEGDGCTALHLACRKGNVVLAQLLIWYGVDVMARDAHGNTALTYARQASSQECINVLLQYGCPDKCV

SEQ ID NO: 916508 - protein, 605 aa, Homo sapiens
MGNILTCRVHPSVSLEFDQQQGSVCPSESEIYEAGAEDRMAGAPMAAAVQPAEVTVEVGEDLHMHHVRDREMPEGEEVIGAIYPRVTLEIPHHITQRDADRSLSIPDEQLHSFAVSTVHITKNRNGGGSLNNYSSSIPSTPSTSQEDPQFSVPPTANTPTPVCKRSMRWSNLFTSEKGSDPDKERKAPENHADTIGSGRAIPIKQGMLLKRSGKWLKTWKKKYVTLCSNGVLTYYSSLGDYMKYIHKKEIDLQTSTIKVPGKWPSLATLACTPISSSKSDGLSKDMDTGLGDSICFSPSISSTTIPKLNPPPSPHANKKKHLKKKSTNNFMIVSATGQTWHFEATTYEERDAWVQAIQSQILASLQSCESSKSKSQLTSQSEAMALQSIQNMRGNAHCVDCETQNPKWASLNLGVLMCIECSGIHRSLGTRLSRVRSLELDDWPVELRKVMSSIGNDLANSIWEGSSQGRTKPTEKSTREEKERWIRSKYEEKLFLAPLPCTELSLGQQLLRATADEDLQTAILLLAHGSREEVNETCGEGDGCTALHLACRKGNVVLAQLLIWYGVDVMARDAHGNTALTYARQASSQECINVLLQYGCPDKCV

SEQ ID NO: 916509 - protein, 196 aa, Homo sapiens
MNLVYDWYQTESQVVITLMIKNVQKNDVNVEFSEKELSALVKLPSGEDYNLKLELLHPIIPEQSTFKVLSTKIEIKLKKPEAVRWEKLEGQGDVPTPKQFVADVKNLYPSSSPYTRNWDKLVGEIKEEEKNEKLEGDAALNRLFQQIYSDGSDEVKRAMNKSFMESGGTVLSTNWSDVGKRKVEINPPDDMEWKKY

SEQ ID NO: 916510 - protein, 207 aa, Homo sapiens
RLAAAGERESRKSTLYDWYQTESQVVITLMIKNVQKNDVNVEFSEKELSALVKLPSGEDYNLKLELLHPIIPEQSTFKVLSTKIEIKLKKPEAVRWEKLEGQGDVPTPKQFVADVKNLYPSSSPYTRNWDKLVGEIKEEEKNEKLEGDAALNRLFQQIYSDGSDEVKRAMNKSFMESGGTVLSTNWSDVGKRKVEINPPDDMEWKKY

SEQ ID NO: 916511 - protein, 195 aa, Homo sapiens
LTLLESSLTESQVVITLMIKNVQKNDVNVEFSEKELSALVKLPSGEDYNLKLELLHPIIPEQSTFKVLSTKIEIKLKKPEAVRWEKLEGQGDVPTPKQFVADVKNLYPSSSPYTRNWDKLVGEIKEEEKNEKLEGDAALNRLFQQIYSDGSDEVKRAMNKSFMESGGTVLSTNWSDVGKRKVEINPPDDMEWKKY

SEQ ID NO: 916512 - protein, 173 aa, Homo sapiens
VSKSFTNVRTTQKLSALVKLPSGEDYNLKLELLHPIIPEQSTFKVLSTKIEIKLKKPEAVRWEKLEGQGDVPTPKQFVADVKNLYPSSSPYTRNWDKLVGEIKEEEKNEKLEGDAALNRLFQQIYSDGSDEVKRAMNKSFMESGGTVLSTNWSDVGKRKVEINPPDDMEWKKY

SEQ ID NO: 916513 - protein, 163 aa, Homo sapiens
LSTKIEITLNVLCSGIKDEEVPVSNVIPEQSTFKVLSTKIEIKLKKPEAVRWEKLEGQGDVPTPKQFVADVKNLYPSSSPYTRNWDKLVGEIKEEEKNEKLEGDAALNRLFQQIYSDGSDEVKRAMNKSFMESGGTVLSTNWSDVGKRKVEINPPDDMEWKKY

SEQ ID NO: 916514 - protein, 333 aa, Homo sapiens
MAAAAAGTATSQRFFQSFSDALIDEDPQAALEELTKALEQKPDDAQYYCQRAYCHILLGNYCVAVADAKKSLELNPNNSTAMLRKGICEYHEKNYAAALETFTEGQKLDSADANFSVWIKRCQEAQNGSESEVWTHQSKIKYDWYQTESQVVITLMIKNVQKNDVNVEFSEKELSALVKLPSGEDYNLKLELLHPIIPEQSTFKVLSTKIEIKLKKPEAVRWEKLEGQGDVPTPKQFVADVKNLYPSSSPYTRNWDKLVGEIKEEEKNEKLEGDAALNRLFQQIYSDGSDEVKRAMNKSFMESGGTVLSTNWSDVGKRKVEINPPDDMEWKKY

SEQ ID NO: 916515 - protein, 367 aa, Homo sapiens
MAAAAAGTATSQRFFQSFSDALIDEDPQAALEELTKALEQKPDDAQYYCQRAYCHILLGNYCVAVADAKKSLELNPNNSTAMLRKGICEYHEKNYAAALETFTEGQKLDIETGFHRVGQAGLQLLTSSDPPALDSQSAGITGADANFSVWIKRCQEAQNGVKKSESVGFISPKLGYDWYQTESQVVITLMIKNVQKNDVNVEFSEKELSALVKLPSGEDYNLKLELLHPIIPEQSTFKVLSTKIEIKLKKPEAVRWEKLEGQGDVPTPKQFVADVKNLYPSSSPYTRNWDKLVGEIKEEEKNEKLEGDAALNRLFQQIYSDGSDEVKRAMNKSFMESGGTVLSTNWSDVGKRKVEINPPDDMEWKKY

SEQ ID NO: 916516 - protein, 367 aa, Homo sapiens
MAAAAAGTATSQRFFQSFSDALIDEDPQAALEELTKALEQKPDDAQYYCQRAYCHILLGNYCVAVADAKKSLELNPNNSTAMLRKGICEYHEKNYAAALETFTEGQKLDIETGFHRVGQAGLQLLTSSDPPALDSQSAGITGQMLISVSGITQVSKKAQEVGSESEVWTHQSKIKYDWYQTESQVVITLMIKNVQKNDVNVEFSEKELSALVKLPSGEDYNLKLELLHPIIPEQSTFKVLSTKIEIKLKKPEAVRWEKLEGQGDVPTPKQFVADVKNLYPSSSPYTRNWDKLVGEIKEEEKNEKLEGDAALNRLFQQIYSDGSDEVKRAMNKSFMESGGTVLSTNWSDVGKRKVEINPPDDMEWKKY

SEQ ID NO: 916517 - protein, 367 aa, Homo sapiens; identical to SEQ ID NO: 916515

SEQ ID NO: 916518 - protein, 105 aa, Homo sapiens
GWEESVLHCPSRPRAGVSPPVPLAARCVAARWLFRTEARLVFLQKFPPWAVVEVVTVIVAAPAAATATTRDGGGCSRNCNIPEVFPELLGCPNRRGPPGGVRGAD

SEQ ID NO: 916519 - protein, 105 aa, Homo sapiens; identical to SEQ ID NO: 916518

SEQ ID NO: 916520 - protein, 66 aa, Homo sapiens
PPPAGGEPALNRLFQQIYSDGSDEVKRAMNKSFMESGGTVLSTNWSDVGKRKVEINPPDDMEWKKY

SEQ ID NO: 916521 - protein, 212 aa, Homo sapiens
GRVGLRFSESEVWTHQSKIKYDWYQTESQVVITLMIKNVQKNDVNVEFSEKELSALVKLPSGEDYNLKLELLHPIIPEQSTFKVLSTKIEIKLKKPEAVRWEKLEGQGDVPTPKQFVADVKNLYPSSSPYTRNWDKLVGEIKEEEKNEKLEGDAALNRLFQQIYSDGSDEVKRAMNKSFMESGGTVLSTNWSDVGKRKVEINPPDDMEWKKY

SEQ ID NO: 916522 - protein, 177 aa, Homo sapiens
ASSYELHNVTKKKKKLLLSALVKLPSGEDYNLKLELLHPIIPEQSTFKVLSTKIEIKLKKPEAVRWEKLEGQGDVPTPKQFVADVKNLYPSSSPYTRNWDKLVGEIKEEEKNEKLEGDAALNRLFQQIYSDGSDEVKRAMNKSFMESGGTVLSTNWSDVGKRKVEINPPDDMEWKKY

SEQ ID NO: 916523 - protein, 175 aa, Homo sapiens
VSEPYFTQTTPKKTLLSALVKLPSGEDYNLKLELLHPIIPEQSTFKVLSTKIEIKLKKPEAVRWEKLEGQGDVPTPKQFVADVKNLYPSSSPYTRNWDKLVGEIKEEEKNEKLEGDAALNRLFQQIYSDGSDEVKRAMNKSFMESGGTVLSTNWSDVGKRKVEINPPDDMEWKKY

SEQ ID NO: 916524 - protein, 365 aa, Homo sapiens
MAAAAAGTATSQRFFQSFSDALIDEDPQAALEELTKALEQKPDDAQYYCQRAYCHILLGNYCVAVADAKKSLELNPNNSTAMLRKGICEYHEKNYAAALETFTEGQKLDIETGFHRVGQAGLQLLTSSDPPALDSQSAGITGADANFSVWIKRCQEAQNGSESEVWTHQSKIKYDWYQTESQVVITLMIKNVQKNDVNVEFSEKELSALVKLPSGEDYNLKLELLHPIIPEQSTFKVLSTKIEIKLKKPEAVRWEKLEGQGDVPTPKQFVADVKNLYPSSSPYTRNWDKLVGEIKEEEKNEKLEGDAALNRLFQQIYSDGSDEVKRAMNKSFMESGGTVLSTNWSDVGKRKVEINPPDDMEWKKY

SEQ ID NO: 916525 - protein, 311 aa, Homo sapiens
MLSQKEVAVADAKKSLELNPNNSTAMLRKGICEYHEKNYAAALETFTEGQKLDIETGFHRVGQAGLQLLTSSDPPALDSQSAGITGADANFSVWIKRCQEAQNGVKKSESVGFISPKLGYDWYQTESQVVITLMIKNVQKNDVNVEFSEKELSALVKLPSGEDYNLKLELLHPIIPEQSTFKVLSTKIEIKLKKPEAVRWEKLEGQGDVPTPKQFVADVKNLYPSSSPYTRNWDKLVGEIKEEEKNEKLEGDAALNRLFQQIYSDGSDEVKRAMNKSFMESGGTVLSTNWSDVGKRKVEINPPDDMEWKKY

SEQ ID NO: 916526 - protein, 277 aa, Homo sapiens
MLSQKEVAVADAKKSLELNPNNSTAMLRKGICEYHEKNYAAALETFTEGQKLDSADANFSVWIKRCQEAQNGSESEVWTHQSKIKYDWYQTESQVVITLMIKNVQKNDVNVEFSEKELSALVKLPSGEDYNLKLELLHPIIPEQSTFKVLSTKIEIKLKKPEAVRWEKLEGQGDVPTPKQFVADVKNLYPSSSPYTRNWDKLVGEIKEEEKNEKLEGDAALNRLFQQIYSDGSDEVKRAMNKSFMESGGTVLSTNWSDVGKRKVEINPPDDMEWKKY

SEQ ID NO: 916527 - protein, 365 aa, Homo sapiens; identical to SEQ ID NO: 916524

SEQ ID NO: 916528 - protein, 176 aa, Homo sapiens
MAAAAAGTATSQRFFQSFSDALIDEDPQAALEELTKALEQKPDDAQYYCQRAYCHILLGNYCVAVADAKKSLELNPNNSTAMLRKGICEYHEKNYAAALETFTEGQKLDIETGFHRVGQAGLQLLTSSDPPALDSQSAGITGADANFSVWIKRCQEAQNGVKKSESVGFISAKTRV

SEQ ID NO: 916529 - protein, 473 aa, Homo sapiens
EESHVGRAGAQLAWGSLSRWPPRSRWNRRCWRRSSLTWVSSLTTRLRTMWRRNERPTRAREEVTPRVVYACVAEPFDAPRCACCAREYGRIRHAAQRYRMRGQQTKWGQSFFSRKDSIRTIYTSLHNELKKVVTGRGALGGTAPHVEELLSHLSEQLCFFVQARMEIADFYEKMYTLSTQKFINAEELVGLLDAIMKKYSSRFHHPILSPLESSFQLEVDVLCHLLKAQAQVSEWKFLPSLVNLHSAHTKLQTWGQIFEKQRETKKHLFGGQSQKAVQPPHLFLWLMKLKNMLLAKFSFYFHEALSRQTTASEMKTLTAKANPDFFGKISSFIRKYDAANVSLIFDNRGSESFQGHGYHHPHSYREAPKGVDQYPAVVSLPSDRPVMHWPNVIMIMTDRTSDLNSLEKVVHFYDDKVQSTYFLTRPEPHFTIVIIFESKKSERDSHFISFLNEVSLALKNPKVFASLKPGSKG

SEQ ID NO: 916530 - protein, 457 aa, Homo sapiens
GEPRGSSWGAARMGESIPLAAPVPVEQAVLETFFSHLGIFSYDKAKDNVEKEREANKSAGGSWLSLLAALAHLAAAEKVYHSLTYLGQKLGGQSFFSRKDSIRTIYTSLHNELKKVVTGRGALGGTAPHVEELLSHLSEQLCFFVQARMEIADFYEKMYTLSTQKFINAEELVGLLDAIMKKYSSRFHHPILSPLESSFQLEVDVLCHLLKAQAQVSEWKFLPSLVNLHSAHTKLQTWGQIFEKQRETKKHLFGGQSQKAVQPPHLFLWLMKLKNMLLAKFSFYFHEALSRQTTASEMKTLTAKANPDFFGKISSFIRKYDAANVSLIFDNRGSESFQGHGYHHPHSYREAPKGVDQYPAVVSLPSDRPVMHWPNVIMIMTDRTSDLNSLEKVVHFYDDKVQSTYFLTRPEPHFTIVIIFESKKSERDSHFISFLNEVSLALKNPKVFASLKPGSKG

SEQ ID NO: 916531 - protein, 457 aa, Homo sapiens; identical to SEQ ID NO: 916530

SEQ ID NO: 916532 - protein, 457 aa, Homo sapiens; identical to SEQ ID NO: 916530

SEQ ID NO: 916533 - protein, 182 aa, Homo sapiens
MLLAKFSFYFHEALSRQTTASEMKTLTAKANPDFFGKISSFIRKYDAANVSLIFDNRGSESFQGHGYHHPHSYREAPKGVDQYPAVVSLPSDRPVMHWPNVIMIMTDRTSDLNSLEKVVHFYDDKVQSTYFLTRPEPHFTIVIIFESKKSERDSHFISFLNEVSLALKNPKVFASLKPGSKG

SEQ ID NO: 916534 - protein, 311 aa, Homo sapiens
MGKENCTTVAEFILLGLSDVPELRVCLFLLFLLIYGVTLLANLGMTALIQVSSRLHTPVYFFLSHLSFVDFCYSSIIVPKMLANIFNKDKAISFLGCMVQFYLFCTCGVTEVFLLAVMAYDRFVAICNPLLYMVTMSQKLRVELTSCCYFCGTVCSLIHSSLALRILFYRSNVINHFFCDLPPLLSLACSDVTVNETLLFLVATLNESVTIMIILTSYLLILTTILKIHSAESRHKAFSTCASHLTAITVSHGTILYIYCRPSSGNSGDVDKVATVFYTVVIPMLNPLIYSLRNKDVNKALRKVMGSKIHS

SEQ ID NO: 916535 - protein, 166 aa, Homo sapiens
MNFTPGPAPKLDTGDNGSLYCTEDSEGLSRWSHANSDTSSAPGHSTRPRCLPHPSGCAGHSPRFFSDSYRAPSLFNKGEGSSADRGTLSSWDLGQQPQGCPGFERQVQNCTHPLKARQDCTGHGPGLLTHCPQQPSQGTALVEEGQTQSALGWDAGIQSPFFHLKH

SEQ ID NO: 916536 - protein, 86 aa, Homo sapiens
PSSCIVNNTLKLKGASHSGSRSASSQHARRDRGASSMVPDTWRHPLLTVWVNEENAYLAPEWPIAGWHGVPLLRGERVSMGSTGRQ

SEQ ID NO: 916537 - protein, 232 aa, Homo sapiens
PASVHMLLSLPVRAQLFPDWQRQKAVQNNPYPSAFLQGEQDTVGVLDQVSPPPPRPFWEPAPPPSSLHLPPPRLWGAHGLREEPEFVTARAGESVVLRCDVIHPVTGQPPPYVVEWFKFGVPIPIFIKFGYYPPHVDPEYAGRASLHDKASLRLEQVRSEDQGWYECKVLMLDQQYDTFHNGSWVHLTINETWLGRGVRHVQVGSGVGSSSQSGQACSEAQSEESGAFREHG

SEQ ID NO: 916538 - protein, 431 aa, Homo sapiens
EAQLIMLLPLIVIQGPDSHFRPRGVDAAASTREVVVYAPLSKKQEIFYTAIVNRTIANMFGSSEKETIELSPTGRPKRRTRKSINYSKIDDFPNELEKLISQIQPEVDRERAVVEVNIPVESEVNLKLQNIMMLLRKCCNHPYLIEYPIDPVTQEFKIDEELVTNSGKFLILDRMLPELKKRGHKVLLFSQMTSMLDILMDYCHLRDFNFSRLDGSMSYSEREKNMHSFNTDPEVFIFLVSTRAGGLGINLTAADTVIIYDSDWNPQSDLQAQDRCHRIGQTKPVVVYRLVTANTIDQKIVERAAAKRKLEKLIIHKNHFKGGQSGLNLSKNFLDPKELMELLKSRDYEREIKGSREKVISDKDLELLLDRSDLIDQMNASGPIKEKMGIFKILENSEDSSPELMQFMGFRYFSYEVGFSWGEIGIMLSVV

SEQ ID NO: 916539 - protein, 184 aa, Homo sapiens
FSQRVDKENVVYSYYSPIKRNEIMALAATWMEVETIILSENKSRQRNLEGLDWLSLPAYIFFLCGMLSAFQHHTPSSSDFGLLDLRYRLESEVCTIGFPTFEVLGLRLASWLLTLQIAYCGTSPGDCQRPIGKDSLKILSSLSHLLPGSSLWAEHTCGWRRATAEELITHIGITIFQTVTHVSL

SEQ ID NO: 916540 - protein, 249 aa, Homo sapiens
CEMRGRREQRRGPFRLCSASNSRLLVRLFLRGNGEKVQPQVLAFPGKSSQPPSAGPTPPPSSRPPPSPPRRRRPAWLQDEAEVAAALAGYGFINPSSTGEGPARPSTQTLRRSGAFPCESVGVPGARPGRGAEGRPARRRPAPAPPLLPLPSRALWLGGEESRRVEKSREEWRRVEKSREEWTRRTVCSEAGLGGAGRTGFRPVSLSRGSPGVTPTPSHAEAFRPSCGIHANGAASAPPGQNLNVISGN

SEQ ID NO: 916541 - protein, 715 aa, Homo sapiens
MSCQISCKSRGRGGGGGGFRGFSSGSAVVSGGSRRSTSSFSCLSRHGGGGGGFGGGGFGSRSLVGLGGTKSISISVAGGGGGFGAAGGFGGRGGGFGGGSSFGGGSGFSGGGFGGGGFGGGRFGGFGGPGGVGGLGGPGGFGPGGYPGGIHEVSVNQSLLQPLNVKVDPEIQNVKAQEREQIKTLNNKFASFIDKVRFLEQQNQVLQTKWELLQQMNVGTRPINLEPIFQGYIDSLKRYLDGLTAERTSQNSELNNMQDLVEDYKKKYEDEINKRTAAENDFVTLKKDVDNAYMIKVELQSKVDLLNQEIEFLKVLYDAEISQIHQSVTDTNVILSMDNSRNLDLDSIIAEVKAQYEEIAQRSKEEAEALYHSKASRGNVGRATAPCHELGCTPSWKVYSKYEELQVTVGRHGDSLKEIKIEISELNRVIQRLQGEIAHVKKQCKNVQDAIADAEQRGEHALKDARNKLNDLEEALQQAKEDLARLLRDYQELMNVKLALDVEIATYRKLLEGEECSILGDLIWLKQLEGEKLPQAISKPDDKQGVAFFRRLLCPCLEAMPPMPSLMSGDLSSNVTVSVTSSTISSNVASKAAFGGSGGRGSSSGGGYSSGSSSYGSGGRQSGSRGGSGGGGSISGGGYGSGGGSGGRYGSGGGSKGGSISGGGYGSGGGKHSSGGGSRGGSSSGGGYGSGGGGSSSVKGSSGEAFGSSVTFSFR

SEQ ID NO: 916542 - protein, 252 aa, Homo sapiens
MGSGPFEHPVSPMHLSLSAIRGELVDSRCIKAYPLPLAPQDFEEEEADETETAWPPLPAVPCDYDHCRHLQVPCKELQRVGPAACLCPGLSSPAQPPDPPRMGEVRIAAEEGRAVVHWCAPFSPVLHYWLLLWDGSEAAQKGPPLNATVRRAELKGLKPGGIYVVCVVAANEAGASRVPQAGGEGLEGADIPAFGPCSRLAVPPNPRTLVHAAVGVGTALALLSCAALVWHFCLRDRWGCPRRAAARAAGAL

SEQ ID NO: 916543 - protein, 558 aa, Homo sapiens
WGSGMHLSPASASHPRQVMLHYRSDLLQMLDTLVFSSLLLFGFAEQKQLLEVELYADYRENSYVPTTGAIIEIHSKRIQLYGAYLRIHAHFTGLRYLLYNFPMTCAFIGVASNFTFLSVIVLFSYMQWVWGGIWPRHRFSLQVNIRKRDNSRKEVQRRISAHQPGPEGQEESTPQSDVTEDGESPEDPSGTEGQLSEEEKPDQQPLSGEEELEPEASDGSGSWEDAALLTEANLPAPAPASASAPVLETLGSSEPAGGALRQRPTCSSSRRKGADSSHSSTFPPDSSPLVFPSINYFVSSFFLDSEMGSGPFEHPVSPMHLSLSAIRGELVDSRCIKAYPLPLAPQDFEEEEADETETAWPPLPAVPCDYDHCRHLQVPCKELQRVGPAACLCPGLSSPAQPPDPPRMGEVRIAAEEGRAVVHWCAPFSPVLHYWLLLWDGSEAAQKGPPLNATVRRAELKGLKPGGIYVVCVVAANEAGASRVPQAGGEGLEGADIPAFGPCSRLAVPPNPRTLVHAAVGVGTALALLSCAALVWHFCLRDRWGCPRRAAARAAGAL

SEQ ID NO: 916544 - protein, 160 aa, Homo sapiens
MKAPLCPVICDRYLFSSSFQCIILDFGIFALYLSVEHHKFKNPKSEMLQIRISFQPHGKDAIEIKKETDTCHKSLDTAELLSTQLKCVHLVPVKLEKLVVVQHDLIIKILYQSACCSFDSVWRSFGSMDNLYWCYIWGSACLGPGLDTTKADNENRVGFY

SEQ ID NO: 916545 - protein, 148 aa, Homo sapiens
GDGQHSCAEMGTLPESSPSVVLLTLISLAISTYSILRVFQEDAQESALRGKKMRNTRWTTLARLLGTSLRAQLPEERRKSCQQDPVSCWRWLRTGFLLSSSAASSHKTAVPVLDLKACETMMEPSSAPPWSARFVLILFQSRHLNNRQ

SEQ ID NO: 916546 - protein, 801 aa, Homo sapiens
DYILVPPTTSENNEMVELQRIRMKDEIREYKFREARLLQDYTELEEENITLQKLVSTLKQNQVEYEGLKHEIKRFEEETVLLNSQLEDAIRLKEIAEHQLEEALETLKNEREQKNNLRKELSQYISLNDNHISISVDGLKFAEDGSEPNNDDKMNGHIHGPLVKLNGDYRTPTLRKGESLNPVSDLFSELNISEIQKLKQQLMQVEREKAILLANLQESQTQLEHTKGALTEQHERVHRLTEHVNAMRGLQSSKELKAELDGEKGRDSGEEAHDYEVDINGLEILECKYRVAVTEVIDLKAEIKALKEKYNKSVENYTDEKAKYESKIQMYDEQVTSLEKTTKESGEKMAHMEKELQKMTSIANENHSTLNTAQDELVTFSEELAQLYHHVCLCNNETPNRVMLDYYRQSRVTRSGSLKGPDDPRGLLSPRLARRGVSSPVETRTSSEPVAKESTEASKEPSPTKTPTISPVITAPPSSPVLDTSDIRKEPMNIYNLNAIIRDQIKHLQKAVDRSLQLSRQRAAARELAPMIDKDKEALMEEILKLKSLLSTKREQIATLRAVLKANKQTAEVALANLKNKYENEKAMVTETMTKLRNELKALKEDAATFSSLRAMFATRCDEYVTQLDEMQRQLAAAEDEKKTLNTLLRMAIQQKLALTQRLEDLEFDHEQSRRSKGKLGKSKIGSPKSRPRTSGASYLQNLLRVPPDPTSTESFLLKGPPSMSEFIQGHRLSKEKRLTVAPPEKIILANKNHPFKESLHERRSTCPSAMSSALQPGAGLRSNRKRGCKGGQGPEDRGPG

SEQ ID NO: 916547 - protein, 225 aa, Homo sapiens
MQPSVKSRNAQMLPMTSASVMRHAWERAPTASLSTQHTCCALTHSSTCLHAHTLRSLREREHEPSLLQTPKQALSCIIPQVCSLGMAQRPQPRRPKPSHVLLLKPCLLLRVCVSPEEGPSVSLACREALWFLVSSGLSVTSWKEPLPAYCPTAFHSTHIWGSSALCKALHVIMMKEDQPDPSAPTQGGTTLQETLTQPISAQERQASNCTISLSFPMQLPLNDDQ

SEQ ID NO: 916548 - protein, 225 aa, Homo sapiens; identical to SEQ ID NO: 916547

SEQ ID NO: 916549 - protein, 164 aa, Homo sapiens
EKNLKETKMFQEKEDKERLAGLKTQGEDRTFAEGRTTYSDTRKARVREEEIVVDRPGACKADILVAAFGVTEGKLLEVKRPMGPGGTHGEPGKKLYLMNTNLCIWHAPFSKACHSVLFQRCLKTQTTDGCIHMTDFKHSTLQEKSRIRAWKVGGSTTLLFRFSF

SEQ ID NO: 916550 - protein, 392 aa, Homo sapiens
MAGILGEPHLFFEDHLRNISSVMLVLFIHPLQCCACHRILPCQCTFIPMEPLVLLLVETSEAPFLFSFLSRKFNNMLLYCVPKFSLVGSKFTVRTRVGIDGMKIVETQNEEYPHTFQVSGKERTLELQASSAQDKEEWIKALQETIDAFHQRHETFRNAIAKDNDIHSEVSTAELGKRAPRWIRDNEVTMCMKCKEPFNALTRRRHHCRACGYVVCWKCSDYKAQLEYDGGKLSKVCKDCYQIISGFTDSEEKKRKGILEIESAEVSGNSVVCSFLQYMEKSKPWQKAWCVIPKQDPLVLYMYGAPQDVRAQATIPLLGYVVDEMPRSADLPHSFKLTQSKSVHSFAADSEELKQKWLKVILLAVTGETPGGPNEHPATLDDHPEPKKKSEC

SEQ ID NO: 916551 - protein, 220 aa, Homo sapiens
MLFVFISLVLFAAPINFLVAVSVSLLGALLGGAEPPSVSSEGSDVLVLSPFSPPECSIGNPLSPIPYPSSPTLYPPLPEELSPASTTCSGASYQPPKGNLCPLREVTNGEEVTVRVHVPFSMSDLAVYKEEFGHFSEDPGKFIDKFEKLTLTYSLTWQDLHVLLSLCCTVEEKQHILGAARTHAHEVLACNPNHDIYQAGGEIHLSFWDWLLLNMQALIL

SEQ ID NO: 916552 - protein, 1767 aa, Homo sapiens
VDTSSGAVLPKGHCGDCLQPPQLIPLCLPALKEGLPHVMKVSTLRESSAMASPLPREMEEELVPTGSEPGDTRAKPPVKPKPRALPAKPALPAKPSLLVPVGPRPPRGPLAELPSARKMNMLAGPQPYGGSKRPLPFAPRPAVEASTGGEATQETGKEEAGKEEPPPLTPPARCAAPGGVRKAPAPFRPASERFAATTVEEILAKMEQPRKEVLASPDRLWGSRLTFNHDGSSRYGPRTYGTTTAPRDEDGSTLFRGWSQEGPVKSPAECREEHSKTPEERSLPSDLAFNGDLAKAASSELPADISKPWIPSSPAPSSENGGPASPGLPAEASGSGPGSPHLHPPDKSSPCHSQLLEAQTPEASQASPCPAVTPSAPSAALPDEGSRHTPSPGLPAEGAPEAPRPSSPPPEVLEPHSLDQPPATSPRPLIEVGELLDLTRTFPSGGEEEAKGDAHLRPTSLVQRRFSEGVLQSPSQDQEKLGGSLAALPQGQGSQLALDRPFGAESNWSLSQSFEWTFPTRPSGLGVWRLDSPPPSPITEASEAAEAAEAGNLAVSSREEGVSQQGQGAGSAPSGSGSSWVQGDDPSMSLTQKGDGESQPQFPAVPLEPLPTTEGTPGLPLQQAEERYESQEPLAGQESPLPLATREAALPILEPVLGQEQPAAPDQPCVLFADAPEPGQALPVEEEAVTLARAETTQARTEAQDLCRASPEPPGPESSSRWLDDLLASPPPSGGGARRGAGAELKDTQSPSTCSEGLLGWSQKDLQSEFGITGDPQPSSFSPSSWCQGASQDYGLGGASPRGDPGLGERDWTSKYGQGAGEGSTREWASRCGIGQEEMEASSSQDQSKVSAPGVLTAQDRVVGKPAQLGTQRSQEADVQDWEFRKRDSQGTYSSRDAELQDQEFGKRDSLGTYSSRDVSLGDWEFGKRDSLGAYASQDANEQGQDLGKRDHHGRYSSQDADEQDWEFQKRDVSLGTYGSRAAEPQEQEFGKSAWIRDYSSGGSSRTLDAQDRSFGTRPLSSGFSPEEAQQQDEEFEKKIPSVEDSLGEGSRDAGRPGERGSGGLFSPSTAHVPDGALGQRDQSSWQNSDASQEVGGHQERQQAGAQGPGSADLEDGEMGKRGWVGEFSLSVGPQREAAFSPGQQDWSRDFCIEASERSYQFGIIGNDRVSGAGFSPSSKMEGGHFVPPGKTTAGSVDWTDQLGLRNLEVSSCVGSGGSSEARESAVGQMGWSGGLSLRDMNLTGCLESGGSEEPGGIGVGEKDWTSDVNVKSKDLAEVGEGGGHSQARESGVGQTDWSGVEAGEFLKSRERGVGQADWTPDLGLRNMAPGAVCSPGESKELGVGQMDWGNNLGLRDLEVTCDPDSGGSQGLRGCGVGQMDWTQDLAPQNVELFGAPSEAREHGVGGVSQCPEPGLRHNGSLSPGLEARDPLEARELGVGETSGPETQGEDYSSSSLEPHPADPGMETGEALSFGASPGRCPARPPPSGSQGLLEEMLAASSSKAVARRESAASGLGGLLEEEGAGAGAAQEEVLEPGRDSPPSWRPQPDGEASQTEDVDGTWGSSAARWSDQGPAQTSRRPSQGPPARSPSQDFSFIEDTEILDSAMYRSRANLGRKRGHRAPVIRPGGTLGLSEAADSDAHLFQDSTEPRASRVPSSDEEVVEEPQSRRTRMSLGTKGLKVNLFPGLSPSALKAKLRPRNRSAEEGELAESKSSQKESAVQRSKSCKVPGLGKPLTLPPKPEKSSGSEGSSPNWLQALKLKKKKV

SEQ ID NO: 916553 - protein, 731 aa, Homo sapiens
MWCSAAVDIMFLLDGSNSVGKGSFERSKHFAITVCDGLDISPERILIIVTDGKSQGDVALPSKQLKERGVTVFAVGVRFPRWEELHALASEPRGQHVLLAEQVEDATNGLFSTLSSSAICSSATPDCRVEAHPCEHRTLEMVREFAGNAPCWRGSRRTLAVLAAHCPFYREDPALEEHLIGLPLCGQPRVRPSQELLPTQSGAFCPQMRNRSCDSRAHGPGDAGEARRLMGISLIGPCDSQPCQNGGTCVPEGLDGYQCLCPLAFGGEANCGSFSAPSPSWEMFGISGGTARMPHDHGLTVGVAVIPAALKLSLECRVDLLFLLDSSAGTTLDGFLRAKVFVKRFVRAVLSEDSRARVGVATYSRELLVAVPVGEYQDVPDLVWSLDGIPFRGGPTLTGSALRQAAERGFGSATRTGQDRPRRVVVLLTESHSEDEVAGPARHARARELLLLGVGSEAVRAELEEITGSPKHVMVYSDPQDLFNQIPELQGKLCSRQRPGCRTQALDLVFMLDTSASVGPENFAQMQSFVRSCALQFEVNPDVTQVGLVVYGSQVQTAFGLDTKPTRAAMLRAISQAPYLGGVGSAGTALLHIYDKVMTVQRGARPGVPKAVVVLTGGRGAEDAAVPAQKLRNNGISVLVVGVGPVLSEGLRRLAGPRDSLIHVAAYADLRYHQDVLIEWLCGEAKQPVNLCKPSPCMNEGSCVLQNGSYRCKCRDGWEGPHCENRFLRRP

SEQ ID NO: 916554 - protein, 731 aa, Homo sapiens; identical to SEQ ID NO: 916553

SEQ ID NO: 916555 - protein, 145 aa, Homo sapiens; identical to SEQ ID NO: 747275

SEQ ID NO: 916556 - protein, 303 aa, Homo sapiens
TCLGLCPSLTVTMARGRYSRCFCPQGEGSGPHREPGHRGCDGLADGARRRPRCGRAFRDSPCDISWDGEPTSSEQGGLEGSGSAAGEGKPALSEEERQEQTKRMLELVAQKQREREEREEREALERERQRRRQGQELSAARQRLQEDEMRRAAEERRREKAEELAARQRVREKIERDKAERAKKYGGSVGSQPPPVAPEPGPVPSSPSQEPPPKREYDQCRIQVRLPDGTSLTQTFRAREQLAAVRLYVELHRGEELGGGQDPVQLLSGFPRRAFSEADMERPLQELGLVPSAVLIVAKKCPS

SEQ ID NO: 916557 - protein, 108 aa, Homo sapiens
MDWLMEHEDDPDVDEPPPKREYDQCRIQVRLPDGTSLTQTFRAREQLAAVRLYVELHRGEELGGGQDPVQLLSGFPRRAFSEADMERPLQELGLVPSAVLIVAKKCPS

SEQ ID NO: 916558 - protein, 128 aa, Homo sapiens [sequence omitted]

SEQ ID NO: 916559 - protein, 124 aa, Homo sapiens [sequence omitted]

SEQ ID NO: 916560 - protein, 124 aa, Homo sapiens [sequence omitted]

SEQ ID NO: 916561 - protein, 124 aa, Homo sapiens [sequence omitted]

SEQ ID NO: 916562 - protein, 148 aa, Homo sapiens
MVLQDVMIKGNWVNGTLDLSVIFLQLPMSLLFGFTDMFDPRLGEKEFRKARKENMEIQVKPVAELLAFLLKVHPKLCAVVQVQLPFQLVLEQYLLLEPFSHATLRLSSNVYSHNFRAEETFGDALSQHPPFVTEEHRTRQNLPKNMVE

SEQ ID NO: 916563 - protein, 177 aa, Homo sapiens
MPVGPHTHSRCLRTTENKDSWVLSCYIRGLMSGPSSAGLLEFAGGPLQILFAWVSPAEVAEQQRFLPAPSSGSFILEEHLPDASQSSPPLTGAAAFLSEMPCPVRRNLERQSGHSCFAALQSHWGKKKKLLQLAQCLPKQPPSFALETQGPGSIGTQGNLLVCVLQKLWEKHNFWAG

SEQ ID NO: 916564 - protein, 187 aa, Homo sapiens
FFALYALVRTFSTMLKRSGPYWTHVLFTWKSKEGLKVYVNGTLSTSDPSGKVSRDYGESNVNLVIGSEQDQAKCYENGAFDEFIIWERALTPDEIAMYFTAAIGKHALLSSTLPSLFMTSTASPVMPTDAYHPIITNLTEERKTFQSPGVILSYLQNVSLSLPSKSLSEQTALNLTKIEFKKSRNFY

SEQ ID NO: 916565 - protein, 134 aa, Homo sapiens
MSQLRQRLHYPTDYRQQPHQDSVEGSSLGRTAVPGKASLKPEQEEAGPSEGSGKSLSARGNCLDKGPEKGIACMFERQKESPGGKKMATIYQIFVRPLSNLSLRGSCLGQDCISQQPLQSSVAVYLVLTYRQCI

SEQ ID NO: 916566 - protein, 158 aa, Homo sapiens
LKYMNRRASQMLLMFLLAICLLAIIFVPQEMQTLREVLATLGLGASALANTLAFAHGNEVIPTIISKMINHKLPVWIFNRYSCIAVSTQRARAMGINATFANIAGALAPLMMILSVYSPPLPWIIYGVFPFISGFAFLLLPETRNKPLFDTIQDEKNE

SEQ ID NO: 916567 - protein, 177 aa, Homo sapiens
LKYMNRRASQMLLMFLLAICLLAIIFVPQEMQTLREVLATLGLGASALANTLAFAHGNEVIPTIISKMINHKLPVWIFNRYSCIAVSTQRARAMGINATFANIAGALAPLMMILSVYSPPLPWIIYGVFPFISGFAFLLLPETRNKPLFDTIQDEKNERKDPREPKQEDPRVEVTQF

SEQ ID NO: 916568 - protein, 148 aa, Homo sapiens
MEKLAPKLQEVSQRSKGALGLSKLKNPGPLVRVTFHALVRGAFGISYIVLKVLGPKDSKITRLSQSSNREHLVPCEDVLLTKPEGIMQIPRNSHRTTMGCQWRLVAPLNHIIQLNIINFPMKPTTFVCHGHLRVYEGFGPGKKLIGEC

SEQ ID NO: 916569 - protein, 124 aa, Homo sapiens
LYPSIFNLFFLNLSRAQVKKLLNKVVLRESCFYRKLTDTSKDEENHEESESLQEDMLGNRLLLPTPTVKQESKDVEENVGLIVYNGAMVDVGSLLQKLEKSEKVRAEVEQKLQLLEEKTGKGQL

SEQ ID NO: 916570 - protein, 1150 aa, Homo sapiens
MAQFGGQKNPPWATQFTATAVSQPAALGVQQPSLLGASPTIYTQQTALAAAGLTTQTPANYQLTQTAALQQQAAAAAAALQQQYSQPQQALYSVQQQLQQPQQTLLTQPAVALPTSLSLSTPQPTAQITVSYPTPRSSQQQTQPQKQRVFTGVVTKLHDTFGFVDEDVFFQLSAVKGKTPQVGDRVLVEATYNPNMPFKWNAQRIQTLPNQNQSQTQPLLKTPPAVLQPIAPQTTFGVQTQPQPQSLLQAQISAASITPLLQTQPQPLLQQPQQKAGLLQPPVRIVSQPQPARRLDPPSRFSGRNDRGDQVPNRKDDRSRERERERRRSRERSPQRKRSRERSPRRERERSPRRVRRVVPRYTVQFSKFSLDCPSCDMMELRRRYQNLYIPSDFFDAQFTWVDAFPLSRPFQLGNYCNFYVMHREVESLEKNMAILDPPDADHLYSAKVMLMASPSMEDLYHKSCALAEDPQELRDGFQHPARLVKFLVGMKGKDEAMAIGGHWSPSLDGPDPEKDPSVLIKTAIRCCKALTGIDLSVCTQWYRFAEIRYHRPEETHKGRTVPAHVETVVLFFPDVWHCLPTRSEWETLSRGYKQQLVEKLQGERKEADGEQDEEEKDDGEAKEISTPTHWSKLDPKTMKVNDLRKELESRALSSKGLKSQLIARLTKQLKVEEQKEEQKELEKSEKEEDEDDDRKSEDDKEEEERKRQEEIERQRRERRYILPDEPAIIVHPNWAAKSGKFDCSIMSLSVLLDYRLEDNKEHSFEVSLFAELFNEMLQRDFGVRIYKSLLSLPEKEDKKEKDKKSKKDERKDKKEERDDETDEPKPKRRKSGDDKDKKEDRDERKKEDKRKDDSKDDDETEEDNNQDEYDPMEAEEAEDEEDDRDEEEMTKRDDKRDINRYCKERPSKDKEKEKTQMITINRDLLMAFVYFDQSHCGYLLEKDLEEILYTLGLHLSRAQVKKLLNKVVLRESCFYRKLTDTSKDEENHEESESLQEDMLGNRLLLPTPTVKQESKDVEENVGLIVYNGAMVDVGSLLQKLEKSEKVRAEVEQKLQLLEEKTDEDEKTILNLENSNKSLSGELREVKKDLSQLQENLKISENMNLQFENQMNKTIRNLSTVMDEIHTVLKKDNVKNEDKDQKSKENGASV

SEQ ID NO: 916571 - protein, 106 aa, Homo sapiens [sequence omitted]

SEQ ID NO: 916572 - protein, 979 aa, Homo sapiens
MAQFGGQKNPPWATQFTATAVSQPAALGVQQPSLLGASPTIYTQQTALAAAGLTTQTPANYQLTQTAALQQQAAAAAAALQQQYSQPQQALYSVQQQLQQPQQTLLTQPAVALPTSLSLSTPQPTAQITVSYPTPRSSQQQTQPQKQRVFTGVVTKLHDTFGFVDEDVFFQLSAVKGKTPQVGDRVLVEATYNPNMPFKWNAQRIQTLPNQNQSQTQPLLKTPPAVLQPIAPQTTFGVQTQPQPQSLLQAQISAASITPLLQTQPQPLLQQPQQKAGLLQPPVRIVSQPQPARRLDPPSRFSGRNDRGDQVPNRKDDRSRERERERRRSRERSPQRKRSRERSPRRERERSPRRVRRVVPRYTVQFSKFSLDCPSCDMMELRRRYQNLYIPSDFFDAQFTWVDAFPLSRPFQLGNYCNFYVMHREVESLEKNMAILDPPDADHLYSAKVMLMASPSMEDLYHKSCALAEDPQELRDGFQHPARLVKFLVGMKGKDEAMAIGGHWSPSLDGPDPEKDPSVLIKTAIRCCKALTGIDLSVCTQWYRFAEIRYHRPEETHKGRTVPAHVETVVLFFPDVWHCLPTRSEWETLSRGYKQQLVEKLQGERKEADGEQDEEEKDDGEAKEISTPTHWSKLDPKTMKVNDLRKELESRALSSKGLKSQLIARLTKQLKVEEQKEEQKELEKSEKEEDEDDDRKSEDDKEEEERKRQEEIERQRRERRYILPDEPAIIVHPNWAAKSGKFDCSIMSLSVLLDYRLEDNKEHSFEVSLFAELFNEMLQRDFGVRIYKSLLSLPEKEDKKEKDKKSKKDERKDKKEERDDETDEPKPKRRKSGDDKDKKEDRDERKKEDKRKDDSKDDDETEEDNNQDEYDPMEAEEAEDEEDDRDEEEMTKRDDKRDINRYCKERPSKDKEKEKTQMITINRDLLMAFVYFDQSHCGYLLEKEVVRERQENLRLVRLMPDKEAMIGNSKKNCLLIETR

SEQ ID NO: 916573 - protein, 965 aa, Homo sapiens
MAQFGGQKNPPWATQFTATAVSQPAALGVQQPSLLGASPTIYTQQTALAAAGLTTQTPANYQLTQTAALQQQAAAAAAALQQQYSQPQQALYSVQQQLQQPQQTLLTQPAVALPTSLSLSTPQPTAQITVSYPTPRSSQQQTQPQKQRVFTGVVTKLHDTFGFVDEDVFFQLSAVKGKTPQVGDRVLVEATYNPNMPFKWNAQRIQTLPNQNQSQTQPLLKTPPAVLQPIAPQTTFGVQTQPQPQSLLQAQISAASITPLLQTQPQPLLQQPQQKAGLLQPPVRIVSQPQPARRLDPPSRFSGRNDRGDQVPNRKDDRSRERERERRRSRERSPQRKRSRERSPRRERERSPRRVRRVVPRYTVQFSKFSLDCPSCDMMELRRRYQNLYIPSDFFDAQFTWVDAFPLSRPFQLGNYCNFYVMHREVESLEKNMAILDPPDADHLYSAKVMLMASPSMEDLYHKSCALAEDPQELRDGFQHPARLVKFLVGMKGKDEAMAIGGHWSPSLDGPDPEKDPSVLIKTAIRCCKALTGIDLSVCTQWYRFAEIRYHRPEETHKGRTVPAHVETVVLFFPDVWHCLPTRSEWETLSRGYKQQLVEKLQGERKEADGEQDEEEKDDGEAKEISTPTHWSKLDPKTMKVNDLRKELESRALSSKGLKSQLIARLTKQLKVEEQKEEQKELEKSEKEEDEDDDRKSEDDKEEEERKRQEEIERQRRERRYILPDEPAIIVHPNWAAKSGKFDCSIMSLSVLLDYRLEDNKEHSFEVSLFAELFNEMLQRDFGVRIYKSLLSLPEKEDKKEKDKKSKKDERKDKKEERDDETDEPKPKRRKSGDDKDKKEDRDERKKEDKRKDDSKDDDETEEERKRQEEIEARSRKKIYLPDEPASCVHPNGAAKSGKFDGSIMSLSVLWDYRLEDNKEHSLRFHCLGTFKKCSKRFGVSVYTNHYCLFPEKRGQQRKDKKAKG

SEQ ID NO: 916574 - protein, 639 aa, Homo sapiens [sequence omitted]

SEQ ID NO: 916575 - protein, 1162 aa, Homo sapiens
MAQFGGQKNPPWATQFTATAVSQPAALGVQQPSLLGASPTIYTQQTALAAAGLTTQTPANYQLTQTAALQQQAAAAAAALQQQYSQPQQALYSVQQQLQQPQQTLLTQPAVALPTSLSLSTPQPTAQITVSYPTPRSSQQQTQPQKQRVFTGVVTKLHDTFGFVDEDVFFQLSAVKGKTPQVGDRVLVEATYNPNMPFKWNAQRIQTLPNQNQSQTQPLLKTPPAVLQPIAPQTTFGVQTQPQPQSLLQAQISAASITPLLQTQPQPLLQQPQQKAGLLQPPVRIVSQPQPARRLDPPSRFSGRNDRGDQVPNRKDDRSRERERERRRSRERSPQRKRSRERSPRRERERSPRRVRRVVPRYTVQFSKFSLDCPSCDMMELRRRYQNLYIPSDFFDAQFTWVDAFPLSRPFQLGNYCNFYVMHREVESLEKNMAILDPPDADHLYSAKTFDRIELFDYNEVMLMASPSMEDLYHKSCALAEDPQELRDGFQHPARLVKFLVGMKGKDEAMAIGGHWSPSLDGPDPEKDPSVLIKTAIRCCKALTGIDLSVCTQWYRFAEIRYHRPEETHKGRTVPAHVETVVLFFPDVWHCLPTRSEWETLSRGYKQQLVEKLQGERKEADGEQDEEEKDDGEAKEISTPTHWSKLDPKTMKVNDLRKELESRALSSKGLKSQLIARLTKQLKVEEQKEEQKELEKSEKEEDEDDDRKSEDDKEEEERKRQEEIERQRRERRYILPDEPAIIVHPNWAAKSGKFDCSIMSLSVLLDYRLEDNKEHSFEVSLFAELFNEMLQRDFGVRIYKSLLSLPEKEDKKEKDKKSKKDERKDKKEERDDETDEPKPKRRKSGDDKDKKEDRDERKKEDKRKDDSKDDDETEEDNNQDEYDPMEAEEAEDEEDDRDEEEMTKRDDKRDINRYCKERPSKDKEKEKTQMITINRDLLMAFVYFDQSHCGYLLEKDLEEILYTLGLHLSRAQVKKLLNKVVLRESCFYRKLTDTSKDEENHEESESLQEDMLGNRLLLPTPTVKQESKDVEENVGLIVYNGAMVDVGSLLQKLEKSEKVRAEVEQKLQLLEEKTDEDEKTILNLENSNKSLSGELREVKKDLSQLQENLKISENMNLQFENQMNKTIRNLSTVMDEIHTVLKKDNVKNEDKDQKSKENGASV

SEQ ID NO: 916576 - protein, 711 aa, Homo sapiens
MAQFGGQKNPPWATQFTATAVSQPAALGVQQPSLLGASPTIYTQQTALAAAGLTTQTPANYQLTQTAALQQQAAAAAAALQQQYSQPQQALYSVQQQLQQPQQTLLTQPAVALPTSLSLSTPQPTAQITVSYPTPRSSQQQTQPQKQRVFTGVVTKLHDTFGFVDEDVFFQLSAVKGKTPQVGDRVLVEATYNPNMPFKWNAQRIQTLPNQNQSQTQPLLKTPPAVLQPIAPQTTFGVQTQPQPQSLLQAQISAASITPLLQTQPQPLLQQPQQKAGLLQPPVRIVSQPQPARRLDPPSRFSGRNDRGDQVPNRKDDRSRERERERRRSRERSPQRKRSRERSPRRERERSPRRVRRVVPRYTVQFSKFSLDCPSCDMMELRRRYQNLYIPSDFFDAQFTWVDAFPLSRPFQLGNYCNFYVMHREVESLEKNMAILDPPDADHLYSAKVMLMASPSMEDLYHKSCALAEDPQELRDGFQHPARLVKFLVGMKGKDEAMAIGGHWSPSLDGPDPEKDPSVLIKTAIRCCKALTGIDLSVCTQWYRFAEIRYHRPEETHKGRTVPAHVETVVLFFPDVWHCLPTRSEWETLSRGYKQQLVEKLQGERKEADGEQDEEEKDDGEAKEISTPTHWSKLDPKTMKVNDLRKELESRALSSKGLKSQLIARLTKQLKVEEQKEEQKELEKSEKEEDEDDDRKSEDDKEVCTQSIIIL

SEQ ID NO: 916577 - protein, 404 aa, Homo sapiens
MSLSVLLDYRLEDNKEHSFEVSLFAELFNEMLQRDFGVRIYKSLLSLPEKEDKKEKDKKSKKDERKDKKEERDDETDEPKPKRRKSGDDKDKKEDRDERKKEDKRKDDSKDDDETEEDNNQDEYDPMEAEEAEDEEDDRDEEEMTKRDDKRDINRYCKERPSKDKEKEKTQMITINRDLLMAFVYFDQSHCGYLLEKDLEEILYTLGLHLSRAQVKKLLNKVVLRESCFYRKLTDTSKDEENHEESESLQEDMLGNRLLLPTPTVKQESKDVEENVGLIVYNGAMVDVGSLLQKLEKSEKVRAEVEQKLQLLEEKTDEDEKTILNLENSNKSLSGELREVKKDLSQLQENLKISENMNLQFENQMNKTIRNLSTVMDEIHTVLKKDNVKNEDKDQKSKENGASV

SEQ ID NO: 916578 - protein, 639 aa, Homo sapiens [sequence omitted]

SEQ ID NO: 916579 - protein, 484 aa, Homo sapiens
AAVYYYYTVLEEQKELEKSEKEEDEDDDRKSEDDKEEEERKRQEEIERQRRERRYILPDEPAIIVHPNWAAKSGKFDCSIMSLSVLLDYRLEDNKEHSFEVSLFAELFNEMLQRDFGVRIYKSLLSLPEKEDKKEKDKKSKKDERKDKKEERDDETDEPKPKRRKSGDDKDKKEDRDERKKEDKRKDDSKDDDETEEDNNQDEYDPMEAEEAEDEEDDRDEEEMTKRDDKRDINRYCKERPSKDKEKEKTQMITINRDLLMAFVYFDQSHCGYLLEKDLEEILYTLGLHLSRAQVKKLLNKVVLRESCFYRKLTDTSKDEENHEESESLQEDMLGNRLLLPTPTVKQESKDVEENVGLIVYNGAMVDVGSLLQKLEKSEKVRAEVEQKLQLLEEKTDEDEKTILNLENSNKSLSGELREVKKDLSQLQENLKISENMNLQFENQMNKTIRNLSTVMDEIHTVLKKDNVKNEDKDQKSKENGASV

SEQ ID NO: 916580 - protein, 152 aa, Homo sapiens [sequence omitted]

SEQ ID NO: 916581 - protein, 639 aa, Homo sapiens [sequence omitted]

SEQ ID NO: 916582 - protein, 1150 aa, Homo sapiens; identical to SEQ ID NO: 916570

SEQ ID NO: 916583 - protein, 1102 aa, Homo sapiens
MAQFGGQKNPPWATQFTATAVSQPAALGVQQPSLLGASPTIYTQQTALAAAGLTTQTPANYQLTQTAALQQQAAAAAAALQQQYSQPQQALYSVQQQLQQPQQTLLTQPAVALPTSLSLSTPQPTAQITVSYPTPRSSQQQTQPQKQRVFTGVVTKLHDTFGFVDEDVFFQLSAVKGKTPQVGDRVLVEATYNPNMPFKWNAQRIQTLPNQNQSQTQPLLKTPPAVLQPIAPQTTFGVQTQPQPQSLLQAQISAASITPLLQTQPQPLLQQPQQKAGLLQPPVRIVSQPQPARRLDPPSRFSGRNDRGDQVPNRKDDRSRERERERRRSRERSPQRKRSRERSPRRERERSPRRVRRVVPRYTVQFSKFSLDCPSCDMMELRRRYQNLYIPSDFFDAQFTWVDAFPLSRPFQLGNYCNFYVMHREVESLEKNMAILDPPDADHLYSAKVMLMASPSMEDLYHKSCALAEDPQELRDGFQHPARLVKFLVGMKGKDEAMAIGGHWSPSLDGPDPEKDPSVLIKTAIRCCKALTGIDLSVCTQWYRFAEIRYHRPEETHKGRTVPAHVETVVLFFPDVWHCLPTRSEWETLSRGYKQQLVEKLQGERKEADGEQDEEEKDDGEAKEISTPTHWSKLDPKTMKVNDLRKELESRALSSKGLKSQLIARLTKQLKVEEQKEEQKELEKSEKEEDEDDDRKSEDDKEEEERKRQEEIERQRRERRYILPDEPAIIVHPNWAAKSGKFDCSIMSLSVLLDYRLEDNKEHSFEVSLFAELFNEMLQRDFGVRIYKSLLSLPEKEDKKEKDKKSKKDERKDKKEERDDETDEPKPKRRKSGDDKDKKEDRDERKKEDKRKDDSKDDDETEEDNNQDEYDPMEAEEAEDEEDDRDEEEMTKRDDKRDINRYCKERPSKDKEKEKTQMITINRDLLMAFVYFDQSHCGYLLEKDLEEILYTLGLHLSRAQVKKLLNKVVLRESCFYRKLTDTSKDEENHEESESLQEDMLGNRLLLPTPTVKQESKDVEENVGLIVYNGAMVDVGSLLQKLEKSEKVRAEVEQKLQLLEEKTDEDEKTILNLENSNKSLSGELREVKKDLSQLQENLKISET

SEQ ID NO: 916584 - protein, 1150 aa, Homo sapiens; identical to SEQ ID NO: 916570

SEQ ID NO: 916585 - protein, 1086 aa, Homo sapiens
GIRGDTSGKQQLRQLLQQQYSQPQQALYSVQQQLQQPQQTLLTQPAVALPTSLSLSTPQPTAQITVSYPTPRSSQQQTQPQKQRVFTGVVTKLHDTFGFVDEDVFFQLSAVKGKTPQVGDRVLVEATYNPNMPFKWNAQRIQTLPNQNQSQTQPLLKTPPAVLQPIAPQTTFGVQTQPQPQSLLQAQISAASITPLLQTQPQPLLQQPQQKAGLLQPPVRIVSQPQPARRLDPPSRFSGRNDRGDQVPNRKDDRSRERERERRRSRERSPQRKRSRERSPRRERERSPRRVRRVVPRYTVQFSKFSLDCPSCDMMELRRRYQNLYIPSDFFDAQFTWVDAFPLSRPFQLGNYCNFYVMHREVESLEKNMAILDPPDADHLYSAKVMLMASPSMEDLYHKSCALAEDPQELRDGFQHPARLVKFLVGMKGKDEAMAIGGHWSPSLDGPDPEKDPSVLIKTAIRCCKALTGIDLSVCTQWYRFAEIRYHRPEETHKGRTVPAHVETVVLFFPDVWHCLPTRSEWETLSRGYKQQLVEKLQGERKEADGEQDEEEKDDGEAKEISTPTHWSKLDPKTMKVNDLRKELESRALSSKGLKSQLIARLTKQLKVEEQKEEQKELEKSEKEEDEDDDRKSEDDKEEEERKRQEEIERQRRERRYILPDEPAIIVHPNWAAKSGKFDCSIMSLSVLLDYRLEDNKEHSFEVSLFAELFNEMLQRDFGVRIYKSLLSLPEKEDKKEKDKKSKKDERKDKKEERDDETDEPKPKRRKSGDDKDKKEDRDERKKEDKRKDDSKDDDETEEDNNQDEYDPMEAEEAEDEEDDRDEEEMTKRDDKRDINRYCKERPSKDKEKEKTQMITINRDLLMAFVYFDQSHCGYLLEKDLEEILYTLGLHLSRAQVKKLLNKVVLRESCFYRKLTDTSKDEENHEESESLQEDMLGNRLLLPTPTVKQESKDVEENVGLIVYNGAMVDVGSLLQKLEKSEKVRAEVEQKLQLLEEKTDEDEKTILNLENSNKSLSGELREVKKDLSQLQENLKISENMNLQFENQMNKTIRNLSTVMDEIHTVLKKDNVKNEDKDQKSKENGASV

SEQ ID NO: 916586 - protein, 639 aa, Homo sapiens [sequence omitted]

SEQ ID NO: 916587 - protein, 539 aa, Homo sapiens
MDEEEKDDGEAKEISTPTHWSKLDPKTMKVNDLRKELESRALSSKGLKSQLIARLTKQLKVEEQKEEQKELEKSEKEEDEDDDRKSEDDKEEEERKRQEEIERQRRERRYILPDEPAIIVHPNWAAKSGKFDCSIMSLSVLLDYRLEDNKEHSFEVSLFAELFNEMLQRDFGVRIYKSLLSLPEKEDKKEKDKKSKKDERKDKKEERDDETDEPKPKRRKSGDDKDKKEDRDERKKEDKRKDDSKDDDETEEDNNQDEYDPMEAEEAEDEEDDRDEEEMTKRDDKRDINRYCKERPSKDKEKEKTQMITINRDLLMAFVYFDQSHCGYLLEKDLEEILYTLGLHLSRAQVKKLLNKVVLRESCFYRKLTDTSKDEENHEESESLQEDMLGNRLLLPTPTVKQESKDVEENVGLIVYNGAMVDVGSLLQKLEKSEKVRAEVEQKLQLLEEKTDEDEKTILNLENSNKSLSGELREVKKDLSQLQENLKISENMNLQFENQMNKTIRNLSTVMDEIHTVLKKDNVKNEDKDQKSKENGASV

SEQ ID NO: 916588 - protein, 551 aa, Homo sapiens
MAQQEWIMMEAEKDEEEKDDGEAKEISTPTHWSKLDPKTMKVNDLRKELESRALSSKGLKSQLIARLTKQLKVEEQKEEQKELEKSEKEEDEDDDRKSEDDKEEEERKRQEEIERQRRERRYILPDEPAIIVHPNWAAKSGKFDCSIMSLSVLLDYRLEDNKEHSFEVSLFAELFNEMLQRDFGVRIYKSLLSLPEKEDKKEKDKKSKKDERKDKKEERDDETDEPKPKRRKSGDDKDKKEDRDERKKEDKRKDDSKDDDETEEDNNQDEYDPMEAEEAEDEEDDRDEEEMTKRDDKRDINRYCKERPSKDKEKEKTQMITINRDLLMAFVYFDQSHCGYLLEKDLEEILYTLGLHLSRAQVKKLLNKVVLRESCFYRKLTDTSKDEENHEESESLQEDMLGNRLLLPTPTVKQESKDVEENVGLIVYNGAMVDVGSLLQKLEKSEKVRAEVEQKLQLLEEKTDEDEKTILNLENSNKSLSGELREVKKDLSQLQENLKISENMNLQFENQMNKTIRNLSTVMDEIHTVLKKDNVKNEDKDQKSKENGASV

SEQ ID NO: 916589 - protein, 526 aa, Homo sapiens
LAGSPDLDALIPKTMKVNDLRKELESRALSSKGLKSQLIARLTKQLKVEEQKEEQKELEKSEKEEDEDDDRKSEDDKEEEERKRQEEIERQRRERRYILPDEPAIIVHPNWAAKSGKFDCSIMSLSVLLDYRLEDNKEHSFEVSLFAELFNEMLQRDFGVRIYKSLLSLPEKEDKKEKDKKSKKDERKDKKEERDDETDEPKPKRRKSGDDKDKKEDRDERKKEDKRKDDSKDDDETEEDNNQDEYDPMEAEEAEDEEDDRDEEEMTKRDDKRDINRYCKERPSKDKEKEKTQMITINRDLLMAFVYFDQSHCGYLLEKDLEEILYTLGLHLSRAQVKKLLNKVVLRESCFYRKLTDTSKDEENHEESESLQEDMLGNRLLLPTPTVKQESKDVEENVGLIVYNGAMVDVGSLLQKLEKSEKVRAEVEQKLQLLEEKTDEDEKTILNLENSNKSLSGELREVKKDLSQLQENLKISENMNLQFENQMNKTIRNLSTVMDEIHTVLKKDNVKNEDKDQKSKENGASV

SEQ ID NO: 916590 - protein, 639 aa, Homo sapiens [sequence omitted]

SEQ ID NO: 916591 - protein, 225 aa, Homo sapiens
AVTLQDLITCHCGYLLEKDLEEILYTLGLHLSRAQVKKLLNKVVLRESCFYRKLTDTSKDEENHEESESLQEDMLGNRLLLPTPTVKQESKDVEENVGLIVYNGAMVDVGSLLQKLEKSEKVRAEVEQKLQLLEEKTDEDEKTILNLENSNKSLSGELREVKKDLSQLQENLKISENMNLQFENQMNKTIRNLSTVMDEIHTVLKKDNVKNEDKDQKSKENGASV

SEQ ID NO: 916592 - protein, 202 aa, Homo sapiens
DSLLRAHLSRAQVKKLLNKVVLRESCFYRKLTDTSKDEENHEESESLQEDMLGNRLLLPTPTVKQESKDVEENVGLIVYNGAMVDVGSLLQKLEKSEKVRAEVEQKLQLLEEKTDEDEKTILNLENSNKSLSGELREVKKDLSQLQENLKISENMNLQFENQMNKTIRNLSTVMDEIHTVLKKDNVKNEDKDQKSKENGASV

SEQ ID NO: 916593 - protein, 373 aa, Homo sapiens
MGEGGAAAALVAAAAAAAAAAAAVVAGQRRRRLGRRARCHGPGRAAGGKMSKPCAVEAAAAAVAATAPGPEMVERRGPGRPRTDGENVFTGQSKIYSYMSPNKCSGMRFPLQEDNSVTHHEVKCQGKPLAGIYRKREEKRNAGNAVRSAMKSEEQKIKDARRGPLVPFPNQKSEAAEPPKTPPSSCDSTNAAIAKPALKKPIKGKQAPPKKSSRKNATESQTYGFLPYELIESGKEEGMKIDLIDGKGRGVIATKQFSRGDFVVEYHGDLIEITDAKKREALYAQDPSTGCYMYYFQYLSKTYCVDATRETNRLGRLINHSKRGNCQTKLHDIDGVPHLILIASRDIAAGEEPLYDYGDRSKASIEAHPWLKH

SEQ ID NO: 916594 - protein, 152 aa, Homo sapiens
SVAEVLYELIESGKEEGMKIDLIDGKGRGVIATKQFSRGDFVVEYHGDLIEITDAKKREALYAQDPSTGCYMYYFQYLSKTYCVDATRETNRLGRLINHSKRGNCQTKLHDIDGVPHLILIASRDIAAGEEPLYDYGDRSKASIEAHPWLKH

SEQ ID NO: 916595 - protein, 393 aa, Homo sapiens
MGEGGAAAALVAAAAAAAAAAAAVVAGQRRRRLGRRARCHGPGRAAGGKMSKPCAVEAAAAAVAATAPGPEMVERRGPGRPRTDGENVFTGQSKIYSYMSPNKCSGMRFPLQEDNSVTHHEVKCQGKPLAGIYRKREEKRNAGNAVRSAMKSEEQKIKDARRGPLVPFPNQKSEAAEPPKTPPSSCDSTNAAIAKPALKKPIKGKQAPRKKAQGKTQQNRKLTDFYPVRRSSRKSKAELQSEERKRIDELIESGKEEGMKIDLIDGKGRGVIATKQFSRGDFVVEYHGDLIEITDAKKREALYAQDPSTGCYMYYFQYLSKTYCVDATRETNRLGRLINHSKRGNCQTKLHDIDGVPHLILIASRDIAAGEEPLYDYGDRSKASIEAHPWLKH

SEQ ID NO: 916596 - protein, 157 aa, Homo sapiens
FYSAISRMSYGLPSTGITGAKRNGGHCFGLRSCTRPQQTKPNQNGVACAKTLRKHIDSRTDQVLFFLLQISIMKISKSGGICPLKFPLNLLTKFISSCLETFKLQIIMQQRFQPIPGEDTAPMPSRNYSTSTRQNRMPRTWTPSTINNACNTSTLGG

SEQ ID NO: 916597 - protein, 465 aa, Homo sapiens
AGMEILGSSHTFSSRAEAALSLEGALTLVLALAQQLALEIAVFLHLKQELKKERGDLSMCLCLNELQRLQLDKDNVRMWPWWDHWSTPYLYTVMSTQGLLGHLHLMFTRGLGIHLGPGNLQGPNVTLQIGCGLMTYCILLLTYGLVSTWGLVITWELDINLGPGFLVDIWCQVDIWLQEDIRPQVETQYTGGQQVPGGHQDPVGHQATAEHQFPMNTSPQVDTELEVYIRPQIDIQSPGGHDTSIGHQVLRLITKSQVDTTSKMNTRPKVVIQAPNGHQALEDICPQVDITLKVYIRPQMYTQVQGRHESPVKLKAPGGYSSPRWMPRPQVNIKLQVDIMPQVNFRVPAQLNIRLQVDIRSKVNISTQVDIRLQVDIKPKVDTELEVYIRPQVDTQAQVDIGPQVDIRPNVDTQDQDGHQDSGGHLVTGGQQAWCVPCPRVVIRPQFNTSPWVDSSAPGGHPVFS

SEQ ID NO: 916598 - protein, 507 aa, Homo sapiens
MFTECPGGICIAQDCLHSKLTTSLFSTVSNEVPEHPCVSPVSNHVYERRLIEKYIAENGTDPINNQPLSEEQLIDIKVAHPIRPKPPSATSIPAILKALQDEWDAVMLHSFTLRQQLQTTRQELSHALYQHDAACRVIARLTKEVTAAREGAASPLPSPTLGWFCIGAGEPMDLGELVGMTPEIIQKLQDKATVLTTERKKRGKTVPEELVKPEELSKYRQVASHVGLHSASIPGILALDLCPSDTNKILTGGADKNVVVFDKSSEQILATLKGHTKKVTSVVFHPSQDLVFSASPDATIRIWSVPNASCVQVVRAHESAVTGLSLHATGDYLLSSSDDQYWAFSDIQTGRVLTKVTDETSGCSLTCAQFHPDGLIFGTGTMDSQIKIWDLKERTNVANFPGHSGPITSIAFSENGYYLATAADDSSVKLWDLRKLKNFKTLQLDNNFEVKSLIFDQSGTYLALGGTDVQIYICKQWTEILHFTGRGWSWAPGISLGAQARREASLG

SEQ ID NO: 916599 - protein, 516 aa, Homo sapiens
MFTECPGGICIAQDCLHSKLTTSLFSTVSNEVPEHPCVSPVSNHVYERRLIEKYIAENGTDPINNQPLSEEQLIDIKVAHPIRPKPPSATSIPAILKALQDEWDAVMLHSFTLRQQLQTTRQELSHALYQHDAACRVIARLTKEVTAAREGAASPLPSPTLGWFCIGAGEPMDLGELVGMTPEIIQKLQDKATVLTTERKKRGKTVPEELVKPEELSKYRQVASHVGLHSASIPGILALDLCPSDTNKILTGGADKNVVVFDKSSEQILATLKGHTKKVTSVVFHPSQDLVFSASPDATIRIWSVPNASCVQVVRAHESAVTGLSLHATGDYLLSSSDDQYWAFSDIQTGRVLTKVTDETSGCSLTCAQFHPDGLIFGTGTMDSQIKIWDLKERTNVANFPGHSGPITSIAFSENGYYLATAADDSSVKLWDLRKLKNFKTLQLDNNFEVKSLIFDQSGTYLALGGTDVQIYICKQWTEILHFTEHSGLTTGVAFGHHAKFIASTGMDRSLKFYSL

SEQ ID NO: 916600 - protein, 155 aa, Homo sapiens
YNKPHSFVNCPVLDMSLSAVQKETYTLPYFQSAQLDPCLISRREGFLYPRFLSWCTGRIGSHVGLGNEYKVLLSGISSQQMGEPERRWFSPRVELLSGPRSPLTTPAKLCVIPWVDGLPVCWCALPQVCSPQHLAACVFFVDVFLSMSSSCVFAC

SEQ ID NO: 916601 - protein, 170 aa, Homo sapiens
MQVSKNILAVNIQCAMDINQCRQGWFLLEVLRENLFHASLLASNGCWHSLAGRHITSHHLLPPYSNGVLSSPRTIFKIKIMAFLIRWSRGQPPHVRGPGANRAANMLPSIGLWMAELKKLISTLPPPLGLWGSGYEDRGDTPEDFTFSISVLEFLHQAYSLKKLNEYAVF

SEQ ID NO: 916602 - protein, 109 aa, Homo sapiens
KHVGLRTQSRVKCAGRFPQTERSNEKKTKKILKNRVNQFVENCRVVLSRTTTISYKLHQRQMKMKKLSSYITNLCCAPTKPALNFRANYNPHSVSGKATHIIHIQVREC

SEQ ID NO: 916603 - protein, 240 aa, Homo sapiens
MSAAPASNGVFVVIPPNNASGLCPPPAILPTSMCQPPGIMQFEEPPLGAQTPRATQPPDLRPVETFLTGEPKVLGTVQILIGLIHLGFGSVLLMVRRGHVGIFFIEGGVPFWGGACFIISGSLSVAAEKNHTSCLVRSSLGTNILSVMAAFAGTAILLMDFGVTNRDVDRGYLAVLTIFTVLEFFTAVIAMHFGCQAIHAQASAPVIFLPNAFSADFNIPSPAASAPPAYDNVAYAQGVV

SEQ ID NO: 916604 - protein, 147 aa, Homo sapiens
MVRRGHVGIFFIEGGVPFWGGACFIISGSLSVAAEKNHTSCLVRSSLGTNILSVMAAFAGTAILLMDFGVTNRDVDRGYLAVLTIFTVLEFFTAVIAMHFGCQAIHAQASAPVIFLPNAFSADFNIPSPAASAPPAYDNVAYAQGVV

SEQ ID NO: 916605 - protein, 136 aa, Homo sapiens
MVIYSEIWATAVGHGEQPLPGGDFDVRLRPGEEFYRQASAEIGTLSVENFHILEYAFTPDIVVEVLRILVLIGQILFSLAAVFLLCLVIKKYLIGPYYRKLHMESKGNKEILILGISAFIFLMLTVILKLCVIYVI

SEQ ID NO: 916606 - protein, 181 aa, Homo sapiens
LHDYDTPMSTSRVTTNTVYRVKDKHPSLGCKYVSSHSPLIKPTRCRGVDTSALAFPCSLAGKLCRDPYKGYSLDVWVSSREKLSPGTTLSCSVTGVPPAPVVGGAQTALETPPCSPAPDGFVLTVVGLVAVFTFHNHGRTANLYSLHSWLGITTVFLFACQWFLGFAVFLLPWASMWCAAS

SEQ ID NO: 916607 - protein, 179 aa, Homo sapiens
KGGHLKKRLVLKSCCSRPSSTTLHFIVMGRCAFCKHFGATIKCCEEKCTQMYHYPCAAGADTFQDFSHIFLLCPEHIDQAPERSKEDANCAVCDSPGDLLDQFFCTTCGQHYHGMCLDIAVTPLKRAGWQCPECKVCQNCKQSGEDSKMLVCDTCDKGYHTFCLQRIMKSVPTNGWKCK

SEQ ID NO: 916608 - protein, 111 aa, Homo sapiens
RGSRFTFYTDQAPERSKEDANCAVCDSPGDLLDQFFCTTCGQHYHGMCLDIAVTPLKRAGWQCPECKVCQNCKQSGEDSKMLVCDTCDKGYHTFCLQRIMKSVPTNGWKCK

SEQ ID NO: 916609 - protein, 624 aa, Homo sapiens
MLRCPRKLGEFSSRASEVGRAYQDREPSSEQKEPPEEAEPVAAAEPEVPENNGNNSWPHNDTEIANSTPNPKPAASSPETPSAGQQEAKTDQADGPREPPQSARRKRSYKQAVSELDEEQHLEDEELQPPRSKTPSSPCPASKVVRPLRTFLHTVQRNQMLMTPTSAPRSVMKSFIKRNTPLRMDPKEKERQRLENLRRKEEAEQLRRQKVEEDKRRRLEEVKLKREERLRKVLQARERVEQMKEEKKKQIEQKFAQIDEKTEKAKEERLAEEKAKKKAAAKKMEEVEARRKQEEEARRLRWLQQEEEERRHQELLQKKKEEEQERLRKAAEAKRLAEQREQERREQERREQERREQERREQERREQERQLAEQERRREQERLQAERRGTCWPACLPSMCVEERRCEPCLDTAPPACDGLQVLSLAPNPEAHLNTLPIGYGRSKELFWVLRELQEREKALRLQKEQLQRELEEKKKKEEQQRLAERQLQEEQEKKAKEAAGASKALNVTVDMTPQGHRAPPKINPDNYGMDLNSDDSTDDEAHPRKPIPTWARGTPLSQAIIHQYYHPPNLLELFGTILPLDLEDIFKKSKPRYHKRTSSAVWNSPPLQGARVPSSLAYSLKKH

SEQ ID NO: 916610 - protein, 151 aa, Homo sapiens
MVFSFWKIFFKCSFFSFICLKRSITLLLCDENSAIPSNLGFTYFFMKTEDDARLFEHLQGSDAWGALGDSIWEKLQQGLRRLQCIWKVAAPYTQQQLSQCLLENKCENSGDSQKCSGNWDLQISGEPESRPGAGLLAIPVMVAQRDLGTWR

SEQ ID NO: 916611 - protein, 153 aa, Homo sapiens
PLSHPQASAKLVVIMTIVHNLLFLRYWCDAGSPSSCPHLQVEAPTAVALTYWTSPSKAPWNTDMKSRNIAIATLQMPQGIKVWKSLSSENVCLDTRGTITDMLCHEVTKVVARQLTLRLGEKTPEEEGNNRKRRSSNSERHTFFFACPESDSA

SEQ ID NO: 916612 - protein, 132 aa, Homo sapiens
MGCVETPEIGLYRCKLLVKDLGSFHRRKGLLEGNMNSKMHFLKRCPTYSEGPLGAGAFMLDGQSRLSYGCAKKAKQDQKGTCRKEELRIPKFKLGLSAIVKLGTRTQNTELAQSGEVAQVAEGLSFQRMVTG

SEQ ID NO: 916613 - protein, 157 aa, Homo sapiens
MATAVHLHRFSTRPQSVTSRIQPGSDVIVCAEMDEQWGYVGAKSRQRWLFYAYDSLRKTVVAHVFGERTMATLGRLMSLLSPFDVVIWMTDGWPLYESRLKGKLHVISKRYTQRIERHNLNLRQHLARLGRKSLSFSKSVELHDKVIGHYLNIKHYQ

SEQ ID NO: 916614 - protein, 133 aa, Homo sapiens
MTQNPFSLSQWVTEEALSAHLSAHWAAELAGSKLKPQYQASVLGLGLEYSKPHSKRRQTPAQNFLMDFQCMEEGTRTDLSIEGPLRTVSPVSANRALLTPIMISTNTSFQALSAFASCHTPRAVGYIVIYKYL

SEQ ID NO: 916615 - protein, 173 aa, Homo sapiens
TLILHSSELFAELSGEFSGKNGSRITKISVHRYLKMLHCKKTQYSKTNCSSWETAKQRLKTKPPAVGKPKDPVIVEETITVDPRHCRGTPEAVQSSFHPSILLPSSREKQTGYASLWDSDTFTHLKRNSWCQFCDKLCKMPNSDAKESRETREGLKETAQLFQVQLVCSTQGL

SEQ ID NO: 916616 - protein, 134 aa, Homo sapiens
MLNCPSLTAPCCPCRTSPWANIIYVDSWRPPSIYPMAFNIPEQCQTNTTYWYRASHLLKHPDWFHPIISTGMTYRLDRTTASLKASLIMQKRGVMGANGHKQTVRTIHFWHPLRMLLLITESVELGITSEKMCS

SEQ ID NO: 916617 - protein, 404 aa, Homo sapiens
MKVLGRSFFWVLFPVLPWAVQAVEHEEVAQRVIKLHRGRGVAAMQSRQWVRDSCRKLSGLLRQKNAVLNKLKTAIGAVEKDVGLSDEEKLFQVHTFEIFQKELNESENSVFQAVYGLQRALQGDYKDVVNMKESSRQRLEALREAAIKEETEYMELLAAEKHQVEALKNMQHQNQSLSMLDEILEDVRKAADRLEEEIEEHAFDDNKSVKGVNFEAVLRVEEEEANSKQNITKREVEDDLGLSMLIDSQNNQYILTKPRDSTIPRADHHFIKVDIVTIGMLSLPCGWLCTAIGLPTMFGYIICGVLLGPSGLNSIKEVAVPVSEGAVLLETTPLLVSISFKDSISSNVLDQVIQTTFHVLNVTKSIVQVETLGEFGVFFTLFLVGLEFSPEKLRKQKFLSDCQM

SEQ ID NO: 916618 - protein, 251 aa, Homo sapiens
MELLAAEKHQVEALKNMQHQNQSLSMLDEILEDVRKAADRLEEEIEEHAFDDNKSVKGVNFEAVLRVEEEEANSKQNITKREVEDDLGLSMLIDSQNNQYILTKPRDSTIPRADHHFIKVDIVTIGMLSLPCGWLCTAIGLPTMFGYIICGVLLGPSGLNSIKEVAVPVSEGAVLLETTPLLVSISFKDSISSNVLDQVIQTTFHVLNVTKSIVQVETLGEFGVFFTLFLVGLEFSPEKLRKQKFLSDCQM

SEQ ID NO: 916619 - protein, 225 aa, Homo sapiens
AAERKARPLRVRFGPAPPAPPAPATGTWYGRAVGVLCGSCQGRAFQIFPLKEWRRPGQFALEMEGPSLRGPALRLAGLPTQQDCNIQEKIDLEIRMREGIWKLLSLSTQKDQVLHAVKNLMVCNARLMAYTSELQKLEEQIANQTGRCDVKFESKERTACKGKIAISDIRIPLMWKDSDHFSNKERSRRYAIFCLFKMGANVFDTDVVNVDKTITDICFENVTIL

SEQ ID NO: 916620 - protein, 153 aa, Homo sapiens
TVPYSSPMFDLTRSLSGDDVNARPRFLSWCQQQYLDIRGRCSQGKDHKLSLERDHLTTKPVGGLDLALTATEGFEAFSEKAAPGPREDAPPHRMFFTLQEAQILIGLMTRCLRLTMALFVSTVYAVGVLHIINMNYHLWGSFSEELLNAGYES

SEQ ID NO: 916621 - protein, 144 aa, Homo sapiens
MSFIKLFSYDPIGVCPPPPWFLPGLWHTVSCSSSLPQDPAQCLPHHRAVPRTEERVDPALALLGWAAWQVESAGIELAFLFTIFSQVQGGLNTEAFIATAPQVAQENLRAQECKGWHSSGSEAVPSGGGELLLIDVDKTVDKVC

SEQ ID NO: 916622 - protein, 265 aa, Homo sapiens
MCFRTKLSVSWVPLFLLLSRVFSTETDKPSAQDSRSRGSSGQPADLLQVLSAGDHPPHNHSRSLIKTLLEKTGCPRRRNGMQGDCNLCFEPDALLLIAGGNFEDQLREEVVQRVSLLLLYYIIHQEEICSSKLNMSNKEYKFYLHSLLSLRQDEDSSFLSQNETEDILAFTRQYFDTSQSQCMETKTLQKKSGIVSSEGANESTLPQLAAMIITLSLQGVCLGQGNLPSPDYFTEYIFSSLNRTNTLRLSELDQLLNTLWTEVLV

SEQ ID NO: 916623 - protein, 331 aa, Homo sapiens
MCFRTKLSVSWVPLFLLLSRVFSTETDKPSAQDSRSRGSSGQPADLLQVLSAGDHPPHNHSRSLIKTLLEKTGCPRRRNGMQGDCNLCFEPDALLLIAGGNFEDQLREEVVQRVSLLLLYYIIHQEEICSSKLNMSNKEYKFYLHSLLSLRQDEDSSFLSQNETEDILAFTRQYFDTSQSQCMETKTLQKKSGIVSSEGANESTLPQLAAMIITLSLQGVCLGQGNLPSPDYFTEYIFSSLNRTNTLRLSEEPYSVASTTTGPWGELPHYCQCSLKAQGLLNQLLVNAAYPRTHPSGLCLGLSKGCGQQQYHLGTCWKCTSSDPNPESTES

SEQ ID NO: 916624 - protein, 73 aa, Homo sapiens
NGLCLQYYVGKCCKREPILPKQEPRLCKVLSVTSLKTWFISAAATLSLNSSLKLPRDRLSRASELYNRIFQVP

SEQ ID NO: 916625 - protein, 141 aa, Homo sapiens
TSTCHLMSGYFFFSRDRVFLCVQSSLELVAFSSPPAPASQNAVIDRYKPHARTPGVSFHMLICHLYIFFGEVSVNIFGLFFNYIFYCTVLRVICVFGIKVLSENSMKMGVKVTAHIQPTETITAAMVEFYKPEMQCHGRKL

SEQ ID NO: 916626 - protein, 187 aa, Homo sapiens
MDLNGWEKNEARESPVVGSLASNKCLASTRPGAEAGRCGRAAHLAQRAACPADRALVTGFQAQRGKAPRKHTRKWVHQHESRKRFHSQTLWINPKERASKRGSFFKFKEKKIIKGPTKGASTAGDQGEAGAPTPCGKRRRPPRAGRVSQVAGEPTGVYGQGALGALADPWSARPGVETFPEGEDRIV

SEQ ID NO: 916627 - protein, 153 aa, Homo sapiens
MSKSSLKPSPEADAGAMLLVQPEELRRDREVMGGEWCGPWQGLHLQPVSVDLGRGLIDLTNTSRLWTTKQKEHPVTHAHWGFSCKHSPLNTGLGRRDDVDMNKSQLMRKLLRIFYADENTPTFSSHHPDQSAAINIKARPSISKKSMTGYRVI

SEQ ID NO: 916628 - protein, 142 aa, Homo sapiens
MFPFFFFFFLRGQTQSTISGCCCSLTVLLPGFNLFNIFIGELLENTENHGIMLVNMAERISAYQRYTRFPFMPRGDIKTSATGESSEAVCIARSQGLELCDRAAQTSVCLELTVESAARPQKALSAVERCLDSTVGLFPKLA

SEQ ID NO: 916629 - protein, 147 aa, Homo sapiens
MGLEPERRRPLWRATGFSPWERLRICAHSTLDLWGKQQTNFAGCEKPSGLVDCVSSGLHIYPESKMPHLASSAAAPMTFFQVLYISAKLNLMLCPQHNGPLDWDGRWLKACCNNPNKTQPGLPQPSKSGKIENNVGDWDASDTGSHN

SEQ ID NO: 916630 - protein, 284 aa, Homo sapiens
TCAMATSGSYHPFLWQCYLQHTVCGVALLCKGSHKAVTPPELRPVALFRSPTSSLVQGSTLRSSGTPPTYPTSPGPYPLLPEEVNLTSTTRNGAPYQPPELKMFSLQWVADGDGGVAGVYVPFSMPDLALCKQKYGTAPVLALHNLEKPFTLYVAEKQGMALGALTQRLGIIPRPMTYFSKHLDQEVPNFPTFFCLLLSPPNCSNLCLLHRSKIVSTFSVMIKVFFFSQRDENVFLQGPKPGVKLYVGSPSPRKGTYSPCTSLWSNLKTGSWPQDSHGHRRAHP

SEQ ID NO: 916631 - protein, 289 aa, Homo sapiens
TCAMATSGSYHPFLWQCYLQHTVCGVALLCKGSHKAVTPPELRPVALFRSPTSSLVQGSTLRSSGTPPTYPTSPGPYPLLPEEVNLTSTTRNGAPYQPPELKMFSLQWVADGDGGVAGVYVPFSMPDLALCKQKYGTAPVLALHNLEKPFTLYVAEKQGMALGALTQRLGIIPRPMTYFSKHLDQEVPNFPTFFCLLLSPPNCSNLCLLHRSKIVSTFSVMIKVFFFSQRDENVFLQGPKPGVKLYVGSPSPRKGTYSPCTSLWSNLKTGSWPQDSFAGWEVQDKATSI

SEQ ID NO: 916632 - protein, 150 aa, Homo sapiens [sequence omitted]

SEQ ID NO: 916633 - protein, 148 aa, Homo sapiens
MMLPAALDTQASQKKQLQLHQSGGLDPFFAEWVCLEKLHRTANPEILGRLSDVVCGVGPNLGSRRTGLEPESGGMLTDPRSVGVGLALGPTGEVNRQNEINTWDSMPWWVSWNLAKGRAIWHERKSRMEDLHKIKASLITFQGECRSD

SEQ ID NO: 916634 - protein, 164 aa, Homo sapiens
MIPKADERVWAARTKSLSFLQDNTFLQHNRGRGAGLLGRSFYTSGPLLCDIGKLHVQRQQILSGVLDVILECLGFKWELHQPQLFQSETLAKLYLKALAQGTTHPLRELEELLRAQSPKKTKEKSPAKRIIISLKINDPLVTKVGMYIPVYILRMPLNKWSSQI

SEQ ID NO: 916635 - protein, 1187 aa, Homo sapiens
MERRLRALEQLARGEAGGCPGLDGLLDLLLALHHELSSGPLRRERSVAQFLSWGTRTPTGFPRRLPAVALTRTTGPPRPAHSPAHLTLTPILTHALSLSQTPTHAHTHQLVLSPFVSKVKELRLQRDDFEILKVIGRGAFGEVTVVRQRDTGQIFAMKMLHKWEMLKRAETACFREERDVLVKGDSRWVTTLHYAFQDEEYLYLVMDYYAGGDLLTLLSRFEDRLPPELAQFYLAEMVLAIHSLHQLGYVHRDVKPDNVLLDVNGHIRLADFGSCLRLNTNGMVDSSVAVGTPDYISPEILQAMEEGKGHYGPQCDWWSLGVCAYELLFGETPFYAESLVETYGKIMNHEDHLQFPPDVPDVPASAQDLIRQLLCRQEERLGRGGLDDFRNHPFFEGVDWERLASSTAPYIPELRGPMDTSNFDVDDDTLNHPGTLPPPSHGAFSGHHLPFVGFTYTSGSHSPESSSEAWAALERKLQCLEQEKVELSRKHQEALHAPTDHRELEQLRKEVQTLRDRLPEMLRDKASLSQTDGPPAGSPGQDSDLRQELDRLHRELAEGRAGLQAQEQELCRAQGQQEELLQRLQEAQEREAATASQTRALSSQLEEARAAQRELEAQVSSLSRQVTQLQGQWEQRLEESSQAKTIHTASETNGMGPPEGGPQEAQLRKEVAALREQLEQAHSHRPSGKEEALCQLQEENRRLSREQERLEAELAQEQESKQRLEGERRETESNWEAQLADILSWVNDEKVSRGYLQALATKMAEELESLRNVGTQTLPARPLDHQWKARRLQKMEASARLELQSALEAEIRAKQGLQERLTQVQEAQLQAERRLQEAEKQSQALQQELAMLREELRARGPVDTKPSNSLIPFLSFRSSEKDSAKDPGISGEATRHGGEPDLRPEGRRSLRMGAVFPRAPTANTASTEGLPAKVSAQRGKQGGGTKQFCQAEWALWGHSTCIVASRHNWGGGGGDELACRHRLAGTRRSLLPGSAPVSFLTPQGWGMGPWEALGNGCPPPQPGSHTLRPRSFPSPTKCLRCTSLMLGLGRQGLGCDGESPHPLCSSHGPSLRLLLSHNLCPTGPTLPVPPDLLRTALGVHPETGTGTAYEGFLSVPRPSGVRRGWQRVFAALSDSRLLLFDAPDLRLSPPSGALLQVLDLRPVLAPLWRWSHGSGVVCLPVWPTPCC

SEQ ID NO: 916636 - protein, 1099 aa, Homo sapiens
MERRLRALEQLARGEAGGCPGLDGLLDLLLALHHELSSGPLRRERSVAQFLSWGTRTPTGFPRRLPAVALTRTTGPPRPAHSPAHLTLTPILTHALSLSQTPTHAHTHQLVLSPFVSKVKELRLQRDDFEILKVIGRGAFGEVTVVRQRDTGQIFAMKMLHKWEMLKRAETACFREERDVLVKGDSRWVTTLHYAFQDEEYLYLVMDYYAGGDLLTLLSRFEDRLPPELAQFYLAEMVLAIHSLHQLGYVHRDVKPDNVLLDVNGHIRLADFGSCLRLNTNGMVDSSVAVGTPDYISPEILQAMEEGKGHYGPQCDWWSLGVCAYELLFGETPFYAESLVETYGKIMNHEDHLQFPPDVPDVPASAQDLIRQLLCRQEERLGRGGLDDFRNHPFFEGVDWERLASSTAPYIPELRGPMDTSNFDVDDDTLNHPGTLPPPSHGAFSGHHLPFVGFTYTSGSHSPESSSEAWAALERKLQCLEQEKVELSRKHQEALHAPTDHRELEQLRKEVQTLRDRLPEMLRDKASLSQTDGPPAGSPGQDSDLRQELDRLHRELAEGRAGLQAQEQELCRAQGQQEELLQRLQEAQEREAATASQTRALSSQLEEARAAQRELEAQVSSLSRQVTQLQGQWEQRLEESSQAKTIHTASETNGMGPPEGGPQEAQLRKEVAALREQLEQAHSHRPSGKEEALCQLQEENRRLSREQERLEAELAQEQESKQRLEGERRETESNWEAQLADILSWVNDEKVSRGYLQALATKMAEELESLRNVGTQTLPARPLDHQWKARRLQKMEASARLELQSALEAEIRAKQGLQERLTQVQEAQLQAERRLQEAEKQSQALQQELAMLREELRARGPVDTKPSNSLIPFLSFRSSEKDSAKDPGISGEATRHGGEPDLRPEGRRSLRMGAVFPRAPTANTASTEGLPAKPGSHTLRPRSFPSPTKCLRCTSLMLGLGRQGLGCDGESPHPLCSSHGPSLRLLLSHNLCPTGPTLPLPPDLLRTALGVHPETGTGTAYEGFLSVPRPSGVRRGWQRVFAALSDSRLLLFDAPDLRLSPPSGALLQVLDLRPVLAPLWRWSHGSGVVCLPVWPTPCC

SEQ ID NO: 916637 - protein, 209 aa, Homo sapiens
MKATRHGGEPDLRPEGRRSLRMGAVFPRAPTANTASTEGLPAKPGSHTLRPRSFPSPTKCLRCTSLMLGLGRQGLGCDGESPHPLCSSHGPSLRLLLSHNLCPTGPTLPLPPDLLRTALGVHPETGTGTAYEGFLSVPRPSGVRRGWQRVFAALSDSRLLLFDAPDLRLSPPSGALLQVLDLRPVLAPLWRWSHGSGVVCLPVWPTPCC

SEQ ID NO: 916638 - protein, 233 aa, Homo sapiens
MQAGDRLVAVAGESVEGLGHEETVSRIQGQGSCVSLTVVDPEADRFFSMNSLSPLLFLENTEAPASPRGSSSASVVETEDPSLEDTSVHSVLLGSRQCFLYPGPGGSYGFRLSCVASGPRLFISQVTPGGSAARAGLQVGDVILEVNGYPVGGQNDLERLQQLPEAEPPLCLKLAARSLRGLEAWIPPGAAEPDQRDSDTTDHRLAQVLPPFLQAHLPAEGVVGGLRQVPEGV

SEQ ID NO: 916639 - protein, 596 aa, Homo sapiens
DPAMEKAADLQDTASLTLKFKFNPKLGIDNPVLSLAEDHDPYDPWSLERPRFCLLSKEEGKSFGFHLQQELGRAGHVVCRVDPGTSAQRQGLQEGDRILAVNNDVVEHEDYAVVVRRIRASSPRVLLTVLARHAHDVARAQLGEDAHLCPTLGPGVRPRLCHIVKDEGGFGFSVTHGNQGPFWLVLSTGGAAERAGVPPGARLLEVNGLWQSGQQVTLLVAGPEVEEQCRQLGLPLAAPLAEGWALPTKPRCLHLEKGPQGFGFLLREEKGLDGRPGEWEPWGRWGKVGLGVGTQAYIHLSVHRRGVPVCALALGRLFPFTLGSVPWCVHSGLGELERSSEDVYAPGQFLWEVDPGLPAKKAGMQAGDRLVAVAGESVEGLGHEETVSRIQGQGSCVSLTVVDPEADRFFSMNSLSPLLFLENTEAPASPRGSSSASVVETEDPSLEDTSVHSVLLGSRQCFLYPGPGGSYGFRLSCVASGPRLFISQVTPGGSAARAGLQVGDVILEVNGYPVGGQNDLERLQQLPEAEPPLCLKLAARSLRGLEAWIPPGAAEPDQRDSDTTDHRLAQVLPPFLQAHLPAEGVVGGLRQVPEGV

SEQ ID NO: 916640 - protein, 242 aa, Homo sapiens
PQLAFEFARTYVKTSITFRIKAMMLFSYKLLRPVLEFSVLFPHHIQEAPTSIRKGQEEKQQDCYTAGSHEAPGIQIDNQLDTAISNPFLVLRGFFDCHLLHTAGLQALLAPTDDGAAGHRRSSPPRRRGGGAETLLSSQTGSRLDRGALHISDGAAGQRRSPHPRRWAAGQRRSSLPRRDDGQEEALLTSQTGRPGRGAPHIPDNGQPGRDAPHFLDGVVAGQRLPSRRFGRPRQAAGRWRL

SEQ ID NO: 916641 - protein, 152 aa, Homo sapiens
MLQMKVLLLIPLKYKHKFIPHLHFFNKYEIANHDTSAILKNYSTQLHCHAVFQLNLKSYVYMEYHISLLEVKIGVSVGRCTDSHAPKYNTNPTSSQLTSHRHHLLRTYFYFTELQLRARQRRAVWRLQNIEDNLCPQRQHPTEERIKKDENK

SEQ ID NO: 916642 - protein, 135 aa, Homo sapiens
MPNYELSGTLSPKGANAGSVTQVVNTGGSYKVVVFLHAGGENRLGKFSDRYYGIFPRIPLLACRRWRSVLLAITSFIISNFDPLRTVGRKDPEGPAAVSPPRIERPWQGVGGVTGHGSPQLAKWLRKILHHYYCE

SEQ ID NO: 916643 - protein, 237 aa, Homo sapiens
MIKSDSLRELSAAWLVWQLLSVSRPHPTSPAPCLLRWRSILSQWSHNTCAPLEFLQRVNECPVVAGKKCHKPDSVKQQKLTHSPGGQKSAIRTRDEEGQTEARDEEGPTQARDEEGPAQTRDEEGPAQTREEEGPAQAREEEGPAQAREEEGPSTAPQPLVSCCVAWYQSVAQGLGTLALKAPGAHHIMPCVPDPKFLKRLKICMADSLTTESLLIHDLLDDTDLDRPTCNCTSDHS

SEQ ID NO: 916644 - protein, 154 aa, Homo sapiens
WVPTPKRHRERARAASMLSPLNTRQLLRREGNFYAHCGVQGAVCGIRVGSGGFRKLRKEDRVPKVESRESKICGVNSALDLVWFQGAIFYITTREGCSDESLGQAAIPQVPPTSAVEVALGDAHDLWGQKCWLLTNVMFWVEECSERMLTNFRW

SEQ ID NO: 916645 - protein, 132 aa, Homo sapiens
MTCFILFPRVVATVGGQLASWLHSMVCKQLGGSLKGGVGSVALNVQFEFPKLKAHRVIGNQEKNYCGLSREGRKVLDTRLLERSTCAMPQLHSVSSSFQLVVSLQKAHHLYLYSGASPVSWGMRLINCGDLA

SEQ ID NO: 916646 - protein, 143 aa, Homo sapiens
IEKLLMEKCSELSAVTERCLQVENEHVLKSMKACVSETLSMLGQHFGQLLELALTREVQALVRKIDASDNIYTTESTTGNLFSLTQEGAPLCRIIAKEGGVVALFKVCRQDSFRCLYPQALRTLASICCVEEGVHQLEKEFHS

SEQ ID NO: 916647 - protein, 235 aa, Homo sapiens
MYNVHRFCGSAVLEGTARCLSLTQQESATSALRLAWWNMGHRPNLGQPPHPNAVAAALHASLCPANRGTCPLGKPGYPGCLWFQPLLLFPGCLCSPDGPFPRAVFTSAGKGPLQTDLGRGRVPPRDQQTPKSGPCPRAPVASNRQSGGSAPPPAAERRSLDREAGARGRARGALPENLTLRSSSGSRSDALFQSHFNCTGPCGSLLHRPDPCGSLRSDLPGPPGWMKKTHLGLKP

SEQ ID NO: 916648 - protein, 192 aa, Homo sapiens
MYNVHRFCGSAVLEGTARCLSLTQQESATSALRLAWWNMGHRPNLGQPPHPNAVAAALHASLCPANRGTCPLGKPGYPGCLWFQPLLLFPGCLCSPDGPFPRAVFTSAGKGPLQTDLGRGRVPPRDQQTPKSGPCPRAPVASNRQSGGSAPPPAAERRSLDREAGARGRARGALPENLTLRSSSGSRSDALC

SEQ ID NO: 916649 - protein, 150 aa, Homo sapiens
TTLSLRGRAFRGVRMLCLPLSAGLCWRVAWPSPIAVALRVVGFGGLGRGCSFLSLSLAPSGSVEDGTASGPAPPPPCTLPAVAADESGDGTRVQSNGGSVPGSGFCRLRKDRGGTVSRLGDTGHRGPTTATAAPAAARAATTHASLLQPA

SEQ ID NO: 916650 - protein, 135 aa, Homo sapiens
MKTKEHSIVEDNVACDGFGEDVCFHKFIKYGVLSTSILIEDLPNWNNLHITGGLQKLVKITAMNENVTLTDQPSIEFWSAVTTVFLMLPESFSEGNLSTEIAGLSYLDYQTAYGNRFDAKADTNISLSLIKLDIK

SEQ ID NO: 916651 - protein, 138 aa, Homo sapiens
PPVPRPRGMSRVLTASLPCLTSGKSLCGLQDSRCIGDFSLKNIFSMDAPGSSHGSYQSGLCPGDAVILMEAIRVVFGQEMQSSSSKLSELSLARRCSHPHGSYLSGLLAGRCSHPQISSCFSHLSLLHGLSKENTCIG

SEQ ID NO: 916652 - protein, 189 aa, Homo sapiens
MCDIIWESPAVAMETHLPGLGKLPHLSATFFQTGHGRLALIWVPDRGELKPEGEEIKSQGGVNFKQPRAGAGTGTPAPPHQGQITSCYEGATCYRDKAYETIEPSTIGREEKNRKIRPHGPRRNALLSGPNRESGTTSLQRKRQAAGKELDAGAWWGQCPPSTHSGVGREESPVEIPKTLRLSLQGSIT

SEQ ID NO: 916653 - protein, 179 aa, Homo sapiens
MDQGHQNPWGGTEAGIGLLLPLPRGRGIPVFIKVEDNCIGGKKQLTTWILNSYLFFSQEPTGKNAPGGKDRKGGTREEGGLHTSAAGKARIAPPTPACCTRGWELPWTLWSWSSCRIESSIMAGGEIFHLEESRSYWLDRELLGEQKWNSVSGKGELDFGGDVAALGITGRSLPQPGSL

SEQ ID NO: 916654 - protein, 145 aa, Homo sapiens
LLFMLLMVAEIFLSKNYITQYCLLLPVPDTGVRPNHVLGVFIDLSHGSTVLSGCTACEHLLSKLTIFQLRLIQQTIHASRNQRITLGPCYYLGKRLIMTLLDWLHKKSQIFLPFLSRLGLWAGSTKPRKGPRDRKRKYRDDSSEA

SEQ ID NO: 916655 - protein, 788 aa, Homo sapiens
MGPTQGPRAPLEFGGPLGAAALLLLLPATMFHLLLAARSGPARLLGPPASLPGLEVLWSPRALLLWLAWLGLQAALYLLPARKVAEGQELKDKSRLRYPINGAYGDGPSRWSFQALVLTALLVGLGMSAGLPLGALPEMLLPLAFVATLTAFIFSLFLYMKAQVAPVSALAPGGNSGNPIYDFFLGRELNPRICFFDFKYFCELRPGLIGWVLINLALLMKEAELRGSPSLAMWLVNGFQLLYVGDALWHEEAVLTTMDITHDGFGFMLAFGDMAWVPFTYSLQAQFLLHHPQPLGLPMASVICLINATGYYIFRGANSQKNTFRKNPSDPRVAGLETISTATGRKLLVSGWWGMVRHPNYLGDLIMALAWSLPCGVSHLLPYFYLLYFTALLVHREARDERQCLQKYGLAWQEYCRRQEELALFPGPVKMISLFSSHGLFPGTAQGLCQVPQCCQRVAFLVGRALAQQDAGDLVHSPSCAQGPRRVLACFQHVGCRLQGFFRRGEDLLGTQGSGNAEQCGTEVREQRVVTAVIQGESMRVGEQHIGQLEAHERRDWAAAQADYRGDAGGYDGRAGPRDISKNPLGGRGLRGGGIFHRIRRGPRRGELQLRGVTTRGIIQLLQKLRSGSAVPPPRPPWRQQPPGLTAAQQPLEGSFFARRQPLPECHASGSSAASSRAHYSEGRCNALAGPPPPGRSHRARPAPWQLAPRSTCERTPVVVRNFRGFFDYFRFAARPTARCGESRPRSRASGTSPALCDDARSEKMGLASASPVPRLPLVVTPKRGPII

SEQ ID NO: 916656 - protein, 752 aa, Homo sapiens
MGPTQGPRAPLEFGGPLGAAALLLLLPATMFHLLLAARSGPARLLGPPASLPGLEVLWSPRALLLWLAWLGLQAALYLLPARKVAEGQELKDKSRLRYPLPEMLLPLAFVATLTAFIFSLFLYMKAQVAPVSALAPGGNSGNPIYDFFLGRELNPRICFFDFKYFCELRPGLIGWVLINLALLMKEAELRGSPSLAMWLVNGFQLLYVGDALWHEEAVLTTMDITHDGFGFMLAFGDMAWVPFTYSLQAQFLLHHPQPLGLPMASVICLINATGYYIFRGANSQKNTFRKNPSDPRVAGLETISTATGRKLLVSGWWGMVRHPNYLGDLIMALAWSLPCGVSHLLPYFYLLYFTALLVHREARDERQCLQKYGLAWQEYCRRQEELALFPGPVKMISLFSSHGLFPGTAQGLCQVPQCCQRVAFLVGRALAQQDAGDLVHSPSCAQGPRRVLACFQHVGCRLQGFFRRGEDLLGTQGSGNAEQCGTEVREQRVVTAVIQGESMRVGEQHIGQLEAHERRDWAAAQADYRGDAGGYDGRAGPRDISKNPLGGRGLRGGGIFHRIRRGPRRGELQLRGVTTRGIIQLLQKLRSGSAVPPPRPPWRQQPPGLTAAQQPLEGSFFARRQPLPECHASGSSAASSRAHYSEGRCNALAGPPPPGRSHRARPAPWQLAPRSTCERTPVVVRNFRGFFDYFRFAARPTARCGESRPRSRASGTSPALCDDARSEKMGLASASPVPRLPLVVTPKRGPII

SEQ ID NO: 916657 - protein, 775 aa, Homo sapiens
MGPTQGPRAPLEFGGPLGAAALLLLLPATMFHLLLAARSGPARLLGPPASLPGLEVLWSPRALLLWLAWLGLQAALYLLPARKVAEGQELKDKSRLRYRFQALVLTALLVGLGMSAGLPLGALPEMLLPLAFVATLTAFIFSLFLYMKAQVAPVSALAPGGNSGNPIYDFFLGRELNPRICFFDFKYFCELRPGLIGWVLINLALLMKEAELRGSPSLAMWLVNGFQLLYVGDALWHEEAVLTTMDITHDGFGFMLAFGDMAWVPFTYSLQAQFLLHHPQPLGLPMASVICLINATGYYIFRGANSQKNTFRKNPSDPRVAGLETISTATGRKLLVSGWWGMVRHPNYLGDLIMALAWSLPCGVSHLLPYFYLLYFTALLVHREARDERQCLQKYGLAWQEYCRRQEELALFPGPVKMISLFSSHGLFPGTAQGLCQVPQCCQRVAFLVGRALAQQDAGDLVHSPSCAQGPRRVLACFQHVGCRLQGFFRRGEDLLGTQGSGNAEQCGTEVREQRVVTAVIQGESMRVGEQHIGQLEAHERRDWAAAQADYRGDAGGYDGRAGPRDISKNPLGGRGLRGGGIFHRIRRGPRRGELQLRGVTTRGIIQLLQKLRSGSAVPPPRPPWRQQPPGLTAAQQPLEGSFFARRQPLPECHASGSSAASSRAHYSEGRCNALAGPPPPGRSHRARPAPWQLAPRSTCERTPVVVRNFRGFFDYFRFAARPTARCGESRPRSRASGTSPALCDDARSEKMGLASASPVPRLPLVVTPKRGPII

SEQ ID NO: 916658 - protein, 637 aa, Homo sapiens
ERQQVQQKSVRGHPHPMGTAPLMVSTERFSQQYSSCSTIFLDDSTAIQHYLTMTIISTSQEDPQFSVPPTANTPTPVCKLSMRWSNLFTSEKGSDPDKERKAPENHADTIGSGRAIPIKQGMLLKRSGKWLKTWKKKYVTLCSNGVLTYYSSLGDYMKNIHKKEIDLRTSTIKVPGKWPSLATSACAPISSSKSNGLSKDMDTGLGDSICFSPGISSTTSPKLNPPPSPHANKKKHLKKKSTNNFMIVSATGQTWHFEATTYEERDAWVQAIQSQILASLQSCKSSKSKSQLTSQSEAMALQSIQNMRGNAHCVDCETQNPKWASLNLGVLMCIECSGIHRSFGTRLSRVRSLELDDWPVELRKVMSSIGNELANSIWEGSSQGQTKPSIKSTREEKEWWIRSKYEEKLFLAPLPCTELSLGQQLLRATTDEDLQTAILLLAHGSREEVNETWECGPGAAPDGVDVMARDAHGNTALTYARQASSQECINVLLQPRHIQESSSRSLHWGESLRPLPQACTPEFATVCCHTMLGGLGKLAAEGLAHRTEKATEGASEDPGLLSTWAGGIWGRLVHAVEEVVKEVVGHAKETGEKAIAEAIKKAQESGDKKMKEITETVTNTVTNAITHAAESLDKLGQ

SEQ ID NO: 916659 - protein, 145 aa, Homo sapiens
AKGMGWGMKEALLNTPDGAWTTLQIFVHLCTSISWTLKRAVSLNRGSQQADKNSNSQIKVKMTPSLWAEGQDLQWKLGYVLGAAFKQEKARWKLPWPGDRFTEEMRLGQISSCHSALFLLTTTPGRCIYLRFLVSSKRSRSSSLA

SEQ ID NO: 916660 - protein, 145 aa, Homo sapiens; identical to SEQ ID NO: 916659

SEQ ID NO: 916661 - protein, 213 aa, Homo sapiens
MSKSESPKEPEQLRKLFIGGLSFETTDESLRSHFEQWGTLTDCVVMRDPNTKRSRGFGFVTYATVEEVDAAMNARPHKVDGRVVEPKRAVSREDSQRPGAHLTVKKIFVGGIKEDTEEHHLRDYFEQYGKIEVIEIMTDRGSGKKRGFAFVTFDDHDSVDKIVIQKYHTVNGHNCEVRKALSKQEMASASSSQRGRSGSGNFGGGRGGGFRWE

SEQ ID NO: 916662 - protein, 320 aa, Homo sapiens
MSKSESPKEPEQLRKLFIGGLSFETTDESLRSHFEQWGTLTDCVVMRDPNTKRSRGFGFVTYATVEEVDAAMNARPHKVDGRVVEPKRAVSREDSQRPGAHLTVKKIFVGGIKEDTEEHHLRDYFEQYGKIEVIEIMTDRGSGKKRGFAFVTFDDHDSVDKIVIQKYHTVNGHNCEVRKALSKQEMASASSSQRGRSGSGNFGGGRGGGFGGNDNFGRGGNFSGRGGFGGSCGGGGYGGSGDGYNGFGNDGSNFEGGGSYNDLGNYTNQSSNFGPMKGGNFGGRSSGPYGGGGQYFAKHKTQGGYGGSSSSSSYGSGRRF

SEQ ID NO: 916663 - protein, 320 aa, Homo sapiens; identical to SEQ ID NO: 916662

SEQ ID NO: 916664 - protein, 321 aa, Homo sapiens
MSKSESPKEPEQLRKLFIGGLSFETTDESLRSHFEQWGTLTDCVVMRDPNTKRSRGFGFVTYATVEEVDAAMNARPHKVDGRVVEPKRAVSREDSQRPGAHLTVKKIFVGGIKEDTEEHHLRDYFEQYGKIEVIEIMTDRGSGKKRGFAFVTFDDHDSVDKIVIQKYHTVNGHNCEVRKALSKQEMASASSSQRGRSGSGNFGGGRGGGFLVGMTTFGRGGNFSGRGGFGGSCGGGGYGGSGDGYNGFGNDGSNFEGGGSYNDLGNYTNQSSNFGPMKGGNFGGRSSGPYGGGGQYFAKHKTQGGYGGSSSSSSYGSGRRF

SEQ ID NO: 916665 - protein, 488 aa, Homo sapiens
PGRRPRAKPRRRGSALRLRVRAAARPLLPARPRPQGRILQRAVPTEARGGFSPTKMNWAPATCWALLLAAAFLCDSGAAKGGRGGARGSARGGVRGGARGASRVRVRPAQRYGAPGSSLRVAAAGAAAGAAAGAAAGLAAGSGWRRAAGPGERGLEDEEDGVPGGNGTGPGIYSYRAWTSGAGPTRGPRLCLVLGGALGALGLLRPYGLAGLGDHIWPPARAIPQDPPAWAPPSSLAHGLGAPLGAGAAGCPCGPAIHRPAHAASACHLPPRGDHGPCPTHSRMLGSPQPKRQLPVAPGTATANPAEEASLGTAQAARCTHFPEGSPFFGSSCSRPRNRAWADECVGYGAAEAASQQRGATEHQGPGGGCCGTVRPPPQRGSRSFCTGCPWPQVLQHLRSSGRTKHAELLRDVHWEAWCPLPPAWALQLGSLELARLWGAREHSTLVTSMELLDRPGGGPAGRRGPASRNPAAHGGKSAGSHGLPQDS

SEQ ID NO: 916666 - protein, 1099 aa, Homo sapiens
LPPPSFLLSSLCLSSPADQVRNSYYIGADGSLRLLLANGMEVALQTEPHLLAGTVNPTVGKRNVTLPIDNGLNLVEWRQRKEQARGQVTVFGRRLRVHNRNLLSLDFDRVTRTEKIYDDHRKFTLRILYDQAGRPSLWSPSSRLNGVNVTYSPGGYIAGIQRGIMSERMEYDQAGRITSRIFADGKTWSYTYLEKAGVCLPASLALPYRRPIIHGQAQPGGLSGLYLTHVTKRKCSGKSATEGMGSQEASGWIREIAWQVVSMVLLLHSQRQYIFEFDKNDRLSSVTMPNVARQTLETIRSVGYYRNIYQPPEGNASVIQDFTEDGHLLHTFYLGTGRRVIYKYGKLSKLAETLYDTTKVSFTYDETAGMLKTINLQNEGFTCTIRYRQIGPLIDRQIFRFTEEGMVNARFDYNYDNSFRVTSMQAVINETPLPIDLYRYDDVSGKTEQFGKFGVIYYDINQIITTAVMTHTKHFDAYGRMKEVQYEIFRSLMYWMTVQYDNMGRVVKKELKVGPYANTTRYSYEYDADGQLQTVSINDKPLWRYSYDLNGNLHLLSPGNSARLTPLRYDIRDRITRLGDVQYKMDEDGFLRQRGGDIFEYNSAGLLIKAYNRAGSWSVRYRYDGLGRRVSSKSSHSHHLQFFYADLTNPTKVTHLYNHSSSEITSLYYDLQGHLFAMELSSGDEFYIACDNIGTPLAVFSGTGLMIKQILYTAYGEIYMDTNPNFQIIIGYHGGLYDPLTKLVHMGRRDYDVLAGRWTSPDHELWKHLSSSNVMPFNLYMFKNNNPISNSQDIKCFMTDVNSWLLTFGFQLHNVIPGYPKPDMDAMEPSYELIHTQMKTQEWDNSKSILGVQCEVQKQLKAFVTLERFDQLYGSTITSCQQAPKTKKFASSGSVFGKGVKFALKDGRVTTDIISVANEDGRRVAAILNHAHYLENLHFTIDGVDTHYFVKPGPSEGDLAILGLSGGRRTLENGVNVTVSQINTVLNGRTRRYTDIQLQYGALCLNTRYGTTLDEEKARVLELARQRAVRQAWAREQQRLREGEEGLRAWTEGEKQQVLSTGRVQGYDGFFVISVEQYPELSDSANNIHFMRQSEMGRR

SEQ ID NO: 916667 - protein, 1099 aa, Homo sapiens; identical to SEQ ID NO: 916666

SEQ ID NO: 916668 - protein, 1099 aa, Homo sapiens; identical to SEQ ID NO: 916666

SEQ ID NO: 916669 - protein, 147 aa, Homo sapiens
MPTPWEGMLMKKRIGNPSAMKNYLSPTSGRETSHSYICSPRFRTVPFVSFPSEGCQEQLFQLRKAGDSTALETRFLAMNQTTKASYKYWLLEKQEEVACKVQRTKVPRRCFTREKAPGSRVKPIDDSMAVGSPDSRLALIDNGSEEG

SEQ ID NO: 916670 - protein, 765 aa, Homo sapiens
SLTQQQGSVCPFESEIYEAGAEDRMAGAPMAAAVQPAEVTVEVGEDLHMHQVRDREMPEALEFNLSANPEASTIFQRNSQTDALEFNPSANPEASTIFQRNSQTDVVEIRRSNCTNRVSTERFSQQYSSCSTIFLDDSTAIQHYLTMTIISDADRSLSIPDEQLHSFAVSTVHIMKKRNGGGSLNNYSSSIPPTPSTSQEDPQFSVPPTANTPTPICKRSMRWSNLFTSEKGSDPDKERKAPENHADTIGSGRAIPIKQGMLLKRSGKWLKTWKKKYVTLCSNGVLTYYSSLGDYMKNIHKKEIDLRTSTIKVPGKWPSLATSACAPISSSKSNGLSKDMDTGLGDSICFSPSISSTTSPKLNPPPSPHANKKKHLKKKSTNNFMIVSATGQTWHFEATTYEERDAWVQAIQSQILASLQSCESSKSKSQLTSQSEAMALQSIQNMRGNAHCVDCETQNPKWASLNLGVLMCIECSGIHRSLGTRLSRVRSLELDDWPVELRKVMSSIGNELANSIWEGSSQGQTKPSIKSTREEKERWIHSKYEEKLFLAPLPCTELSLGQQLLRATADEDLQTAILLLAHGSREEVNETCGEGDGCTALHLACRKGNVVLEQLLIWYGVDVMARDAHGNTALTYARQASSQECINVLLQYGCPDECLLLPKTKRLWQDGGFPNARLRCLMKAAADGSRCREIGDAGGKAGLEKGEDKPPEEWLLEWEEEKQKEKELKIGEAVVPVLNSAKHLKKEGNSNTCYNMDEHRGHYAK

SEQ ID NO: 916671 - protein, 743 aa, Homo sapiens
SLTQQQGSVCPFESEIYEAGAEDRMAGAPMAAAVQPAEVTVEVGEDLHMHQVRDREMPEALEFNLSANPEASTIFQRNSQTDALEFNPSANPEASTIFQRNSQTDVVEIRRSNCTNLVTLEIPHHITQRDADRSLSIPDEQLHSFAVSTVHIMKKRNGGGSLNNYSSSIPPTPSTSQEDPQFSVPPTANTPTPICKRSMRWSNLFTSEKGSDPDKERKAPENHADTIGSGRAIPIKQGMLLKRSGKWLKTWKKKYVTLCSNGVLTYYSSLGDYMKNIHKKEIDLRTSTIKVPGKWPSLATSACAPISSSKSNGLSKDMDTGLGDSICFSPSISSTTSPKLNPPPSPHANKKKHLKKKSTNNFMIVSATGQTWHFEATTYEERDAWVQAIQSQILASLQSCESSKSKSQLTSQSEAMALQSIQNMRGNAHCVDCETQNPKWASLNLGVLMCIECSGIHRSLGTRLSRVRSLELDDWPVELRKVMSSIGNELANSIWEGSSQGQTKPSIKSTREEKERWIHSKYEEKLFLAPLPCTELSLGQQLLRATADEDLQTAILLLAHGSREEVNETCGEGDGCTALHLACRKGNVVLEQLLIWYGVDVMARDAHGNTALTYARQASSQECINVLLQYGCPDECLLLPKTKRLWQDGGFPNARLRCLMKAAADGSRCREIGDAGGKAGLEKGEDKPPEEWLLEWEEEKQKEKELKIGEAVVPVLNSAKHLKKEGNSNTCYNMDEHRGHYAK

SEQ ID NO: 916672 - protein, 150 aa, Homo sapiens
VLPSVHGIPGDGRLREKTHLQVNMEYGCRHLFSQICYVIAQRLMVFKAIELLNGKAEIPDQPHSTWCYDDVSLPLCFGNAFMEGLLEVKRFTVLGLHHSVDKPEVPQSWKSPDRHYCIKYRAQDSDTCSVTLVSAGSSATQVHASGTPNI

SEQ ID NO: 916673 - protein, 116 aa, Homo sapiens
MTFLNIPSIMMTFRLEICAICPVKVSQPWEENHLFSLPPSAPVGRCLPEPEEYLCSFQLPHSKQSLTTQPHFLLSQPVGTNTKRPGATETLIHEPRRKKLCGSCPALLCNHALPVY

SEQ ID NO: 916674 - protein, 179 aa, Homo sapiens
MLPCFILSIPRSPCSERASAISVLLILEKWVVGEQWVTIPIKKNPWELLRLCGPPVLSMKRPLMALPCHQPMAGTDHSAGRTSLSCRNVGDESVEEAQLGSPSPSHTVAAMPATEPWGGRRTITVHDLKGIRDQYMLPMHKQSKLNREKMDTHGAATDWERIWLFYYFIMLSCDGPDDI

SEQ ID NO: 916675 - protein, 195 aa, Homo sapiens [sequence omitted]

SEQ ID NO: 916676 - protein, 174 aa, Homo sapiens
ILQQSLRREKSSFQMKADPMDQPQVGLRGSTGLLHSAKAALAVTTVTLATTNGGEHAALGSAGPSPTRFSSGSFHITYFEALFDVLQLVHIPSQIRKELNRIISTFALYVPILKNNTGKRLLGRDKIFLCCPDWSETPGLKTYEYPALEAKNKLCAQKKFIFLIFLQLNGTGFN

SEQ ID NO: 916677 - protein, 337 aa, Homo sapiens
MSDSQDPTTSPVVTTQVELGGCSRQGGGNGFLRFRQHQEVQAFLSLLEDSFVQEFLSKDPCFQISDKYLLAMVLVYFQRAHLKLSEYTHSSLFLALYLANDMEEDLEGPKCEIFPWALGKDWCLRVGKFLHQRDKLWARMGFRAVVSRQCCEEVMAKEPFHWAWTRDRRPHHGGVQRVCPQVPVRLPRGPGLSPPHCSPCGLPQHCSSHLLKPVSSKCPSLTSECHRPPSQNYLSRVKNAWGGDFLIVLPPQMQLEPGTYSLRNNGNTSRQVQLHDSLFRETLQMLGNAPEAVAMGCNQYTFPLLDLGNYFFIPEGQSSGNSVLQTLTGGPPKVLGL

SEQ ID NO: 916678 - protein, 367 aa, Homo sapiens
LYKRTRGGVGVMLWAIPELGSPCPISISYEMSDSQDPTTSPVVTTQVELGGCSRQGGGNGFLRFRQHQEVQAFLSLLEDSFVQEFLSKDPCFQISDKYLLAMVLVYFQRAHLKLSEYTHSSLFLALYLANDMEEDLEGPKCEIFPWALGKDWCLRVGKFLHQRDKLWARMGFRAVVSRQCCEEVMAKEPFHWAWTRDRRPHHGGVQRVCPQVPVRLPRGPGLSPPHCSPCGLPQHCSSHLLKPVSSKCPSLTSECHRPPSQNYLSRVKNAWGGDFLIVLPPQMQLEPGTYSLRNNGNTSRQVQLHDSLFRETLQMLGNAPEAVAMGCNQYTFPLLDLGNYFFIPEGQSSGNSVLQTLTGGPPKVLGL

SEQ ID NO: 916679 - protein, 1076 aa, Homo sapiens
MRAALWTLGLGPLLLNLWAVPIGGPGALRLAYRHSTCDGVVLVRHHGAWGYVCNQEWTLAEASVVCRQLGCGPAVGAPKYVPLPGEMAQPWLHNVSCRGNESSLWECSLGSWCQSPCPHAWVVVALCSNGTFRELRLVKGRSPCAGLPEIRNVNGVDRLCVLHVEEAMVFCRELGCGPVLQAPRRDVGVVRKYLACRGTEPTIRSCRLDNNFRSGCDLRLDAEVVCSGHTEARLVGGEHPCAGRLEVTWGTVCDAALDLATAHVVCRELQCGAVVSTPEGARFGRGSGPVWTEAFRCAGNESLLFHCPRGRGSQCGHGHDAGLRCSEFRMVNGSSSCEGRVEFQVQGSWAPLCATHWDIADATVLCHQLNCGNAVAAPGGGHFGDGDAAIWPDAFHCEGTESYLWNCPVSTLGAPACAPGNTASAVCSGLAHALRLREGQSRCDGRVEVSLDGVWGRVLDDAWDLRGAGVVCRQLGCRGAQQAYDAPAPSRGSVQVALSRVRCLGTETRLTQCNVSATLQEPAGTSRDAGVVCSGEVGTASPMARRHGIPGALTLSLHREPQGAAGRGAGALHGGAWGTVCDDAWDLRDAHVVCRQLGCGRALSALGAAHFGAGAGRIWLDELGCQGHESALWQCPSAGWGRHDWRHKEDAGVFCSESVALRLRGGTCCCAGWLDVFYNGTWGAMCSNALKDLSLSIICKQLGCGVWGVGLAGEQALPLCGHRDRLGGQHRVPQAAQLHSVAMPFPPMAPALLRPSRAGLDYLCRAWAWGSLGSTAFLVKLLWAPKLSELLFNPQDCQRTGHRLLGSPSTAPPGSAAQVPLCPCRCPPSHPGPAPAVTAAPFAEEGALRVRGGEDRCSGRVELWHAGSWGTVCDDGWDLADAEVVCRQLGCGRAVAALGAAAFGPGSGPVWLDEVGCRGSEASLWGCPAERWGRGDRAHEEDAGVRCWEPGPGPPLPAAPFRTFWVVSVVLGSLLGLLLLGLMAFLILPRVTQAMQRALKTELNPRRFPQAAHWGPLGSIMWFAGKGRWPGMGGHWESGYVAVVPPSQPTASCLFAAWLGFLPGVAVLPCLWPHPH

SEQ ID NO: 916680 - protein, 168 aa, Homo sapiens
AFLRMRQPRSQSTTAFPVSPTRETMHVSTIRDSQRISHLSKGGGPQIQFEIQFLLTLKPDLSLLPHKFCANMGITLGSKHPHSSSQGCGPDDYSILGLKFSLRGRNSGMQRGGCDTLMTRTDHPWTGKETMHYEPEENVTFARISVKMAGPVVKTSLVLKVEGLSGIQ

SEQ ID NO: 916681 - protein, 210 aa, Homo sapiens
MVSGRFYLSCLLLGSLGSMCILFTIYWMQYWRGGFAWNGSIYMFNWHPVLMVAGMVVFYGGGPLALPHSIMMGKLPLGVVSPYVKMSSGGYTDPLKFYATSYCTAYGREDFKPRVGSHVGTGYKSIFQPVVSCQASLEALDNPARGEQAQDHFQSVASKTYRPLEVVTASIPCPGDAPDQLRLWAGEAQCGPPTKELVKVEVTGHGAATL

SEQ ID NO: 916682 - protein, 176 aa, Homo sapiens
MVSGRFYLSCLLLGSLGSMCILFTIYWMQYWRGGFAWNGSIYMFNWHPVLMVAGMVVFYGGASLVYRLPQSWVGPKLPWKLLHAALHLMAFVLTVVGLVAVFTFHNHGRTANLYSLHSWLGITTVFLFACQWFLGFAVFLLPWASMWLRSLLKPIHVFFGARHPLSVHRIRHFGHY

SEQ ID NO: 916683 - protein, 166 aa, Homo sapiens
MAVFSYIAELFLGGILDYGPLDYSITLLLFLLPLTAMQLILHLATSVSDQNMNQIMSCLFFTTFLWLPISLASNLEERMMSYSAVTERRSLMSQLGLPQQNTTDWAVQATEIFSQLWRLEVLQVLSGLGFGHMNLGEHKYSVHDSDNSGEYLKIKSAQVGPKALKT

SEQ ID NO: 916684 - protein, 643 aa, Homo sapiens
MSRSRHARPSRLVRKEDVNKKKKNSQLRKTTKGANKNVASVKTLSPGKLKQLIQERDVKKKTEPKPPVPVRSLLTRAGAARMNLDRTEVLFQNPESLTCNGFTMALRSTSLSRRLSQPPLVVAKSKKVPLSKGLEKQHDCDYKILPALGVKHSENDSVPMQDTQVLPDIETLIGVQNPSLLKGKSQETTQFWSQRVEDSKINIPTHSGPAAEILPGPLEGTRCGEGLFSEETLNDTSGSPKMFAQDTVCAPFPQRATPKVTSQGNPSIQLEELGSRVESLKLSDSYLDPIKSEHDCYPTSSLNKVIPDLNLRNCLALGGSTSPTSVIKFLLAGSKQATLGAKPDHQEAFEATANQQEVSDTTSFLGQAFGAIPHQWELPGADPVHGEALGETPDLPEIPGAIPVQGEVFGTILDQQETLGMSGSVVPDLPVFLPVPPNPIATFNAPSKWPEPQSTVSYGLAVQGAIQILPLGSGHTPQSSSNSEKNSLPPVMAISNVENEKQVHISFLPANTQGFPLAPERGLFHASLGIAQLSQAGPSKSDRGSSQVSVTSTVHVVNTTVVTMPVPMVSTSSSSYTTLLPTLEKKKRKRCGVCEPCQQKTNCGECTYCKNRKNSHQICKKRKCEELKKKPSVVVPLEDLMET

SEQ ID NO: 916685 - protein, 344 aa, Homo sapiens
MSTLERSYLLKINGKVAERPQHMLMRVSVGIHKEDIDAAIETYNLLSERWFTHASPTLFNAGTNRPQLSSCFLLSMKDDSIEGIYDTLKQCALISKSAGGIGVAVSCIRATGSYIAGTNGNSNGLVPMLRVYNNTARYVDQGGNKRPGAFAIYLEPWHLDIFEFLDLKKNTGKEEQRARDLFFALWIPDLFMKRVETNQDWSLMCPNECPGLDEVWGEEFEKLYASYEKQGRVRKVVKAQQLWYAIIESQTETGTPYMLYKDSCNRKSNQQNLGTIKCSNLCTEIVEYTSKDEVAVCNLASLALNMYVTSEHTYDFKKLAEVTKVVVRNLNKIIDINYYPVPEV

SEQ ID NO: 916686 - protein, 491 aa, Homo sapiens
MHVIKRDGRQDRVMFDKITSRIQKLCYGLNMDFVDPAQITMKVIQGLYSGVTTVELDTLAAETAATLTTKHPDYAILAARIAVSNLHKETKKVFSDVMEDLYNYINPHNGKHSPMVAKSTLDIVLANKDRLNSAIIYDRDFSYNYFGFKTLERSYLLKINGKVAERPQHMLMRVSVGIHKEDIDAAIETYNLLSERWFTHASPTLFNAGTNRPQLSSCFLLSMKDDSIEGIYDTLKQCALISKSAGGIGVAVSCIRATGSYIAGTNGNSNGLVPMLRVYNNTARYVDQGGNKRPGAFAIYLEPWHLDIFEFLDLKKNTGKEEQRARDLFFALWIPDLFMKRVETNQDWSLMCPNECPGLDEVWGEEFEKLYASYEKQGRVRKVVKAQQLWYAIIESQTETGTPYMLYKDSCNRKSNQQNLGTIKCSNLCTEIVEYTSKDEVAVCNLASLALNMYVTSEHTYDFKKLAEVTKVVVRNLNKIIDINYYPVPEV

SEQ ID NO: 916687 - protein, 327 aa, Homo sapiens
SPSSWDPGRTMKWLLLLGLVALSECIMYKVPLIRKKSLRRTLSERGLLKDFLKKHNLNPARKYFPQWKAPTLVDEQPLENYLDMEYFGTIGIGTPAQDFTVLFDTGSSNLWVPSVYCSSLACTNHNRFNPEDSSTYQSTSETVSITYGTGSMTGILGYDTVQDSPGKCPINGRSEEATADGHTNGRTKKFMSSPLTFHSDDKSGSVVIFGGIDSSYYTGSLNWVPVTVEGYWQITVDSITMNGETIACAEGCQAIVDTGTSLLTGPTSPIANIQSDIGASENSDGDMVVSCSAISSLPDIVFTINGVQYPVPPSAYILQVRRLWTIH

SEQ ID NO: 916688 - protein, 217 aa, Homo sapiens
SIVRSLRSESESHPSICSAMLSTVPSTEGLHCHGDFENVWSMGGLVKTMWVVDERIPDKQPYPVPLQGRVLWGIYDSPQRIQTIFIFLQLATTPNFIKGHGKKACTVKREKNSRCQVSDYWGEIHLRFVYIFCFSDFGRRPRTVHTTGLAVLYESSHNRDALKVLLSSTVKAQPSHPLEKGENGHQQCRVHFISISLVCDLSFPFEDKRRVMSVPLV

SEQ ID NO: 916689 - protein, 254 aa, Homo sapiens
LAQSGSCYTLRSEIFRTMPCTYQHPFLWSLCPLPPASPSFRVPRSQVPVRSDMAHGIWFFISWVKALPGDATATRSPVLPAMVNPTMFFNIAINSEALGHVSFELFADKFPKTENFRALSTGEKGFGYKGSCFHRIILGLLCQGGDFTCHNGTGGKSVYREKFDDENFILKHTGPGILSMKHTGPGILSMANAGPNTNDSQIFICTAKTEWLDGKHVVSGRVKEGIKIVEAMKRYGSKNGKSRKKITTADCGQL

SEQ ID NO: 916690 - protein, 137 aa, Homo sapiens
TQMRDGRMTSFRTQMSDGRMTSFRTQMRKGFLPDADEGRADDSFRTHLSMCTCCSCQADDIRNAHQLEGEEMLGGLLLHRVHPPERPSAHGGQCVEVLQALIHNSSSTVKVDNLDCLSIPASSVLHITIPNGMLLCL

SEQ ID NO: 916691 - protein, 137 aa, Homo sapiens; identical to SEQ ID NO: 916690

SEQ ID NO: 916692 - protein, 155 aa, Homo sapiens
MNEDTDAALGNKNTPMSQEPSKDCTTTKKLNQTCRLLQQGGQLQVLAQALALCEAGPGAPQAAFTAGTGEHVALRSLEMPATTGLQGGSHSPGSGSSQQGEARQQEQTPLSLRGLGQPSWAPQEYTDAWVRSHSLGGRNCTRKSGAPACSVEQEA

SEQ ID NO: 916693 - protein, 135 aa, Homo sapiens
MSAASAQALIRLECVHSFLKLEFFNQNETYCSDSNGKQPNYTPGNYSFQPHVRSPLLNSVLLVILPPVTGTGFANILTRRRGETGSGRDGISLCCPRWFQTPSLKQSSCLSLLKPWDYKHKPPPPARSHDSLHLC

SEQ ID NO: 916694 - protein, 1114 aa, Homo sapiens
MEEKQQIILANQDGGTVAGAAPTFFVILKQPGNGKTDQGILVTNQDACALASSVSSPVKSKGKICLPADCTVGGITVTLDNNSMWNEFYHRSTEMILTKQGRRMFPYCRYWITGLDSNLKYILVMDISPVDNHRYKWNGRWWEPSGKAEPHVLGRVFIHPESPSTGHYWMHQPVSFYKLKLTNNTLDQEGHIILHSMHRYLPRLHLVPAEKAVEVIQLNGPGVHTFTFPQTEFFAVTAYQNIQITQLKIDYNPFAKGFRDDGLNNKPQRDGKQKNSSDQEGNNISSSSGHRVRLTEGQGSEIQPGDLDPLSRGHETSGKGLEKTSLNIKRDFLGFMDTDSALSEVPQLKQEISECLIASSFEDDSRVASPLDQNGSFNVVIKEEPLDDYDYELGECPEGVTVKQEETDEETDVYSNSDDDPILEKQLKRHNKVDNPEADHLSSKWLPSSPSGVAKAKMFKLDTGKMPVVYLEPCAVTRSTVKISELPDNMLSTSRKDKSSMLAELEYLPTYIENSNETAFCLGKESENGLRKHSPDLRVVQKYPLLKEPQWKYPDISDSISTERILDDSKDSVGDSLSGKEDLGRKRTTMLKIATAAKVVNANQNASPNVPGKRGRPRKLKLCKAGRPPKNTGKSLISTKNTPVSPGSTFPDVKPDLEDVDGVLFVSFESKEALDIHAVDGTTEESSSLQASTTNDSGYRARISQLEKELIEDLKTLRHKQVIHPGLQEGGNSESSLKNRSAFCSDKLDEYLENEGKLMETSMGFSSNAPTSPVVYQLPTKSTSYVRTLDSVLKKQSTISPSTSYSLKPHSVPPVSRKAKSQNRQATFSGRTKSSYKSILPYPVSPKQKYSHVILGDKVTKNSSGIISENQANNFVVPTLDENIFPKQISLRQAQQQQQQQQGSRPPGLSKSQVKLMDLEDCALWEGKPRTYITEERADVSLTTLLTAQASLKTKPIHTIIRKRAPPCNNDFCRLGCVCSSLALEKRQPAHCRRPDCMFGCTCLKRKVVLVKGGSKTKHFQRKAAHRDPVFYDTLGEEAREEEEGIREEEEQLKEKKKRKKLEYSLLSVMLFIYGATTMDTARSEELLGSLRQEDHFSQEATVSHDCATTWATE

SEQ ID NO: 916695 - protein, 484 aa, Homo sapiens
SSTRIVRPFWKPSATVCTELGSGKKGNPGGACWAQVLSSFGSRVPNTVMDQNSVPEKAQNEADTNNADRFFRSHSSPPHHRPGHSRALHHYELHHHGVPHQRGESHHPPEFQDFHDQALSSHVHQSHHHSEARNHGRAHGPTGFGLAPSQGAVPSHRSYGEDYHDELQRDGRRHHDGSQYSGFHQQSDSHYHRGSHHGRPQYLGENLSHYSSGVPHHGEASHHGGSYLPHGPNPYSESFHHSEASHLSGLQHDESQHHQVPHRGWPHHHQVHHHGRSRHHEAHQHGKSPHHGETISPHSSVGSYQRGISDYHSEYHQGDHHPSEYHHGDHPHHTQHHYHQTHRHRDYHQHQDHHGAYHSSYLHGDYVQSTSQLSIPHTSRSLIHDAPGPAASRTGVFPYHIAHPRGSAHSMTRSSSTIRSRVTQMSKKVHTQDISTKHSEDWGKEEGQFQKRKSESLLGPPCQLLLPGAGSRPDLGPALSFRRS

SEQ ID NO: 916696 - protein, 340 aa, Homo sapiens
MPEWPPCLSVAPALVITMAAGKGAPLSPSAENRWRLSEPELGRGCKPVLLEKTNRLGPEAAVGRAGRDVGSAELALLVAPGKPRPGKPLPPKTRGEQRQSAFTELPRMKDRQVDAQAQEREHDDPTGQPGAPQLTQNIPRGPAGSKVFSVWPSGARSEQRSAFSKPTKRPAERPELTSVFPAGESADALGELSGLLNTTDLACWGRLSTPKLLVGDLWNLQALPQNAPLCSTFLGAPTLWLEHTQAQVPPPSSSSTTSWALLPPTLTSLGLSTQNWCAKCNLSFRLTSDLVFHMRSHHKKEHAGPDPHSQKRREEALACPVCQEHFRERHHLSRHMTSHS

SEQ ID NO: 916697 - protein, 233 aa, Homo sapiens
MKDRQVDAQAQEREHDDPTGQPGAPQLTQNIPRGPAGSKVFSVWPSGARSEQRSAFSKPTKRPAERPELTSVFPAGESADALGELSGLLNTTDLACWGRLSTPKLLVGDLWNLQALPQNAPLCSTFLGAPTLWLEHTQAQVPPPSSSSTTSWALLPPTLTSLGLSTQNWCAKCNLSFRLTSDLVFHMRSHHKKEHAGPDPHSQKRREEALACPVCQEHFRERHHLSRHMTSHS

SEQ ID NO: 916698 - protein, 340 aa, Homo sapiens; identical to SEQ ID NO: 916696

SEQ ID NO: 916699 - protein, 1284 aa, Homo sapiens
MGSTQFELPGGFFYSVRGKPPTQASIMVDTPSHTKLKCPRLTSVCCAGSKNFKPVDVSLLGSMGETQCNCKHPSRHWENFPSGKELKLFLFVFVAEPIFYFGDVEYSVDESAGYVEVQVWRTGTDLSKSSSVTVRSRKTDPPSADAGTDYVGISRNLDFAPGVNMQPVRVVILDDLGQPALEGIEKFELVLRMPMNAALGEPSKATVSINDSVSDLPKMQFKERIYTGSESDGQIVTMIHRTGDVQYRSSVRCYTRQGSAQVMMDFEERPNTDTSIITFLPGETEKPCILELMDDVLYEEVEELRLVLGTPQSNSPFGAAVGEQNETLIRIRDDADKTVIKFGETKFSVTEPKEPGESVVIRIPVIRQGDTSKVSIVRVHTKDGSATSGEDYHPVSEEIEFKEGETQHVVEIEVTFDGVREMREAFTVHLKPDENMIAEMQLTKAIVYIEEMSSMADVTFPSVPQIVSLLMYDDTSKAKESAEPMSGYPVICITACNPKYSDYDKTGSICASENINDTLTRYRWLISAPAGPDGVTSPMREVDFDTFFTSSKMVTLDSIYFQPGSRVQCAARAVNTNGDEGLELMSPIVTISREEGLCQPRVPGVVGAEPFSAKLRYTGPEDADYTNLIKLTVTMPHIDGMLPVISTRELSNFELTLSPDGTRVGNHKCSNLLDYTEVKTHYGFLTDATKNPEIIGETYPYQYSLSIRGSTTLRFYRNLNLEACLWEFVSYYDMSELLADCGGTIGTDGQVLNLVQSYVTLRVPLYVSYVFHSPVGVGGWQHFDLKSELRLTFVYDTAILWNDGIGSPPEAELQGSLYPTSMRIGDEGRLAVHFKTEAQFHGLFVLSHPASFTSSVIMSADHPGLTFSLRLIRSEPTYNQPVQQWSFVSDFAVRDYSGTYTVKLVPCTAPSHQEYRLPVTCNPREPVTFDLDIRFQQVSDPVAAEFSLNTQMYLLSKKSLWLSDGSMGFGQESDVAFAEGDIIYGRVMVDPVQNLGDSFYCSIEKVFLCTGADGYVPKYSPMNAEYGCLADSPSLLYRFKIVDKAQPETQATSFGNVLFNAKLAVDDPEAILLVNQPGSDGFKVDSTPLFQKPRYKFLTQGSKVEGNTGSCHNTEQMPQISRGAYTANLCRSKSKDNANRGIGKRSVEYHSLVSQGKPQSTTKSRKKREIRSTPSLAWEIGAENSRGTNIQHIALDRTKRQIPHGRAPPDGILPWELNSPSSAVSLVTVVGGTTVGLLTICLTVIAVLMCRGKESFRGKDAPKGSSSSEPMVPPQSHHNDSSEV

SEQ ID NO: 916700 - protein, 661 aa, Homo sapiens
NGGPLTLGDDRCHRKTGMLPVISTRELSNFELTLSPDGTRVGNHKCSNLLDYTEVKTHYGFLTDATKNPEIIGETYPYQYSLSIRGSTTLRFYRNLNLEACLWEFVSYYDMSELLADCGGTIGTDGQVLNLVQSYVTLRVPLYVSYVFHSPVGVGGWQHFDLKSELRLTFVYDTAILWNDGIGSPPEAELQGSLYPTSMRIGDEGRLAVHFKTEAQFHGLFVLSHPASFTSSVIMSADHPGLTFSLRLIRSEPTYNQPVQQWSFVSDFAVRDYSGTYTVKLVPCTAPSHQEYRLPVTCNPREPVTFDLDIRFQQVSDPVAAEFSLNTQMYLLSKKSLWLSDGSMGFGQESDVAFAEGDIIYGRVMVDPVQNLGDSFYCSIEKVFLCTGADGYVPKYSPMNAEYGCLADSPSLLYRFKIVDKAQPETQATSFGNVLFNAKLAVDDPEAILLVNQPGSDGFKVDSTPLFQKPRYKFLTQGSKVEGNTGSCHNTEQMPQISRGAYTANLCRSKSKDNANRGIGKRSVEYHSLVSQGKPQSTTKSRKKREIRSTPSLAWEIGAENSRGTNIQHIALDRTKRQIPHGRAPPDGILPWELNSPSSAVSLVTVVGGTTVGLLTICLTVIAVLMCRGKESFRGKDAPKGSSSSEPMVPPQSHHNDSSEV

SEQ ID NO: 916701 - protein, 142 aa, Homo sapiens
MTTTNLVKGHLLPPSQGTGPRELHVGRNEPSGCLAEGIHGQVSETLLTLPLTFAKKQVWFYPEWPSVVSHDSIHIVISRGKALVKGLMTGHCRHELDLSCSTAWYFPSTVFCPDTAKAKGSAGTATVTLCWEVNSSISSGTA

SEQ ID NO: 916702 - protein, 142 aa, Homo sapiens; identical to SEQ ID NO: 916701

SEQ ID NO: 916703 - protein, 142 aa, Homo sapiens; identical to SEQ ID NO: 916701

SEQ ID NO: 916704 - protein, 142 aa, Homo sapiens; identical to SEQ ID NO: 916701

SEQ ID NO: 916705 - protein, 337 aa, Homo sapiens
MWSPPLGGVECNDVTAPLGTVRTSKEEKKHEIHLVQKLGRSLFKLKNQTAEPLAPQPPAGPSKVEQLQDETNHLRKELESVGRQLQAEVENNQMLSLLNRRQEERLREQEERLREQEERLCEQEERLCEQEERLREQEERLCEQEKLPGQERLLEEVEKLLKQERRQEEQERLLERERLLDEVEELLEQERLRQQDERLWQQETLRELERLRELERMLELGWEALYEQRAEPRSGFEELNNENKSTLQLEQQVKELEKSGGAEEPRGSESAAAARPVPGAPVPQGAWMCGQAGWTPQEHPGLSGEAVGTGEAAGGAGEAACHSFRAAENRELNITII

SEQ ID NO: 916706 - protein, 232 aa, Homo sapiens
PHSSAEAEPPRTFFMDILIIYKCKLYLLLALFFWQEHVNETPGAWSCLEFVPSDVQTCSEFLPSGGVRGLAGSGVKLRTFALDIKVLQVPTRLRSPAGFTQWIPHRAAGGAACQFPAVCPHSSALGCRWDWAHGVGGGARLGGSGHTGAHGAQQLLAEVLSPSLPEASGAGQLLRVRGPPSPRPSGTRAGLQAPRAALVPARASPSTPPCKLKEPAPALASTERGSHSAASS

SEQ ID NO: 916707 - protein, 170 aa, Homo sapiens
MVLAAAAELECSSLGRSSAPDKSGSNSTVGPQSQAAQQPCQPQTLPPTLWSLAPHPGLCSFSDTKCQCQDCFPSRISKRLLTPSQSVFSLSLGTHQGQGKNKPQCADNGTSLFLSGLRLALWQIKQNLGKTSDPEAPPSVGIPSRIGNSETCKCQNPHLGICYFSLCEST

SEQ ID NO: 916708 - protein, 203 aa, Homo sapiens
EIYSEPNMSDHGPSHSPQGVLRTCAQGERRDNSKRGLPGYRKKVRKKERKKVRKKERKKERKKERERERERERKKERKKERKKEKEREREKEERKKKEREKEKKERKEKRKRERKKKERRRKREKERGKKGRKEKKEKERRKERKKEKERRKEGKKKEKERKKEKESSGVIKVQILGQCLKLTDSQFSNFWQWPFKNSTLHIS

SEQ ID NO: 916709 - protein, 754 aa, Homo sapiens
MLEGLYMWILKSSRTVTKVMLKKQSHPKNPNDKHRSKKCKDPKPRVKKLKYHQYIPPDQKGEKNEPQMDSNYARLLQQQQLFLQLQILSQQKQHYNYQTILPAPFKYGGAHAILNAGAYHTVSEVHMVRVACIPFQFLSSKIGSEFLQVRNAFSQLFIQICLLLEHQNSTRCSEKSKAREGPFQAQGNAVSTSTEEGIDKKWKTKIEYSQCLRGLEAGQKTLLNTADRQRSASEQAADAVRPKYKKKQLDAGVEGTSGDNEELWQQNSNILRKIKPISNSDLIVKYLNLKHQGMEMKRERTLYPVTILRAGRPEPLNDKNSNSGNSALNNATPNTPRQNTSTPVSELKTELKLRGLPVSGTKPDLIERLKPYQEVNSSGLAAGGIVAVSSSAIVTSNPEVTVALPVTTLHNTVTSSVSTLKAELPPTGTSNATRVENVHSPLPISPSPSEQSSLSTDDTNMADTFTEIMTMMSPSQFLSSSPLRMTNNEDSLSPTSSTLSNLELDAAEKDRKLQEKEKQIEELKRKLEQEQKLVEVLKMQLEVEKRGQQQRPLEAQPSAPGHSVKSDQKHGSLGSSIKDEASLPDCSSSRQPIPVASHAGQPPPAVVAQPQALLTTQTAQLLLPVSIQGSSVTSVQLPVGSLKLQTSPQAGMQTQPQIATAAQIPTAALASGLAPTVPQTQDTFPQHVLSQPQQVRKVFTNSASSNTVLPYQRHPAPAVQQPFINKASNSVLQSRNAPLPSLQNGPNTPNKVTL

SEQ ID NO: 916710 - protein, 658 aa, Homo sapiens
MLEGLYMWILKSSRTVTKVMLKKQSHPKNPNDKHRSKKCKDPKPRVKKLKYHQYIPPDQKGEKNEPQMDSNYARLLQQQQLFLQLQILSQQKQHYNYQTILPAPFKYGGAHAILNAGAYHTVSEVHMVRVACIPFQFLSSKIGSEFLQVRNAFSQLFIQICLLLEHQNSTRCSEKSKAREGPFQAQGNAVSTSTEEGIDKKWKTKIEYSQCLRGLEAGQKTLLNTADRQRSASEQAADAVRPKYKKKQLDAGVEGTSGDNEELWQQNSNILRKIKPISNSDLIVKYLNLKHQGMEMKRERTLYPVTILRAGRPEPLNDKNSNSGNSALNNATPNTPRQNTSTPVSELKTELKLRGLPVSGTKPDLIERLKPYQEVNSSGLAAGGIVAVSSSAIVTSNPEVTVALPVTTLHNTVTSSVSTLKAELPPTGTSNATRVENVHSPLPISPSPSEQSSLSTDDTNMADTFTEIMTMMSPSQFLSSSPLRMTNNEDSLSPTSSTLSNLELDAAEKDRKLQEKEKQIEELKRKLEQEQKLVEVLKMQLEVEKRGQQQRPLEAQPSAPGHSVKSDQKHGSLGSSIKDEASLPDCSSSRQPIPVASHAGQPPPAVVAQPQALLTTQTAQLLLPVSIQGSSVTSVQLPVGSLKLQGMHTPLASSNWDS

SEQ ID NO: 916711 - protein, 193 aa, Homo sapiens
YRCLRAFPFRLLWLQVHCPRGVTSRLRPMAIEFEGTWGGIEWRGLLEDKCLGSRKENEGKEMDSTADLDLGTIQLRVSEKFDHLKPSSLNSSKSLSVQLCSIAGPSAAGLLDCAGGPLQTLFAWVSAAESAEQRILLNSKCCCLIVPLEVSNQRGTCLCEVSQNPCWENHYPLQSSVGNAKITCLLHRSHWEL

SEQ ID NO: 916712 - protein, 178 aa, Homo sapiens
MVQCTESCSFLLLLSLFFGFDSWKKMSWAILAVSPNLPSAPCTAVSNERLGIIHHPFPTWPVTGPTSQMGRSWLAGRPQKGPLSENEVEHQGELLSFEQAKRNVSCNCGWSLLPGKIGRRYCFNNQRKQETSHLMTPIFPCCHKCVFSFLNITWSHCSFRWVRGLADFKNGAVDLPEC

SEQ ID NO: 916713 - protein, 169 aa, Homo sapiens
LVLLTCMHDASGRKNGENKTQSPLQIPATHMEVRREDPFLCGPFLPKLRATRKSDPLQGQEASRAWRLTGANNLAKTICPINKASGKHPGPHNGANLLGTHFPSGVLARIPLPSRWRSEPHGKHEKECRLPLRSKTSPQQKRVTSVLQPRRTEFSQQLNSPPELVLPTD

SEQ ID NO: 916714 - protein, 181 aa, Homo sapiens
MLLRPGFFPRWLLAALSLVSLVLFFWTLFWLDDGLPGMEDSPPDSSTPPYAGSGNGQAGKSWTRVRHEPQGICHCKQVSHVSDPRHTMDNQALGHPSGGLGATWHSLHQLAERLSDWRGQKNHHERASQNTVDGQTQRSGLGLRMCISDKYSGIAVAAGLGPCHEEHGSAQLSLITCLLID

SEQ ID NO: 916715 - protein, 1044 aa, Homo sapiens
MCFLQQSCQQQTFPESLSRTANKGTGPRESQQDSEQADRSQSDSAGQRARGQVPESLSRTASKRTGPRESQQDSEQADRSQRVSAGQRASGQVPENLSRTASKRTGPRESQQDSEQADRSQRVSAGQRASGQVPESQQDSEQGDRSQRVSAGQRASGQVPESLSRTASKGTGPRESQQDSEQADRFQRVSAGQRASRQVPESLSRTASKQTGPRVSARQRARGQVPESLSRTASKRTGPRECQQDSEQADRSQRVSAGQRARGQVPESLSRTASKRTGPRECQQDSEQADRSQSLSKTASKGTGPRESQQDSEQADRSQRVSAGQRARGQVPESLSRTASKGTGPRESQQDSEQADRSQRVSAGQRASGQVPESLSRTASKPTGPRESQQDSEQADRSQSLSKTASKGTGPRESQQDSEQADRSQRVSAGQRASGQVPESLSRTASKGTGPRESQQDSEQADRSQRVSAGQRASGQVPESLSRTASKRTGPRESQQDSEQADRSQSVSAGQRARGQVPESVSRTASKGTGPRESQQDSEQGDRSQRVSAGQRARGQVPESLSRTASKRTGPRASQQDSEQGDRSQRVSAGQRARGQVPESLSRTASKGTGPRESQQDSEQGDRSQRVSAGQRASRQVPERLSRTASKGTGPRESQQDSEQADRSQRVSAGQRASGQQDSEQADRSQRVSAGQRASGQVPESLSRTASKRTGPRESQQDSEQGDRSQRVSAGQRARGQVPESLSRTASKGTGPRESQQDSEQADRSQRVSAGQRASRQVPESLSRTASKRTGPRVSARQRARGQVPESLSRTASKRTGPRESQQDSEQADRSQRVSAGQRASRQVPESLSRTASKRTGPRVSARQRARGQVPESVSRTASKRTGPRESQQDSEQGDRSQRVSAGQRASGQVPESVSRTASKRTGPRVSARQRARGQVPESLSRTASKRTGPRESQQDSEQGDRKHPHGHGHQSESRPPHASVLLSHQPGPFRHRLHIHGQQQSGGCAVHSGQPHPEPLTYSLRNKDLSEQCGSIHLGGAAGRVFV

SEQ ID NO: 916716 - protein, 147 aa, Homo sapiens
TSGAPVRAMFSKHDHMTSDDTWRRKAILLKSPHSPGPGSPIPPLPYTGECYLLIAQMRKLKLVSNSHTAEEGPRGPRAVHTLPPWTYRTSRWHRSTQATERPCPAPCHALCVHPGPRAVAARSPPLPTIRVLPPFAVILSRTLSRQL

SEQ ID NO: 916717 - protein, 480 aa, Homo sapiens
MWSPPLGGVECNDVTSATGIYGEGRASSTTLEDLESQYQELAVALDSSSAIISQLTENINSLVRTSKEEKKHEIHLVQKLGRSLFKLKNQTAEPLAPEPPAGPSKVEQLQDETNHLRKELESVGRQLQAEVENNQMLSLLNRRQEERLREQEERLREQEERLREQEDRLHEQEERLREQEERLCEQEERLREHEERLCEQEERLCEQEERLREQEERLCEQEERLREQEERLCEQEKLPGQERLLEEVEKLLEQERRQEEQERLLERERLLEEVEKLLEQERRQEEQERLLERERLLDEVEELLDEVEELLEQERLRLRELERMLELGWEALYEQRAEPRSGFEELNNENKSTLQLEQQVKELEKSGELKETVTSDPSKKMWEAGTSLWGGEVPGHRQLQPGDRVFRQVELKSQEAPSLQQQPDQYLEPQSHKELGCADKQGGLPRSTQAWVEKLLVQERRQEEQERLHAILFGLPRTGS

SEQ ID NO: 916718 - protein, 205 aa, Homo sapiens
MHSHAILLSFDQNQPFLSKIQKLPQQVYTYTTIKSGRYHDAFWERSSTKSKMAASRRLMKELEEIRKCGMENFRNIQVDEANLLTWQGLIVPDNPPYNKGAFRIEINFPAEYPFKPPRITFKTKIYHPNIDEKGQVCLPVISAENWKPATKTDQVIQSLIALVNDPQPEHPLRADLAEEYSNDRKKFCKNAEEFTKKYGEKRPVD

SEQ ID NO: 916719 - protein, 193 aa, Homo sapiens
MEFLKLLNREDVIQKPLVASACFLCISGFFFPPFLIISGKTQESSPAPKIVIKLMCCTQVVTPRKRVKDSHIKQRMRTMPRHSQSLTMAPYSSVSLVEQLEDRILCHEKTTAALVEHAFRIKDDIVNSLQKMQNKGGGDRLARLFLEEHIRNITAIVKQLNRDIESVPNPGATFLNSWDRQAGKPGEPAGSHG

SEQ ID NO: 916720 - protein, 130 aa, Homo sapiens
MFPFRKGELRRKKGVTDPKQVQNLARQILLDLKAQELSSLAQCPIFQAHWGGSITPIAPGRGPAPVVLADPGSCQKAVSPRLLWMVLLQSFRLRGEKKQLSKLRRHGNTGKSPAFPADTEEPMIPGENQK

SEQ ID NO: 916721 - protein, 136 aa, Homo sapiens
TTAHIILNMRHYVLARDQTETIQEEHGLNDRQLNCHETQKSGRMYWCLSTTEEGRRQTMIALTRKNKWKNDATGCLILTFLGLLVVSSSASNSETSLVSSLLSCCNMAALRQPYFREPRQRSSVRVRVGTQNLALS

SEQ ID NO: 916722 - protein, 142 aa, Homo sapiens
MLIEGAGLCAVSCLLSAGSARTLSCGYGSGSKQPGSGSAAGRRAPSWFRWGCGSLRPRGDPAHPGPAHQRAPERSHRGGACAVSLSLLVPRLRHRKKRVKGFCKLSSVVTYEPQAAHSQPQTTSHSSCVYQKLAHPTASLQR

SEQ ID NO: 916723 - protein, 140 aa, Homo sapiens
MRVRINFQKNKVSKNIFGGEEVEMKKWMKQSSAMAAEGLEHHIERAAGLTQVSGATTDRKDGQNTQYLRICKWPFLKKKEMLYRTTDDTRCPCWGEKLDDPIGKPAPEICIKASASHSYLVSPLLKSCWDFQRHSTNGKF

SEQ ID NO: 916724 - protein, 142 aa, Homo sapiens
KVRSRRRRTLSVFCSLPPENMFPSMEKSCDHLKFGPALLCLYFQVALPIGGFEAWRKHGSKGWWGSQRLGGKSPGSFALSCDPGQALELGWVSSEMGSGSSMEDTVQGARGGTVTQGRSPAVGAFALLIESWVLKGILGVFW

SEQ ID NO: 916725 - protein, 214 aa, Homo sapiens
MAQVSINNDYSEWDLSTDAGERARLLQSPCVDTAPKSEWEASPGGLDRGTTSTLGAIFIVVNACLGAGLLNFPAAFSTAGGVAAGIALQMCHVSSVPVFNSMQQPEVKTWGGVVTAAMVIALAVYMGTAWWVHGPANGNPSWSPWEAFIFKPEPQTNAIYVRSPGHKQLSPKGNKKDFGIGRKETHSLELMRSILKSRSFNEWMKSGIISRNGE

SEQ ID NO: 916726 - protein, 344 aa, Homo sapiens
MAQVSINNDYSEWDLSTDAGERARLLQSPCVDTAPKSEWEASPGGLDRGTTSTLGAIFIVVNACLGAGLLNFPAAFSTAGGVAAGIALQMGMLVFIISGLVILAYCSQASNERTYQEVVWAVCGKLTGVLCEVAIAVYTFGTCIAFLIIIGDQQDKIIAVMAKEPEGASGPWYTDRKFTISLTAFLFILPLSIPREIGFQKYASFLSVVGTWYVTAIVIIKYIWPDKEMTPGNILTRPASWMAVFNAMPTICFGFQCHVSSVPVFNSMQQPEVKTWGGVVTAAMVIALAVYMGTGICGFLTFGAAVDPDVLLSYPSEDMAVAVARAFIILSVLTSYPILHFCGR

SEQ ID NO: 916727 - protein, 236 aa, Homo sapiens
MRHIPSGPVECLHECFLFTAWYDQAAPNTTCTMIKQVSDPVQLSSMCPCTGREQLKSACVIQKPMTWDSLSGPPVQSMHAGSKNNRRKSFIAEPGREIVRVTLKRDPHRGFGQADPGIFISSIIPGGPAEKAKTIKPGGQILALNHISLEGFTFNMAVRMIQNSPDNIELIISQSKGVHDYCEVLDLEVHVGLLYCFPHGVGLQRSSVVAQINKLCNFRGRMGVTMLVLLKGSNLL

SEQ ID NO: 916728 - protein, 767 aa, Homo sapiens
WVPVTVLPGCVGCRTVAALASWTVRDVKERIFAETGFPVSEQRLWRGGREVGGGRGRWAGLRHAEERRASRARGGRRRFPRAARMTPAAWPPLSDWIKIGDLTSKNCHLFVNLQSKGLKGGGRFGQTTPPLVDFLKDILRRYPEGGQILKELIQNAEDAGATEVKFLYDETQYGTETLWSKDMAPYQGPALYVYNNAVFTPEDWHGIQEIARSRKKDDPLKVGRFGIGFNSVYHITDVPCIFSGDQIGMLDPHQTLFGPHESGQCWNLKDDSKEISELSDQFAPFVGIFGSTKETFINGNFPGTFFRFPLRLQPSQLSSNLYNKQKVLELFESFRADADTVLLFLKSVQDVSLYVREADGTEKLVFRVTSSESKALKHERPNSIKILGTAISNYCKKTPSNNITCVTYHVNIVLEEESTKDAQKTSWLVCNSVGGRGISSKLDSLADELKFVPIIGIAMPLSSRDDEAKGATSDFSGKAFCFLPLPPGEESSTGLPVHISGFFGLTDNRRSIKWRELDQWRDPAALWNEFLVMNVVPKAYATLILDSIKRLEMEKSSDFPLSVDVIYKLWPEASKVKVHWQPVLEPLFSELLQNAVIYSISCDWVRLEQVYFSELDENLEYTKTVLNYLQSSGKQIAKVPGNVDAAVQLTAASGTTPVRKVTPAWVRQVLRKCAHLGCAEEKLHLLEFVLSDQAYSELLGLELLPLQNGNFVPFSSSVSDQDVIYITSAEYPRSLFPSLEGRFILDNLKPHLVAALKEAAQTRGIIV

SEQ ID NO: 916729 - protein, 836 aa, Homo sapiens
MPGAVRLRGQVRSPVRGLRLQRVALSANKITVLRRGAFADVTQVTSLWLAHNEVRTVEPGALAVLSQLKNLDLSHNFISSFPWSDLRNLSALQLLKMNHNRLGSLPRDALGALPDLRSLRINNNRLRTLAPGTFDALSALSHLQLYHNPFHCGCGLVWLQAWAASTRVSLPEPDSIACASPPALQGVPVYRLPALPCAPPSVHLSAEPPLEAPGTPLRAGLAFVLHCIADGHPTPRLQWQLQIPGGTVVLEPPVLSGEDDGVGAEEGEGEGDGDLLTQTQAQTPTPAPAWPAPPATPRFLALANGSLLVPLLSAKEAGVYTCRAHNELGANSTSIRVAVAATGPPKHAPGAGGEPDGQAPTSERKSTAKGRGNSVLPSKPEGKIKGQGLAKVSILGETETEPEEDTSEGEEAEDQILADPAEEQRCGNGDPSRYVSNHAFNQSAELKPHVFELGVIALDVAEREARVQLTPLAARWGPGPGGAGGAPRPGRRPLRLLYLCPAGGGAAVQWSRVEEGVNAYWFRGLRPGTNYSVCLALAGEACHVQVVFSTKKELPSLLVIVAVSVFLLVLATVPLLGAACCHLLAKHPGKPYRLILRPQAPDPMEKRIAADFDPRASYLESEKSYPAGGEAGGEEPEDVQGEGLDEDAEQGDPSGDLQREESLAACSLVESQSKANQEEFEAGSEYSDRLPLGAEATVGDIYVPPFPSRLSAKSTPQPAPPWALEPEETSEDFGNLARRRTARPLAAEPVDLVAGQFRCPCVGLSGAGKRRRRRKLTVASRAAALWRARALVRTKPARDCATNWGPSSRPSRILSATRAGGEEVKALPLFVQGHVS

SEQ ID NO: 916730 - protein, 836 aa, Homo sapiens; identical to SEQ ID NO: 916729

SEQ ID NO: 916731 - protein, 207 aa, Homo sapiens
MRELTGDKDRLSTRQHHHQCFLKGFIMATTAPQAHPDILQCLVTEPEVQPGRSLSAPFAHCREVPFWPSIPICARPPDLPCTEPLTFPSCDPLDLSHPILATFILLSSVPPSPPGSKESRVYMSDQHPALVFFQKAACMLDVFQLEKTTALNTTTTRDLTTERGTALDMKNSDNHHPQLRKESGREKTRAPPGGSNVALPEIGRNKA

SEQ ID NO: 916732 - protein, 146 aa, Homo sapiens
MKEKLKRGIFFKLRKISGHSQTASAMHPWMPATGCGTKGPSIFLQLCVSGGLWMISVLKSVFASFSKKSSPSQAVSLGRSTHLSQIQPRPVNTYWTSAQPSMGLMHRWALGSLPMFYLNTVTWPPRQLQDGLEREDFLCAQEEEVV

SEQ ID NO: 916733 - protein, 221 aa, Homo sapiens
MENYTGSFRVRPGSDSHRFLCPPSNCPELSHMTAPNCKGGWKKVFYVGVSNIRTFQAPCPSIIPECKTHSEAWGRDSNSAFPLPPQSEPICGMPCPFSIPSLQVGLGSWDEFFRPYKCKLCRGASNKKNQSLAGPLRAGFWRGRPVLSLALGHSGRKEEGWLAAGGRACEGLALGLVLLLLEVAGCAMASWLLLLEPCDHSSRLHPHFSPPVPCMTSENMT

SEQ ID NO: 916734 - protein, 221 aa, Homo sapiens; identical to SEQ ID NO: 916733

SEQ ID NO: 916735 - protein, 432 aa, Homo sapiens
MIIIINKITLHSGELWGDDLTSAPLPRTGERGKAGVNPAEPGPPSPGGWRRCGQEALGGWSPFPCKQGARVSLLSRLPTDPRPRQGPAVRMIMPTGWVGCWQSGAAGQVLEATPRGWAGVCRRGRARNGERMECVIVSERGMGTESLPTQMPKLTYPLGNCMAGRLILFSWSLILGLRSIWVQPAALGSSSVCHLNHEDLVASAAIEICTGNINSQDTCRQGHPGIPGNPGHNGLPGRDGRDGAKGDKGDAGEPGCPGSPGKDGTSGEKGERGADGKVEAKGIKGDQGSRGSPGKHGPKGLAGPMGEKGLRGETGPQGQKGNKGDVGPTGPEGPRGNIGPLGPTGLPGPMGPIGKPGPKGEAGPTGPQGEPGVRGIRGWKGDRGEKGKIGETLVLPKSAFTVGLTVLSKFPSSDVPIKFDKILYNEFNHYDT

SEQ ID NO: 916736 - protein, 92 aa, Homo sapiens
NGETEMSPEESWEHKEEISEAEPGGGSLGDGRPPEESAHEMMEEEEEIPKPKSAYSYLFEEVEFTALICLVDKNQGKKLDPPVLSTGQVACS

SEQ ID NO: 916737 - protein, 336 aa, Homo sapiens
NGETEMSPEESWEHKEEISEAEPGGGSLGDGRPPEESAHEMMEEEEEIPKPKSVVAPPGAPKKEHVNVVFIGHVESTMKPKKVDMGQELAGALVCRKVSLFVFKTDFADGCPLKVLAVSTLLPHYPAGLVPFSGSGEGPEGSTGQTSWLWRWEENEVLKVQLKKYVGAVQMLKREGQTAEGGLVALEVTALKLYIVAPLSGGLVALEVTALKLYSVAPLSGGLVVLEVTFLKLRSVAPLSGGLVVLEVTALKLRSVALLSGGLVALEVTTLKLYSVALMSDGLVALEVTSLKLCSVALLSGGLVALEVTSLKLCSVASLSVGLVALEAPVDAMMQT

SEQ ID NO: 916738 - protein, 328 aa, Homo sapiens
LRLEKGRGTRGTRPGGRGGLGSRRQQDRLGIYSYWQDTSSQKIEDLMEMVQKLQKVGSLEPRVEVLINRINEVQQAKKKANKDLGEARTICEALQKELDSLHGEKVHLKEILSKKQETLRILRLHCQEKESEAHRKHTMLQECKERISALNLQIEEEKNKQRQLRLAFEEQLEDLMGQHKDLWDFHMPERLAKEICALDSSKEQLLKEEKLVKATLEDVKHQLCSLCGAEGPSTLDEGLFLRSQEAAATVQLFQEEHRKAEELLAAAAQRHQQLQQKCQQQQQKRQRLKEELEKHGMQVPAQAQSTQEEEAGPGDVAPRPGRPVTWWS

SEQ ID NO: 916739 - protein, 190 aa, Homo sapiens
MLQECKERISALNLQIEEEKNKQRQLRLAFEEQLEDLMGQHKDLWDFHMPERLAKEICALDSSKEQLLKEEKLVKATLEDVKHQLCSLCGAEGPSTLDEGLFLRSQEAAATVQLFQEEHRKAEELLAAAAQRHQQLQQKCQQQQQKRQRLKEELEKHGMQVPAQAQSTQEEEAGPGDVAPRPGRPVTWWS

SEQ ID NO: 916740 - protein, 190 aa, Homo sapiens; identical to SEQ ID NO: 916739

SEQ ID NO: 916741 - protein, 227 aa, Homo sapiens
MLQECKERISALNLQIEEEKNKQRQLRLAFEEQLEDLMGQHKDLWDFHMPERLAKEICALDSSKEQLLKEEKLVKATLEDVKHQLCSLCGAEGPSTLDEGLFLRSQEAAATVQLFQEEHRKAEELLAAAAQRHQQLQQKCQQQQQKRQRLKEELEKHGMQVPAQAQSTQEEEAGPGDVVSPRSGRQGTETATEGTAEGAGGQGRGSWDSSEDGLWGGPFPYWVHPRW

SEQ ID NO: 916742 - protein, 328 aa, Homo sapiens; identical to SEQ ID NO: 916738

SEQ ID NO: 916743 - protein, 351 aa, Homo sapiens
MAGRSLTSKAEPTAGAVDRAEKAGGQDTSSQKIEDLMEMVQKLQKVGSLEPRVEVLINRINEVQQAKKKANKDLGEARTICEALQKELDSLHGEKVHLKEILSKKQETLRILRLHCQEKESEAHRKHTMLQECKERISALNLQIEEEKNKQRQLRLAFEEQLEDLMGQHKDLWDFHMPERLAKEICALDSSKEQLLKEEKLVKATLEDVKHQLCSLCGAEGPSTLDEGLFLRSQEAAATVQLFQEEHRKAEELLAAAAQRHQQLQQKCQQQQQKRQRLKEELEKHGMQVPAQAQSTQEEEAGPGDVASPKPLKGERPGAAHQAGPDVLIGQEDTLHPDLSPRGFQEIKELF

SEQ ID NO: 916744 - protein, 318 aa, Homo sapiens
MAGRSLTSKAEPTAGAVDRAEKAGGQDTSSQKIEDLMEMVQKLQKVGSLEPRVEVLINRINEVQQAKKKANKDLGEARTICEALQKELDSLHGEKVHLKEILSKKQETLRILRLHCQEKESEAHRKHTMLQECKERISALNLQIEEEKNKQRQLRLAFEEQLEDLMGQHKDLWDFHMPERLAKEICALDSSKEQLLKEEKLVKATLEDVKHQLCSLCGAEGPSTLDEGLFLRSQEAAATVQLFQEEHRKAEELLAAAAQRHQQLQQKCQQQQQKRQRLKEELEKHGMQVPAQAQSTQEEEAGPGDVAPRPGRPVTWWS

SEQ ID NO: 916745 - protein, 553 aa, Homo sapiens
MALNNFLFAQCACYFLAFLFSFVVVVPLSENGHDFRGRCLLFTEGMWLSANLTVQERERFTVQEWGPPAACRFSLLASLLSLLLAAAHAWRTLFFLCKGHEGSFFSAFLNLLVSAFVVFLVFIASTIVSVGFTMWCDTITEKGTVPHSCEELQDIDLELGVDNSAFYDQFAIAQFGLWASWLAWLAITTLAFLKVYHNYRQEDLLDSLIHEKELLLARPSPRTSFQEEKSAVISGTVQAGGAGPDLPAALGGTGLPGEAAGALCLGPGHMQPCVCPLDATCSEVSAPVPTCEPGSGLGGCRLPDEDGAERLWVWGGGGGHLQASHRAPWLSQYDLTGQPMWRASSLSPPTLAGCCLHASWPRGGQMSLSPERILHEFCHPGRGCVWGGAHGTFQPLAPGWPPPQLSPPPGIWGRNLPILLPGVGWDGLGLGRDAGGSPGEPPPWSLLGHFWKQPLLLPPPATLGSLDSKAGSDPGDHFTCSLAPGVAGTHPDCRAKGAGRASLKTQGLGQPLPEWTHPLPGLQEMGRFQAPRTSALATEADSLANRFWFLSFL

SEQ ID NO: 916746 - protein, 156 aa, Homo sapiens
MKNNAIDILAPLGERRGLSSGSQTQQWYAENPTCTFPLKLGASYPWGIHGYILFDIRILICLTTPTRSKVWVGEVGVTMWCNTITDKGTEPHSCEELQDIDLELGVDNSAFYDQFAIAQVQFRTPGWPLKALAGRGWPEDASPGQEPSKGAGRGWA

SEQ ID NO: 916747 - protein, 253 aa, Homo sapiens
MRTRPGRGARDLPAPPLRSLPRPPRPAQPPAAFPPPLSPGPAMALNNFLFAQCACYFLAFLFSFVVVVPLSENGHDFRGRCLLFTEGMWLSANLTVQERERFTVQEWGPPAACRFSLLASLLSLLLAAAHAWRTLFFLCKGHEGSFFSAFLNLLVSAFVVFLVFIASTIVSVGFTMWCDTITEKGTVPHSCEELQDIDLELGVDNSAFYDQFAIAQVQFRTPGWPLKALAGRGWPEDASPGQEPSKGAGRGWA

SEQ ID NO: 916748 - protein, 172 aa, Homo sapiens
MHFWGLGWSYCLCKGYKSGLANALAHGGCQDGEQAVLGSEEDVPKRRCFVFPQDAKFVEERRKQLQNYLRSVMNKVIQMVPEFAASPKKETLIQLMPFFVRRCPIRKSVSPTPCGVHSPGISGPVFPKHSHGRDPRGDVRYRSWREARTPRIRSVRLDRKSVTASVICRAVI

SEQ ID NO: 916749 - protein, 310 aa, Homo sapiens
EVEEAGAARRRGRPAELCFYSGRVLGHPGSLVSLSACGAAGGLVGLIQLGQEQVLIQPLNNSQGPFSGREHLIRRKWSLTPSPSAEAQRPEQLCKVLTERLIRLIQAFPGNMLFLAEHGSHRFRALLVTLCYDSLGHGLRVALPALVEFCSVYIKHSVSVCFWWKMKGSQRVTWGEKGAREKGTRESEEALSPSGFWVTAEKHTSHLQDTVLCSALGCFSLGSRPPPAPSAILPSLGVPYALHYGKVFTESFHMHFCQMPQGSSTSAHVISPSVLILRPSEAQDDLLVCVAQAWGFVLGTLPMSRWYPEL

SEQ ID NO: 916750 - protein, 203 aa, Homo sapiens
EVEEAGAARRRGRPAELCFYSGRVLGHPGSLVSLSACGAAGGLVGLIQLGQEQVLIQPLNNSQGPFSGREHLIRRKWSLTPSPSAEAQRPEQLCKVLTEKKKPTWGRPSRDWRERRNAIRLTSEHTVETLVVADADMVQYHGAEAAQRFILTVMNMVYNMFQHQSLGIKMNIQVTKLVLLQQRAAKLSIGHHSELSLKSLCHW

SEQ ID NO: 916751 - protein, 130 aa, Homo sapiens
EVEEAGAARRRGRPAELCFYSGRVLGHPGSLVSLSACGAAGGLVGLIQLGQEQVLIQPLNNSQGPFSGREHLIRRKWSLTPSPSAEAQRPEQLCKVLTVPQCLGLTWEDLKSGGWSDLEVPHSCVWPGGG

SEQ ID NO: 916752 - protein, 169 aa, Homo sapiens
CFYSGRVLGHPGSLVSLSACGAAGGLVLPAPPPGRPVRSVATQSGRRGGWGWGASAGSPASRGTGGNPLPFHLSPSPTPAFGTLYRQRGWEGQHPSPAPLQPVEPARSWGCVGYTPPALGSADLAGMKLSGPWTEAPWPQCREHCICTAVSKCMSREYLCTCRCYVLGL

SEQ ID NO: 916753 - protein, 145 aa, Homo sapiens
MAERRQKEIISPVSLLCTEGHVPQGSRLSSCSLHPCSRRPRCPPARPTHHSRVRAASTHTFLRDVFNSLEVGEGGIPYIELVSKAMLELKPLESSDLTKVVVYGYYLYKLQTKWMLQSVAEWHRQRQEPLDEANQLPANAMKARM

SEQ ID NO: 916754 - protein, 148 aa, Homo sapiens
RRGTTVRMRSLESLGTTVRMRSLESPGTTVRMRSLESPGTTVRMWSLESLGTTVRMWSLESLESPGTTVRMWSLESPGTTVAEMHGELIEFNERLHRALVAKEALVSQMRQELIDLRGPVIYICFLLLYHFNQILEVFNPSALLMVSL

SEQ ID NO: 916755 - protein, 148 aa, Homo sapiens; identical to SEQ ID NO: 916754

SEQ ID NO: 916756 - protein, 148 aa, Homo sapiens; identical to SEQ ID NO: 916754

SEQ ID NO: 916757 - protein, 164 aa, Homo sapiens
MERLGAVNLFMRLPPYSSLPSRRALEERSRQVRLSLQTKPCAEVEGSSRIPIPNPSPPRCHTGSRVESARREKQERERCHLCSGIKRQSTVKTLDVSILLLQKFHQILSGSRMGMSLCGMQAMPPLTDCPGYEVETMKITILHSVSPAFSVKMFQQRHVVKLNL

SEQ ID NO: 916758 - protein, 157 aa, Homo sapiens
QQVPAEDLVRAGPRVMAVDMTDALGPAAQLGEAGFPCWGACSPFMNPLQALVEKPISNSQFQKRLLQHRPPAASPRVTQGQELLRRAEGLEGALACKPFAGGDLWREPLGAVWFPSGLERPGVELGCCLLGQSDFQQGSLPEVTHSFERLDFKAPGG

SEQ ID NO: 916759 - protein, 191 aa, Homo sapiens
RDLERKNMNSSIHSAAILNASCVPDAVLEAQNIYERDRQCPHMPRPSYASLDSRKTVGWVNDYEGNDSEAEDLNFREALPSSSQENTPRSKVFENKVNSEKVKLSLRNFPHNDYEDVFEEPSESGSDPSMWTARGPFGRDRWSSEDEEAAGPSQALSPLLSVFHSPVEGHCVVSRFWQLWIKVLQIFTNFV

SEQ ID NO: 916760 - protein, 141 aa, Homo sapiens
KPMHEFTMIINIVKLPWVRKQDRHSVYYYRNKRTMTVIFNLRNPPGRTTACLPGRHSCSQGLPEPRYSLLGNMPMSGSLAWEWGFVLEQEKMLVILVLIYVSKFPLPQRIQGPLPSLERVLKSQDFLIIVGIVNRTPEIKR

SEQ ID NO: 916761 - protein, 313 aa, Homo sapiens
MQKPPLLLRRPLPPKFTKLSLHEKKTHTAKTGKIESLHVAFTEDETTSIKMDRTRFPDVLRNQSLTPINIQNIFLDHCVQERVTAISSPQKSTKHVREQIPDTATGSIFFPHCNSASTRIFGKQTNKMESSRKFKTMKDVYTEKRLENILILSSKFSKPKSTPGSVIAQKLEKMHPKHQPLPESPGYTYQHISRDLSATVPSPPPMTVSMKPEGQWPEHFKSTATLTLRVTEFPGFVSLPTPVLPRKPHRQSVIEVLTLQICQGQTGYSIQMVIMGTNKGIQRIGKANIKKQNSCNRKWKYRKCPKANPTKTT

SEQ ID NO: 916762 - protein, 140 aa, Homo sapiens
LGLLEGGDPWCFFGNSLLQEDPRWTFTSLPRFRGKGDRRRKASWFGKRPIILKGSVGVQHFHAPLWVLRKGDFQHRVEHMTREYTLSACVQLSFGGKRPICAVSGCSLLGYQWNNAVPGTFDVALQTKSTFWGCIFSHYF

SEQ ID NO: 916763 - protein, 105 aa, Homo sapiens
TPVARVCLLGLLEGGDPWCFFGNSLLQEDPRWTFTSLPRFRGKGDRRRKASWFGKRPIILKGSVGVQHFHAPLWVLRKGDFQHRVEHMTREYTLSACVQLSFGGL

SEQ ID NO: 916764 - protein, 147 aa, Homo sapiens
MRSCIVPAEHLPSAAHLIIPATPPEFSEAQKSSQLPNVTQLVTVRAENAGQHVSSVKYLVPAQCPGHSDGWLQLPESPGQSTKHMHKSTIQSQAGQAFSTASAPHSLLPATPSYLQSLCPAFSAGPPFQRHPLFMHKWLGEGVGHRR

SEQ ID NO: 916765 - protein, 179 aa, Homo sapiens
MIHFNRSMHFSSTQYSCARLPQQHPLLVFLLLHQGSSRFSLLRLPQDLEEGGVGKKALALVWSLGVCWVLSSELAQVPFWDILMGLLLMSAVGKVDTETGQEIELKDPLSGLVPWQVEAICTLKLHGSREILSKGLWILSTFLPFSYSSSGATVHDVSLHTLLCLSAWQLESNPASCLP

SEQ ID NO: 916766 - protein, 176 aa, Homo sapiens
MGICLTDKAHNSTNVAFRRLCEILECCVHNTEKLYRSQTGEVRPGGHYAKPYNRCPPIEDSSYLLYPNIAGEKTAAAIDSPMETKSYYKPRNRCMAAKQDHKGKCQAVRRNKGGARQIKHPTYKDTISHMFHKTTTNPPVPKQLNLQFQACKAKRRPYPCLPWADSLFGLSPPAPR

SEQ ID NO: 916767 - protein, 176 aa, Homo sapiens; identical to SEQ ID NO: 916766

SEQ ID NO: 916768 - protein, 176 aa, Homo sapiens; identical to SEQ ID NO: 916766

SEQ ID NO: 916769 - protein, 176 aa, Homo sapiens; identical to SEQ ID NO: 916766

SEQ ID NO: 916770 - protein, 583 aa, Homo sapiens [sequence omitted]

SEQ ID NO: 916771 - protein, 196 aa, Homo sapiens [sequence omitted]

SEQ ID NO: 916772 - protein, 334 aa, Homo sapiens
MASASQGADDDGSRRKPRLAASLQISPQPRPWRPLPAQAQSAWEPAPAPATYRAEGGWPQVSVLRDSGPGAGAGVGELGAARAWENLGEQMGKAPRVPVPPAGLSLPLKDPPASQAVSLLTEYAASLGIFLLFREDQPPGPCFPFSVSAELDGVVCPAGTANSKTEAKQQAALSALCYIRSQLENPENILTHEQRCAALVSAGFDLLLDERSPYWACKGTVAGVILEREIPRARGHVKEIYKLVALGTGSSCCAGWLEFSGQQLHDCHGLVIARRALLRFLFRQLLLATQGGPKGKEQSVLAPQPGPGPPFTLKPRVFLHLYISNTPKGAARDI

SEQ ID NO: 916773 - protein, 165 aa, Homo sapiens
HRDSNHQLQLLDTKFKGTVEELSNQILSARSWLQQEQERIEKELLQKIDQLSLIVKENSGASERDMEKKLSQMSARLDKIEEGQKKTFDGQRTRQEEEKMHGRITKLELQMNQNIKEMKAEVNAGFTAVYESIGSLRQVLEAKMKLDRDQLQKQIQLMQKPETPM

SEQ ID NO: 916774 - protein, 193 aa, Homo sapiens
DHALCRDMDGSGSHYPQQSNTGTENQTPHVLTYKWELNNENIFKGTVEELSNQILSARSWLQQEQERIEKELLQKIDQLSLIVKENSGASERDMEKKLSQMSARLDKIEEGQKKTFDGQRTRQEEEKMHGRITKLELQMNQNIKEMKAEVNAGFTAVYESIGSLRQVLEAKMKLDRDQLQKQIQLMQKPETPM

SEQ ID NO: 916775 - protein, 109 aa, Homo sapiens
MDFSESEKFMVLLWKNFILKRRRCIALVVEMVLTFLFSAALLATRSVITINKNGPFDFAAQPVDEVPFYITASLISPSPLELAYVPSRSTVVQGIIERVKMDLNPQMKG

SEQ ID NO: 916776 - protein, 221 aa, Homo sapiens
QYEVHRSLCGIGSLRQELEQETDEIGRIQGGMAVDQGGMAIDSIIVQQQCRGLSSHKEDGPSCVNSCSVAILYVICGAVEKPLPVATTTTNPQQVLPGHHQCSLKAEKLFGHLKRSGLEMLSKSLGLDLGTLRTHLLLYPTVAKLVPKGNTEFDVKSHSHCVFPSPGAQTPRNARPLPGNAGGVMLAIEDCLSYPLQCLFQQYEVKTRLVLGLKFQILLPL

SEQ ID NO: 916777 - protein, 199 aa, Homo sapiens
SVRCSSCFYHSTSYMDCNISLLLQLLIKLGAPQSQGWCLISFLLPGAQSSLWHELFEHWLSLTGLCRAEYSKRQGEGGVRNFFYQGWKKHGLLYSSPELDGEDGEGDMYHPCGAPSPTSEDEEYLTINSTCQGQLPCEECLEADSGTIPLPQFCSWGTVPESLPPEESPESGSEWEDLEEPVALEYGALRSLSFGGLNV

SEQ ID NO: 916778 - protein, 323 aa, Homo sapiens
QLPSRRAPGTWPWLAMTGTGQGTQNRQRLRRPRGHRLLQTCPHSVEVQNLAAIQLHVPGQGNSEEAGVAKPAGTRAESMGGDCHEAAVSIYCSMRKRSLSHWALVSVLSLLACCLIYSLTGVYGFLTFGTEVSADVLMSYPGNDMVIIVARVLFAVSIVTVYPIVLFLGSQDWNANHVLHPLPHGLPDGGRTPEDAHVSVLAVASRSVMQDFWRRSCLGGWGPSALADPSGLWVRMPLTILWVTVTLAMALFMPDLSEIVSIIGGISSFFIFIFPGLCLICAMGVEPIGPRVKCCLEVWGVVSVLVGTFIFGQSTAAAVWEMF

SEQ ID NO: 916779 - protein, 239 aa, Homo sapiens
MHVFIVGMSLSSVTLASALQVRGEALSEEEIWSLLFLAAEQLLEDLRNDSSDYVVCPWSALLSAAGSLSFQGRVSHIEAAPFKAPELLQGQSEDEQPDASQPLQLCEPLHSILLTMCEDQPHRRCTLQSVLEACRVHEKEVSVYPAPAGLHIRRLVGLVLGTISEVEKRVVEESSSVQQNRSYLLRKRLRGTSSESPAAQAPECLHPCRVSERSTETQSSPEPHWSTLTHSHCSLLVNR

SEQ ID NO: 916780 - protein, 207 aa, Homo sapiens
MHVFIVGMSLSSVTLASALQVRGEALSEEEIWSLLFLAAEQLLEDLRNDSSDYVVCPWSALLSAAGSLSFQGRVSHIEAAPFKAPELLQGQSEDEQPDASQMHVYSLGMTLYWSAGFHVPPHQPLQLCEPLHSILLTMCEDQPHRRCTLQSVLEACRVHEKEVSVYPAPAGLHIRRLVGLVLGTISEVSREPCFSSSSCWSCVAIKI

SEQ ID NO: 916781 - protein, 328 aa, Homo sapiens
MHVFIVGMSLSSVTLASALQVRGEALSEEEIWSLLFLAAEQLLEDLRNDSSDYVVCPWSALLSAAGSLSFQGRVSHIEAAPFKAPELLQGQSEDEQPDASQPLQLCEPLHSILLTMCEDQPHRRCTLQSVLEACRVHEKEVSVYPAPAGLHIRRLVGLVLGTISEVEKRVVEESSSVQQNRSYLLRKRLRGTSSESPAAQAPECLHPCRVSERSTETQSSPEPHWSTLTHSHCSLLVNRALPGADPQDQQAGRRLSSGSVHSAADSSWPTTPSQRGFLQRRSKVSKIRLKDTPQGGLSRELWVAGTVAENGQGLLGDNFPGLRFIGLD

SEQ ID NO: 916782 - protein, 392 aa, Homo sapiens
MGRNWGQHEFRVGVGSAVEGAPGPPALLAHLCHAQILAGPQPPPCGAGLGTCSPPCPNPPCSTEPGPIDYTMAKECGHAAWDGRATPHVALERDPLGEASWAPESASLLKPARPRTHQKEETPNKSEHQKEQTLDPPPLRTVILTTRVRGFILEVSETKNPPIPDTIGSKIPLGGCILPGLHVLRGTGLISLYQYATIDVSILRLRGIGFVSGWVLSRCLEGVWDAVCLLGTNTCEKKGEEAGLGRRRRIHTEGNFQVGGPALQLFLPQLPGLPCCPGYEASGAPRSPLPWGTASKAYGKEEEKEGEGEEQGRGRGFAAAWRSASAGTEAPQGRRPGARRLCLFEFQKSQPGQGGGETRSLRGAGSGTLALQDPQHFPTWKTSSFPIAEKIR

SEQ ID NO: 916783 - protein, 126 aa, Homo sapiens
KRAFLLEGRVLGELTLFSPALSPNLNPFLSKHSSLSTPLWHSKSHGNGKEVAGSKQPAYSQQLKILFRRFWFQGQELKINAWSLPHSESSSLAPGGSSSSLHICFFLMKLLLVGNLSNFIRLLQCL

SEQ ID NO: 916784 - protein, 212 aa, Homo sapiens
KTFREREEQLSGADGNPLQSLCKTGVRCMTESQRSPSASFQKAATTELSCGKGATRCSHEPDLGSQWLLQEVVSGCKKSQAGSLPGDSSRDILQNIRLVLPKLTVQVTESKESLINCHGHEESKDTSNFHSHPKWNPRQKEDLSLHICFFLMKLLLVGNLSNFIRWLELSVSPFLSVMAGKSSWAMSCIFINMNRLAGIPKWDKCYLIADSF

SEQ ID NO: 916785 - protein, 188 aa, Homo sapiens
KTFREREEQLSGADGNPLQSLCKTGVRCMTESQRSPSASFQKAATTELSCGKGATRCSHEPDLGSQWLLQEVVSGCKKSQAGSLPGDSSRDILQNIRLVLPKLTVQVTESKESLINCHGHEESKDTSNFHSHPKWNPRQKEDLSLHICFFLMKLLLVGNLSNFIRNTEISHDFLMGFSCLRCSAFSCI

SEQ ID NO: 916786 - protein, 182 aa, Homo sapiens
KTFREREEQLSGADGNPLQSLCKTGVRCMTESQRSPSASFQKAATTELSCGKGATRCSHEPDLGSQWLLQEVVSGCKKSQAGSLPGDSSRDILQNIRLVLPKLTVQVTESKESLINCHGHEESKDTSNFHSHPKWNPRQKEDLSLHICFFLMKLLLVGNLSNFISFMKTQPQQTYRLAQGLL

SEQ ID NO: 916787 - protein, 174 aa, Homo sapiens
MNDWAANLVCLFVLSKHLNTWELNKMRIWKRYERENESEKITTGASEIQKIIRNPHEKFYANKQDNLKETDKFLEKYKPPRLGLCEVINWPNFNTVVFQGIERPEERVRDGKMGGDTPKVPSSYIIRLKFQDLLVMGSYLQVWLLGSDHLQSKRRFFFSANGDRFGTKKRREET

SEQ ID NO: 916788 - protein, 126 aa, Homo sapiens
MENGQQQFWTEQQVESQGAMRKQDACGNCWRRMVDSVVPVPGTFSVKDPPDKETSSSPPNRNVMTVLEGYFQDDTKPGFWSALKMENGLLTLVTLADVFHNINQLNKPLHSPGENVFTKNVKSFWI

SEQ ID NO: 916789 - protein, 126 aa, Homo sapiens; identical to SEQ ID NO: 916788

SEQ ID NO: 916790 - protein, 157 aa, Homo sapiens
DTQEIRPIFMLGLHVASRRVIQSGISPQYKATCFPTGWSRHWGHRVLFLLYSLHLAIAPNKSNSSKHHSALPSECLLLRVSSVYPSLSLAHLSVPKRQSTRIPPTPPVPSKLWVPFLLGQRVAPAAVIPLPKARVLNGHPLRVVVTALSCPSASPRG

SEQ ID NO: 916791 - protein, 131 aa, Homo sapiens
ALSFYRHNTSNFLNIGGRVAVREFNFPKSAFCKGRMWDRHHGEFAAGGRDPSYPKLPAAYLYGVGFPHAQCFPHPWELSTRSVFRKLCACPSEAFFIVSGGVYPEDHTLPLLSLNVHAQEVSSPWECTVDP

SEQ ID NO: 916792 - protein, 162 aa, Homo sapiens
MWEPQLSATSFMPQGSLQVDPPTRYWRLMNAWEKPDVDTWSVSQTEKLTLRELSVAQGHHAGKWHSQDLNSAVVDSVRQSAAAFMVSPLPLGQREQEAAPSPSLVSSPPAAVLQMPSHLLAWLTPSHLKPQLKCTLQNPSLGESLRQGAAPSHPISLTRLSL

SEQ ID NO: 916793 - protein, 148 aa, Homo sapiens
MPATYLYWRFQTDASLGPTGLLTYEFIWEKNVLGRGNIQCKYPGVEMCLSWSKNSKEASVALAGWGVMIDDGDDDDDDDDDDDDGDGKDEKEEKIIKMATITIVLSHSAEHSQCIRHSIQGASPFIIPANPCSNLYESPVLGIHAFNR

SEQ ID NO: 916794 - protein, 151 aa, Homo sapiens
MATVQKAPRPSMLARSVRPLWGYCRTSPSYYPFKYRRFGLAAAGPIRSASVPHFPASAWLRPPPGGASEIPASLRAERPGPSNVPILEKATPVASSAGRPEAASDEETALAAIASLCKQYRVYLPKPKQHSLLHTQAVGCASRLQTCTVWY

SEQ ID NO: 916795 - protein, 137 aa, Homo sapiens
MKSTSPPHTPTPTLGHKTLLAGQEKSQGGEISWWTRDPITQADGNFGNLRRRAHGGRGVAGRSKEEESEDPGVWTLRITCLAKLLKLHKETKKAKPTKINRKPLPTGQGADISVWPGQVKPLGFNSELTQAGLKFLC

SEQ ID NO: 916796 - protein, 160 aa, Homo sapiens [sequence omitted]

SEQ ID NO: 916797 - protein, 160 aa, Homo sapiens [sequence omitted]

SEQ ID NO: 916798 - protein, 160 aa, Homo sapiens [sequence omitted]

SEQ ID NO: 916799 - protein, 160 aa, Homo sapiens [sequence omitted]

SEQ ID NO: 916800 - protein, 160 aa, Homo sapiens [sequence omitted]

SEQ ID NO: 916801 - protein, 160 aa, Homo sapiens [sequence omitted]

SEQ ID NO: 916802 - protein, 160 aa, Homo sapiens [sequence omitted]

SEQ ID NO: 916803 - protein, 160 aa, Homo sapiens [sequence omitted]

SEQ ID NO: 916804 - protein, 237 aa, Homo sapiens [sequence omitted]

SEQ ID NO: 916805 - protein, 237 aa, Homo sapiens [sequence omitted]

SEQ ID NO: 916806 - protein, 112 aa, Homo sapiens
DDGVLLIALEGPFPGCLTRCKCQLVLAGCLSFARGENILTDFLCSQRRSSSLERSRLRLAFPSGSAVGSPQALVRRAPRPRLFPFGRNRHLPVIRQNDEHKGKEERHPIYVL

SEQ ID NO: 916807 - protein, 237 aa, Homo sapiens [sequence omitted]

SEQ ID NO: 916808 - protein, 237 aa, Homo sapiens [sequence omitted]

SEQ ID NO: 916809 - protein, 160 aa, Homo sapiens [sequence omitted]

SEQ ID NO: 916810 - protein, 112 aa, Homo sapiens; identical to SEQ ID NO: 916806

SEQ ID NO: 916811 - protein, 160 aa, Homo sapiens [sequence omitted]

SEQ ID NO: 916812 - protein, 160 aa, Homo sapiens [sequence omitted]

SEQ ID NO: 916813 - protein, 160 aa, Homo sapiens [sequence omitted]

SEQ ID NO: 916814 - protein, 141 aa, Homo sapiens
MTNTKGKRRGTRYMFSRPFRKHGVVPLATYMRIYKKGDIVDIKGMGTVQKGMPHKCYHGKTGRVYNVTQHAVGIVVNKQVKGKILAKRINVRIEHIKHSKSRDSFLKRVKENDQKKKEAKEKGTWVQLKRQVRIWCIFHWF

SEQ ID NO: 916815 - protein, 112 aa, Homo sapiens; identical to SEQ ID NO: 916806

SEQ ID NO: 916816 - protein, 160 aa, Homo sapiens [sequence omitted]

SEQ ID NO: 916817 - protein, 143 aa, Homo sapiens
MGEGAHHHPSVTSRVMIASCPGSWRFEQRIGQNSKQRKNEATKEQKQGFIENKSTLHSVGAALAALPPDPRCFTESSWVQIPPRTFPLAIPCSPHVNEEVACNWSDWLPDPPPHQTDPPKEAQFAPREFDQPGKIVSYHWRGE

SEQ ID NO: 916818 - protein, 425 aa, Homo sapiens
SGESPKSSLEDQAMQPEGLKCRMEESNAERGTAEPFPRLHNLYSTPRCAQQAALPRLSRRMASQHSYPLNRFSSVPLDPMERPMSQADLELDYNPPRVQLSDEMFVFQDGRWVNENCRLQSPYFSPSASFHHKLHHKRLAKECMLQEENKSLREENKALREENRMLSKENKILQVFWEEHKASLGREESRAPSPLLHKDSASLEVVKKDHVALQVPRGKEDSTLQLLREENRALQQLLEQKQAYWAQAEDTAAPAEESKPAPSPHEEPCSPGLLQDQGSGLSSRFEEPKGPPARQEDSKELRALRKMVSNMSGPSGEEEAKVGPGLPDGCQPLQLLREMRQALQALLKENRLLQEENRTLQVLRAEHRGFQEENKALWENNKLKLQQKLVIDTVTEVTARMEMLIEELYAFMPARSQDPKKPSRV

SEQ ID NO: 916819 - protein, 143 aa, Homo sapiens
MKDFTSVFVCLFVFEMESCSVAQVAVQWCDLSSLQSPLPRFKGFSCLSFPSHLAQLIFVFLVETGFHHVGQTGFKLLTSGDPPSSASQSAGITGAKLKICKRQLYAKLDKRKPQSGKVNLREKPFILWVMLSAHLSGDLKTRL

SEQ ID NO: 916820 - protein, 295 aa, Homo sapiens
MYHPRELYPSLGAGYRLGPAQPGADSSFPPALAEGYRYPELDTPKLDCFLSGMEAAPRTLAAHPPLPLLPPAMGTEPAPSAPEALHSLPGVSLSLENRELWKEFSSVGTEMIITKAGRRMFPACRVSVTGLDPEARYLFLLDVIPVDGARYRWQGRRWEPSGKAEPRLPDRVYIHPDSPATGAHWMRQPVSFHRVKLTNSTLDPHGHLILHSMHKYQPRIHLVRAAQLCSQHWGGMASFRFPETTFISVTAYQNPQITQLKIAANPFAKGFRENGRNCKRWELFIHLFMHSTNVY

SEQ ID NO: 916821 - protein, 45 aa, Homo sapiens
MYHPRELYPSLGAGYRLGPAQPGADSSFPPALAEGYRYPGERWDQ

SEQ ID NO: 916822 - protein, 338 aa, Homo sapiens
MMDKFRMIFQFLQSNQESFMNGICGIMALASAQMYSAFDFNCPCLPGYNAAYSAGILLAPPLVLFLLGLVMNNNVSMLAEEWKRPLGRRAKDPAVLRYMFCSMAQRALIAPVVWVAVTLLDGKCFLCAFCTAVPVSALGNGSLAPGLPAPELARLLARVPCPEIYDGDWLLAREVAVRYLRCISQALGWSFVLLTTLLAFVVRSVRPCFTQAAFLKSKYWSHYIDIERKLFDETCTEHAKAFAKVCIQQFFEAMNHDLELGHTHGTLATAPASAAAPTTPDGAEEEREKLRGITDQGTMNRLLTSWHKCKPPLRLGQEEPPLMGNGWAGGGPRPPRVS

SEQ ID NO: 916823 - protein, 818 aa, Homo sapiens
MLTVRGMVQPELGAEWEWAWCGVGEVGLWCPAGSPLEHLEPKKLSLTFAIPGTRPLIMMKVDPNPLRGLKEQRQAMLAPGPPFPVTQPPPPEVQRNLVPAAVNPYVMIFLPALFRVLVLAAVFGQLKEYQQRKSPGIPAGAKTKKKKTDSSPETTTSGGGHSPGDIQDILKVRVSNLNHSNGSQYQELAVALESSSVTISQLNENIESLAKKTNNEIHKAQMERLETINILTLEKADLKTTLYHTKRAARHFEEESKDLAGRLQYSLQRIQELERALCAVSTQQQEEDRGHCLSSPDQNFSLFTIQSSSCREAVLHRRLQQTIKERALLNAHVTQVTESLKQVQLERDEYAKHIKGERARWQERMWKMSVEARTLKEEKKRDIHRIQELERSLSELKNQMAKPPSLAPPAVTSVVEQLQDEAKHLRQEVEGLEGKLQSQVENNQALSLLSKEQKQRLQEQEEMLREQEVQRVREQERLCEQNERLREQQKTLQEQGERLRKQEQRLRKQEERLRKEEERLQKQEKRLWDQEERLWKKEERLQKQEERLALSQNHKLDKQLAEPQCSFEDLNNEKKSALQLEQQVKELQEKLDEVKEMQYVATYQQLTSEKEALHRQLLLQTQLVDQLQQQEAWGKAEHLEAASQQNQQLETQLSLVALPGEGDGGQHLDSEEEEAPRPTPNIPEDLESREATEPEAEAPAPGSGGEFVCGESYRALKEAMVKLKGRESFTVYESQGAVPNTRHQEMEDVIRLAQKEEEMKVKLLELQELVLPLVGNHEGHGKFLIAAQNPADEPTPGAPAPQELGAAGEQDATLVTLT

SEQ ID NO: 916824 - protein, 452 aa, Homo sapiens
MTCIQRTDHSHQLTDSIQKASLESPPTVYYSTGYSSRKMNPTLGLAIFLAVLLTVKGLLKPSFSPRNYKALSEVQGWKQRMAAKELARQNMDLGFKLLKKLAFYNPGRNIFLSPLSISTAFSMLCLGAQDSTLDEIKQGFNFRKMPEKDLHEGFHYIIHELTQKTQDLKLSIGNTLFIDQRLQPQRKFLEDAKNFYSAETILTNFQNLEMAQKQINDFISQKTHGKINNLIENIDPGTVMLLANYIFFRARWKHEFDPNVTKEEDFFLEKNSSVKVPMMFRSGIYQVGYDDKLSCTILEIPYQKNITAIFILPDEGKLKHLEKGLQVDTFSRWKTLLSRRVVDVSVPRLHMTGTFDLKKTLSYIGVSKIFEEHGDLTKIAPHRSLKVGEAVHKAELKMDERGTEGAAGTGAQTLPMETPLVVKIDKPYLLLIYSEKIPSVLFLGKIVNPIGK

SEQ ID NO: 916825 - protein, 155 aa, Homo sapiens
MADFTLPIRERFGDFQIASVYTILIFWPVSDHFSFIWQRREKGMSCQVVDADGSAGSHQKLTLKVYFNVAQIRANDVKRVLFLLEGCHLFLLQGKCLPSSLPNLQAEPTQLWLPCPPEDLRIHQQPKTPRKLFQGQASPAHVSTNGNMMSDAAWS

SEQ ID NO: 916826 - protein, 155 aa, Homo sapiens; identical to SEQ ID NO: 916825

SEQ ID NO: 916827 - protein, 174 aa, Homo sapiens
MKGFIMGVTTAYITEATAVFLGEDDTSELRSMSVFHASKNGKERHLSQAACIGDDSAVRLDVHSHLGDCGGGETDVRQGQVGEEEVHGGVEVGVRADGQDDEQVPQRHDQARGQEQPRKPGTGARERCIPNDPVPILSGIFDVISAALSILDTVIVAPTGLAVVYKEPPKGRAQ

SEQ ID NO: 916828 - protein, 483 aa, Homo sapiens
MFRDQVGVLAGWFKGWNECEQTVALLSLLKRVSQTQARFLQLCLEHSLADCAELHVLEREANSPGKCAAAAAAVPPAQPPLLPPLLCLGPGRGQSLPAAPGPGRRGPEALGIHPLRVSPHYRPPPTYLRRPLWDFAHCELRQPFPCGSYGSMNDGFFSHAVSWEITTHDEMPGTALQKPSLDKAVRAVWKSVTKGSGLSQALRKDIGRQSYGQQIWDQNLTLLTVIQSLNRADMFVRGQRRCLKDKEEDASSSPELPHGICTSPAQHLAHWIDTAMLATAITRMSIFPLSPTSGLHSLTERFILLNEQHSGHQWPSEWAEIPWAAPDPSKPLNQPLHKNRSLEKAFEETLPYASLFPSIVASGIKGGRTEAEDCSVSLPGAACEVTGALPGRSRWCCLETPPAFMSITAMSQRGLHQGRELNNGMDEEYLLQQYNSASDEIADALKVKHETIGEAAMEIGLQPSADWVRPTHIMDGTLLYSGH

SEQ ID NO: 916829 - protein, 153 aa, Homo sapiens
MGTVWVTPSPESITMPVVRPEVYKDSTAWMATYMAGDGVLLGSHTQLIVEGVVPDLLHVVPVGDDAVLHGVLQGQDASLALGLIAHIGLHLTHAPHHVLVPGAPHDGREDSPGGIVTCKAGLAHARAVVNDEHGSIIIHAGSDVSLRLVPVLA

SEQ ID NO: 916830 - protein, 153 aa, Homo sapiens; identical to SEQ ID NO: 916829

SEQ ID NO: 916831 - protein, 105 aa, Homo sapiens
MIHCSLDLLDSSDLPAAAPEVAGTTGSYSVTQAGVQWHNLGSLQPQHPRLKQSSRLSLLSSWDHRNPNCRTCSVKQPELNHLKCISQYSPQINLTPVTCVWVIFP

SEQ ID NO: 916832 - protein, 132 aa, Homo sapiens
PSSFMLQNSQNGCVYMNFGGNSEETELHADIDTDGLEDILGIVWKGGIGPLAVMRYRNKEWWAKCASSMQNRENSKCDENKKIRIERESKGSDFITVRHCLIPCSCATYRDPRPPPMIPGWRKQQASGIQDQ

SEQ ID NO: 916833 - protein, 259 aa, Homo sapiens
MATYQQLTSEKEALHRQLLLQTQFVDQLQQQEAWGKAEHLEAASHQNQQLETQLSLVALPGEGDGGQHLDSEEEEAPRPTPNIPEDLESREATEPEAEAPAPGTGGEFVCGESYRALKEAMVKLKGRESFTVYESQGAVPNTRHQEMEDVIRLAQKEEEMKHPSLQVKLLELQELVLPLVGNHEGHGKFLIAAQNPADEPTPGAPAPQELGAAGEQDVFYEVSLDNNVEPAPGAAREGSPHDNPTVQQIVQLSPVMQDT

SEQ ID NO: 916834 - protein, 127 aa, Homo sapiens
MICDYLCLFDEMTPYHYEMTFFIPDLPPSISRISPCLSFTVAAAPVQATLTLAGKTQQPLTWSHVAEHLLQLTAESHQAAIPPRSLLWGPLHVVNYSAREDGKMQRGGVTPEATQLTSEPKHEPQSL

SEQ ID NO: 916835 - protein, 141 aa, Homo sapiens
SHRPHPAPMQTEGPVSLPPCPTLTAPSLFPGRGQEGLENLPKAIRLPAAKEKGFSSPSACEVCRPGLHPPLSFDQETSHFVINCHEVQERIFSPCGVLSPAPLATLLKDPCSARQEWGAWGPSELPGCFCCFLSPVFLLAL

SEQ ID NO: 916836 - protein, 435 aa, Homo sapiens
GSGTLKVMRSKFTKECTRRLEPTERPLQIVYDYLSRLGFDDPVRIQEEATNPDLGCMIRFYGEKPCHMDRLDRILLSGIYNVRKGKTQLHKWAERLVVLCGTCLIVSSVKDCQTGKMHILPLVGGKIEEVKRRQYSLAFSSAGAQAQTYHVSFETLAEYQRWQRQASKVVSQRISTVDLSCYSLEEVPEHLFYSQDITYLNLRHNFMQLERPGGLDTLYKFSQLKGLNLSHNKLGLFPILLCEISTLTELNLSCNGFHDLPSQIGNLLNLQTLCLDGNFLTTLPEELGNLQQLSSLGISFNNFSQIPEVYEKLTMLDRVVMAGNCLEVLNLGVLNRMNHIKHVDLRMNHLKTMVIENLEGNKHITHVDLRDNRLTDLDLSSLCSLEQLHCGRNQLRELTLSGFSLRTLYASSNSESSERLSSTQPVTFLDLSRNC

SEQ ID NO: 916837 - protein, 346 aa, Homo sapiens
GSGTLKVMRSKFTKECTRRLEPTERPLQIVYDYLSRLGFDDPVRIQEEATNPDLGCMIRFYGEKPCHMDRLDRILLSGIYNVRKGKTQLHKWAERLVVLCGTCLIVSSVKDCQTGKMHILPLVGGKIEEVKRRQYSLAFSSAGAQAQTYHVSFETLAEYQRWQRQASKVVSQRISTVDLSCYSLEEVPEHLFYSQDITYLNLRHNFMQLERPGGLDTLYKFSQLKGLNLSHNKLGLFPILLCEISTLTELNLSCNGFHDLPSQIGNLLNLQTLCLDGNFLTTLPEELGNLQQLSSLGISFNNFSQIPEVYEKLTMLDRVVMAGNCLEVLNLGVLNRMNHIKHVDLR

SEQ ID NO: 916838 - protein, 138 aa, Homo sapiens
MDVDSGREFSIHCPYPDLWLSVPPCPNRIQSRPNLPSPLYKPVAAVPVAILMVLNSLWDTRICCKTLSCILSHPPLLAVPWSHVTTESAPHKGLNAPWVAVPTGKPVCALLRTGGLAEKRGWSPVGFTSIFTKRCAQE

SEQ ID NO: 916839 - protein, 158 aa, Homo sapiens
MGLITPRTTATSSQRNGTRNQASPSLQKSSQHVRTIIMDDARVVGAPEQTCMLSSGVALLHFWAGARGPGFVICPFPCLIPFPSKFPRLLFCQSVKRGKSGEESFVPGHWGLNMALLPGHCPNIYFYWHNFVESVMRYGVLDIFLTQDPSESPFYTAY

SEQ ID NO: 916840 - protein, 177 aa, Homo sapiens
MTIKSARCKLSVHLPFWGLEDDDPLLTASVTSAPVEVPKLQLLTSVHLQAQNHMQATKAWGLHPLKQWPDLYISPFLPWLACREPDLMRLMHYHENSTGKSTPIIQLPLTRSLLQHMEIMRVTIPDEILMRRQPNSIKRFVEDQIVADVRFYFWVLYSVPLVYVSVFNFQYYVEYEW

SEQ ID NO: 916841 - protein, 152 aa, Homo sapiens
ALLVLATVLCNLGAMRNLYAMHRRLQRHPRSCTRDCAEPRADGREASPQPLEELDHLLLLALMTVLFTMCSLPVIYRAYYGAFKDVKEKNRTSEEAEDLRALRFLSVISIVDPWIFIIFRSPVFRIFFHKIFIRPLRYRSRCSNSTNMESSL

SEQ ID NO: 916842 - protein, 207 aa, Homo sapiens
RSFFYILSTTICRKMLHRHMLIFRLPNLQMLDGSPVNSDDRAKAEFHLAELQAKKNSVIIILFTIFLLKHINGEAASADVEAAASYPEDLARIIDESRYTKKEIFNVDATALYQKKMPSRTFIAREEKSMTGFKASKDNKKNKNAGILTNNPRSIHAEIAFRQLRGISISPSLLSHQNIASPTAQIYQSNQDKRRIFGSNFPRSNRM

SEQ ID NO: 916843 - protein, 164 aa, Homo sapiens
MAHLQVLLCILTLPTILSTELLTINIGFLSYPFRVFFLLIEVHLFYGLNVCVLQNSYVETKVMVSEGPIHTLITESDGYFNRQQASLPTEPSLSGTSLHAGWLGQAGMKQVRAKLRFNGRIQGVKSIGAYVLSGKKPTNIKGFAMAGWQEKASMFSWQNIKRLL

SEQ ID NO: 916844 - protein, 268 aa, Homo sapiens
MGHTCPKGMFLAPAKVPIARYNRTSYFYPTFSESSEHSHLLVSPVLVASAVIGVVIILSCITIIVGSIRRDRQARLQRHRHRHHRHHHHHHHHRRRRHREYEHGYVSDEHTYSRSSRRMRYACSSSEDWPPPLDISSDGDVDATVLRELYPDSPPGYEECVGPGATQLYVPTDAPPPYSLTDSCPTLDGTSDSGSGHSPGRHQQEQRTPAQGGLHTVSMDTLPPYEAVCGAGPPSGLLPLPGPDPGPRGSQGSPTPTRAPASGPERIV

SEQ ID NO: 916845 - protein, 268 aa, Homo sapiens; identical to SEQ ID NO: 916844

SEQ ID NO: 916846 - protein, 135 aa, Homo sapiens
MFKQKPVPSRPLVLSALRPPACPHWPLLFHSTLHTHSPPGLCPEPLLGPPPRTGEPWSRAGPLTVLSSHRVHGTYTSASRGHVNAASSAVRQLLFLSDRSWPVSPPTYVELSELRSPLTTVLPLAHNVKVVSIPS

SEQ ID NO: 916847 - protein, 223 aa, Homo sapiens
ATLSMQQIIFNVQILKQCSRVMRDNKSCAFFMGKLNVCFEGTVIAGYSVFVIMCVIDMAVASALQFPKKSSHPHRTALHLASANGNSEVVKLLLDRRCQLNILDNKKRTALTKAVQCREDECALMLLEHGTDPNIPDEYGNTALHYAIYNEDKLMAKALLLYGADIESKNKIESHSVSQAGVQWCDHSSLQPRPPEAQMVLQPQPQLFFSFFLFIFIFIFIFF

SEQ ID NO: 916848 - protein, 179 aa, Homo sapiens
GLKRARALLWIRLWLKRTSCMFVLVPMLKGWQLWSRNSLHGKQKVKPNHPSIFQVFACAISADIPLAKATHKTNLQVKGGKAHLVSSGITSNYKAKGMDIRRGEELVVSSLKNRVNVGGQKNESYDQLSIPLEATGANSKLFLMKAGCSKQDVGKMTNCICHPEGMLRAVMPQVQCFCD

SEQ ID NO: 916849 - protein, 179 aa, Homo sapiens; identical to SEQ ID NO: 916848

SEQ ID NO: 916850 - protein, 179 aa, Homo sapiens; identical to SEQ ID NO: 916848

SEQ ID NO: 916851 - protein, 774 aa, Homo sapiens
MLAPGPPFPVTQPPPPEVQRNLVPAAVNPYVMIFLPALFRVLVLAAVFGQLKEYQQRKSPGIPAGAKTKKKKTDSSPETTTSGGGHSPGDIQDILKVRVSNLNHSNGSQYQELAVALESSSVTINQLNENIESLAKKTNNEIHKAQMEQLETINILTLEKADLKTTLYHTKRAARHFEEESKDLAGRLQYSLQRIQELERALSAVSTQQQEEDRGHCPGSPDQNFSLFTIQSSSCREAVLQRRLQQTIKERALLNAHVTQVTESLKQVQLERDEYAKHIKGERARWQERMWKMSVEARTLKEEKKRDIHRIQELERSLSELKNQMAEPPSLAPPAVTSVVEQLQDEAKHLRQEVEGLEGKLQSQVENNQALSLLSKEQKQRLQEQEEMLREQEAQRVREQERLCEQNERLREQQKTLQEQGERLRKQEQRLRKQEERLRKEEERLQKQEKRLWDQEERLWKKEERLQKQEERLALSQNHKLDKQLAEPQCSFEDLNNEKKSALQLEQQVKELQEKLDEVKEMQYMATYQQLTSEKEALHRQLLLQTQFVDQLQQQEAWGKAEHLEAASQRNQQLETQLSLVALPGEGDGGQHLDSEEEEAPRPTPNIPEDLESREATEEQARLCGQRKVRRLCRLHLAHLVALAWKEPEAEAPAPGRTGDEFVCGESYRALKEAMVKLKGRESFTVYESQGAVPNTRHQEMEDVIRLAQKEEEMKVKLLELQELVLPLVGNHEGHGKFLIAAQNPADEPTPGAPAPQELGAAGEQDGFVCALGS

SEQ ID NO: 916852 - protein, 205 aa, Homo sapiens
LHAFEPAMPDRVFQQREPLGIFFWCSLSCLHRGLPDTSQRTERATANDRKANTTWLRQEGQELAKPGIAGGGSNSEHNTAPPGPWAFPGSRALGVFRLPSLSQQILVAQGCLVLHGDQKKGSTSSSLKHLCSSQGSRETCPSLVGIQIGNDNITHSKQPNQYVMGEPNDDICKYTSTAAMAWEGHSEQELVLLRNKDLDHSISKD

SEQ ID NO: 916853 - protein, 232 aa, Homo sapiens
SVLCGRGLCLPCDAMGLLQSCDPQSAQPMTIAMENPKELMTSLIELLPLEASCASSAQPPPSVATAGLPSQKPGLPRQDLSLPSAAKSLSSRATCLMTGSPQVTGSWERDPERTRVLSLDVGHAAGKGRMRGDKDLASHLQTVQPRPCLEWDLLNGHSRTLEEAPLSQCCWGLRGLEPGALMRPVGGASLSTLRSQLHISFPLTLEPWVVQGGHSLLSVPWPIPKSPPLTTS

SEQ ID NO: 916854 - protein, 127 aa, Homo sapiens
MFQVPLEGAEILGMPGAWLHGLAALMPSCSPQQASKAEENGSNSFMHSMVPQLEWQMETTQSLVDSYVAIVNKTVWDLMVGLTPKTIMHLMINNNKEFIFSELLANLYLHGDKNMLMEESAEQAQRS

SEQ ID NO: 916855 - protein, 140 aa, Homo sapiens
MPTTPVSTLRMPIFQVLAGAAHADSGSQGEKTPEVRQSIKPQVKRSKLVLVLQVAHLALFQLRWQEWNLGFTTPELNFGHPLRNLWDHQLRSPKISQTSLDTPANSWKTCISYVGRKHPRLKRLLPLILKKNPFLLKKDK

SEQ ID NO: 916856 - protein, 177 aa, Homo sapiens
LSTDMLLETYLCSPTTLLDGHQDNCPLLTITVILHSHFKHKAIPERTLFSTNLHLFLNSWCALRALLLYSSLGPGQPLEAKDDWGDSKKLNRDLDLDLSPKCVAPSLTHCSTLLFSSLLALKTFGFMFTYMKCTKSLVMAVFYISNQMQLSRSMHEVNHKIEIELNRSTLESTISRY

SEQ ID NO: 916857 - protein, 174 aa, Homo sapiens
MAAGLLTETLGPWLWPVAYVSKQLERVSKGWPLMFEGCGINCPDRPPSRILRSLGLTWRTVGIRCPRRKLKSADGRTPIAGVGGTPNEAGTESQPLVPPGIGPPSRILRTLGPTWRTVGIRCPRRKLKSADGRYVLVHNLKEIDDAVTDVFAYGDKHQPHSLAYFLLTLTPTDP

SEQ ID NO: 916858 - protein, 271 aa, Homo sapiens
LLQGVGQGDSLPQVTGRAVSVLLSPLMLQQRGCHTATPTAAQEDAASGCPTQVAKRGTDHPSQAQCGVRPQGQGGVTAPLGDRHLPAPSHLHGPRGRGAAACVMPLAPALPQVLSVLCVLASPRQGLLSFPVSTAGPDGPADPSRPQSGAKVYNLRAQGTCIRPKKEIFNHEKNIRKAQTEGSSTKYSTRAVLKTISVITDRQSPRNCQPRGAHGNPMTVTWNPGWDPGTETATRGNLRKLELKQCVRLIHSCPLVDGCRILTNVKVSVVL

SEQ ID NO: 916859 - protein, 264 aa, Homo sapiens
MNAKLLSLTGGLSLLRVAHRAVFQAQDMGSQLLSQCGGWPIGGSLCSASSPAGFSGKRQRQFGEKDTGKEGAVKGESSLPVKDQPSVKGQLLAGWPQAESGSQGGAAAGWDWGILHLIQVKQSLVQHPLCTEVLLFGAFQFIFQVINCLFQLGYRSLSKLSTGLCLLGFISKNLDFFLIFVFFLRVLFFSSTQTLQVLVHQSNLLIHLSATGLCQLSSFLCAFQVSFNGHQLTSHLFILPICLFCNVLSFFELEFLEFHLFFIF

SEQ ID NO: 916860 - protein, 69 aa, Homo sapiens
SPVSTLAGSPCLSGCPGLCQLSSFLCAFQVSFNGHQLTSHLFILPICLFCNVLSFFELEFLEFHLFFIF

SEQ ID NO: 916861 - protein, 258 aa, Homo sapiens
MRQITRGWPKCIPSVAATALLTEESRKITFRGLTPEHKGNVGHTGKGPLESSSPDPFLCGQERGKQVQDCYIDGKCSPQGKNALKMYSGEFDPVRVCVPFSLSDLKQLKIDLGRFSDNPDGYIDVLQGLGQSFDLTWRDIMLLLDQTLTPNERNATITAAREFGDLWCLSQVNDRMTTEQRERFPTGQQAVPSVDPRWDTESEHGDGNKPPPHPCPLCQGNYWKAYCSRGRRSSESEADPAAGLRVPRASTSPCHHPH

SEQ ID NO: 916862 - protein, 237 aa, Homo sapiens
KSSFIEAECSGSCLQSQRFGRPSNYGSHSLTHLHKAPSMVSVTKEWFAGTAQGIVFDRHVVDDSRPSEPADMLPRECSRDLRKWWQQPGTLRCLSGRGRARSARSSRRGGFDARSPPRLSGKRHIPLPEWPPVLLSAQHCQGSLPQTWGSPGTETAPCNPKDLDGALAQRSSINICPMNKCHSLELVVLGEPEAKPSCPSHRQLVARRKGHLCPGRRGVVMESLTLALWSPLRFDFS

SEQ ID NO: 916863 - protein, 728 aa, Homo sapiens
MTWRWHQPLPQVDAPPRDLQAAAAPGQALGYHLAQHLCPEHPQGLPLGCLARTAGMARSLIGAKDACLLELAVFLEKALHVTSSMKPDTVPSHDPRAALTTACPGLIFKEKVTSLKFKEKPTGLETRSSQTKLEVALYMFLRNPDTEAVLVAMSCFRHLCEEADTRCGVDEVSLRNLLPNSNTFMEFACQQCDVNSYPKAQMEDGQRRMSHVSGGGPIDLSDTDSLQAWINMTGFLCALGGVCLQQRRNSGLATYSPPVDIMKNLLDNHTEGSSEHLEQASIETMMLNLVSHITILVEPSCEDSQGLNYLRVCPGNQPALVQGILERVVDGPVPHQTVRLEDLDESGEPQAGEPVLPGILRPPYLAEGLGLGLPVTAIPVLPAEGAGLLHYLSKMLLMVATGLLRPYMGKGFVNCEAFLCKAEHDVPGAPGPWSSALGGTTCMRQRHSGDWPAMPSRAEDYEVLYTIGTGSYGRCQKIRRKSDSKILVWKELDYGFMTEAEKQMLISEVNLLCKLKNPNIVHYYDRIIDRTNTTLYIVMEYCEEGDLASVITKGTKERQYLDEEFVLRVTTQLTLALKMLKDYHRPSVEEILENPLIADLVAEEQRRNLERRGRQLGEPEKLPDSSPVLSELKLKEIQLEEQERALKAGEERLEQKEQELCVCERLAEDRLTIPENLLKNYSLLKEQKFLSLASSPELLNLPSSVIKKKVHFSGESKENVMRKVSETG

SEQ ID NO: 916864 - protein, 750 aa, Homo sapiens
MRFPPPPGGVECSDVTVLLGTLKEYQQRKSPGIPAGAKTKKKKTDSSPETTTSGGGHSPGDIQDILKVRVSNLNHSNGSQYQELAVALESSSVTINQLNENIESLAKKTNNEIHKAQMEQLETINILTLEKADLKTTLYHTKRAARHFEEESKDLAGRLQYSLQHIQELERALCAVSTQQQEEDRGHCPSSPDQNFSLFTIQSSSCREAVLQRRLQQTIKERALLNAHVTQVTESLKQVQLERDEYAKHIKGERARWQERMWKMSVEARTLKEEKKRDIHRIQELERSLSELKNQMAEPPSLAPPAVTSVVEQLQDEAKHLRQEVEGLEGKLQSQVENNQALSLLSKEQKQRLQEQEEMLREQEAQRVREQERLCEQNERLREQQKTLQEQGERLRKQEQRLRKQEERLRKEEERLQKQEKRLWDQEERLWKKEERLQKQEERLALSQNHKLDKQLAEPQCSFEDLNNEKKSALQLEQQVKELQEKLDEVKEMQYMATYQQLTSEKEALHRQLLLQTQFVDQLQQQEAWGKAEHLEAASQRNQQLETQLSLVALPGEGDGGQHLDSEEEEAPRPTPNIPEDLESREATEPEAEAPAPGRTGDEFVCGESYRALKEAMVKLKGRESFTVYESQGAVPNTRHQEMEDVIRLAQKEEEMKVKLLELQELVLPLVGNHEGHGKFLIAAQNPADEPTPGAPAPQELGAAGEQDVFYEVSLDNNVEPAPGVAREGSPHNNPTVQQIVQLSPVMQDT

SEQ ID NO: 916865 - protein, 435 aa, Homo sapiens
MQGQGRRRGTCKDIFCSKMASYLYGVLFAVGLCAPIYCVSPANAPSAYPRPSSTKSTPASQVYSLNTDFAFRLYRRLVLETPSQNIFFSPVSVSTSLAMLSLGAHSVTKTQILQGLGFNLTHTPESAIHQGFQHLVHSLTVPSKDLTLKMGSALFVKKELQLQANFLGNVKRLYEAEVFSTDFSNPSIAQARINSHVKKKTQGKVVDIIQGLDLLTAMVLVNHIFFKAKWEKPFHPEYTRKNFPFLVGEQVTVHVPMMHQKEQFAFGVDTELNCFVLQMDYKGDAVAFFVLPSKGKMRQLEQALSARTLRKWSHSLQKRWIEVFIPRFSISASYNLETILPKMGIQNVFDKNADFSGIAKRDSLQVSKATHKAVLDVSEEGTEATAATTTKFIVRSKDGPSYFTVSFNRTFLMMITNKATDGILFLGKVENPTKS

SEQ ID NO: 916866 - protein, 403 aa, Homo sapiens
PQLDCHRAGGRGEIKVRRELQPSKQVSGLTNHARTGQEKRNLQRLVLETPSQNIFFSPVSVSTSLAMLSLGAHSVTKTQILQGLGFNLTHTPESAIHQGFQHLVHSLTVPSKDLTLKMGSALFVKKELQLQANFLGNVKRLYEAEVFSTDFSNPSIAQARINSHVKKKTQGKVVDIIQGLDLLTAMVLVNHIFFKAKWEKPFHPEYTRKNFPFLVGEQVTVHVPMMHQKEQFAFGVDTELNCFVLQMDYKGDAVAFFVLPSKGKMRQLEQALSARTLRKWSHSLQKRWIEVFIPRFSISASYNLETILPKMGIQNVFDKNADFSGIAKRDSLQVSKATHKAVLDVSEEGTEATAATTTKFIVRSKDGPSYFTVSFNRTFLMMITNKATDGILFLGKVENPTKS

SEQ ID NO: 916867 - protein, 234 aa, Homo sapiens
MASYLYGVLFAVGLCAPIYCVSPANAPSAYPRPSSTKSTPASQVYSLNTDFAFRLYRRLVLETPSQNIFFSPVSVSTSLAMLSLGAHSVTKTQILQGLGFNLTHTPESAIHQGFQHLVHSLTVPSKDLTLKMGSALFVKKELQLQANFLGNVKRLYEAEVFSTDFSNPSIAQARINSHVKKKTQGKVVDIIQGLDLLTAMVLVNHIFFKASGKSPLPWIFQKEFPSWWGTVMFF

SEQ ID NO: 916868 - protein, 138 aa, Homo sapiens
MLSPLKRRRPLSSSRQNGRFTASMHCVPRKTAGTQCQPVKAPMGAVPCRGTGEELRKVFKAHHHLYQCALNSRSMPYLQALYISHQFNLWRTMGNEELAPNVISYNKKILKFMWKFKEPNSKSNPEQEQNKIIFTIIY

SEQ ID NO: 916869 - protein, 189 aa, Homo sapiens
LITFSRFEMFSVTILLNKLSTLISLSLCLSSLRPGHTLVDAKHGVEITSDGMETIFIDSVEDSEPEEEEEGKGSEIGKKRKQKKPKLKNLCATGVMENPYEKLENNKQCPIMIVLFPVEHIATMNEIEVLSTKMDAMLLGENLVYPTASNLKYFTNSSLALFQEEIERLTEFVQVSECMQRVLCEVQIR

SEQ ID NO: 916870 - protein, 112 aa, Homo sapiens
MEFGLSWLFLVAILKGVQCEVQLLESGGGLVQPGGSLRLSCAASGFTFSSYAMSWVRQAPGKGLEWVSAISGSGCHEAPALAFTQKTIDRLAVNPPTVNVSVVMAEADGTCY

SEQ ID NO: 916871 - protein, 192 aa, Homo sapiens
MEFGLSWLFLVAILKGVQCEVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKDTVRGSHCEPRHKPPCRNDGGEISGRGRSGPADQSHPQRQVQMEAVSCQDGPLGPHSRAQGIFLELSDWSLLERD

SEQ ID NO: 916872 - protein, 155 aa, Homo sapiens
QSQEDLVKRWQSRMSSGRKESQEERGKEMSKYQGHVCQARTLAQQDTRRGGDPEKCELCLSLKGFSLQSIHFLERLSSSSSSSSSSSSSSSSSSSSSSSSSSSSSSSSSSSSSSCSSSSSSSSGTAEVVSKEEIKDDLTLQNFNIYHACGNALSP

SEQ ID NO: 916873 - protein, 163 aa, Homo sapiens
MGISSLVLIKLQLEIKYVNHSSWKGFLLSGLVMQSTPRGIQEGGGGVYLENNMEGPEGRRNGSHSPVPGQEVSTPGSVLLAVPLTFCVLEYSRRTGWHGPAGHSTWEKTTDSTACSTARTRATAKNIITQKCGTETMQQRGLSRDSGGGTERLEEVGLVLRDG

SEQ ID NO: 916874 - protein, 102 aa, Homo sapiens
IMHSLGQERAMAAPTRMLCRDLWLLLLSQPGGSTSGSLATLPSSLFPTIACFPFFCLLNFAALPAYCRSTSVSLFDFLQEGKGLRDPVPSTVPCPESGISKW

SEQ ID NO: 916875 - protein, 101 aa, Homo sapiens
MARGDAGRGRGLLALTFCLLAARGKGGRPERQERLRSAGAPAPWSASGCGAGSSRSPEQVRGLRVQVPAMPARGSASCGRGAFVGRACPQWVCAFGSQSLE

SEQ ID NO: 916876 - protein, 290 aa, Homo sapiens
MARGDAGRGRGLLALTFCLLAARGELLLPQETTVELSCGVGPLQVILGPEQAAVLNCSLGAAAAGPPTRVTWSKDGDTLLEHDHLHLLPNGSLWLSQPLAPNGSDESVPEAVGVIEGNYSCLAHGPLGVLASQTAVVKLATLADFSLHPESQTVEENGTARFECHIEGLPAPIITWEKDQVTLPEEPRLIVLPNGVLQILDVQESDAGPYRCVATNSARQHFSQEALLSVAHRGSLASTRGQDVVIVAAPENTTVVSGQSVVMECVASADPTPFVSWVRQGDVLFKLYYL

SEQ ID NO: 916877 - protein, 163 aa, Homo sapiens
ARVPPSLPKETMTTHKRHFFLRSLGSHCNASFLRLRKDLYPEGGGGGVLNVPKPKAGPYVELRKPWPGTGECKGRLGDPGTWCKPRTSTSQLCSQGQLTPPWSLECAYRLPCWGAARPGQQTALYCLWPVDSRCSINLSFLSETQSPYVDDSIFLKDLKFHPP

SEQ ID NO: 916878 - protein, 801 aa, Homo sapiens
AECSSPLTVAPTGLGYCGHRHSSLGAMEEPGATPQPYWGLVLEEPRRVVAALPEGRRPDSNPYGFPWELVICAAVLGFVAVPFFLWRSFRSVRSRLYVGREKELAVALSGLIEEKCRLLEKFSLVQKEYEGYEAESPLEDASFEKEATEAQSLEANCEKLNRSNSELEHEILCLEKELKEDKSKHSEQDEVMADISKRIQSLEDESKSLKSLLAEAKMTFKRFQMNEEQMKIAIQDALNENSQLQESQKQLLQEAEVWKEQVSELNKQKITFEDSKVHAEQVLNDKENHIETLTERLLKIKDRAAMLEEDITDDENLELEMNSESEDGAYLDNPPKGALKKLIHTAKLNASLTTLEGVRNQIYIQLSEVDKTKEELREHIKNLQTEQASLQSENTYFESENQKLQQKLKVMTELYQENEMKLYRKLIVEENNRLEKEKFSKVDEMISHATEELETYRKRAKYLEEELERTIHFYQGKIIYHEKKAHDNCLAAQTAERNLNDLRKENAHNRQKLIETDFKIKFLEKDPYALDVPNTAFGREHSSYGPSPLGRPSSETRAFLYPPTLSEGPLRLSPFPPGGGGRGPRGPGNPLDHQITSERGESSCNRFTDPHKAPSDTGPLSPPWEQDRRMMFPPPGQSYPDSALPPQRQDRFYSNCARRSGPAELRSFNMPSLDKMDGSVHSEMEFSGNDTKDNLGNLNVPDSSLPAESEATGPGFVPPPLAPIRGPLFPVDTRGPFMRRGPPFPPPPPGTMFGASPDYFPPRDVPGPPRAPFAMRNVCPLRGFPPYLPPRPGFSPPTRTF

SEQ ID NO: 916879 - protein, 134 aa, Homo sapiens
MMLIRLIKFGETKFNVTEPKEPGESVVIRIPVIHQGDTSKVSIAYGGHFLFTQEPTISHKIMSTGIRLSTAAEKAWERRSCSGRRRAHVEAAPRPGGGAVTWGSVGRCLGNAERALQGLFGVPELSAPEGTYFI

SEQ ID NO: 916880 - protein, 139 aa, Homo sapiens
MEGSKKEETSPYSQATAHIEGPPLNKKMGVGQEVFCNYSFRIKIADKQFTQVMVRGSQGQFPHTSSLAFCHVRYDCAPPSPSAMIVRPPQPCGTGSCFSLFGVSERLVARTPGKRKAEGHSGKRYHLSLAAQARFYGLE

SEQ ID NO: 916881 - protein, 170 aa, Homo sapiens
MEGSKKEETSPYSQATAHIEGPPLNKKMGVGQEVFCNYSFRIKIADKQFTQVMVRGSQGQFPHTSSLAFCHVRYDCAPPSPSAMIVRPPQPCGTGSCFSLFGVSERLVARTPGKRKAEGHSGKRKPRAKRMATSDHSTSPAWCTFLGSLSRLPSIAFIFLLPIKPVLFSF

SEQ ID NO: 916882 - protein, 144 aa, Homo sapiens
MEGSKKEETSPYSQATAHIEGPPLNKKMGVGQEVFCNYSFRIKIADKQFTQVMVRGSQGQFPHTSSLAFCHVRYDCAPPSPSAMIVRPPQPCGTGSCFSLFGVSERLVARTPGKRKAEGHSGKRWRQKLDWAQEYVFLKFSRRF

SEQ ID NO: 916883 - protein, 126 aa, Homo sapiens
MEGSKKEETSPYSQATAHIEGPPLNKKMGVGQEVFCNYSFRIKIADKQFTQVMVRGSQGQFPHTSSLAFCHVRYDCAPPSPSAMIVRPPQPCGTGSCFSLFGVSERLVARTPGKRKAEGHSGKRPR

SEQ ID NO: 916884 - protein, 158 aa, Homo sapiens
MTAKLFIAQFTEYFKLPVKTYCSEQKLPFKILLLIDNAPSHSKALMEIVQEINVVFMPVNTTCILQPISQGIISNLKSYPLRPTFYVIKNMPDSWEEVKMSTLTAIWKKLVPILMDDFEGFRTSVKEVTTDWVEKARELELEVEPENVTELLQSHDKT

SEQ ID NO: 916885 - protein, 158 aa, Homo sapiens; identical to SEQ ID NO: 916884

SEQ ID NO: 916886 - protein, 305 aa, Homo sapiens
AAARRRPRACPTPGPGPSPPPPGSHVTAPPPSARPARPPRVRGPAAAPGRRGSGGAGAMAERGRLGLPGAPGALNTPVPMNLFATWEVDGSSPSCVPRYAPPAALCSRRAPAGGVLAAASARPIPGPGPPAEPRSPPAPPPAGSTRAAAAPPQLRQARPQPPRSRAPGAALSFRGPGAAQTRRDLGAPGRRSPGSPQPHLHTCLNAVPAGVTRVLPLSGTTRFLSRSATLSDLGLGATPGARGAQDSVVSSVQRAVEMPCPAGRGRPRGYLVGAVSHLEASPSQYCYLRLPVDLAIAEDWLFCTW

SEQ ID NO: 916887 - protein, 904 aa, Homo sapiens
MAERGRLGLPGAPGALNTPVPMNLFATWEVDGSSPSCVPRLCSLTLKKLVVFKELEKELISVVIAVKMQGSKRILRSHEIVLPPSGQVETDLALTFSLQYPHFLKREGNKLQIMLQRRKRYKNRTILGYKTLAAGSISMAEVMQHPSEGGQVLSLCSSIKEAPVKAAEIWIASLSSQPIDHEDSTMQAGPKAKSTDNYSEEEYESFSSEQEASDDAVQGQDLDEDDFDVGKPKKQRRSIVRTTSMTRQQNFKQKVVALLRRFKVSDEVLDSEQDPAEHIPEAEEDLDLLYDTLDMEHPSDSGPDMEDDDSVLSTPKPKLRPYFEGLSHSSSQTEIGSIHSARSHKEPPSPADVPEKTRSLGGRQPSDSVSDTVALGVPGPREHPGQPEDSPEAEASTLDVFTERLPPSGRITKTESLVIPSTRSEGKQAGRRGRSTSLKERQAARPQNERANSLDNERCPDARSQLQVQLQIPRKTVYDQLNHILISDDQLPENIILVNTSDWQGQFLSDVLQRHTLPVVCTCSPADVQAAFSTIVSRIQRYCNCNSQPPTPVKIAVAGAQHYLSAILRLFVEQLSHKTPDWLGYMRFLVIPLGSHPVARYLGSVDYRYNNFFQDLAWRDLFNKLEAQSAVQDTPDIVSRITQYIAGANCAHQLPIAEAMLTYKQKRKKHFHFDFTLSPDEESSQKFIPFVGVVKVGIVEPSSATSGDSDDAAPSGSGTLSSTPPSASPAAKEASPTPPSSPSVSGGLSSPSQGVGAELMGLQVDYWTAAQPADRKRDAEKKDLPVTKNTLKCTFRSLQVSRLPSSGEAAATPTMSMTVVTKEKNKKVMFLPKKAKDKDVESKSQCIEGISRLICTARQQQNMLRVLIDGVECSDVKFFQLAAQWSSHVKHFPICIFGHSKATF

SEQ ID NO: 916888 - protein, 144 aa, Homo sapiens
VRDMEHCDHITMPSPAWAAGISGLIRAERSGSCWPHATDFLSQEQPSSLSLREKFNYKKFANIFGKKVCWSRGATVELIIWSAMALGQSNRHARQSSAGKFQTPQARFPYKEPVCKCVCSRIFVHGNESVCEKTQFLTTDALLR

SEQ ID NO: 916889 - protein, 1673 aa, Homo sapiens
SLFWKNADKHKKRTPSFLPLCNLPSSLQPAPPLLSVAPSFPPLCAPSSLPLCSPLLPCSCRKSSKTCSDVMSVDAQTLKKKMGKLACDPAAHSILSSLLLYVTGRADRPPGTEAGGSRPSHQPQTQEATQRPTRFQLLQAKFLGTGRERYLKRTREVGRLISKDKQGPGGGLVGATINKLLEKTKEPAPKPCLSEKPRWGHPAGKSTVKNILKIFLAAEEKEAKEKEAREKPPVERPKAARGLLPKIMGKSSVLSKLREKFEQNSCLCSEASALRLHTQERKKRNLQRKRMHRPEVRVLHTATMASTCVKMPPARFLACTAEPLPALSIATVVCGPRSWLSHCTKISHSEARRPPRGEASVPPSARETGPSGNKAVGKGPLEEEPQRQPRPSKPVTPQVMAQRDGHAVPSLAFSCAPCTGGVLPGLVPASSPLGPASPWGTGSAGGDGTADPTAESTAGGVQEVRGARLTWPPGPPGECAGEGPEITMTVCSSEDEREGAGFPDPGRDPLFATQKYFPEQKVPEHIPPLNAPSVQAARRTQPATEPPRITVQIPVVHEMPAPPTRLQNMSSGENKPCICGGENVVENAHTEFPTVTENRRGHRAPVELSKLSGMQAGLSASSPQGPRAAPRLAAARGAVGADHSVPETLLTQRLQTDPAGGKENKGSFENSHGPRNPDDISGERTSELRDVKHPLPESNEISMQKKGSATNDPAASQNLLRGNTSHASSSQQVPSPTGRNPTGAPTSLAASSKGRTGPEGVTPMGMTVPGALEECRRPLLIESSQPLKAAEEITSHDVRENPLSSLNEPPKPGMKACGAMAAAGSVASRATPAPAPGSTQSPGDRTAGEPETLGQWGSRALSESHPRGEALPRDPHSHGLLAPGGSLEPKSGAAGRSLLRGVALVQHPEDIATLARHPEDAAALARHPEAARLYISNTSAASRHTAAVGGRKDVAVEGNLLGFSTESGIPASDHPRPQARSVAESPSYGPGLPPSPPENPQAKGREGVRFPRGAEPDHLLPAVPPAEVDMGWVGGTHQRGPPHLQAHLPPTAGDTQAKLRASVPEPRTQAGESQERPLTQADLGRQQSHQAQEETPQPGDAGKRVAPSGSKVVLNPAKEPQTWWAQDLAGDKGMAIGVGGACQRSDQGQQHLQGPWEERGRSTAWGEGTRAARNPAVPPGEPEGPGSPAAQGQAQKQVQEWDRGQVQGHAQEQAQWQTQIEAQGQAQEQAQGGTQGHSQGQAQKQFQNWAQGQAQGHAQEQAQWQTQIEAQGQAQEPAQGGAQGQVQGQAQKWAQGQIQGQAQKQVQGEVQKWAQEEAQGQAQWQTQIKAQKWAQEQTQKGAQERVQGQAQKGAQERAQEQAQEQTQIEAQGQAQKGAQERAREQAQKGAQERAREQAQKGAQERAREQAQKGAQERAREQAQKGAQERAREQAQKGAQERAREQAQKGAQERAQEQGREQTHIEAQGQAQKGAQEWARDRARDQGWEQTQIETQRQTQKGAQERAWEQGREQALTSGMAPRAWEQPISGIAEGVDAAGRSGGSRSPAPRDGGQSGGSGLGEPSAGYPPPGSRPLRGKSIATSPLGLGKSPTEPKPEAGGCGTPQAPAQEGSPDHPGAERALQDRMEASEPERRGRSRHLAKYKAQSFRDQRAFDLSFRPMSVRASDTSELPK

SEQ ID NO: 916890 - protein, 175 aa, Homo sapiens
MRLKTILTEQGDNWRLGDQGKANVRQPLAQVPAGALLHLVRQLVLVLQEPHGVIRQPAGPQPGGLGPTHLQLVGLVPVVGAIAREECGAQCGQDGGRPQGTGALVRAGLDKTFKEGITPTSSSVGSEKQVGPGPPDVHNPYLSGSSKMGRHIQEGTTHRRQPRNGRKSFEYFFKH

SEQ ID NO: 916891 - protein, 125 aa, Homo sapiens
MLVKVPQQIRRVCTQLEGLMDNTELPPFLISCHLLQGREKEKACVPSYIPNKNENVCPTKNLYTNVHSEIIMAIKWISPKKYPSLEWIMGYIPTIEHYWARKRNEVLMHATTWTNLENIMQKSAH

SEQ ID NO: 916892 - protein, 226 aa, Homo sapiens
MATKIDKEACRAAYNLVRDDGSAVIWRNFSFVSTPRSPGSRGASCTRAGLQAGRIRASRACLPRLIPGRRARPPRASPWPARLLDCPLQAPRRAAPALMCVCFFLLPTQRVTFKYDGSTIVPGEQGAEYQHFIQQCTDDVRLFAFVRFTTGDAMSKRSKFALITWIGENVSGLQRAKTGTDKTLVKEVVQNFAKEFVISDRKELEEDFIKSELKKAGGANYDAQTE

SEQ ID NO: 916893 - protein, 130 aa, Homo sapiens
ARKLLRDDGSGVIWVTFKYDGSTIVPGEQGAEYQHFIQQCTDDVRLFAFVRFTTGDAMSKRSKFALITWIGENVSGLQRAKTGTDKTLVKEVVQNFAKEFVISDRKELEEDFIKSELKKAGGANYDAQTE

SEQ ID NO: 916894 - protein, 142 aa, Homo sapiens; identical to SEQ ID NO: 756005

SEQ ID NO: 916895 - protein, 142 aa, Homo sapiens; identical to SEQ ID NO: 756005

SEQ ID NO: 916896 - protein, 142 aa, Homo sapiens; identical to SEQ ID NO: 756005

SEQ ID NO: 916897 - protein, 142 aa, Homo sapiens; identical to SEQ ID NO: 756005

SEQ ID NO: 916898 - protein, 142 aa, Homo sapiens; identical to SEQ ID NO: 756005

SEQ ID NO: 916899 - protein, 142 aa, Homo sapiens; identical to SEQ ID NO: 756005

SEQ ID NO: 916900 - protein, 142 aa, Homo sapiens; identical to SEQ ID NO: 756005

SEQ ID NO: 916901 - protein, 142 aa, Homo sapiens; identical to SEQ ID NO: 756005

SEQ ID NO: 916902 - protein, 142 aa, Homo sapiens; identical to SEQ ID NO: 756005

SEQ ID NO: 916903 - protein, 142 aa, Homo sapiens; identical to SEQ ID NO: 756005

SEQ ID NO: 916904 - protein, 154 aa, Homo sapiens
MIVCEINKKYKIVPGIMDNGLNTGTGWIAVTTLDVPYLGHTSEQPGVAALPLCRAGLPSRFPRPVDSLPSACTVFICFAFLEDSYTPVKARCECSLCSDALLVFVVLVSRVVVVCMSVSSTPWRSPPGERDFVPLVVYWQRWEQYLAACTDVVE

SEQ ID NO: 916905 - protein, 154 aa, Homo sapiens; identical to SEQ ID NO: 916904

SEQ ID NO: 916906 - protein, 142 aa, Homo sapiens; identical to SEQ ID NO: 756005

SEQ ID NO: 916907 - protein, 74 aa, Homo sapiens
RTWRPLAFSLALDDIFLQLLPITDHGDSLAEILYDRLHQGLVRPGFGALQPPPHHPLPKSSACSPGERTAGLSY

SEQ ID NO: 916908 - protein, 142 aa, Homo sapiens; identical to SEQ ID NO: 756005

SEQ ID NO: 916909 - protein, 142 aa, Homo sapiens; identical to SEQ ID NO: 756005

SEQ ID NO: 916910 - protein, 142 aa, Homo sapiens; identical to SEQ ID NO: 756005

SEQ ID NO: 916911 - protein, 142 aa, Homo sapiens; identical to SEQ ID NO: 756005

SEQ ID NO: 916912 - protein, 142 aa, Homo sapiens; identical to SEQ ID NO: 756005

SEQ ID NO: 916913 - protein, 142 aa, Homo sapiens; identical to SEQ ID NO: 756005

SEQ ID NO: 916914 - protein, 142 aa, Homo sapiens; identical to SEQ ID NO: 756005

SEQ ID NO: 916915 - protein, 142 aa, Homo sapiens; identical to SEQ ID NO: 756005

SEQ ID NO: 916916 - protein, 129 aa, Homo sapiens
MKISMSSLPLYIISSPRHTAACAQVLPVDRKLPCLVTTALGRRSKERAQRTTGKKAEKGVPDVKSKELSSEEGHTYWKNICQPQKIVGKMRQVLSNTGNCPPPFLAPLPLFIMAYEQPKGKMIRKLDSF

SEQ ID NO: 916917 - protein, 162 aa, Homo sapiens
MATGRSKLKWTNEQWPEQITLIEPSLVTGLEHISGSMSMPSRRREKSSTQMPAIPNNAFYVNRKVPTNCDVRDQGGFTREELRKLLGGGERAFIPLQTNTRGPQCHMPAKLRASQQCQGVLAWGWAMGLVLTQRSRNHLLSHLQELWFPGRFPNQLPTPPNR

SEQ ID NO: 916918 - protein, 162 aa, Homo sapiens; identical to SEQ ID NO: 916917

SEQ ID NO: 916919 - protein, 162 aa, Homo sapiens; identical to SEQ ID NO: 916917

SEQ ID NO: 916920 - protein, 162 aa, Homo sapiens; identical to SEQ ID NO: 916917

SEQ ID NO: 916921 - protein, 658 aa, Homo sapiens
LAVLQPVFWGQRHVIHMRRKHLLWPRHLLVTTQDDQGYLGYLEEVPLSMVTVDTCYGDLRGIMRLDDLAYEIKPLQDSRRFEHVVFQIVAEPNATGPTFRDDDNETDPLFSEANDSMNPRISNSLYSSHRGNIKGHVQCSNSYYRIYGNITTCSKEVVQMFSLIDSIAQNIDLRYYIYLLTIYNNRDPAPVNEYRIQSAMFTYFKTTFFDTFHVHSSTLLIKYVPHESNYEPERYNFCSRIALLHIGTPGRHYLLVAVIITQTQMRSIGLEYDDNYCTCQRRASCIMQRFPGMTDAFSNCSYGHAQNCFIHSGRCVFETLAPVYNETMTTVRCGNLIVEGREECDCGSFKQCYASYCCQSDCHLTPGSICHIGECCTNCSFSPPGTLCRPIQNICDLPEYCHGTTVTCPANVYMQDGTPCTEEGYCYRGNCTDRNVLCKAIFGVSAEDAPEVCYDINLESYRFGHCIRQQTYLSYQACAGIDKFCGRLQCTNVTHLPRLQERVSFHHSVRGGFQCFGLDEHHATDTTDVGRVIDGTPCVHGNFCNNTQCNVTITSLGYNCHPQKCGHRGVCNNRRNCHCHIGWDPPLCLRRGAGGSVNSGPPPKRTRSVKQSQQSVMYLRVVFGRIYAFIIALLFGTAKNVRTIRTTTVKEGTVTNPE

SEQ ID NO: 916922 - protein, 164 aa, Homo sapiens
MEKNEKEQEEEEKKEKNSKKKEEEEEEEGGGEEEEEEGEGGEEEEEEEEEEEEEEEEEEEEEEEKKKKKKKKKKKKKKKKKKKKKRKKKKKEEEEKVVEEEDEFIWFLGNSLYFPSFSHFASDLIFWLWSQQASMWTKGNAWCEGVSFDSEFQVEKMKGKGDFV

SEQ ID NO: 916923 - protein, 164 aa, Homo sapiens; identical to SEQ ID NO: 916922

SEQ ID NO: 916924 - protein, 164 aa, Homo sapiens; identical to SEQ ID NO: 916922

SEQ ID NO: 916925 - protein, 198 aa, Homo sapiens
SESTLHTSFMSGWDPGLSSQVPACGCPAVCTRKQGILSHIPTPHCSQRMHTGQRKKNENKSSAKPPQKRDKSSTQARISNTLGSENDRTVITQVKHMIGLNITIETLMYSAYTRMCRMKILLLKKPPLATLRQPRAEATQIQTTGCFFQPQTHMKNLFPDSSYSYGGSRPCPMQKALLKFQDQGFSHSTRKTPQIQCQ

SEQ ID NO: 916926 - protein, 304 aa, Homo sapiens
MCCATLPYDGCDVTKCLNEILESADAPLEVTEGFIQSISLSVPWGSLLQDNCALEVRGLEMVFRPRPRPATGSEPMYWSSFMTSSMQLAKECLSQKLTDEQGEGSQPFEGLEKFAETIETVLRRVKVTFIDTVLRIEHVPENSKTGTALEIRIERTVYCDETADESSGINVHQPTAFAHKLLQLSGVSLFWDEFSASAKSSPVCSTAPVETEPKLSPSWNPKIIYEPHPQLTRNLPEIAPSDPVQIGRLIGRLELSLTLKQNEVLPGAKVSVCFTFCSKTKIKVQVFFILCSDSLIDYCRLSCN

SEQ ID NO: 916927 - protein, 152 aa, Homo sapiens
LPHHHHQHYQFLCTMDLDGIVSLTSKYLQSYNQAMVPITLQTPEHSSNPRKSELWNLPGITVSKADGILEEVEDPMWCLKVPPSLSFSLLLPCEEDPSFPFIFAVTVNIKQHCTWKEAKVFDNSSAAANLSVSVQCKLLWLPHSSCRFKCGW

SEQ ID NO: 916928 - protein, 229 aa, Homo sapiens
MRANKANSAESIPHVVSHTDKHNRKLCPASEPVSSFQLLHCEHYKLAKHHAQLCSWPIPRQDANPWTWVGERWEEAQSMYDVSSYKPPNMDYLTLVSPTRPRQTHRWYSIRTPMMVSLNMMLFWLNHIGTGPALRFKRWCAIGAGIPLTGPVRDCEIGKSHNSVACSPARSVNTLQCGHTWIPWRLDGEHGRGILPFRELRHYQHTLPTSSEPSSDPEEKFSELTSLVE

SEQ ID NO: 916929 - protein, 178 aa, Homo sapiens
MRKNRLQKHSMHPAQHKHSLKIQGIRMKCRIPRFSFLLDCDLEHESKRTTQVVFDYYVQIDQHADYSTGHQHLLPSNILLINVVQQHSVRKNFIKGHPPNKRNVQPRTPPSFVRTICNTRGEGQKYRSCFEDTQGSCEENAKETVTLHTVMPVASHSVLDHPTLITPGFCTNLGPWMQ

SEQ ID NO: 916930 - protein, 161 aa, Homo sapiens
MKPSPAGTAKELEPPAPARGEQRTAEPEGRWREKGEADTERQRTRERQEATLAGLAELEYLRQRQELLVRGALRGAGGAGAAAPRAGELLGEAAQRSRLEEKFLEENILLLRKQLNCLRRRDAGLLNQLQELDKQISDLRLDVEKTSEEHLETDSRPSSGE

SEQ ID NO: 916931 - protein, 145 aa, Homo sapiens
MAREQVVGPFPSLGPLPAEGRAGGLVSTSCLCQPVGPAAPLMTQVSSPPFPFRKRPCHNRRKRKAVSPYAFPGSLFKSGSSGGGFTLLSNSFISGFLPGFGAEGFFYRFATSFSPFLIWPSRKYCGHSQGTKKKERRGRLDGTQM

SEQ ID NO: 916932 - protein, 161 aa, Homo sapiens
SHEVGINMPILEKRSLRSRTAKYLQKQRLRFVSLSYNSKLCLILKTHDNIQSPPVEPPKPPAAPATSILSSPNSESPQCLPPTSDPKLLRIYRTLRKAVNLYPFPYLQRGVLQQGRPACAKAQRRQDTMGYFRSCLYFSMTQPDRTSRTNMQGKVTTKPGV

SEQ ID NO: 916933 - protein, 154 aa, Homo sapiens
WEIVDEMLEAHKGKGKSSLAEKTRNSESSLVPGSYGGKAHRMNAKTQLLWAACVLTGGPGLVSWGLLFLLKHISQIYPQLLLHVPSDPHSSSSFLSPRDSRKDFFCKYHQECGEWERGKHFHFHFFYIFICMINKEKKIHIALLKHYSYLVFGT

SEQ ID NO: 916934 - protein, 153 aa, Homo sapiens
MVKVPAPCTAQRLSTGKRHCESGLIFRRININRKQLALGADVEKMHRNKGCLQFRRFNETVNVKPLAHCRCSLQVAISTSGSVCRRKPWPECGQQVLVISQVLNMAGGQGEQKQALGTGKGIYSYVRGIRFAGAALDRNQCSSSGHLWHPSRG

SEQ ID NO: 916935 - protein, 185 aa, Homo sapiens
MFPYEPVQPSSGHLPPEVWRERHEQEPGLRAALVGQLEFRVGVGLAGRTRSSQLALPAPGNEGLSTRASGCRGCTGSPSSASPQALCSISHRALAAFPRGRAGDLQPAMPEPPTCSMGSYAARASPMSAAPCSTAPSPIDHPRAEECERTARDWQAAPPAALVRDPLGEASWAPESGGAVENLYV

SEQ ID NO: 916936 - protein, 185 aa, Homo sapiens; identical to SEQ ID NO: 916935

SEQ ID NO: 916937 - protein, 261 aa, Homo sapiens
MRQHQLSEPAPAYHRITPTITNFALRLYKELAADAPGNIFFSPVSISTTLALLSLGAQANTSALILEGLGFNLTETPEADIHQGFRSLLHTLALPSPKLELKVGNSLFLDKRLKPRQHYLDSIKELYGAFAFSANFTDSVTTGRQINDYLRRQTYGQVVDCLPEFSQDTFMVLANYIFFKAKWKHPFSRYQTQKQESFFVDERTSLQVPMMHQKEMHRFLYDQDLACTVLQIEYRGNALALLVLPDPGKMKQVELLCSHRP

SEQ ID NO: 916938 - protein, 171 aa, Homo sapiens
MDDSFGRITVHEESKSISRLFILLSLLTGIEEKAPASSIAAYQRYLEGEHPDGRDRPDKGLRQETAGAFEDSKKALQLEHPKCLTHRKSSLDAGHDGSDDNDSDQRGKFTLKSSWCLMENFEKVVVMNQFNGWSISCKGSYLEKEDFRIVCMSGQSKEEFSNCCLKTHSLL

SEQ ID NO: 916939 - protein, 178 aa, Homo sapiens
AVVPRLPSGRGFGAGMGGIFQGGPGAGSRRPPSTVLGQESAHARGDLCARVLCRLLPQLNNLVVTRKQRDFYVTSSWQEAPLPTLTSRSPWQLLLGHHWHQIVSLKGHTAARADKQFHGNKPSIWDTCSRNQPPSCEKSKPQSEARNSCCSQEPQLSSQPTFSITASHGNFQEPFTLL

SEQ ID NO: 916940 - protein, 172 aa, Homo sapiens
MEKKLKEAGHLQTSHNPWQPLQKRLPLREDERGPLAPNPRLTDAANAPPKVPSTQHACGQHSHKREAQNRKSEHLMFAAHSERAKHHSRILANIRMVTPEDNPPSPHSQQRKQRNTEVNFPRSHNWDMALTVSSTSDVTESITSGDEQKLRARLFNPQITDEETEVQREMYE

SEQ ID NO: 916941 - protein, 172 aa, Homo sapiens; identical to SEQ ID NO: 916940

SEQ ID NO: 916942 - protein, 135 aa, Homo sapiens
MSSHVVRGSIPEEGTVIIGDDSSVHVIASKHLPVAQDVELEDSDTDDPDPVCWSLLEVHFRTYLPGYHQGRLQNSKYCCLVLPLDASSQRGTRLYEVSVGPYWEVSPSQATRVRRHPALLQLTLHGLHPLSNQSQ

SEQ ID NO: 916943 - protein, 171 aa, Homo sapiens
MFHLDSDKLGPKLGATGVSCLLIRLGVGQLLNERLQWFAGADVTKYHTLGGLNSRNLLSQFWSHNILLTQSLIQSKTLTLFNSMKTEREEEAVEKLETNKGWLTRFKERSHLHNMKVQGEAASADIEAAASYPDDLEISTAIPSFSNHHPDESAAINIEARLSTSKKIMVH

SEQ ID NO: 916944 - protein, 167 aa, Homo sapiens
FDDFEAVAHAWYLEAGCPQRQESSVSSVTCSSVMEKMKHLAASGGAQKGQVLYNPSNNGLAITLTFEKNEAKANRTDAEAYNCRIVWGKNLRLWAVDSARARRPRMGAGDVDFSKWSWYHNFSSRFLYQGLAKGQVPNEKCIHIYELSDEFPLFFSVMNRSTCPQQK

SEQ ID NO: 916945 - protein, 149 aa, Homo sapiens
MMCRWCFRGAPRFSCRWPLGAGPAQMSLIVRKPPLARLVQDASDGASGQFWCGLSECSDKAQRMSRAEKSPADHPRGGQISAWTRKTCPCPKHLRRVGSVSATAGSRETQVRKTVVRCMDPGQSLFCDLLHNPTSGSGLGSQQEFSDDE

SEQ ID NO: 916946 - protein, 244 aa, Homo sapiens
MVALSLKICVRHCNVVKTMQFEPSTAVYDACRVIRERVPEAQTGQVFDRQLRNWIPSKSDILEYKKKQRPQKIRMLDGSVKTVMVDDSKTVGELLVTICSRIGITNYEEYSLIQETIEEKKEEGTGTLKKDRTLLRDERKMEKLKAKLHTDDDLNWLDHSRTFREQGVDENETLLLRRKFFYSDQNVDSRDPVQLNLLYVQARDDILNGSHPVSFEKACEFGGFQAQIQFGPHVEHKHKPGFLE

SEQ ID NO: 916947 - protein, 191 aa, Homo sapiens
MALNSALTEVDCPPCPVPSCPSPFSPGYYSALAAPSTEPHHPVPTVEPAFLGQHPKFQTFHGFFSTSQFGTLWQVSVLAWPQGPVETGPAVLQPWAQAVAGREAVQRQQGWEEQLDTQSIVTTAEGKLQPCRSPLLHFAKTSQRRTAGLPRGPSPASLSSKSEWRPLPVYLALSSGPALHSSLYNFFYLDL

SEQ ID NO: 916948 - protein, 235 aa, Homo sapiens
MAMENVFPAEPELEIKFWRTLGKTGKDSTKVHIQGGSNSCRYPLGMGNHGYRKYMSCLLVLVVESQCPQPMCLRLGKEEVAADQAPGWWEGDSAWSGGVRDTDAQEEAWAKLLKALAVNTAAGLTSSTHSKTMSMAPMSFYGNLRVNGLSQTYADIFLEGCGCSHTDLTVQEARLQYLHLVRALVRFHSWWKVKGRWPAEITGQEVLDSAIHKRNMSYNYWNEETVMITDQLSQK

SEQ ID NO: 916949 - protein, 154 aa, Homo sapiens
MRTMKNSQAESEGNNNHTCPRGVMTIHKKPEQKGQANLPQTGVKPESMLSGNEGRLGENLSREPSSAVSRPMTNRSNKMTQCDITSILGGTARHSYFKIMKSVVAKLQDGRMIPPPEVTKFSVTVTGKRQPIQYFRASYIIFPSIQNGKNTSQT

SEQ ID NO: 916950 - protein, 1216 aa, Homo sapiens
WPGRLLHWLLRVLESQEESGMEEVERQGPGRQRPSLPCVAIVPYRPRKMGLMVSENESNGGENKYSEKTITGMKVVVAEGYKVQGRMGGGPLSDGLSRAGSGSPSVPCCRMAFCREMYYDGFHRSFCDTDDLETVHESDCIFAFETPEIFRPEGILSQRGLLFFCSTPVVINASVLPGNWLEMQILGPYSTPSKGETLVNKPFRAQMPCWENHCSLQSCQTRTFKSAEAVCCLLFSYALPTEVESIEAAGLAELYSLSQLPLARKGKSPDPLSFPGIHLNNNLNHLKFGLDYHRLSSPTQTAAKQGKMDSPTSRAGSDKIVLLVCNRACTGQQGKRFGLPFVLHLEKTIAWDLLQKEILEKMKYFLRPTVCIQVCPFSLRVVSVVGITYLLPQEEQPLCHPIVERALKSCGPGGTAHVKLVVEWDKETRDFLFVNTEDEYIPDAESVRLQRERHHQPQTCTLSQCFQLYTKEERLAPDDAWRCPHCKQLQQGSITLSLWTLPDVLIIHLKRFRQEGDRRMKLQNMVKFPLTGLDMTPHVVKRSQSSWSLPSHWSPWRRPYGLGRDPEDYIYDLYAVCNHHGTMQGGHYTAYCKNSVDGLWYCFDDSDVQQLSEDEVCTQTAYILFYQRRTAIPSWSANSSVAGSTSSSLCEHWVSRLPGSKPASVTSAASSRRTSLASLSESVEMTGERSEDDGGFSTRPFVRSVQRQSLSSRSSVTSPLAVNENCMRPSWSLSAKLQMRSNSPSRFSGDSPIHSSASTLEKIGEAADDKVSISCFGSLRNLSSSYQEPSDSHSRREHKAVGRAPLAVMEGVFKDESDTRRLNSSVVDTQSKHSAQGDRLPPLSGPFDNNNQIAYVDQSDSVDSSPVKEVKAPSHPGSLAKKPESTTKRSPSSKGTSEPEKSLRKGRPALASQESSLSSTSPSSPLPVKVSLKPSRSRSKADSSSRGSGRHSSPAPAQPKKESSPKSQDSVSSPSPQKQKSASALTYTASSTSAKKASGPATRSPFPPGKSRTSDHSLSREGSRQSLGSDRASATSTSKPNSPRVSQARAGEGRGAGKHVRSSSMASLRSPSTSIKSGLKRDSKSEDKGLSFFKSALRQKETRRSTDLGKTALLSKKAGGSSVKSVCKNTGDDEAERGHQPPASQQPNANTTGKEQLVTKDPASAKHSLLSARKSKSSQLDSGVPSSPGGRQSAEKSSKKLSSSMQTSARPSQKPQ

SEQ ID NO: 916951 - protein, 652 aa, Homo sapiens
WPGRLLHWLLRVLESQEESGMEEVERQGPGRQRPSLPCVAIVPYRPRKMGLMVSENESNGGENKYSEKTITGMKVVVAEGYKVQGRMGGGPLSDGLSRAGSGSPSVPCCRMAFCREMYYDGFHRSFCDTDDLETVHESDCIFAFETPEIFRPEGILSQRGLLFFCSTPVVINASVLPGNWLEMQILGPYSTPSKGETLVNKPFRAQMPCWENHCSLQSCQTRTFKSAEAVCCLLFSYALPTEVESIEAAGLAELYSLSQLPLARKGKSPDPLSFPGIHLNNNLNHLKFGLDYHRLSSPTQTAAKQGKMDSPTSRAGSDKIVLLVCNRACTGQQGKRFGLPFVLHLEKTIAWDLLQKEILEKMKYFLRPTVCIQVCPFSLRVVSVVGITYLLPQEEQPLCHPIVERALKSCGPGGTAHVKLVVEWDKETRDFLFVNTEDEYIPDAESVRLQRERHHQPQTCTLSQCFQLYTKEERLAPDDAWRCPHCKQLQQGSITLSLWTLPDVLIIHLKRFRQEGDRRMKLQNMVKFPLTGLDMTPHVVKRSQSSWSLPSHWSPWRRPYGLGRDPEDYIYDLYAVCNHHGTMQGGHYTGLQCERLRVCAGESFRRVCLWQGDLTLEPHFPSGRQCANCEGSFHPLDLCPRANKRTFFLLFL

SEQ ID NO: 916952 - protein, 419 aa, Homo sapiens
WPGRLLHWLLRVLESQEESGMEEVERQGPGRQRPSLPCVAIVPYRPRKMGLMVSENESNGGENKYSEKTITGMKVVVAEGYKVQGRMGGGPLSDGLSRAGSGSPSVPCCRMAFCREMYYDGFHRSFCDTDDLETVHESDCIFAFETPEIFRPEGILSQRGLLFFCSTPVVINASVLPGNWLEMQILGPYSTPSKGETLVNKPFRAQMPCWENHCSLQSCQTRTFKSAEAVCCLLFSYALPTEVESIEAAGLAELYSLSQLPLARKGKSPDPLSFPGIHLNNNLNHLKFGLDYHRLSSPTQTAAKQGKMDSPTSRAGSDKIVLLVCNRACTGQQGKRFGLPFVLHLEKTIAWDLLQKEILEKMKYFLRPTVCIQVCPFSLRVVSVVGITYLLPQEEQPLCHPIVERHKSTWQLPWQLRGN

SEQ ID NO: 916953 - protein, 1216 aa, Homo sapiens; identical to SEQ ID NO: 916950

SEQ ID NO: 916954 - protein, 1216 aa, Homo sapiens; identical to SEQ ID NO: 916950

SEQ ID NO: 916955 - protein, 153 aa, Homo sapiens
MCADYFLNIVKADENLPRTAVKDPFVLWAPISVSSPTRDCQKHFSGTSSRIAECRALLISVFHQCLAWKDPTTLPTISAVHLFPILPHGDIQPFTRVTVHWGKGNDQTFWGLLDTGSELMLIPGDSKHHCGPPVKVGTYGEVPTPPFSMMSSP

SEQ ID NO: 916956 - protein, 143 aa, Homo sapiens
MTDKHPVASHSLPKGPLKDRACPDCTACSSTVLSKSLPLDVSFSERMSLVSNAWKATAFGHQVPLHPHQAAFPVLFLAPTLGQWTSQSVQITLHQGREAPDSYTLHQVHGDKGTRVIEAAGRMQFSSTLGVAALFLLCFPESL

SEQ ID NO: 916957 - protein, 143 aa, Homo sapiens; identical to SEQ ID NO: 916956

SEQ ID NO: 916958 - protein, 147 aa, Homo sapiens
SSLVYLSLGAGPVVPLALASMAMAAEAPIYQLPLTHDQGYPAASSLFHSPETSNNHGVGTHGATQSFSQPARSTAISCIGAYRQYKLCNTNVCPESSRSIREVQCASYNNKPFMGRFYEWEPFAEGKNRPSPVHRSYFSLFSILVDF

SEQ ID NO: 916959 - protein, 158 aa, Homo sapiens
MAARNIREMSPRRGIGPHLSYGLKTEKGQAVTSGEKRREETMVSRGGSVFRSPGEEGEGSAHPENSKVASVPGVTNSGFESKCEVYQVKLSLRVKSEFVFVNALVTRVSFSPKKEIHVWLKFPGEHRRGGNIAINQMSFGNEGGSEGRSKQKPNSPFR

SEQ ID NO: 916960 - protein, 134 aa, Homo sapiens
MRVPRVLLDPKGQGWQAALQCFIRQTMHSTWSSPVAHQGHMGVQGPSDGCRQVARVGFLLLLSDPSQKEAISLQLVPNWSSQNIYSVAAAVELHRPVPGTFSRQIRPVENSGHSGLHTHFRTKGKEHGIREAGA

SEQ ID NO: 916961 - protein, 728 aa, Homo sapiens
MWDVEGTSEVKDCVSQFVAEMMVATLAPEARPCLCVSSRDEDLINKCGDDARIYIVFQYHLIIFVLIICIPSLGIILPINYTGSVLDWSSHFARTTIVNVSTESKLLWLHSLLSFFYFITNFMFMAHHCLGFAPRNSQKVTRTLMITYVPKDIEDPELIIKHFHEAYPGSVVTRVHFCYDVRNLIDLDDQRRHAMRGRLFYTAKAKKTGKVMIRIHPCARLCFCKCWTCFKEVDAEQYYSELEEQLTDEFNAELNRVPLKRLDLIFVTFQDSRMAKRVRKDYKYVQCGVQPQQSSVTTIVKSYYWRVTMAPHPKDIIWKHLSVRRFFWWARFIAINTFLFFLFFFLTTPAIIMNTIDMYNVTRPIEKLQNPIVTQFFPSVMLWGFTVILPLIVYFSAFLEAHWTRSSQNLVMVHKCYIFLVFMVVILPSMGLTSLDVFLRWLFDIYYLEQASIRFQCVFLPDNGAFFVNYVITAALLGTGMELLRLGSLFCYSTRLFFSRSEPERVNIRKNQAIDFQFGREYAWMMNVFSVVMAYSITCPIIVPFGLLYLCMKHLTDRYNMYYSFAPTKLNEQIHMAAVSQAIFAPLLGLFWMLFFSILRLGSLHAITIFSLSTLLIAMVIAFVGIFLGKLRMVADYEPEEEEIQTVFDMEPSSTSSTPTSLLYVATVLQEPELNLTPASSPARHTYGTMNNQPEEGEEESGLRGFARELDSAQFQEGLELEGQNQYH

SEQ ID NO: 916962 - protein, 109 aa, Homo sapiens
QGASFSLPPLHHPVVTRGGPDGANWHEALLVPLRVDYGTFSHGHYRMVEQGASFSLPPPPHPGPLRHLLPQPTPASPIAPLPPPTAIPLLCQPLPSRPTPLHPPNHLLT

SEQ ID NO: 916963 - protein, 728 aa, Homo sapiens; identical to SEQ ID NO: 916961

SEQ ID NO: 916964 - protein, 155 aa, Homo sapiens
MISVFSPEPCRLLCAPWKGRSTVSSGCVRSGALCTPHRERSLQRTERRQKEKTRKGKRAAYLAGLLCAKPLSDTPYDPQHCGNPSTESAFSITGLCFAPQTHAWSLGCGTYRSPVLRNTDHPTGARTQQSGRRGCLTEEGKSQEGGTWAQSSQLR

SEQ ID NO: 916965 - protein, 107 aa, Homo sapiens
MISVFSPEPCRLLCAPWKGRSTVSSGCVRSGALCTPHRERSLQRTERRQKEKTRKGKRAAYLAGLLCAKPLSDTPYDPQHCGNPRAAPALSPSPPQGHTNCGVPAIT

SEQ ID NO: 916966 - protein, 150 aa, Homo sapiens
FHFIQSCLQLEMQTPTLLISGHSCCEHTVPGTHILPCSWPDDKTGRNCGQVRPKGTSDQYFSGGQRDKQNPEVGIYLGDNVSESNGCNEMCCESELGRETAGTGDVESFLVKNDSIGNFISEQVEGKLEGPERTTGLAATAGRRKGNTRS

SEQ ID NO: 916967 - protein, 308 aa, Homo sapiens
MKKNTSKTTMRINKQDALCTPHSHDPRDLQNMLDGGEYAPFVSPPMLESNFIQVNRRGESIYLHNRANWVTVGICFSSSTHKIPNVMLLAHLTPGAQKDTETLFKSLLTSPPAEKLVLTRFLPLQFVTLSVHDAENMSLKVKLVSGRAYYLQLCTSAYKQDTLFSQWVALISLLNQEKAKVSKVSEVSSLSGITNSTDITGSMDVTDVTTFTAILTPYMYAGTGPEHVRDSIDFPEFTDITDITDVTDLPENEVPEVPDVRIVTEVIEVREATEVTDSSDITNCSGVTVVFENNDLIRAKQEEKELEN

SEQ ID NO: 916968 - protein, 222 aa, Homo sapiens
MLLAHLTPGAQKDTETLFKSLLTSPPAEKLVLTRFLPLQFVTLSVHDAENMSLKVKLVSGRAYYLQLCTSAYKQDTLFSQWVALISLLNQEKAKVSKVSEVSSLSGITNSTDITGSMDVTDVTTFTAILTPYMYAGTGPEHVRDSIDFPEFTDITDITDVTDLPENEVPEVPDVRIVTEVIEVREATEVTDSSDITNCSGVTVVFENNDLIRAKQEEKELEN

SEQ ID NO: 916969 - protein, 321 aa, Homo sapiens
VKAGETPLTGTSYLPEALAARRARGWGPGRSGPGRRARAPSRPPVAPASEAAPGRGRGLTLRYNSGRAARAGRHRRPQSLSPVLSLSPDSMSFTTRSTFSTNYRSLGSVQAPSYGARPVSSAASVYAGAGGSGSRISVSRSTSFSGAAWGPGGLATGIAGGLAGMGGIQNEKETMQSLNDRLASYLDRVRSLETENRRLESKIREHLEKKGPQVRDWSHYFKIIEDLRAQIFANTVDNARIVLQIDNARLAADDFRVKYETELAMRQSVENDIHGLRKVIDDTNITRLQLEDRDRGSQGGAALHERRTTKRQAGATGQARD

SEQ ID NO: 916970 - protein, 222 aa, Homo sapiens
MSFTTRSTFSTNYRSLGSVQAPSYGARPVSSAASVYAGAGGSGSRISVSRSTSFSGAAWGPGGLATGIAGGLAGMGGIQNEKETMQSLNDRLASYLDRVRSLETENRRLESKIREHLEKKGPQVRDWSHYFKIIEDLRAQIFANTVDNARIVLQIDNARLAADDFRVKYETELAMRQSVENDIHGLRKVIDDTNITRLQLEDRDRGSQGGAALHERRTTKRK

SEQ ID NO: 916971 - protein, 312 aa, Homo sapiens
VKAGETPLTGTSYLPEALAARRARGWGPGRSGPGRRARAPSRPPVAPASEAAPGRGRGLTLRYNSGRAARAGRHRRPQSLSPVLSLSPDSMSFTTRSTFSTNYRSLGSVQAPSYGARPVSSAASVYAGAGGSGSRISVSRSTSFSGAAWGPGGLATGIAGGLAGMGGIQNEKETMQSLNDRLASYLDRVRSLETENRRLESKIREHLEKKGPQVRDWSHYFKIIEDLRAQIFANTVDNARIVLQIDNARLAADDFRVKYETELAMRQSVENDIHGLRKVIDDTNITRLQLEDRDRGSQGGAALHERRTTKRK

SEQ ID NO: 916972 - protein, 312 aa, Homo sapiens; identical to SEQ ID NO: 916971

SEQ ID NO: 916973 - protein, 312 aa, Homo sapiens; identical to SEQ ID NO: 916971

SEQ ID NO: 916974 - protein, 312 aa, Homo sapiens; identical to SEQ ID NO: 916971

SEQ ID NO: 916975 - protein, 222 aa, Homo sapiens; identical to SEQ ID NO: 916970

SEQ ID NO: 916976 - protein, 312 aa, Homo sapiens; identical to SEQ ID NO: 916971

SEQ ID NO: 916977 - protein, 222 aa, Homo sapiens; identical to SEQ ID NO: 916970

SEQ ID NO: 916978 - protein, 312 aa, Homo sapiens; identical to SEQ ID NO: 916971

SEQ ID NO: 916979 - protein, 312 aa, Homo sapiens; identical to SEQ ID NO: 916971

SEQ ID NO: 916980 - protein, 312 aa, Homo sapiens; identical to SEQ ID NO: 916971

SEQ ID NO: 916981 - protein, 312 aa, Homo sapiens; identical to SEQ ID NO: 916971

SEQ ID NO: 916982 - protein, 312 aa, Homo sapiens; identical to SEQ ID NO: 916971

SEQ ID NO: 916983 - protein, 233 aa, Homo sapiens
IRLGTRLGGRNMSFTTRSTFSTNYRSLGSVQAPSYGARPVSSAASVYAGAGGSGSRISVSRSTSFSGAAWGPGGLATGIAGGLAGMGGIQNEKETMQSLNDRLASYLDRVRSLETENRRLESKIREHLEKKGPQVRDWSHYFKIIEDLRAQIFANTVDNARIVLQIDNARLAADDFRVKYETELAMRQSVENDIHGLRKVIDDTNITRLQLEDRDRGSQGGAALHERRTTKRK

SEQ ID NO: 916984 - protein, 330 aa, Homo sapiens
VKAGETPLTGTSYLPEALAARRARGWGPGRSGPGRRARAPSRPPVAPASEAAPGRGRGLTLRYNSGRAARAGRHRRPQSLSPVLSLSPDSMSFTTRSTFSTNYRSLGSVQAPSYGARPVSSAASVYAGAGGSGSRISVSRSTSFSGAAWGPGGLATGIAGGLAGMGGIQNEKETMQSLNDRLASYLDRVRSLETENRRLESKIREHLEKKGPQVRDWSHYFKIIEDLRAQIFANTVDNARIVLQIDNARLAADDFRVKYETELAMRQSVENDIHGLRKVIDDTNITRLQLEDRDRGSQGGAALHERRTTKRCPQISGPRQDHGRHSGAQY

SEQ ID NO: 916985 - protein, 148 aa, Homo sapiens
MGGIQNEKETMQSLNDRLASYLDRVRSLETENRRLESKIREHLEKKGPQVRDWSHYFKIIEDLRAQIFANTVDNARIVLQIDNARLAADDFRVKYETELAMRQSVENDIHGLRKVIDDTNITRLQLEDRDRGSQGGAALHERRTTKRK

SEQ ID NO: 916986 - protein, 178 aa, Homo sapiens
MSFTTRSTFSTNYRSLGSVQAPSYGARPVRMGGIQNEKETMQSLNDRLASYLDRVRSLETENRRLESKIREHLEKKGPQVRDWSHYFKIIEDLRAQIFANTVDNARIVLQIDNARLAADDFRVKYETELAMRQSVENDIHGLRKVIDDTNITRLQLEDRDRGSQGGAALHERRTTKRK

SEQ ID NO: 916987 - protein, 109 aa, Homo sapiens
MPPNLRTSPRSWQTFRGPILTELARKNREELDKYWSQQIEESTTVVTTQSAEVGAAETTLTELRRTVQSLEIDLDSMRNLKASLENSLREVEARYALQMEQLNGDPAAP

SEQ ID NO: 916988 - protein, 103 aa, Homo sapiens
QFSSVPVTFRGPILTELARKNREELDKYWSQQIEESTTVVTTQSAEVGAAETTLTELRRTVQSLEIDLDSMRNLKASLENSLREVEARYALQMEQLNGDPAAP

SEQ ID NO: 916989 - protein, 322 aa, Homo sapiens
VKAGETPLTGTSYLPEALAARRARGWGPGRSGPGRRARAPSRPPVAPASEAAPGRGRGLTLRYNSGRAARAGRHRRPQSLSPVLSLSPDSMSFTTRSTFSTNYRSLGSVQAPSYGARPVSSAASVYAGAGGSGSRISVSRSTSFSGAAWGPGGLATGIAGGLAGMGGIQNEKETMQSLNDRLASYLDRVRSLETENRRLESKIREHLEKKGPQVRDWSHYFKIIEDLRAQIFANTVDNARIVLQIDNARLAADDFRVKYETELAMRQSVENDIHGLRKVIEFWNHQYHTTVKAVGETEIGAPQKEELASFHETQQNQRKRRK

SEQ ID NO: 916990 - protein, 222 aa, Homo sapiens; identical to SEQ ID NO: 916970

SEQ ID NO: 916991 - protein, 79 aa, Homo sapiens
MVLLGEFVVLLGEFVVLLGEFVVLLGEFVVLLRRIRGAAETTLTELRRTVQSLEIDLDSMRNLVSAFTSAAQLLLHLAS

SEQ ID NO: 916992 - protein, 312 aa, Homo sapiens; identical to SEQ ID NO: 916971

SEQ ID NO: 916993 - protein, 312 aa, Homo sapiens; identical to SEQ ID NO: 916971

SEQ ID NO: 916994 - protein, 312 aa, Homo sapiens; identical to SEQ ID NO: 916971

SEQ ID NO: 916995 - protein, 246 aa, Homo sapiens
MGQYRPGYRRKQSLSPVLSLSPDSMSFTTRSTFSTNYRSLGSVQAPSYGARPVSSAASVYAGAGGSGSRISVSRSTSFSGAAWGPGGLATGIAGGLAGMGGIQNEKETMQSLNDRLASYLDRVRSLETENRRLESKIREHLEKKGPQVRDWSHYFKIIEDLRAQIFANTVDNARIVLQIDNARLAADDFRVKYETELAMRQSVENDIHGLRKVIDDTNITRLQLEDRDRGSQGGAALHERRTTKRK

SEQ ID NO: 916996 - protein, 312 aa, Homo sapiens; identical to SEQ ID NO: 916971

SEQ ID NO: 916997 - protein, 312 aa, Homo sapiens; identical to SEQ ID NO: 916971

SEQ ID NO: 916998 - protein, 312 aa, Homo sapiens; identical to SEQ ID NO: 916971

SEQ ID NO: 916999 - protein, 312 aa, Homo sapiens; identical to SEQ ID NO: 916971

SEQ ID NO: 917000 - protein, 312 aa, Homo sapiens; identical to SEQ ID NO: 916971

SEQ ID NO: 917001 - protein, 224 aa, Homo sapiens
MQSGCVSARPFSTNYRSLGSVQAPSYGARPVSSAASVYAGAGGSGSRISVSRSTSFSGAAWGPGGLATGIAGGLAGMGGIQNEKETMQSLNDRLASYLDRVRSLETENRRLESKIREHLEKKGPQVRDWSHYFKIIEDLRAQIFANTVDNARIVLQIDNARLAADDFRVKYETELAMRQSVENDIHGLRKVIDDTNITRLQLEDRDRGSQGGAALHEGRTTKRK

SEQ ID NO: 917002 - protein, 257 aa, Homo sapiens
AFYTHPYGRESCALFFAPGRICFLKYDSGFLALRCLRFLCDSDPRAPRLREPLSRDQDPAWQSLVMSMQLGSHLGAPSSPMLQYQITSTAGAAWGPGGLATGIAGGLAGMGGIQNEKETMQSLNDRLASYLDRVRSLETENRRLESKIREHLEKKGPQVRDWSHYFKIIEDLRAQIFANTVDNARIVLQIDNARLAADDFRVKYETELAMRQSVENDIHGLRKVIDDTNITRLQLEDRDRGSQGGAALHERRTTKRK

SEQ ID NO: 917003 - protein, 294 aa, Homo sapiens
VKAGETPLTGTSYLPEALAARRARGWGPGRSGPGRRARAPSRPPVAPASEAAPGRGRGLTLRYNSGRAARAGRHRRPQSLSPVLSLSPDSMSFTTRSTFSTNYRSLGSVQAPSYGARPVSSAASVYAGAGGSGSRISVSRSTSFSGAAWGPGGLATGIAGGLAGMGGIQNEKETMQSLNDRLASYLDRVRSLETENRRLESYFKIIEDLRAQIFANTVDNARIVLQIDNARLAADDFRVKYETELAMRQSVENDIHGLRKVIDDTNITRLQLEDRDRGSQGGAALHERRTTKRK

SEQ ID NO: 917004 - protein, 110 aa, Homo sapiens
LNEASRLVGGGAAALWNRRKLSRCSRCREVSQFDSPDCEWHCGVETRDNVVTMEDKGTTVVSELRRPRADVVRLERCPRESKASLENSLREVEARYALQMEQLNGDPAAP

SEQ ID NO: 917005 - protein, 89 aa, Homo sapiens
SSRGSRRFKGYRAEGQRQAQEYEALLNIKVKLEAEIATYRRLLEDGEDFNLGDALDSSNSMQTIQKTTTRRIVDGKVVSETNDTKVLRH

SEQ ID NO: 917006 - protein, 213 aa, Homo sapiens
MGIRGSINQWELPLYFPGAVFTGIFAAEMVLKLIAMDPYEYFQVGWNIFDSLIVTLSLVELFLADVEGLSVLRSFRLLRVFKLAKSWPTLNMLIKIIGNSVGALGNLTLVLAIIVFIFAVVGMQLFGKSYKECVCKINDDCTLPRWHMNDFFHSFLIVFRVLCGEWIETMWDCMEVAGQAMCLIVYMMVMVIGNLVVCNQMFMHFNFSVEIIL

SEQ ID NO: 917007 - protein, 183 aa, Homo sapiens
CRDCKLAMDEEVLGAETAAEWLLGLAWLRWHHEREAGDDVTWTFPAGNQSRINPAEPGSFTCCELRTAAGNLGKKVAWHGGARWLAVAVAAHAYSIKPWNRRCSGLAGEEEGRAVGLSCQGLSGLWLCSDLTILLPAGLEPRAFSGMLNLYISKDEAGSDPSLGQTASAQMPCQKTCYALVKS

SEQ ID NO: 917008 - protein, 143 aa, Homo sapiens
MRPPMKNAQVDMRRGQNPGEQHLERDSKEQEPLKETKKMVIQERGGPGVYDVEESFAMVHTSISQILGPPEKLMKPMVVKLSWLSLLRCPSQQHSAITHQDEFLHTSFCFTGTVCPRVNSSLSHQRPVRQGRRHSAVSLVRDL

SEQ ID NO: 917009 - protein, 144 aa, Homo sapiens
HLILPTMPNVRRITRLNSWQASRGDLQSFTKVTVHWGKGNYQTLWGQLYTGSELTLIPGDPKHYCGPPVKVGVHGGQIINGVLAQVQLTVGPVDSWTHPVVMSPVPECIIGIDILSSWQKLHIGFLSEHVKGKGNYAILQANEL

SEQ ID NO: 917010 - protein, 146 aa, Homo sapiens
MRPRRQELEGCGYKPRNIKTAGNTKSSGTGMEPVLPKDIRRCGPAATAILDFCLQNCADAESQGETNMGQATHLNKPVTVGTVVDDGQGLLESGSPNANNILQYLYDKEVEQLGGLRPDGAQLGVTALENLVTQSRTHVRSPFIEC

SEQ ID NO: 917011 - protein, 156 aa, Homo sapiens
MRVKGGRQPQGAGRVGLCQGNGGWAAERAGSSLTLPSPLGGWCLLSAALPSPHPPASKAATTWGGTRAQAQLLCAKNFDAFSYCVFTTAPGGRCCFHYPHFTEVDTAAQRASCSRAKNKEVSRMLREGQELRHLLAYWKLMQQGAGSQARVFVRSR

SEQ ID NO: 917012 - protein, 183 aa, Homo sapiens
MDPWEQLEGREMASSADRSWEEAGPFGSLLVGKVHQPLGRAGHHLELALGREAKAVNEEPCQQGMHDCLHFMDEETEAQRGVAKLVVSRVGAEPDLACLTVHVSPWLPSPPAQLLLPSWVLDGVIQLNLYSASLVGFKQPQEESFPWQDSPGERLPPHATLSSGSNKSQGLSCLPPLWGPLSC

SEQ ID NO: 917013 - protein, 179 aa, Homo sapiens
MKSKFLRRIAAAKSMRRNVDKSQPLINRSNTKRGTSDIECITTIDSYQNNEPEFDHASDITTSFQEIQRIEEMLNKTIIQQPAKTRMFEVCAMHSDVLPKSRMGKQGKKRNFTVKKANKHYFIQGIKGTASKKLHAPARTHKIKDVLPYAITYPEQVMKASFPLITGSADIAKPISLQN

SEQ ID NO: 917014 - protein, 179 aa, Homo sapiens; identical to SEQ ID NO: 917013

SEQ ID NO: 917015 - protein, 497 aa, Homo sapiens
MTYGFELSQLHRNDLMLGIFESPRGDPLGLAKERVNSFGDDEELSTSSDSDEEVIKQFEISVSRSQSFRSVTSEKGKQTGLEQKPKFSRSLLTHGEDGTEVSACEDLDGASQRRYSENLSYGEDDHIPAHSQSPCERGDAKHHGTSHQESSVVQSLRRQSTEGSLEMETAFNSRGFEDSYATDSSSMTNLQVPSGVSEPISKCGDLDVIFEYRAASQKLTVTIVRAQGLPDKDRSGVNSWQVHVVLLPGKKHRGRTNIQRGPNPVFREKVTFAKLEPRDVAACAVRFRLYAARKMTRERMMGEKLFYLSHLHPEGEMKVTLVLEPRSNISSGGSPLSPSAVSHSDSTSSTQSLSHGGAPELLVGLSYNATTGRLSVEMIKGSHFRNLAVNRAPDTYGKLFLLNSVGQEMSRCKTSIRRGQPNPVYKETFVFQVALFQLSDVTLMISVYNRRTMKRKEMIGWIALGQNSSGEEEQDHWEEMKETKGQQICRWHTLLES

SEQ ID NO: 917016 - protein, 167 aa, Homo sapiens
MYEGILIIKRRKYVNRKNIQLSQNSTLNQTAKFCLFKNIVMCHMTTFQSRRGCIHDNGGIPEESIVIIGDDSSMRVIAPEDLPVGEDVQVKDSDIDDPDPDPLHGKNSAEDTTTFIENILEQDSNCEQNGKCLKELPKLIIKIKRTLKEKLLCGEDGSSEVNPLESG

SEQ ID NO: 917017 - protein, 1716 aa, Homo sapiens
MFELELLSLASPSHPKATQTQIDAVCCRRCVSFILRTTIGGLLGEKAQLAAVKDICQAIWKLKKVMDAVMSDGNLETRLGSTDVAASQHMLVCALQELGNLIHNLGTTAAPLLQDSSTGLLDSILSVILHPSISVRLAAAWCLHCIAVALPSYLTPLLDRCLERLTGHKSSPEAVTGFSFAVAALLGAVKHCPLGIPHGKGKIIMTLAEDLLCSAAQNSRLSAQRTQAGWLLISALMTLGPAVVSHHLARVLLLWKCVFPASPKDLETEKSRGDSFTWQVTLEGRAGALCAIKSFVSHCGDLLTEEVTQRLLPPLPCAVDLLTQLSSILKMYGSPLKTPSVVYRQRLYELLILLPPETYEGNLCAILRELAADLTAPDIQVAASTFLLPPLCHQDDLLILSPFLQETDHRFIEEQLLLGNGVACGSLEYDPYSIYEKDVEGDSVPKPLPPALSVISSASKLFGVVCAHVGETQRLLILEQLLDSIKHTKGARQQVVQLHVVSSVSSFLKYVAGSKGCLGPEEMKRFALTLVMGALESPNPLLRCAAAESWARLAQVVDDGAFTAGLAQVSFDKLKSARDVVTRTGHSLALGSLHRYLGGISSSQHLNSCIGILYTLAQDSTSPDVQTWALHSLSLIIDSAGPLYYVHVEPTLSLIIMLLLNVPPTHAEVHQSLGRCLNALITTLGPELQGNSTSISTLRTSCLLGCAVMQDNPDCLVQAQAISCLQQLHMFAPRHVNLSSLVSCLCVNLCSPYLLLRRAVLACLRQLVQREAAEVSEHAVMLAKDSREELTPDANIREVGLEGALLILLDKETDERLCHDIKETLNYMLTSMAVEKLSLWLKLCKDVLAASADFTAVTCVDTMQEEEGDKGDDASVLTTRRDEKSHPFTNPRWATRVFAAECVCRIINQCENANSAHFDIALAQEMKKRDSRNDFLVLHLADLIRMAFMAATDHSDQLRLSGLEMLLVVIRRFATVPEPEFPGHVILEQYQANVGAALRPAFTSETPPDVTAKACQVCSAWIASGVVSDLNDLRRVHQLLVSSLTKIQAGKEALSHLYNESASTMEILAVLKAWAEVYIIAVQRHKNHRQPLKTTTCLEDGIRNGSCSSDGLLDLVYADLGTLSRLWLAALQDFALLTLPSEFASQLPAEGGAFYTAETSENAKLHYYNSWALILHATALWLTSTGFVVADPDEGASNLSRPVTPTSMCQGSSSGATIKSPEDVYTDRFHLILGISVEFLCSLRSDATMESITACLHALQALLDVPWPRSKIGSDQDLGIELLNVLHRVILTRESPSIQLASLEVVRQIICAAQEHVKEKRRSAEVDDGAAEKETLPEFGEGKDTGGLVPGKSLVFATLELCVCILVRQLPELNPKLTGSPGVKATKPQILLEDGSRLVSAALVILSELPAVCSPEGSISILPTILYLTIGVLRETAVKLPGGQLSSTVAASLQALKGILSSPMARAEKSRTAWTDLLRSALTTILDCWDPVDETHQELDEVSLLTAITVFILSTSPEVTTIPCLQKRCIDKFKATLEIKDPVVQIKTYQLLHSIFQYPNPAVSYPYIYSLASCIMEKLQEIDKRKPENTAELEIFQEGIKVLETLVTVAEEHHRAQLVACLLPILISFLLDENSLGSATSIMRNLHDFALQNLMQIGPQYSSVFKSLVASSPALKARLEAAIKGNQESVKVKIPTSKYTKSPGKNSSIQLKTSFL

SEQ ID NO: 917018 - protein, 876 aa, Homo sapiens
MFELELLSLASPSHPKATQTQIDAVCCRRCVSFILRTTIGGLLGEKAQLAAVKDICQAIWKLKKVMDAVMSDGNLETRLGSTDVAASQHMLVCALQELGNLIHNLGTTAAPLLQDSSTGLLDSILSVILHPSISVRLAAAWCLHCIAVALPSYLTPLLDRCLERLTGHKSSPEAVTGFSFAVAALLGAVKHCPLGIPHGKGKIIMTLAEDLLCSAAQNSRLSAQRTQAGWLLISALMTLGPAVVSHHLARVLLLWKCVFPASPKDLETEKSRGDSFTWQVTLEGRAGALCAIKSFVSHCGDLLTEEVTQRLLPPLPCAVDLLTQLSSILKMYGSPLKTPSVVYRQRLYELLILLPPETYEGNLCAILRELAADLTAPDIQVAASTFLLPPLCHQDDLLILSPFLQETDHRFIEEQLLLGNGVACGSLEYDPYSIYEKDVEGDSVPKPLPPALSVISSASKLFGVVCAHVGETQRLLILEQLLDSIKHTKGARQQVVQLHVVSSVSSFLKYVAGSKGCLGPEEMKRFALTLVMGALESPNPLLRCAAAESWARLAQVVDDGAFTAGLAQVSFDKLKSARDVVTRTGHSLALGSLHRYLGGISSSQHLNSCIGILYTLAQDSTSPDVQTWALHSLSLIIDSAGPLYYVHVEPTLSLIIMLLLNVPPTHAEVHQSLGRCLNALITTLGPELQGNSTSISTLRTSCLLGCAVMQDNPDCLVQAQAISCLQQLHMFAPRHVNLSSLVSCLCVNLCSPYLLLRRAVLACLRQLVQREAAEVSEHAVMLAKDSREELTPDANIREVGLEGALLILLDKETDERLCHDIKETLNYMLTSMAVEKLSLWLKLCKDVLAASAGKYWTLSVKIIKLKFETLHKIVYH

SEQ ID NO: 917019 - protein, 324 aa, Homo sapiens
MFELELLSLASPSHPKATQTQIDAVCCRRCVSFILRTTIGGLLGEKAQLAAVKDICQAIWKLKKVMDAVMSDGNLETRLGSTDVAASQHMLVCALQELGNLIHNLGTTAAPLLQDSSTGLLDSILSVILHPSISVRLAAAWCLHCIAVALPSYLTPLLDRCLERLTGHKSSPEAVTGFSFAVAALLGAVKHCPLGIPHGKGKIIMTLAEDLLCSAAQNSRLSAQRTQAGWLLISALMTLGPAVVSHHLARVLLLWKCVFPASPKDLETEKSRGDSFTWQVTLEGRAGALCAIKSFVSHCGDLLTEEVTQRLLPPLPCAVDLLTQ

SEQ ID NO: 917020 - protein, 1716 aa, Homo sapiens; identical to SEQ ID NO: 917017

SEQ ID NO: 917021 - protein, 260 aa, Homo sapiens [sequence omitted]

SEQ ID NO: 917022 - protein, 147 aa, Homo sapiens
MPESSESQDLPPAQASVLGTSHAPNSPTVFPGLPAPALGDHQWDGVWQDQPCSGRGRPLPTWAQPWDQNEPEHSSHLRRVPGTGAAVHGLARGRGYRGNGFRYRALDTSLVLCVFSDAAFVHLASINHRAELTATLFLSSLPSRTCL

SEQ ID NO: 917023 - protein, 308 aa, Homo sapiens
MVRDALVSLADRKFFAGGVCRTNVQLPGKVVVITGANTGIGKETARELASRGARVYIACRDVLKGESAASEIRVDTKNSQVLVRKLDLSDTKSIRAFAEGFLAEEKQLHILINNAGVMMCPYSKTADGFETHLGVNHLGNTREKNVILGWGSGSTRLARQGQTWGYAGIWAWLEGSHLHDGQPSHGLVHGGHFLLTYLLLERLKVSAPARVVNVSSVAHHIGKIPFHDLQSEKRYSRGFAYCHSKLANVLFTRELAKRLQEMIKIPLSMIDTTHYMLSCLLVVLKPQYKNDIEIEGPRTRHSFWNIEG

SEQ ID NO: 917024 - protein, 307 aa, Homo sapiens
MFNSIPGSYILDGQQPPPPPPPSVMTIQTRPNVPCKEIFSPVDNNWPNARRSVSGSPESDELQELRTRSAKKRRKNALIRHKSIAEVSQNLRQIEIPKVSKRATKKENSHPAPQQPSQPVKDTVQEVTKVRRNLFNQELLSPSKRSLKRGLPRSHSVSAVDGLEDKLDNFKKNKGYHKLLTKSVAETPVHKQISKRLLHRQIKGRSSDPGPDIGVVEESPEKGDEISLRRSPRIKQLSFSRTHSASFYSVSQPKSRSVQRVHSFQQDKSGNIRAPLPSQVRADLVRSVFGKRSKKFDIFFLDIGEVE

SEQ ID NO: 917025 - protein, 369 aa, Homo sapiens
MLALRLLNVVAPAYFLCISLVTFVLQLFLFLPSMREDPAAARLFSPALLHGALFLFLSANALGNYVLVIQNSPDDLGACQGASARKTPCPSPSTHFCRVCARVTLRHDHHCFFTGNCIGSRNMRNFVLFCLYTSLACLYSMVAGVAYISAVLSISFAHPLAFLTLLPTSISQFFSVPGKNPVGNGFHPPRLVPGAVLQGRPKLDSSDVLTSQLEGHLCLSAFLTPKSTMDLGSSIPHMAAQANLCRHGRKEVIGLPYREPKAKEYFRINSRVQCPGCWVGQGAVLGSEMFVILMLYLWFAIGLACAGFCCHQLLLILRGQTRHQVRKGVAVRARPWRKNLQEVFGKRWLLGLLVPMFNVGSESSKQQDK

SEQ ID NO: 917026 - protein, 369 aa, Homo sapiens; identical to SEQ ID NO: 917025

SEQ ID NO: 917027 - protein, 172 aa, Homo sapiens
GAGGCPAAIPAASWPLLAGAQVGSQQLPAPSSPHPRYLPSSRSEAQAASQPGRVHNFAASGRARAGVRGSSCRRPELGELISSPLCDGGSAAAAARGAASRASGRQWPRSPRLPALPVFPRLRLCRPLPRARRAPGLNGQLPTPRGPTGGLCCPFSRAGPGLRLPAERPSLP

SEQ ID NO: 917028 - protein, 206 aa, Homo sapiens
RAVTPTGWSDPVWPLPWGFSCVFLGLEAPAGPTQAVGRRLPCWGFFDRVLGVRGPGPEHQGPQWEEPGVGMPPTSPAATAGGPRSLNNPCIKITVTRHTCPGWGITHANLQTIPDTQGQEGPREDVTHPGGDLDGVANFYLEEEGFQDGRCQKMVLMSEEGPPSLTGCPRVQCPQSNKFKLSKSMQRILRRVHENSRPAVGGLQMP

SEQ ID NO: 917029 - protein, 180 aa, Homo sapiens
ATRIGNQLSGGMEFSEGDRINLAFPGGTFCPAERECGHERAPKGKEERRQEKSWGGTVLGQAFKPVFALNCGQSGLCGLPASVDCLECGFIGEESSPTLADFGSDPSGLALQVLFGGRQDSAACSKCSQASGHDEWLLRCAFLLAPGRRGCSWVSAWWGDDTGIYCVLNKCAFCWVRPSL

SEQ ID NO: 917030 - protein, 812 aa, Homo sapiens
GANMGLSNKRRLSRGSGGMEALTTQLGPGREGSSSPNSKQELQPYSGSSALKPNQVGETSLYGVPIVSLVIDGQERLCLAQISNTLLKNYSYNEIHNRRVALGITCVQCTPVQLEILRRAGAMPISSRRCGMITKREAERLCKSFLGEHKPPKLPENFAFDVVHECAWGSRGSFIPARYNSSRAKCIKCGYCSMYFSPNKFIFHSHRTPDAKYTQPDAANFNSWRRHLKLSDKSATDELSHAWEDVKAMFNGGTRKRTFSLQGGGGGGANGGSGGQGKGGAGGGGGGGPGCGAEMAPGPPPHKSLRCGEDEAAGPPGPPPPHPQRGLGLATGASGPAGPGGPGGGAGVRSYPVIPVPSKGFGLLQKLPPPLFPHPYGFPTAFGLCPKKDDPVLGAGEPKGGPGTGSGGGGAGTGGGAGGPGASHLPPGAGAGPGGGAMFWGHQPSGAAKDAAAVAAAAAAATVYPTFPMFWPAAGSLPVPSYPAAQSQAKAVAAAVAAAAAAAAAAAGSGAPEPLDGAEPAKESGLGAEERCPSALSRGPLDEDGTDEALPPPLAPLPPPPPPPARKGSYVSAFRPVVKDTESIAKLYGSAREAYGAGPARGPGPGAGSGGYVSPDFLSEGSSSYNSASPDVDTADEPEVDVESNRFPDDEDAQEETEPSAPSAGGGPDGEQPTGPPSATSSGADGPANSPDGGSPRPRRRLGPPPAGRPAFGDLAAEDLVRRPERSPPSGGGGYELREPCGPLGGPAPAKVSPAPAPPVAPSHLPCARQGCGAGRRTGILFRAGVGAAGLGHSPQAQPWARCETGPTRTLQ

SEQ ID NO: 917031 - protein, 824 aa, Homo sapiens
RRAGGSGLRRRSPRHLRHVAGSRRRALSGGMEALTTQLGPGREGSSSPNSKQELQPYSGSSALKPNQVGETSLYGVPIVSLVIDGQERLCLAQISNTLLKNYSYNEIHNRRVALGITCVQCTPVQLEILRRAGAMPISSRRCGMITKREAERLCKSFLGEHKPPKLPENFAFDVVHECAWGSRGSFIPARYNSSRAKCIKCGYCSMYFSPNKFIFHSHRTPDAKYTQPDAANFNSWRRHLKLSDKSATDELSHAWEDVKAMFNGGTRKRTFSLQGGGGGGANGGSGGQGKGGAGGGGGGGPGCGAEMAPGPPPHKSLRCGEDEAAGPPGPPPPHPQRGLGLATGASGPAGPGGPGGGAGVRSYPVIPVPSKGFGLLQKLPPPLFPHPYGFPTAFGLCPKKDDPVLGAGEPKGGPGTGSGGGGAGTGGGAGGPGASHLPPGAGAGPGGGAMFWGHQPSGAAKDAAAVAAAAAAATVYPTFPMFWPAAGSLPVPSYPAAQSQAKAVAAAVAAAAAAAAAAAGSGAPEPLDGAEPAKESGLGAEERCPSALSRGPLDEDGTDEALPPPLAPLPPPPPPPARKGSYVSAFRPVVKDTESIAKLYGSAREAYGAGPARGPGPGAGSGGYVSPDFLSEGSSSYNSASPDVDTADEPEVDVESNRFPDDEDAQEETEPSAPSAGGGPDGEQPTGPPSATSSGADGPANSPDGGSPRPRRRLGPPPAGRPAFGDLAAEDLVRRPERSPPSGGGGYELREPCGPLGGPAPAKVSPAPAPPVAPSHLPCARQGCGAGRRTGILFRAGVGAAGLGHSPQAQPWARCETGPTRTLQ

SEQ ID NO: 917032 - protein, 254 aa, Homo sapiens
LAADQALPAPSASPQELATTSTMPYQYPALTPEQKKELSDIAHRIVAPGKGILAADESTGSIAKRLQSIGTENTEENRRFYRQLLLTADDRVNPCIGGVILFHETLYQKADDGRPFPQVIKSKGGVVGIKVDKGVVPLAGTNGETTTQGLDGLSERCAQYKKDGADFAKWRCVLKIGEHTPSALAIMENANVLARYASICQQNGIVPIVEPEILPDGDHDLKRCQYVTEKVWVVSTGSGGPHFSSGGLVGPCAP

SEQ ID NO: 917033 - protein, 364 aa, Homo sapiens
MPYQYPALTPEQKKELSDIAHRIVAPGKGILAADESTGSIAKRLQSIGTENTEENRRFYRQLLLTADDRVNPCIGGVILFHETLYQKADDGRPFPQVIKSKGGVVGIKVDKGVVPLAGTNGETTTQGLDGLSERCAQYKKDGADFAKWRCVLKIGEHTPSALAIMENANVLARYASICQQNGIVPIVEPEILPDGDHDLKRCQYVTEKVLAAVYKALSDHHIYLEGTLLKPNMVTPGHACTQKFSHEEIAMATVTALRRTVPPAVTGITFLSGGQSEEEASINLNAINKCPLLKPWALTFSYGRALQASALKAWGGKKENLKAAQEEYVKRALANSLACQGKYTPSGQAGAAASESLFVSNHAY

SEQ ID NO: 917034 - protein, 414 aa, Homo sapiens
GASTTLRPRTLRYFRRSLAKDLFLLTTKGLRLDFQGRISSEAPELATTSTMPYQYPALTPEQKKELSDIAHRIVAPGKGILAADESTGSIAKRLQSIGTENTEENRRFYRQLLLTADDRVNPCIGGVILFHETLYQKADDGRPFPQVIKSKGGVVGIKVDKGVVPLAGTNGETTTQGLDGLSERCAQYKKDGADFAKWRCVLKIGEHTPSALAIMENANVLARYASICQQNGIVPIVEPEILPDGDHDLKRCQYVTEKVLAAVYKALSDHHIYLEGTLLKPNMVTPGHACTQKFSHEEIAMATVTALRRTVPPAVTGITFLSGGQSEEEASINLNAINKCPLLKPWALTFSYGRALQASALKAWGGKKENLKAAQEEYVKRALANSLACQGKYTPSGQAGAAASESLFVSNHAY

SEQ ID NO: 917035 - protein, 392 aa, Homo sapiens
MPYQYPALTPEQKKELSDIAHRIVAPGKGILAADESTGAGRRQNGWRVQGWEWQADPLNSHVTLPGSIAKRLQSIGTENTEENRRFYRQLLLTADDRVNPCIGGVILFHETLYQKADDGRPFPQVIKSKGGVVGIKVDKGVVPLAGTNGETTTQGLDGLSERCAQYKKDGADFAKWRCVLKIGEHTPSALAIMENANVLARYASICQQNGIVPIVEPEILPDGDHDLKRCQYVTEKVLAAVYKALSDHHIYLEGTLLKPNMVTPGHACTQKFSHEEIAMATVTALRRTVPPAVTGITFLSGGQSEEEASINLNAINKCPLLKPWALTFSYGRALQASALKAWGGKKENLKAAQEEYVKRALANSLACQGKYTPSGQAGAAASESLFVSNHAY

SEQ ID NO: 917036 - protein, 402 aa, Homo sapiens
RLGTRLGVESAEAETKGLRLDFQGRISSEAPELATTSTMPYQYPALTPEQKKELSDIAHRIVAPGKGILAADESTGSIAKRLQSIGTENTEENRRFYRQLLLTADDRVNPCIGGVILFHETLYQKADDGRPFPQVIKSKGGVVGIKVDKGVVPLAGTNGETTTQGLDGLSERCAQYKKDGADFAKWRCVLKIGEHTPSALAIMENANVLARYASICQQNGIVPIVEPEILPDGDHDLKRCQYVTEKVLAAVYKALSDHHIYLEGTLLKPNMVTPGHACTQKFSHEEIAMATVTALRRTVPPAVTGITFLSGGQSEEEASINLNAINKCPLLKPWALTFSYGRALQASALKAWGGKKENLKAAQEEYVKRALANSLACQGKYTPSGQAGAAASESLFVSNHAY

SEQ ID NO: 917037 - protein, 340 aa, Homo sapiens
TRGSTHASADAWAGSIAKRLQSIGTENTEENRRFYRQLLLTADDRVNPCIGGVILFHETLYQKADDGRPFPQVIKSKGGVVGIKVDKGVVPLAGTNGETTTQGLDGLSERCAQYKKDGADFAKWRCVLKIGEHTPSALAIMENANVLARYASICQQNGIVPIVEPEILPDGDHDLKRCQYVTEKVLAAVYKALSDHHIYLEGTLLKPNMVTPGHACTQKFSHEEIAMATVTALRRTVPPAVTGITFLSGGQSEEEASINLNAINKCPLLKPWALTFSYGRALQASALKAWGGKKENLKAAQEEYVKRALANSLACQGKYTPSGQAGAAASESLFVSNHAY

SEQ ID NO: 917038 - protein, 258 aa, Homo sapiens
VDSTDPPLANGRTNGETTTQGLDGLSERCAQYKKDGADFAKWRCVLKIGEHTPSALAIMENANVLARYASICQQNGIVPIVEPEILPDGDHDLKRCQYVTEKVLAAVYKALSDHHIYLEGTLLKPNMVTPGHACTQKFSHEEIAMATVTALRRTVPPAVTGITFLSGGQSEEEASINLNAINKCPLLKPWALTFSYGRALQASALKAWGGKKENLKAAQEEYVKRALANSLACQGKYTPSGQAGAAASESLFVSNHAY

SEQ ID NO: 917039 - protein, 110 aa, Homo sapiens
YLESRRTPLANGSICQQNGIVPIVEPEILPDGDHDLKRCQYVTEKVLAAVYKALSDHHIYLEGTLLKPNMVTPGHACTQKFSHEEIAMAWASGPVGPVWIGCKKGLVPLG

SEQ ID NO: 917040 - protein, 364 aa, Homo sapiens; identical to SEQ ID NO: 917033

SEQ ID NO: 917041 - protein, 364 aa, Homo sapiens; identical to SEQ ID NO: 917033

SEQ ID NO: 917042 - protein, 386 aa, Homo sapiens
LAADQALPAPSASPQELATTSTMPYQYPALTPEQKKELSDIAHRIVAPGKGILAADESTGSIAKRLQSIGTENTEENRRFYRQLLLTADDRVNPCIGGVILFHETLYQKADDGRPFPQVIKSKGGVVGIKVDKGVVPLAGTNGETTTQGLDGLSERCAQYKKDGADFAKWRCVLKIGEHTPSALAIMENANVLARYASICQQNGIVPIVEPEILPDGDHDLKRCQYVTEKVLAAVYKALSDHHIYLEGTLLKPNMVTPGHACTQKFSHEEIAMATVTALRRTVPPAVTGITFLSGGQSEEEASINLNAINKCPLLKPWALTFSYGRALQASALKAWGGKKENLKAAQEEYVKRALANSLACQGKYTPSGQAGAAASESLFVSNHAY

SEQ ID NO: 917043 - protein, 326 aa, Homo sapiens
TQAHFCTQAHFCTQAHFCTQAHFCTQAHFCTQAHFWYSVILFHETLYQKADDGRPFPQVIKSKGGVVGIKVDKGVVPLAGTNGETTTQGLDGLSERCAQYKKDGADFAKWRCVLKIGEHTPSALAIMENANVLARYASICQQNGIVPIVEPEILPDGDHDLKRCQYVTEKVLAAVYKALSDHHIYLEGTLLKPNMVTPGHACTQKFSHEEIAMATVTALRRTVPPAVTGITFLSGGQSEEEASINLNAINKCPLLKPWALTFSYGRALQASALKAWGGKKENLKAAQEEYVKRALANSLACQGKYTPSGQAGAAASESLFVSNHAY

SEQ ID NO: 917044 - protein, 201 aa, Homo sapiens
YLESRRTPLANGSICQQNGIVPIVEPEILPDGDHDLKRCQYVTEKVLAAVYKALSDHHIYLEGTLLKPNMVTPGHACTQKFSHEEIAMATVTALRRTVPPAVTGITFLSGGQSEEEASINLNAINKCPLLKPWALTFSYGRALQASALKAWGGKKENLKAAQEEYVKRALANSLACQGKYTPSGQAGAAASESLFVSNHAY

SEQ ID NO: 917045 - protein, 240 aa, Homo sapiens
MPARIWSKNSHSLMCCCRPGTALGLHLRFPGASVSHLYNVDNRRQHLFPRVALKGFLWGEPPGGRPPRSGGRRLPYATHFRARGGKIVAECGWPGRKAQRGQPRRQASWTCVHERARTDREAKRGPGRTIEKPRQKRTTQPEAAGARAPGQGRRRGVPGLAPLRGGRPSRSAPGGRRRGRRRGSGFAPPPPGSAALGSFPAWLSLDPPPLPLPVRDGLGLPAAPPPPSPAAPRGPLSCRA

SEQ ID NO: 917046 - protein, 522 aa, Homo sapiens
MADVDPDTLLEWLQMGQGDERDMQLIALEQLCMLLLMSDNVDRCFETCPPRTFLPALCKIFLDESAPDNVLEVTARAITYYLDVSAECTRRIVGVDGAIKALCNRLVVVELNNRTSRDLAEQCVKVLELICTRESGAVFEAGGLNCVLTFIRDSGHLVHKDTLHSAMAVVSRLCGKMEPQDSSLEICVESLSSLLKHEDHQVSDGALRCFASLADRFTRRGVDPAPLAKHGLTEELLSRMAAAGGTVSGPSSACKPGRSTTGAPSTTADSKLSNQVSTIVSLLSTLCRGSPVVTHDLLRSELPDSIESALQGDERCVLDTMRLVDLLLVLLFEGRKALPKSSAGSTGRIPGLRRLDSSGERSHRQLIDCIRSKDTDALIDAIDTGAFEVNFMDDVGQTLLNWASAFGTQEMVEFLCERGADVNRGQRSSSLHYAACFGRPQVAKTLLRHGANPDLRDEDGKTPLDKARERGHSEVVAILQSPGDWMCPVNKGDDISYIGRIPQQWFNIFELTSQNGLWDRLD

SEQ ID NO: 917047 - protein, 142 aa, Homo sapiens
MADVDPDTLLEWLQMGQGDERDMQLIALEQLCMLLLMSDNVDRCFETCPPRTFLPALCKIFLDESAPDNVLEVTARAITYYLDVSAECTRRIVGVDGAIKALCNRLVVVELNNRTSRDLAEQCVKVSITYWLITYFSQTSQG

SEQ ID NO: 917048 - protein, 391 aa, Homo sapiens
MADVDPDTLLEWLQMGQGDERDMQLIALEQLCMLLLMSDNVDRCFETCPPRTFLPALCKIFLDESAPDNVLEVTARAITYYLDVSAECTRRIVGVDGAIKALCNRLVVVELNNRTSRDLAEQCVKVLELICTRESGAVFEAGGLNCVLTFIRDSGHLVHKDTLHSAMAVVSRLCGKMEPQDSSLEICVESLSSLLKHEDHQVSDGALRCFASLADRFTRRGVDPAPLAKHGLTEELLSRMAAAGGTVSGPSSACKPGRSTTGAPSTTADSKLSNQVSTIVSLLSTLCRGSPVVTHDLLRSELPDSIESALQGDERCVLDTMRLVDLLLVLLFEGRKALPKSSAGSTGRIPGLRRLDSSGERSHRQLIDCIRSKDTDALIDAIDTGGQKIFF

SEQ ID NO: 917049 - protein, 1995 aa, Homo sapiens
MYPNWGRYGGSSHYPPPPVPPPPPVALPEASPGPGYSSSTTPAAPSSSGFMSFREQHLAQLQQLQQMHQKQMQCVLQPHHLPPPPLPPPPVMPGGGYGDWQPPPPPMPPPPGPALSYQKQQQYKHQMLHHQRDGPPGLVPMELESPPESPPVPPGSYMPPSQSYMPPPQPPPSYYPPTSSQPYLPPAQPSPSQSPPSQSYLAPTPSYSSSSSSSQSYLSHSQSYLPSSQASPSRPSQGHSKSQLLAPPPPSAPPGNKTTVQQEPLESGAKNKSTEQQQAAPEPDPSTMTPQEQQQYWYRQHLLSLQQRTKVHLPGHKKGPVVAKDTPEPVKEEVTVPATSQVPESPSSEEPPLPPPNEEVPPPLPPEEPQSEDPEEDARLKQLQAAAAHWQQHQQHRVGFQYQGIMQKHTQLQQILQQYQQIIQPPPHIQANMQLRHYEMQQQQFQHLYQEWEREFQLWEEQLHSYPHKDQLQEYEKQWKTWQGHMKATQSYLQEKVNSFQNMKNQYMGNMSMPPPFVPYSQMPPPLPTMPPPVLPPSLPPPVMPPALPATVPPPGMPPPVMPPSLPTSVPPPGMPPSLSSAGPPPVLPPPSLSSAGPPPVLPPPSLSSTAPPPVMPLPPLSSATPPPGIPPPGVPQGIPPQLTAAPVPPASSSQSSQVPEKPRPALLPTPVSFGSAPPTTYHPPLQSAGPSEQVNSKAPLSKSALPYSSFSSDQGLGESSAAPSQPITAVKDMPVRSGGLLPDPPRSSYLESPRGPRFDGPRRFEDLGSRCEGPRPKGPRFEGNRPDGPRPRYEGHPAEGTKSKWGMIPRGPASQFYITPSTSLSPRQSGPQWKGPKPAFGQQHQQQPKSQAEPLSGNKEPLADTSSNQQKNFKMQSAAFSIAADVKDVKAAQSNENLSDSQQEPPKSEVSEGPVEPSNWDQNVQSMETQIDKAQAVTQPVPLANKPVPAQSTFPSKTGGMEGGTAVATSSLTADNDFKPVGIGLPHSENNQDKGLPRPDNRDNRLEGNRGNSSSYRGPGQSRMEDTRDKGLVNRGRGQAISRGPGLVKQEDFRDKMMGRREDSREKMNRGEGSRDRGLVRPGSSREKVPGGLQGSQDRGAAGSRERGPPRRAGSQERGPLRRAGSRERIPPRRAGSRERGPPRGPGSRERGLGRSDFGRDRGPFRPEPGDGGEKMYPYHRDEPPRAPWNHGEERGHEEFPLDGRNAPMERERLDDWDRERYWRECERDYQDDTLELYNREDRFSAPPSRSHDGDRRGPWWDDWERDQDMDEDYNREMERDMDRDVDRISRPMDMYDRSLDNEWDRDYGRPLDEQESQFRERDIPSLPPLPPLPPLPPLDRYRDDRWREERNREHGYDRDFRDRGELRIREYPERGDTWREKRDYVPDRMDWERERLSDRWYPSDVDRHSPMAEHMPSSHHSSEMMGSDASLDSDQGLGGVMVLSQRQHEIILKAAQELKMLREQKEQLQKMKDFGSEPQMADHLPPQESRLQNTSSRPGMYPPPGSYRPPPPMGKPPGSIVRPSAPPARSSVPVTRPPVPIPPPPPPPPLPPPPPVIKPQTSAVEQERWDEDSFYGLWDTNDEQGLNSEFKSETAAIPSAPVLPPPPVHSSIPPPGPVPMGMPPMSKPPPVQQTVDYGHGRDISTNKVEQIPYGERITLRPDPLPERSTFETGQRDRYDRERDREPYFDRQSNVIADHRDFKRDRETHRDRDRDRGVIDYDRDRFDRERRPRDDRAQSYRDKKDHSSSRRGGFDRPSYDRKSDRPVYEGPSMFGGERRTYPEERMPLPAPSLSHQPPPAPRVEKKPESKNVDDILKPPGRESRPERIVVIMRGLPGSGKTHVAKLIRDKEVEFGGPAPRVLSLDDYFITEVEKEEKDPDSGKKVKKKVMEYEYEAEMEETYRTSMFKTFKKTLDDGFFPFIILDAINDRVRHFDQFWSAAKTKGFEMADHWETAPRHMMRLDIRSLLQDAAIEEEDHSGSMNLERVSTDRKTR

SEQ ID NO: 917050 - protein, 460 aa, Homo sapiens
MYPNWGRYGGSSHYPPPPVPPPPPVALPEASPGPGYSSSTTPAAPSSSGFMSFREQHLAQLQQLQQMHQKQMQCVLQPHHLPPPPLPPPPVMPGGGYGDWQPPPPPMPPPPGPALSYQKQQQYKHQMLHHQRDGPPGLVPMELESPPESPPVPPGSYMPPSQSYMPPPQPPPSYYPPTSSQPYLPPAQPSPSQSPPSQSYLAPTPSYSSSSSSSQSYLSHSQSYLPSSQASPSRPSQGHSKSQLLAPPPPSAPPGNKTTVQQEPLESGAKNKSTEQQQAAPEPDPSTMTPQEQQQYWYRQHLLSLQQRTKVHLPGHKKGPVVAKDTPEPVKEEVTVPATSQVPESPSSEEPPLPPPNEEVPPPLPPEEPQSEDPEEDARLKQLQAAAAHWQQHQQHRVGFQYQGIMQKHTQLQQILQQYQQIIQPPPHIQAMSVVMQERFRVQEVVILIYAGSSRVHAPH

SEQ ID NO: 917051 - protein, 156 aa, Homo sapiens
EPRKPTEQRLRPGPAPMSPATPPGAQPRLPAARAQVGKRRSAAAPPPRSHRPAARRRRTELRPGDLGPQGGERGATSGAGLTAAQPQAPEGSRGCARACPGAVVRGQEGCPVPGARPAERLGPTWARLEARAGSDGAGGAAGPGLLAPRARLGQDA

SEQ ID NO: 917052 - protein, 304 aa, Homo sapiens
MSRQEKDAELDRRIVALRKKNQALLRRYQEIQEDRRQAEQGGMAVTTPALLQPDGLTVTISQVPGVSLTLGDRARSKEVEAQTIPQPCAYATKHRPLLNLKPQGLKPCRKWGTEKLGLNARSSEKRVVSRNWARGTCGPRVTNEMLEDEDAEDHGGTFCLGELVELAVTMENKAEGKRIVSEKPTRARNQGIEGSPGGRVTRSPPTQVAISSDSARKGSWEPWSRPVGEPPEAGWDYAQWKQEREQIDLARLARHRDAQGDWRRPWDLDKAKSTWVAGLGRLPVVRDGAGFGHCWEGCRDPPRG

SEQ ID NO: 917053 - protein, 128 aa, Homo sapiens
MGSRGFIQARKMCRCCGSFDPGHLTYISPRPQPSWRNYEVYEIQSSVSLSPATGRIIPSSFWGPRKSFFWTQSPPTLELVLGSVILLRIWEEVFIPRGGQEGIASPTLWACLAFDVSSEDLTPWIEWS

SEQ ID NO: 917054 - protein, 143 aa, Homo sapiens
MAYSRHTKSRYLPSHQNYTKKTGKIYEAMLFKAAAIIPRKTMIPERQETNKASLMIATTYCLERVSKSWCKESEPRQSPVDSLIGETKLRVWKDAGRWSLQDKLRESDENHKHTNPRISKYPKHRKLEEKYIKAHYSEIALNK

SEQ ID NO: 917055 - protein, 143 aa, Homo sapiens
VGCMHSATCLEGHESHGKGRARAAGKRRATGGPMSPSHRPPLLGLPGLPHQVFLQLRQKEPLENEKHPPGCRTWAPTAENLQERKFRWQLRATVEQRSPQAAEHTDLGGVQRWHQRYEGVQGKADGRERAGVTAASGAERWTL

SEQ ID NO: 917056 - protein, 143 aa, Homo sapiens; identical to SEQ ID NO: 917055

SEQ ID NO: 917057 - protein, 161 aa, Homo sapiens [sequence omitted]

SEQ ID NO: 917058 - protein, 221 aa, Homo sapiens
MRIKGKNAPKVFSLCLTHSKRTINASYYYYCDYTVQWTLLFLFLIDTKSRREEGCCNVRKKRDAVPTVMKYSHIIKESHNSTTRSTVIERYIMPRAFTRGCGLSRRPYEDTARQPQARREALTRTCPCWLPDVRLPASGTVRKSMSVVSAIQSMAFVMAVQAKTVSLARSSLPLMSLLSNFLSPDPLTLLLGCKSPLILAVFGAELNLSLLLRYFYCNNLK

SEQ ID NO: 917059 - protein, 141 aa, Homo sapiens
MLGLRLLAIVLNYYTTATNHFTGFPLSVNLTETYPFPQFLLSSTLIRLIWCSAQRASTNLTYTVSSPLDASTQRWAWRLSKALVALRIPCARPSWMRAVFNSSCKAALMSITPPAAMPSSAMAVEDEHAGISRYAPKVVQV

SEQ ID NO: 917060 - protein, 1186 aa, Homo sapiens
PVSPEAAAVEKTGTAEMSSILKEHVLGADTSADLEETGHVLSIGDVKRTGTIVDVPVGEELLGRVVDALGNAIDGKGPMGSKTHKIIPRTSVWEPMPTGIKAVDSLVPIGRGQHELIIGDRRTGKTSIAIDTIINQKHFNDRSEEKKKLYCIYVAIGRKRSTVAQLVKRLTDADAVKYTTVVSAMASDAALLQYLAPYSDCSMGEYFRDDGKYTLIIYDDLSKQAACPGDVFYLYSRLLERAAKMNDAFGGGSLTALLVIETQADDVSAYIPTNVISITDRQILETELFYKDIRSAINIGSVCVLCWICCPNQDYEAGGRLSLAHVYLQLHKGENIEDIPKEVLTDCAHLVKANSTQGCKNNVNVVNTPRSNLKKTADVDVRQIGFHRQKDVKIVTMEKKVNEILNRLEKTKLNRFQCSFEEAQHYCHVQRGFLAHIWNKEVQDLIRDYLEEGKKWWIGQNVMPLKKHQDNKYPADVAANGPPKPLSCTYLSRNFIRISSKGDKCLLKYYFICQTGDFLDGDAHYERNGNNSHLYQRHKKTKRGVAIARDKMPPVDSDETGDKIRNNFKPKGRRSSEYLHLLSTSVIAEGIWSGKHGKFKSQVIDEIAGNFSRAVHGLQALNKLQEACEFLQKLTALTPRFSKPAQNNNSLGFKVPPTVCPFHSLNNVTKAGEGSWLESKRHTEPVEDILEMSLVEFGNIGEAFLEQNQSPESSVTLTSANATLLLSRQNISTLPLSSYTLGHPAPVRLGFPSALALKELLNKHPGVNVQITGLAFNPFKDLDNRNIVGSIGSVLLSANRKLLQVHDLMEDIEIMLWRNVSLETHPTSLNMSTHQLTITVNVTSLEKSLIVSIDPDSPLLMTLYLGFQYQPNCTHFHLNITLPKDKVWQKDEEYTWVLNPEHLQHGIGTYYITAVLSERQEGAQQTPSLVSVITAVTQCYYWEIHNQTWSSAGCQVGPQSTILRTQCLCNHLTFFASDFFVVPRTVNVEDTIKLFLRVTNNPVGVSLLASLLGFYVITVVWARKKDQADMQKVKVTVLADNDPSAQFHYLIQVYTGYRRSAATTAKVVITLYGSEGRSEPHHLCDPQKTVFERGGLDVFLLTTWTSLGNLHSLRLWHDNSGVSPSWYVSQVIVCDMAVKRKWHFLCNCWLAVDLGDCELDRVFIPVSKRELFSFRYCWKITINSEY

SEQ ID NO: 917061 - protein, 450 aa, Homo sapiens
MGPAWVQDPLTGALWLPVLWALLSQVYCFHDPPGWRFTSSEIVIPRKVPHRRGGVEMPDQLSYSMHFRGRRHVIHMKLKKNMMPRHLPVFTNNDQGAMQENYPFVPRDCYYDCYLEGVPGSVATLDTCRGGLRGMLQVDDLTYEIKPLEAFSKFEYVVSLLVSEERPGEVSRCKTEGEEIDQESEKCSKFSIPNFPYVAPRCGDNIKNQREECDCGSLKDCASDRCCETSCTLSLGSVCNTGLCCHKCKYAAPGVVCRDLGGICDLPKYCDGKKEECPNDIYIQDGTPCSAVSVCIRGNCSDRDMQCQALFGYQVKDGSPACYQKLNRIAEHTTFRNILVHDIKEEKCFGYEAHQGTDLPEMGLVVDGATCGPGSYCLKHNCTSYQDLHFECDLKTCNYKGVCNNKKHCHCLHGWQPPTCELRGKGGSIDSGPPPDKQYRITASTLANIN

SEQ ID NO: 917062 - protein, 455 aa, Homo sapiens
NGCYNCMEGKLRPRGPNTTEPRLLTSPQPPPLPAQCPPSCCGELGSCRADTLGDQVCRDSLQNQESQGTRASLPRLLASPWGKVEAHLAAEALVPEAIKGGQKGQRPRLGREEGAVRSAQALGRVPAAPRSHALWCQSWHPSPAPPLPCRDQGTGNVAVDSAPWGHGFLSQWAGVEDGFPPFDPCQEKALKVSAGCRAEDSGLCGAEPRSHLACGDPWDPALFYCPLDAAGTLLPGGQERSLEEGARKLPGCKSGFLSKSSAGGEREYGGGHGGPSPDTRLRTRSPAPRAGLGPETRAAASDSCAVGQARACARPDRARRPRVGWRAQEEGTPTAPHRLPGRAATLDGGSAGRGRGAAEGAFVRRVPERVAAGPAPAPLQRPPPARAPGPARIPGEATRGFCGPSPAVAARRRRERLRILLGSPSAGCGCRGDVGGLRVADREFGQLHAPSVVSP

SEQ ID NO: 917063 - protein, 436 aa, Homo sapiens
NGCYNCMEGKLRPRGPNTTEPRLLTSPQPPPLPAQCPPSCCGELGSCRADTLGDQVCRDSLQNQESQGTRASLPRLLASPWGKVEAHLAAEALVPEAIKGGQKGQRPRLGREEGAVRSAQALGRVPAAPRSHALWCQSWHPSPAPPLPCRDQGTGNVAVDSAPWGHGFLSQWAGVEDGFPPFDPCQEKALKVSAGCRAEDSGLCGAEPRSHLACGDPWDPALFYCPLDAAGTLLPGGQERSLEEGARKLPGCKSGFLSKSSAGGEREYGGGHGGPSPDTRLRTRSPAPRAGLGPETRAAASDSCAVGQARACARPDRARRPRVGWRAQEEGTPTAPHRLPGRAATLDGGSAGRGRGAAEGAFVRRVPERVAAGPAPAPLQRPPPARAPGPARIPGEATRGFCGPSPAVAARRRRERLRILLGSPSAGCNPRAVPPS

SEQ ID NO: 917064 - protein, 127 aa, Homo sapiens
MDPPARCGWDRQGPCGVAWLAWSWGRSPRAWSPEGLVGRPGAVVHTKGGLQREVRTLGLPPGQPSLSKSPPAAELPPVKPLFPAFCALNKLLLGLSHQHSVVGVAAARLPSCTQAPHRTSRMIWKSD

SEQ ID NO: 917065 - protein, 227 aa, Homo sapiens
AKRVPLPTPHCPSPVHSTEMLTWEAVRPDLDGQPWQMSSVPSRELGNREMGPCLPRPTDSALLASANLCGFELVLGMTVTASITRGLWNILALGRSGRIISNAVTSAAAYTTIRKHASHTNLTTVHPGSCRLARAPDATSSLESTLTLESIALGWSLPSAIDYLSDSSFQFKFTLTEIQDGVVIWPQPRDIAMLALTTPLVKACKTSEAPAQHGPELLQQPRAVSRY

SEQ ID NO: 917066 - protein, 227 aa, Homo sapiens; identical to SEQ ID NO: 917065

SEQ ID NO: 917067 - protein, 137 aa, Homo sapiens
MWESKAWESIGCAWEIRTQCSTSLLQTRVVSVYFISSVKSVIWKGCEIHPEEQPAEYPLGYWHLLGYKSLAIKDEPTDLALNTQLTNKQRKSKEAHMVYFRGRAWKGYIPPPSHGPLAGTQSHDPTYMQDSICALVV

SEQ ID NO: 917068 - protein, 137 aa, Homo sapiens; identical to SEQ ID NO: 917067

SEQ ID NO: 917069 - protein, 167 aa, Homo sapiens
PAMVSTYDPKSIMLKPNHWCDGIRRPSPDIGSTGTLILEFPAPRTMRSKCTCTHTHILLNENSNTLYMLFCNLLVSFTYIMRMFPCQEMEVKDSAVQGSPSEATSGAQQIFVENLLCAWLDQGGAVELHIIVCIRVSPESQALEGYPDGQDPLPSLREHQKGRCGGG

SEQ ID NO: 917070 - protein, 167 aa, Homo sapiens; identical to SEQ ID NO: 917069

SEQ ID NO: 917071 - protein, 167 aa, Homo sapiens; identical to SEQ ID NO: 917069

SEQ ID NO: 917072 - protein, 131 aa, Homo sapiens
MASSSILKASFCKFLLWVPGNPIGLGLAPAKNKCYSCPVSSEWMLVILVWSPDVRQQVVQKAPEEVSCQSQGQRRRHREPTARDFHLQRATHDEEGGFLGALSPPDTRTQDLLAWKVNSSEFRDDASLGGR

SEQ ID NO: 917073 - protein, 197 aa, Homo sapiens
EHRGFTMELGLRWVFLVAILEGVQCEVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARDTVRGSQCEPRHKPPCRVPRTTRGARDTVHGSVSRAGAVPAEGWLPVMACGALIVKFPQGTSPDLQFCTDISCL

SEQ ID NO: 917074 - protein, 135 aa, Homo sapiens
MKWTLVMKGIILVFSNGILDVELICASHTVTEFGLSPVTLRRAEDGHSIVLGALGNNSRALARQPKVNTAGLQERQAGIPGKTCICRPPWSPIVFYYALIESAPPRLSRTLFVTYEKIMGGSTNTCVMPWEQHLS

SEQ ID NO: 917075 - protein, 150 aa, Homo sapiens [sequence omitted]

SEQ ID NO: 917076 - protein, 113 aa, Homo sapiens
PPAPQPVELGSPRRSPAPAQAGSQVGGVGRQKSQGSWGRLRLYLQATVSSTDLGRGCKCFKETRAAEKRDSEARGTAFSASPPARGSPLLQLPVLSNQVRRLPGPLPTLKVAC

SEQ ID NO: 917077 - protein, 150 aa, Homo sapiens [sequence omitted]

SEQ ID NO: 917078 - protein, 206 aa, Homo sapiens
TGPPEKSNYWLRGFKAAQGRLMKGDKLGTVSRIPAGRPGQPGSRGAAESPRIKGIWRERGSGRPAPAGLPPRRPRRPGVGGCGPRAGTPGFPACLSRGLRRRPLRAARPGGELRRARGSQVSTGAPRAGPGTQDKARGPPRLAREWRSRGPGSRLRRLPAPAAGTPRGRAPGQAPGRRLRKRRLAGRGARGGEPGSVNPRSARRSD

SEQ ID NO: 917079 - protein, 148 aa, Homo sapiens
MKGARNSKPLFTRSKEPPDPFNQKYSFVFVFIPAFIPLCSVQQGLGPCWATVNTAPIASVLAVGRGPPLATVAVMFVIADLLHIAEECLSHSHIELSHKRHQRYDILVGPSSCTCIRPKNLISPLTVINILMKTGYVDAGRWGKLVSS

SEQ ID NO: 917080 - protein, 268 aa, Homo sapiens
DPFSQRQPAGPASPSAAKPRPGLAPLLPPERAMPPRELSEAEPPPLRAPTPPPRRRSAPPELGIKCVLVGDGAVGKSSLIVSYTCNGYPARYRPTALDTFSVQVLVDGAPVRIELWDTAGQEDFDRLRSLCYPDTDVFLACFSVVQPSSFQNITEKWLPEIRTHNPQAPVLLVGTQADLRDDVNVLIQLDQGGREGPVPQPQAQGLAEKIRACCYLECSALTQKNLKEVFDSAILSAIEHKARLEKKLNAKGVRTLSRCRWKKFFCFV

SEQ ID NO: 917081 - protein, 268 aa, Homo sapiens; identical to SEQ ID NO: 917080

SEQ ID NO: 917082 - protein, 153 aa, Homo sapiens
MRISLEVELPNREEGDLLVVYTGLTFANYGNGGQATGQASLAILKIVVLSEDGTECKRVIFYKKKRCTLLLTNFICTYFRKNKIKQRSSLEQQRLLKRVLSDTSRIITVKRIQLYSHLDTEQIKRDWQCSSKWKTSQRRKLENIHFWRDSGKS

SEQ ID NO: 917083 - protein, 505 aa, Homo sapiens
KAVGVLELLAGEEGGRSSLQKDILEDLAGLNMHWLRKVQGLCTLWGTQMSSRTLYINSRQLVSLQWGHQEVPAKFNFASDVLDHWADMEKAGKRLPSPALWWVNGKGKELMWNFRELSENSQQAANVLSGACGLQRGDRVAVVLPRVPEWWLVILGCIRAGLIFMPGTIQMKSTDILYRLQMSKAKAIVAGDEVIQEVDTVASECPSLRISYWCLRLITVWSWLNFKKLLNEASTTHHCVETGSQEASAIYFTSGTSGLPKMAEHSYSSLGLKAKMDAGYKFPHLQNCVTVGESLLPETLENWRAQTGLDIRESYGQTETGLTCMVSKTMKIKPGYMGTAASCYDVQIIDDKGNVLPPGTEGDIGIRVKPIRPIGIFSGYVVRNCAPPPLFPSEDGSTKRDEGGQMAGDLGFAGTMTLSFCGHQDNPDKTAANIRGDFWLLGDRGIKDEDGYFQFMGRADDIINSSGYRIGPSEVENALMEHPAVVETAVISSPDPVRGEVMGKQ

SEQ ID NO: 917084 - protein, 252 aa, Homo sapiens
MDEERVAINVGLTSLDLSWNNFHTRGAVALCNGLRGNVTLTKLDLSMNGFGNEVALALGEVLRLNRCLVYLDIGGNDIGNEGASKISKGLESNESLRVLKLFLNPINMDGAILLILAIKRNPKSRMEELDISNVLVSEQFMKTLDGVYAVHPQLDVVFKAVQGLSPKKTIFLLTNPMKLIQSYADQHKITIVDFFKSLNPTGTMKMSVDEFQKVMIEQNKVPLNQYQVREVIKKLDEKTGMVNFSFLNTMKP

SEQ ID NO: 917085 - protein, 173 aa, Homo sapiens
MAAGKRRSSLPRLGSRAEGLLTSQTMGGQAETLLTSQMGLEGSEEDKKMWESLELTRDLFNGFDDSDMDNEVQAEVVSDGDKFQYLLPQFHLRYCQNGIYHPYFYQYSDHNHLTNPYDLESLKSSASSEPSLELPLKLHSWKSKLFLTCFSKFLQPLPITQFESHLLILGYLL

SEQ ID NO: 917086 - protein, 182 aa, Homo sapiens
PGGGAYQPRAVRPHSSALGRLMGPGALEQEAAFVRETQAAQEPTASSGRGDSGMAGYRSQALPRGGAAKAQREIERSAAAGQDAKPLTTRGRQGRLAAPSARPAKPTPTRNSSWPASAARSPGSRPCLSLHTSLQAEGAGSGLGHPRKGLPQCSGGLKGSSSVARVGAKAEEAPRGSEGCED

SEQ ID NO: 917087 - protein, 345 aa, Homo sapiens
VFYHFIPKQIDEVWREMRWIMDALQYARYKQPVSGLPITKLIDPSDEQSLKKINSTSSSHIDCLPSPPPSPEMHRRKTVSDSQPCSDEEACSEVFLPTNSDYDSSDALSPRDLDLVYLSSHDIAQQTLSGLSGSAPDVLQVHDVKTPLGPGQDPQGEGPNPDHSCAEFLHSLTLTGFTPKNHAKTVSGGRPPLGFLGKRKPGKHPHYGGFSRHHRWLRIHSETQSLSLSEGIYTQHLSQACGLAQEPKEAKRAGPALDDPRGLTLAHAASLPEERNSSLQDARPSVRRLYVEPYAAAVVAQDEKPWASLSPPSGGRITLPSPTGPDVSQEGPTASPMSEILSSML

SEQ ID NO: 917088 - protein, 446 aa, Homo sapiens
MGGCAGSRRRFSDSEGEETVPEPRLPLLDHQGAHWKNAVGFWLLGLCNNFSYVVMLSAAHDILSHKRTSGNQSHVDPGPTPIPHNSSSRFDCNSVSTAAVLLADILPTLVIKLLAPLGLHLLPYRSGPRVLVSGICAAGSFVLVAFSHSVGTSLCGVVFASISSGLGEVTFLSLTAFYPRAVISWWSSGTGGAGLLGALSYLGLTQAGLSPQQTLLSMLGIPALLLASYFLLLTSPEAQDPGGEEEAESAARQPLIRTEAPESKPGSSSSLSLRERWTVFKVRMMAGGLLWYIVPLVVVYFAEYFINQGLFELLFFWNTSLSHAQQYRWYQMLYQAGVFASRSSLRCCRIRFTWALALLQCLNLVFLLADVWFGFLPSIYLVFLIILYEGLLGGAAYVNTFHNIALETSDEHREFAMAATCISDTLGISLSGLLALPLHDFLCQLS

SEQ ID NO: 917089 - protein, 121 aa, Homo sapiens
SADSDAQLAAAESSPSAGRAADRPTEAPIGRLSTAQKEQLLRAPPRRAEAEPRAAGEPCRCHSGRGSALAEVCLTIRLRLPDKRNLVEFDGKVLSPPQRRPRSPRLLSPARPLLPQSRGCP

SEQ ID NO: 917090 - protein, 213 aa, Homo sapiens
MKILFVEPAIFLSAFAMTLTGPLTTQYVYRRIWEETGNYTFSSDSNISECEKNKSSPIFAFQEEVQKKVSRFNLQMDISGLIPGLVSTFILLSISDHYGRKFPMILSSVGALATSVWLCLLCYFAFPFQLLIASTFIGAFCGNYTTFWGACFAYIVDQCKEHKQKTIRIAIIDFLLGLVTGLTGLSSGYFIRELGFENGYDRVCQYNTDDVFR

SEQ ID NO: 917091 - protein, 110 aa, Homo sapiens
ENVFCRNSLGFQEGRPSSGVPWEQRSCHSNTKELDLYEKHSFVFSFLSPHPEWPEPKPAPSEKSLPPDLRLIFRHLGHNILHSLGMLISNCSLAFPALVLLRQGIPALLY

SEQ ID NO: 917092 - protein, 83 aa, Homo sapiens
SQPSEIAGLGVGGKEKILQPSDSMESRKKDIKKRILGDIFDSLDQTLPEAHISEISRYKNKYFLFIVLLDLRQALSFSDSSSS

SEQ ID NO: 917093 - protein, 83 aa, Homo sapiens; identical to SEQ ID NO: 917092

SEQ ID NO: 917094 - protein, 96 aa, Homo sapiens
SQPSEIAGLGVGGKEKILELDLYEKHSFVFSFLSPHPEWPEPKPAPSEKSLPPDLRLIFRHLGHNILHSLGMLISNCSLAFPALVLLRQGIPALLY

SEQ ID NO: 917095 - protein, 149 aa, Homo sapiens
STAWLLLMLIQGPRALQPACGECCQTWDSPFKAVGSPLAQGRSRNAIQELRPGIWDPNSIVGALPHCDQASTYADFWFLRRCFCQPSDSMESRKKDIKKRILGDIFDSLDQTLPEAHISEISRYKNKYFLFIVLLDLRQALSFSDSSSS

SEQ ID NO: 917096 - protein, 1263 aa, Homo sapiens
MPAKGRYFLNEGEEGPDQDALYEKYQLTSQHGPLLLTLLLVAATACVALIIIAFSQGDPSRHQAILGMAFLVLAVFAALSVLMYVECLLRRWLRALALLTWACLVALGYVLVFDAWTKAACAWEQVPFFLFIVFVVYTLLPFSMRGAVAVGAVSTASHLLVLGSLMGGFTTPSVRVGLQLLANAVIFLCGNLTGAFHKHQMQDASRDLFTYTVKCIQIRRKLRIEKRQQENLLLSVLPAHISMGMKLAIIERLKEHGDRRCMPDNNFHSLYVKRHQNVSILYADIVGFTQLASDCSPKELVVVLNELFGKFDQIAKANECMRIKILGDCYYCVSGLPVSLPTHARNCVKMGLDMCQAIKQVREATGVDINMRVGIHSGNVLCGVIGLRKWQYDVWSHDVSLANRMEAAGVPGRVHITEATLKHLDKAYEVEDGHGQQRDPYLKEMNIRTYLVIDPRSCLATPTGEGLRHVFLDRGGGLRPKGDAALKMRASVRMTRYLESWGAARPFAHLNHRESVSSGETHVPNGRRPKSVPQRHRRTPDRNQSFLAPGPSAWPHDGAPVVWCPGGVSGVGGREGDDCGCPGPHANPGGVAEDALDWGSGLPSASGLAAGQLGHAGPCWVLTRPLWASVGPTHSFTIPPEVLGPHWCLRPHPPLGELEVVAVLMQLWVSDSRSMSPKGRSEDDSYDDEMLSAIEGLSSTSPHLTAAAPAHRPCCSKSDDFYTFGSIFLEKGFEREYRLAPIPRARHDFACASLIFVCILLVHVLLMPRTAALGVSFGLVACVLGLVLGLCFATKFSRCCPARGTLCTISERVETQPLLRLTLAVLTIGSLLTVAIINLVGPVVGRQASGVEGDLQIWDAYNVALKAASGCPLPRAQQPLMPFQVPELPVGNETGLLAASSKTRALCEPLPYYTCSCVLGFIACSVFLRMSLEPKVVLLTVALVAYLVLFNLSPCWQWDCCGQGLGNLTKPNGTTSGTPSCSWKDLKTMTNFYLVLFYITLLTLSRQIDYYCRLDCLWKKKFKKEHEEFETMENVNRLLLENVLPAHVAAHFMVTEVKWCKVRFLPIQDWYHQSYDCVCVMFASVPDFKVFYTECDVNKEGLECLRLLNEIIADFDELLLKPKFSGVEKIKTIGSTYMAAAGLSVASGHENQELERQHAHIGVMVEFSIALMSKLDGINRHSFNSFRLRVGINHGPVIAGVIGARKPQYDIWGNTVNVASRMESTGELGKIQVFFPPLKTTGLSSFSGYRGDLHHPPGPRVLL

SEQ ID NO: 917097 - protein, 1263 aa, Homo sapiens; identical to SEQ ID NO: 917096

SEQ ID NO: 917098 - protein, 851 aa, Homo sapiens
PLPLGRPLGRRWSGSAQQLLANAVIFLCGNLTGAFHKHQMQDASRDLFTYTVKCIQIRRKLRIEKRQQENLLLSVLPAHISMGMKLAIIERLKEHGDRRCMPDNNFHSLYVKRHQNVSILYADIVGFTQLASDCSPKELVVVLNELFGKFDQIAKANECMRIKILGDCYYCVSGLPVSLPTHARNCVKMGLDMCQAIKQVREATGVDINMRVGIHSGNVLCGVIGLRKWQYDVWSHDVSLANRMEAAGVPGRVHITEATLKHLDKAYEVEDGHGQQRDPYLKEMNIRTYLVIDPRSQQPPPPSQHLPRPKGDAALKMRASVRMTRYLESWGAARPFAHLNHRESVSSGETHVPNGRRPKSVPQRHRRTPDRSMSPKGRSEDDSYDDEMLSAIEGLSSTRPCCSKSDDFYTFGSIFLEKGFEREYRLAPIPRARHDFACASLIFVCILLVHVLLMPRTAALGVSFGLVACVLGLVLGLCFATKFSRCCPARGTLCTISERVETQPLLRLTLAVLTIGSLLTVAIINLPLMPFQVPELPVGNETGLLAASSKTRALCEPSRGTPSCSWKDLKTMTNFYLVLFYITLLTLSRQIDYYCRLDCLWKKKFKKEHEEFETMENVNRLLLENVLPAHVAAHFIGDKDWYHQSYDCVCVMFASVPDFKVFYTECDVNKEGLECLRLLNEIIADFDELLLKPKFSGVEKIKTIGSTYMAAAGLSVASGHENQELERQHAHIGVMVEFSIALMSKLDGINRHSFNSFRLRVGINHGPVIAGVIGARKPQYDIWGNTVNVASRMESTGELGKIQVTEETCTILQGLGYSCECRGLINVKGKGELRTYFVCTDTAKFQGLGLN

SEQ ID NO: 917099 - protein, 139 aa, Homo sapiens
MQGSDPQPVPQELERQHAHIGVMVEFSIALMSKLDGINRHSFNSFRLRVGINHGPVIAGVIGARKPQYDIWGNTVNVASRMESTGELGKIQVTEETCTILQGLGYSCECRGLINVKGKGELRTYFVCTDTAKFQGLGLN

SEQ ID NO: 917100 - protein, 567 aa, Homo sapiens
PLPLGRPLGRRWSGSAQQLLANAVIFLCGNLTGAFHKHQMQDASRDLFTYTVKCIQIRRKLRIEKRQQENLLLSVLPAHISMGMKLAIIERLKEHGDRRCMPDNNFHSLYVKRHQNVSILYADIVGFTQLASDCSPKELVVVLNELFGKFDQIAKANECMRIKILGDCYYCVSGLPVSLPTHARNCVKMGLDMCQAIKQVREATGVDINMRVGIHSGNVLCGVIGLRKWQYDVWSHDVSLANRMEAAGVPGRVHITEATLKHLDKAYEVEDGHGQQRDPYLKEMNIRTYLVIDPRSQQPPPPSQHLPRPKGDAALKMRASVRMTRYLESWGAARPFAHLNHRESVSSGETHVPNGRRPKSVPQRHRRTPDRSMSPKGRSEDDSYDDEMLSAIEGLSSTRPCCSKSDDFYTFGSIFLEKGFEREYRLAPIPRARHDFACASLIFVCILLVHVLLMPRTAALGVSFGLVACVLGLVLGLCFATKFSRCCPARGTLCTISERVETQPLLRLTLAVLTIGSLLTVAIINLPLMPFQVPELPVGNETGLLAASSKTRALCEPLPHLHTVFSR

SEQ ID NO: 917101 - protein, 601 aa, Homo sapiens
PLPLGRPLGRRWSGSAQQLLANAVIFLCGNLTGAFHKHQMQDASRDLFTYTVKCIQIRRKLRIEKRQQENLLLSVLPAHISMGMKLAIIERLKEHGDRRCMPDNNFHSLYVKRHQNVSILYADIVGFTQLASDCSPKELVVVLNELFGKFDQIAKANECMRIKILGDCYYCVSGLPVSLPTHARNCVKMGLDMCQAIKQVREATGVDINMRVGIHSGNVLCGVIGLRKWQYDVWSHDVSLANRMEAAGVPGRVHITEATLKHLDKAYEVEDGHGQQRDPYLKEMNIRTYLVIDPRSQQPPPPSQHLPRPKGDAALKMRASVRMTRYLESWGAARPFAHLNHRESVSSGETHVPNGRRPKSVPQRHRRTPDRSMSPKGRSEDDSYDDEMLSAIEGLSSTRPCCSKSDDFYTFGSIFLEKGFEREYRLAPIPRARHDFACASLIFVCILLVHVLLMPRTAALGVSFGLVACVLGLVLGLCFATKFSRCCPARGTLCTISERVETQPLLRLTLAVLTIGSLLTVAIINLVGPVVGRQASGVEGDLQIWDAYNVALKAASGCPLPRAQQVDVGGSPLYTQGSSPLGSQMRTLGAQRACVASSRRM

SEQ ID NO: 917102 - protein, 495 aa, Homo sapiens
MPAKGRYFLNEGEEGPDQDALYEKYQLTSQHGPLLLTLLLVAATACVALIIIAFSQGDPSRHQAILGMAFLVLAVFAALSVLMYVECLLRRWLRALALLTWACLVALGYVLVFDAWTKAACAWEQVPFFLFIVFVVYTLLPFSMRGAVAVGAVSTASHLLVLGSLMGGFTTPSVRVGLQLLANAVIFLCGNLTGAFHKHQMQDASRDLFTYTVKCIQIRRKLRIEKRQQENLLLSVLPAHISMGMKLAIIERLKEHGDRRCMPDNNFHSLYVKRHQNVSILYADIVGFTQLASDCSPKELVVVLNELFGKFDQIAKANECMRIKILGDCYYCVSGLPVSLPTHARNCVKMGLDMCQAIKQVREATGVDINMRVGIHSGNVLCGVIGLRKWQYDVWSHDVSLANRMEAAGVPGRVHITEATLKHLDKAYEVEDGHGQQRDPYLKEMNIRTYLVIDPRDPTVEEAVPLPWPGGARLGLSAARPWPASGSPARLATSL

SEQ ID NO: 917103 - protein, 116 aa, Homo sapiens
ELEDPLGGTARCPCNGWRQRSTRPGAHHGGHAKAPGQGVRGGGWARAAAGPLPQGDEHPHLPGHRPPGPLVAPGPHGGGGSSTALARWGPPWPVCCPTLACFRESGTSGHFSVNHP

SEQ ID NO: 917104 - protein, 955 aa, Homo sapiens
PLPLGRPLGRRWSGSAQQLLANAVIFLCGNLTGAFHKHQMQDASRDLFTYTVKCIQIRRKLRIEKRQQENLLLSVLPAHISMGMKLAIIERLKEHGDRRCMPDNNFHSLYVKRHQNVSILYADIVGFTQLASDCSPKELVVVLNELFGKFDQIAKANECMRIKILGDCYYCVSGLPVSLPTHARNCVKMGLDMCQAIKQVREATGVDINMRVGIHSGNVLCGVIGLRKWQYDVWSHDVSLANRMEAAGVPGRVHITEATLKHLDKAYEVEDGHGQQRDPYLKEMNIRTYLVIDPRSQQPPPPSQHLPRPKGDAALKMRASVRMTRYLESWGAARPFAHLNHRESVSSGETHVPNGRRPKSVPQRHRRTPDRSMSPKGRSEDDSYDDEMLSAIEGLSSTRPCCSKSDDFYTFGSIFLEKGFEREYRLAPIPRARHDFACASLIFVCILLVHVLLMPRTAALGVSFGLVACVLGLVLGLCFATKFSRCCPARGTLCTISERVETQPLLRLTLAVLTIGSLLTVAIINLVGPVVGRQASGVEGDLQIWDAYNVALKAASGCPLPRAQQPLMPFQVPELPVGNETGLLAASSKTRALCEPLPYYTCSCVLGFIACSVFLRMSLEPKVVLLTVALVAYLVLFNLSPCWQWDCCGQGLGNLTKPNGTTSGTPSCSWKDLKTMTNFYLVLFYITLLTLSRQIDYYCRLDCLWKKKFKKEHEEFETMENVNRLLLENVLPAHVAAHFIGDKDWYHQSYDCVCVMFASVPDFKVFYTECDVNKEGLECLRLLNEIIADFDELLLKPKFSGVEKIKTIGSTYMAAAGLSVASGHENQELERQHAHIGVMVEFSIALMSKLDGINRHSFNSFRLRVGINHGPVIAGVIGARKPQYDIWGNTVNVASRMESTGELGKIQVTEETCTILQGLGYSCECRGLINVKGKGELRTYFVCTDTAKFQGLGLN

SEQ ID NO: 917105 - protein, 928 aa, Homo sapiens
PLPLGRPLGRRWSGSAQQLLANAVIFLCGNLTGAFHKHQMQDASRDLFTYTVKCIQIRRKLRIEKRQQENLLLSVLPAHISMGMKLAIIERLKEHGDRRCMPDNNFHSLYVKRHQNVSILYADIVGFTQLASDCSPKELVVVLNELFGKFDQIAKANECMRIKILGDCYYCVSGLPVSLPTHARNCVKMGLDMCQAIKQVREATGVDINMRVGIHSGNVLCGVIGLRKWQYDVWSHDVSLANRMEAAGVPGRVHITEATLKHLDKAYEVEDGHGQQRDPYLKEMNIRTYLVIDPRSQQPPPPSQHLPRPKGDAALKMRASVRMTRYLESWGAARPFAHLNHRESVSSGETHVPNGRRPKSVPQRHRRTPDRSMSPKGRSEDDSYDDEMLSAIEGLSSTRPCCSKSDDFYTFGSIFLEKGFEREYRLAPIPRARHDFACASLIFVCILLVHVLLMPRTAALGVSFGLVACVLGLVLGLCFATKFSRCCPARGTLCTISERVETQPLLRLTLAVLTIGSLLTVAIINLPLMPFQVPELPVGNETGLLAASSKTRALCEPSRGTPSCSWKDLKTMTNFYLVLFYITLLTLSRQIDYYCRLDCLWKKKFKKEHEEFETMENVNRLLLENVLPAHVAAHFIGDKDWYHQSYDCVCVMFASVPDFKVFYTECDVNKEGLECLRLLNEIIADFDELLLKPKFSGVEKIKTIGSTYMAAAGLSVASGHENQVLKPKKVKFSCLSSLKGDLSPYLKGVPLSRPGGGAQVLVGLSQDFSGGDPQQELARQGPLGLGALEMQGSDPQPVPQELERQHAHIGVMVEFSIALMSKLDGINRHSFNSFRLRVGINHGPVIAGVIGARKPQYDIWGNTVNVASRMESTGELGKIQVTEETCTILQGLGYSCECRGLINVKGKGELRTYFVCTDTAKFQGLGLN

SEQ ID NO: 917106 - protein, 729 aa, Homo sapiens
PLPLGRPLGRRWSGSAQQLLANAVIFLCGNLTGAFHKHQMQDASRDLFTYTVKCIQIRRKLRIEKRQQENLLLSVLPAHISMGMKLAIIERLKEHGDRRCMPDNNFHSLYVKRHQNVSILYADIVGFTQLASDCSPKELVVVLNELFGKFDQIAKANECMRIKILGDCYYCVSGLPVSLPTHARNCVKMGLDMCQAIKQVREATGVDINMRVGIHSGNVLCGVIGLRKWQYDVWSHDVSLANRMEAAGVPGRVHITEATLKHLDKAYEVEDGHGQQRDPYLKEMNIRTYLVIDPRSQQPPPPSQHLPRPKGDAALKMRASVRMTRYLESWGAARPFAHLNHRESVSSGETHVPNGRRPKSVPQRHRRTPDRSMSPKGRSEDDSYDDEMLSAIEGLSSTRPCCSKSDDFYTFGSIFLEKGFEREYRLAPIPRARHDFACASLIFVCILLVHVLLMPRTAALGVSFGLVACVLGLVLGLCFATKFSRCCPARGTLCTISERVETQPLLRLTLAVLTIGSLLTVAIINLPLMPFQVPELPVGNETGLLAASSKTRALCEPSRGTPSCSWKDLKTMTNFYLVLFYITLLTLSRQIDYYCRLDCLWKKKFKKEHEEFETMENVNRLLLENVLPAHVAAHFIGDKDWYHQSYDCVCVMFASVPDFKVFYTECDVNKEGLECLRLLNEIIADFDELLLKPKFSGVEKIKTIGSTYMAAAGLSVASGHENQVLKPKR

SEQ ID NO: 917107 - protein, 721 aa, Homo sapiens
PLPLGRPLGRRWSGSAQQLLANAVIFLCGNLTGAFHKHQMQDASRDLFTYTVKCIQIRRKLRIEKRQQENLLLSVLPAHISMGMKLAIIERLKEHGDRRCMPDNNFHSLYVKRHQNVSILYADIVGFTQLASDCSPKELVVVLNELFGKFDQIAKANECMRIKILGDCYYCVSGLPVSLPTHARNCVKMGLDMCQAIKQVREATGVDINMRVGIHSGNVLCGVIGLRKWQYDVWSHDVSLANRMEAAGVPGRVHITEATLKHLDKAYEVEDGHGQQRDPYLKEMNIRTYLVIDPRSQQPPPPSQHLPRPKGDAALKMRASVRMTRYLESWGAARPFAHLNHRESVSSGETHVPNGRRPKSVPQRHRRTPDRSMSPKGRSEDDSYDDEMLSAIEGLSSTRPCCSKSDDFYTFGSIFLEKGFEREYRLAPIPRARHDFACASLIFVCILLVHVLLMPRTAALGVSFGLVACVLGLVLGLCFATKFSRCCPARGTLCTISERVETQPLLRLTLAVLTIGSLLTVAIINLVGPVVGRQASGVEGDLQIWDAYNVALKAASGCPLPRAQQPLMPFQVPELPVGNETGLLAASSKTRALCEPLPYYTCSCVLGFIACSVFLRMSLEPKVVLLTVALVAYLVLFNLSPCWQWDCCGQGLGNLTKPNGTTSVKGYNLSLSSIICKMGTNITAHLAVVEDNMGSWGDRVLDTERVTSTWVPTMAITIPTP

SEQ ID NO: 917108 - protein, 201 aa, Homo sapiens
MVNIQHTSSPFYADLLPADPQAACCSFSGFLSTSSLLLTLLLTPNFIHMVGEDDEKFFTTGQKELYLEACKLMGVVPVSYFIRNMEESYVNLNHHGLGPRGTKAIAIALVSNMAVTKLELEDNCIMEEGVLSLVEMLQENYYLQEMVLCPPVLALTIIPGDSQPTGDKPEALPGPRLPPGSCPPLPFPHDFLEEGHITGLK

SEQ ID NO: 917109 - protein, 201 aa, Homo sapiens; identical to SEQ ID NO: 917108

SEQ ID NO: 917110 - protein, 772 aa, Homo sapiens
MTPDCMASSPTKGLTMSVPVAPKKSCYTQLRDNRNAARNNNESILSLGDTNANQIMLEVSSSHDESKTCDLGDEIGNTNSSEPENRTHFHKEFHQLQGFGKGSQAGSASLKDFRLSSTIQRELNEEHTVERGTDSLQTTRSIQGPSLSSWRNVMSEASLDVLAKRDAEIPRHVPKDKLAKTLDNEELRRHSLERASSSVAAVGSLTPQHPQPLSLDSREARGQIPGGGEGPQKTLPDHAVPAAFPATDSTSEGKSVRHPKPSTSESKQSTPSETQTVGAHVLQVCSEHTSHSAHPEPALNLTLASKEIPSKLEAQLGQGKGEAKLDLKYVPPRRVEQEGKAAQEGYLGCHKEENLSALEGRDPCGEAHPEATDALGHLLNSDLHHLGVGRGNCEEKRGVNPGEQDSLHTTPKQGSASLGGADNQPTGKISPCAGEKLGERTSSSFSPGDSHVAFIPNNLTDSKPLDVIEEERRLGSGNKDSVMVLVFNPSVGENKTEVPEPLDPQSGRSEARESKEVTTSVAENRNLLENADKIESTSARADSVLNIPAPLHPETTVNMTYQPTTPSSSFQDVSVFGMDAGSPLVVPPPTDSARLLNTSPKVPDKNTCPSGIPKPVFTHSKDTPSSQEGMENYQVEKTEERTETKPIIMPKPKHVRPKIITYIRRNPQALGQVDASLVPVGLPYAPPTCTMPLPHEEKAAGGDLKPSANLYEKFKPDLQKPRVFSSGLMVSGIKPPGHPFSQMSEKFLQEVRECHYDMVYKLTVPISVTYFQ

SEQ ID NO: 917111 - protein, 401 aa, Homo sapiens
MWGVVHLARNGARDLRVLLIEALCKIFLDESAPDNVLEVTARAITYYLDVSAECTRRIVGVDGAIKALCNRLVVVELNNRTSRDLAEQCVKVLELICTRESGAVFEAGGLNCVLTFIRDSGHLVHKDTLHSAMAVVSRLCGKMEPQDSSLEICVESLSSLLKHEDHQVSDGALRCFASLADRFTRRGVDPAPLAKHGLTEELLSRMAAAGGTVSGPSSACKPGRSTTGAPSTTADSKLSNQVSTIDLLRSELPDSIESALQGDERCVLDTMRLVDLLLVLLFEGRKALPKSSAGSTGRIPGLRRLDSSGERSHRQLIDCIRSKDTDALIDAIDTGAFEVNFMDDVGQTLLNWASAFGTQEMTLLRHGANPDLRDEDGKTPLDKARERGHSEVVAILQSPEG

SEQ ID NO: 917112 - protein, 243 aa, Homo sapiens
MSFALLCHSGSERAAPSSNISLRAVSRLARGTHPSRHGAVSVGCTGWEEPEEVLVEATVKHYGKLFTASQDTQKRLEAFCQMIQAVHRSLESLEEDHRALMLSLKIRLCQLQKKCYRKQEQWWQLKHSITYQKDIDFDTHTSSSYNDQLLGYMQMTITNMARQCCPSAHGVPKSMDLFSKLDLIKDSVMHGMLHSQIQEREPHPHLLSSTMNSAHAEGRSPVSFISNSLCLPGGWHKAGGARC

SEQ ID NO: 917113 - protein, 126 aa, Homo sapiens
MAAMDTGQRADPSNPGDKEGDLQGLWQELYQLQAKQKKLKREVEKHKLFEDYLIKVLEKIPEGCTGWEEPEEVLVEATVKHYGKLFTASQDTQKRLEAFCQMIQAVHRSLESLEEDHRALMLVTAA

SEQ ID NO: 917114 - protein, 211 aa, Homo sapiens
MAAMDTGQRADPSNPGDKEGDLQGLWQELYQLQAKYLLCCLGDAAMGVYLICLWLSLLSSEMKVQRLLSLGQLIKWQKKLKREVEKHKLFEDYLIKVLEKIPEGCSKQQHLLEGSLPPRSVVLIQNPCLSLWLNFPRLHGMGGAGGGAGGGHGEALREALHSQPGHAEAPRGLLPDDPGCPPEPGVSGGGPQGSHVGNSCLKSAPFPVAQG

SEQ ID NO: 917115 - protein, 129 aa, Homo sapiens
MYSSFRHLEKSTEPQEPDKEDDSSAQQQRHRNISQENASQKKTVTQVVTHTLQIRKLRLKVILTSGAAKADTLVLWFPVSGGPHPGCDSSSMDYCKNQDADKMANLRRDGQAKWSTTESLLLRQCGVAP

SEQ ID NO: 917116 - protein, 626 aa, Homo sapiens
MVVSGSLGLSQLLWQFSSRSKARMEWKLEQSMREQALLKAQLTQLKESLKEVQLERDEYAEHLKGERARWQQRMRKMSQEVCSLKKEKKHDKYRVETLERSLSKLKHQMGEDGAGVTWQQDWHQRAVRVAWSAPARWVDGKGFEERERGLCQETASLVISMSLSVPISKEGPLSATRSALSLKVVWKTGYHLAEPLPPEPPAVPSEVELQHLRKELERVAGALQAQVEYNQRISLLNEGQKERLREQEERLQEQQERLREQEERLQQLAEPQNSFKELNNENKSVLQLEQQVKELQEKLGKVKETVTSTPSKKVWEVELKSQEAQSLQQQPDHYLGHLQQYVATYQQQERLEAASQQKQQLTAQLSLMALPGEGHGGEHLDSEGEEAPRPMPSVPEDLESREAMVAFFKSAGASAQEKQAQLQEQVKEQRVCCQRLAHPVASAQKEPEAAVPAPGPGGESSGFMDHLEEKADLSELVEKEELGFFQYYRERCHQKVYHPITKPGGSAKDAAPGGGHHQAGPGQGGDEGRVCNISAGVGVAVTVSAGSSVTAEHPSLQVKLLELQEMVLQLRGACARRGQGGFSPRQAYCTADRAGPPGAPRLGQQLLCAILLLGLAAKKKEINMTI

SEQ ID NO: 917117 - protein, 122 aa, Homo sapiens
ALEAWRSLSSQKFSEGEGPTSPAGQALATESQKPRAEAKSQSQRGWGTPTTERRLRNPSETTLSVLLHLDRMSQQHRRKRPSSERQVSKTATDGSYLLVFTSYVISSPVWAGPGDLLPVNRI

SEQ ID NO: 917118 - protein, 171 aa, Homo sapiens
MQQLWEPRDHCCPVIVSPTMGERPGRFPQRTVQAVWRQWSTLRCGLCGFAFYSRHKIRGLLAWADPGHRLPCRLGSYNLKHLESESPALPPAAASFFCPVGPRGNWLGRGRGGGTGGLGQSPAVLENEFRSCPAPGWHWAQGQALDPARTPLLKPPQPPPSLSVHSAGLKT

SEQ ID NO: 917119 - protein, 122 aa, Homo sapiens; identical to SEQ ID NO: 917117

SEQ ID NO: 917120 - protein, 807 aa, Homo sapiens
MAGHRLTGWAFGGPHGSGSRAAPVCSLTRGDTWFEHVSMLVIMLNCVTLGMFRPCEDVECGSERCNILEAFDAFIFAFFAVEMVIKMVALGLFGQKCYLGDTWNRLDFFIVVAGMMEYSLDGHNVSLSAIRTVRVLRPLRAINRVPSMRILVTLLLDTLPMLGNVLLLCFFVFFIFGIVGVQLWAGLLRNRCFLDSAFVRNNNLTFLRPYYQTEEGEENPFICSSRRDNGMQKCSHIPGRRELRVPCTLGWEAYTQPQAEGVGAARNACINWNQYYNVCRSGDSNPHNGAINFDNIGYAWIAIFQVITLEGWVDIMYYVMDAHSFYNFIYFILLIIVGSFFMINLCLVVIATQFSETKQRESQLMREQRARHLSNDSTLASFSEPGSCYEELLKYVGHIFRKVKRRSLRLYARWQSRWRKKVDPSAVQGQGPGHRQRRAGRHTASVHHLVYHHHHHHHHHYHFSHGSPRRPGPEPGACDTRLVRAGAPPSPPSPGRGPPDAESVHSIYHADCHIEGPQERARVAHAAATAAASLRLATGLGTMNYPTILPSGVGSGKGSTSPGPKGKWAGGPPGTGGHGPLSLNSPDPYEKIPHVVGEHGLGQAPGHLSGLSVPCPLPSPPAGTLTCELKSCPYCTRALEDPEGELSGSESGDSDGRGVYEFTQDVRHGDRWDPTRPPRATDTPGPGPGSPQRRAQQRAAPGEPGWMGRLWVTFSGKLRRIVDSKYFSRGIMMAILVNTLSMGVEYHEQPEELTNALEISNIVFTSMFALEMLLKLLACGPLGYIRNPYNIFDGIIVVIRHYGVRTC

SEQ ID NO: 917121 - protein, 788 aa, Homo sapiens
RPRSWCLRLVCNPWFEHVSMLVIMLNCVTLGMFRPCEDVECGSERCNILEAFDAFIFAFFAVEMVIKMVALGLFGQKCYLGDTWNRLDFFIVVAGMMEYSLDGHNVSLSAIRTVRVLRPLRAINRVPSMRILVTLLLDTLPMLGNVLLLCFFVFFIFGIVGVQLWAGLLRNRCFLDSAFVRNNNLTFLRPYYQTEEGEENPFICSSRRDNGMQKCSHIPGRRELRVPCTLGWEAYTQPQAEGVGAARNACINWNQYYNVCRSGDSNPHNGAINFDNIGYAWIAIFQVITLEGWVDIMYYVMDAHSFYNFIYFILLIIVGSFFMINLCLVVIATQFSETKQRESQLMREQRARHLSNDSTLASFSEPGSCYEELLKYVGHIFRKVKRRSLRLYARWQSRWRKKVDPSAVQGQGPGHRQRRAGRHTASVHHLVYHHHHHHHHHYHFSHGSPRRPGPEPGACDTRLVRAGAPPSPPSPGRGPPDAESVHSIYHADCHIEGPQERARVAHAAATAAASLRLATGLGTMNYPTILPSGVGSGKGSTSPGPKGKWAGGPPGTGGHGPLSLNSPDPYEKIPHVVGEHGLGQAPGHLSGLSVPCPLPSPPAGTLTCELKSCPYCTRALEDPEGELSGSESGDSDGRGVYEFTQDVRHGDRWDPTRPPRATDTPGPGPGSPQRRAQQRAAPGEPGWMGRLWVTFSGKLRRIVDSKYFSRGIMMAILVNTLSMGVEYHEQPEELTNALEISNIVFTSMFALEMLLKLLACGPLGYIRNPYNIFDGIIVVIRHYGVRTC

SEQ ID NO: 917122 - protein, 129 aa, Homo sapiens
RPRSWCLRLVCNPWFEHVSMLVIMLNCVTLGMFRPCEDVECGSERCNILEAFDAFIFAFFAVEMVIKMVALGLFGQKCYLGDTWNRLDFFIVVAGMMEYSLDGHNVSLSAIRTVRVLRPLRAINRVPSK

SEQ ID NO: 917123 - protein, 212 aa, Homo sapiens
HLRQTRYRVPLSMSLTLSLMLEYSGNTQVSLAIFPLSFRQTAADGAIWMETWDSGLCFPGCLSLKGPGSVTGTAGDSLTVWCQYESMYKGYNKYWCRGQYDTSCESIVETKGEEKVERNGRVSIRDHPEALAFTVTMQNLNEDDAGSYWCKIQTVWVLDSWSRDPSDLVRVYVSPAITTPRRTTHPATPPIFLVVNPGRNLSTGEVLTQNSG

SEQ ID NO: 917124 - protein, 166 aa, Homo sapiens
MWLLPALLLLCLSGCLSLKGPGSVTGTAGDSLTVWCQYESMYKGYNKYWCRGQYDTSCESIVETKGEEKVERNGRVSIRDHPEALAFTVTMQNLNEDDAGSYWCKIQTVWVLDSWSRDPSDLVRVYVSPAITTPRRTTHPATPPIFLVVNPGRNLSTGEVLTQNSG

SEQ ID NO: 917125 - protein, 173 aa, Homo sapiens
MASRWRQAPRHDPLAAGAPRSGREASPQTKLEPMRSLGVQSSPGSALTRGSASPRSRAQSGAHRAPVADDCVLRGIIESVHKSLTDQTSQGDRGVELPQDLPHSDGKQMALEERFISCICGISPSTGKNLMLSYQPLWGFHLCSKKMDSFKNSKINWNGASSVQRVINGPGAD

SEQ ID NO: 917126 - protein, 174 aa, Homo sapiens
MEKQSVVLDRRLNIIKKKKKLIIRQGEDTDYHQIGKIKPSDDVCGAVTGKGPKPDPKRGFFDLEQERIWDKSTGNVAQQVSASFYPAPIQVKVALLPMPLTYFPPPFYKRTTNPKGCRESISILTAIHNSEFQQKVISGRLANVQFKKTASKLILHSYTTSTTGIYSTIVKQNK

SEQ ID NO: 917127 - protein, 492 aa, Homo sapiens
LERARALGQEGGRSLQERPVEGLRASDKPLSGVLGAQDTWLMPSPQRLACEAGALAHSGYGGTMFGGHGTSGPSCALLALISPPGDYSIVKSHNDKNKKLEEGSPGYNPPEEAPVKSVGRRVLDGLKHCYHSFSLLWMDTRTATHSLWGILSGHMLTHREHRQFVRVRADLFCLVPLLIFAVVLFMELLRSERQERPNNEEIMRFPKLFEDELTLDNLTCQQLLKSTLQTLPETVVKGAQVKVDKVKEAIPRNEVEEATPERPVADQQPEVPDVILPSEALKDTAPVLEILKEEKITKEEMGVLSDACSKLKEQNKSLTKEKEELELLKEDVQDDSDDLQEIKKEVSKTSKEKYVEKSKASKTLTKRVQQMIWWIDSLIAQLEMDQRPGKLGQAEDSGGAGEKVIGITELISTMKQIKNIPENKLISLASTLDKSKNGKVNTDKLIKVIELVDKDVHISTSQVAEIVAMLEKEERWRRRRRLRERLRRRLQK

SEQ ID NO: 917128 - protein, 336 aa, Homo sapiens
MAEISDLDRQIEQLRRCELIKESEVKALCAKAREILVEESNVQRVDSPVTVCGDIHGQFYDLKELFRVGGDVPETNYLFMGDFVDRGFYSVETFLLLLALKVRYPDRITLIRGNHESRQITQVYGFYDECLRKYGSVTVWRYCTEIFDYLSLSAIIDGKVKPAQGSMGQGEEGGFRPQPRPLSLLSPVDLLRARGPLPLHPDLDQIRTIDRKQEVPHDGPMCDLLWSDPEDTTGWGVSPRGAGYLFGSDVVAQFNAANDIDMICRAHQLVMEGYKWHFNETVLTVWSAPNYCYRCGNVAAILELDEHLQKDFIIFEAAPQETRGIPSKKPVADYFL

SEQ ID NO: 917129 - protein, 207 aa, Homo sapiens
MAEISDLDRQIEQLRRCELIKESEVKALCAKAREILVEESNVQRVDSPVTVCGDIHGQFYDLKELFRVGGDVPETNYLFMGDFVDRGFYSVETFLLLLALKVRYPDRITLIRGNHESRQITQVYGFYDECLRKYGSVTVWRYCTEIFDYLSLSAIIDGKIFCVHGGLSPSIQTWIRFGQSTESKRCLMMGPCVTSSGLTQKTPQAGA

SEQ ID NO: 917130 - protein, 161 aa, Homo sapiens
MHWVRQATGKGLEWVSAIGTAGDTYYPGSVKGRFTISRENAKNSLYLQMNSLRAGDTAVYYCARDTVRGMFLLPVKWGCGSCCQSSRSQAHSLQLRWGSGCGSCSHVEEADGTFLSPIAQHPPVCHVETHLRMEVANSSEGDELVWTKWDVDVKFILCCAK

SEQ ID NO: 917131 - protein, 164 aa, Homo sapiens
MFSTIWQNLNDTGFRTENVRERGSMKSKDIKTEVSYGKEFTKRFKGLSISSLLSTILHMCQPQGFCTYVEIFGSISVLQGKLSSVGGKQKTVESTEPWTVTQRMSTRSSLLCHSAQHDVNSTADRCSQEDRSPSTNSHQRKLFPRTQYVGPLTLHTAHDAEVQC

SEQ ID NO: 917132 - protein, 314 aa, Homo sapiens
EYSLFASTMLYVMWKNVGRFLASTPGHSHTPTPVSLFRETFFAGPVLGLLLFVVGLAVFIIYEVQVSGDGSRTRQALVIYYSFNIVCLGLTTLVSLSGSIIYRFDRRAMDHHKNPTRTLDVALLMGAALGQYAISYYSIVAVVAGTPQDLLAGLNLTHALLMIAQHTFQNMFIIESLHRGPPGAEPHSTHPKEPCQDLTFTNLDALHTLSACPPNPGLVSPSPSDQREAVAIVSTPRSQWRRQCLKDISLFLLLCNVILWIMPAFGARPHFSNTVEVDFYGYSLWAVIVNICLPFGIFYRMHAVSSLLEVYVLS

SEQ ID NO: 917133 - protein, 206 aa, Homo sapiens
MNACLLLSLKFFNNPYSKEKGTSLQWTIGARSIHCLPPVQYVEKLQFLLRTLDCLLSTRTSAPACINLNAFRDVRPPKSADGRNQSQRVQENFRRLTEQKRGEKSKPMFLDGKQTECGGKNTNFRISLPRTNPGLVLMTLAHFCKSQFCVCQAELEFWLGHFLVVTLDEFLKFLVPHLFPHLSSGEIPHQMKRLTLHISLGVVRVK

SEQ ID NO: 917134 - protein, 203 aa, Homo sapiens
MLKESKADIFVDPVLHTACALDIKHHCAAITPGRGRQMSCLMEALEDKRVRLQPECKKRLNDRIEMWSYAAKVAPADGFSDLAMQVMTSPSKNYILSVISGSICILFLIGLMCGRITKRVTRELKDRSTLGPRQGRGLHRGVGGQPFPRLCGVLLSSAETVTLSSFHPNQPLLVTAPQPWVLANSYSSWVTVIWTYQFMPVSL

SEQ ID NO: 917135 - protein, 481 aa, Homo sapiens
IVDKTEGWTSGEPGLLSHSQPEVTWREALSLELITNKELKEKNAELQEKLRLVETEKSEIQLHIKELKRKLETDKIPLPQVQTNTLQEKMWRQEEELRDQEELRDQEKLRKHEEKMWRQEQRLRDQEKELREQEQQMQEQEEQMRKQEEQMRKQEEQMRKQEEQMRKQEEQMRKQEEQMRKQEEQMGKQEEQMGEQEEQMRKQEKQMLKQKEQMRKQEEQMWKQEEQIGEQEEQMRKQEEQMWKQEEQIGEQEEQMRKQEEQMWKQEEQMGEQMRKQEEQMGEQEEQIRKQEEQMGEQEEQMRKQEEQMGEQEEQMRKQEEQMGEQEEQMRKQEEQMGEQEEQMGEQEEQMRKQVERLQFKEERLWDEYEKMQEEEEKIRRQVEKRREKKERMGEQEKTQEERCSEPCLPPSKYPSDMSHPGSLEPAREAGKGYSHDNRTAQIMQLPPGMKNAQERPGLGSTSCIPFFYGGDKKKIKIISI

SEQ ID NO: 917136 - protein, 615 aa, Homo sapiens
MVSFFAHDMTAGFGGHSDVEAPVSTCFSCLPKAQDHTIRILMCQKTELETALHDSQDAARKFEEDSKDLAARLHHSWHFAGELQRALSAMSAEHERADKDAVSCPEDSMGHFLLLLCVVVRGRLGLSQLLWLLLCLLYPDLTFLCLQYIKELTKEREAMSLELFRNIITNKELKEKNAELQEKLRLVETEKSEIQLHIKELKRKLETDKIPLPQVQTNTLQEKMWRQEEELRDQEELRDQEKLRKHEEKMWRQEQRLRDQEKELREQEQQMQEQEEQMRKQEEQMRKQEEQMRKQEEQMRKQEEQMRKQEEQMRKQEEQMGKQEEQMGEQEEQMRKQEKQMLKQKEQMRKQEEQMWKQEEQIGEQEEQMRKQEEQMWKQEEQIGEQEEQMRKQEEQMWKQEEQMGEQMRKQEEQMGEQEEQIRKQEEQMGEQEEQMRKQEEQMGEQEEQMRKQEEQMGEQEEQMRKQEEQMGEQEEQMGEQEEQMRKQVERLQFKEERLWDEYEKMQEEEEKIRRQVEKRREKKERMGEQEKTQEERCSEPCLPPSKYPSDMSHPGSLEPAREAGKGYSHDNRTAQIMQLPPGMKNAQERPGLGSTSCIPFFYGGDKKKIKIISI

SEQ ID NO: 917137 - protein, 224 aa, Homo sapiens
MTARAWASWRSSALLLLLVPGYFPLSHPMTVAGPVGGSLSVQCRYEKEHRTLNKFWCRPPQILRCDKIVETKGSAGKRNGRVSIRDSPANLSFTVTLENLTEEDAGTYWCGVDTPWLRDFHDPIVEVEVSVFPAGTTTASSPQSSMGTSGPPTKLPVHTWPSVTRKDSPEPSPHPGSLFSNVRFLLLVLLELPLLLSMLGAVLWVNRPQRSSRSRQNWPKGENQ

SEQ ID NO: 917138 - protein, 140 aa, Homo sapiens
MTARAWASWRSSALLLLLVPGYFPLSHPMTVAGPVGGSLSVQCRYEKEHRTLNKFWCRPPQILRCDKIVETKGSAGKRNGRVSIRDSPANLSFTVTLENLTEEDAGTYWCGVDTPWLRDFHDPIVEVEVSVFPGEPLLFS

SEQ ID NO: 917139 - protein, 148 aa, Homo sapiens
MKQRTQVVPRFLTHRYRVIINAYCLKPPSFLGNGSETVKKKKEGEEGEGGGGRGGAGGGREGGEGGEEERKKEKEKEKKLIWFGFVYPPKSHVELFNANPIKIPITFFTEIEKTILKFIWNHKGTRIAKAIISKKNKARGIKLYYKAT

SEQ ID NO: 917140 - protein, 152 aa, Homo sapiens
MLKGNKTKKKKEWKGGLADAVTDVEGPVINKMCPSNIEMRTLTSKKVMGTEEEQNQSVKLFVILQPILCLYTVQLLLPGKIFDFTCEVEDTGISRLRSDMTCAGALEMQVQWLVGYLASWVSQAQVHPYTPLGNHKTLSLARINYWEDNTLD

SEQ ID NO: 917141 - protein, 152 aa, Homo sapiens; identical to SEQ ID NO: 917140

SEQ ID NO: 917142 - protein, 793 aa, Homo sapiens
MLRGDHPDVLEDKNERADEEILRVRFGRCTRPTPWMWLREPGKPGMSLLLLFVVEELEACAFRVQVGQLRLYEDDQRTKVVEIVRHPQYNESLSAQGGADIALLKLEAPVPLSELIHPVSLPSASLDVPSGKTCWVTGWGVIGRGELLPWPLSLWEATVKVRSNVLCNQTCRRRFPSNHTERFERLIKDDMLCAGDGNHGSWPGDNGGPLLCRRNCTWVQVEVVSWGKLCGLRGYPGMYTRVTSYVSWIRQVLLVPQDVALRAAPLPPAPDLQEAEVPIMRTRACERMYHKGPTAHGQVTIIKAAMPCAGRKGQGSCQGKWSWQVSLRIYSYHWASWVPICGGSLIHPQWVLTAAHCIFRKDTDPSTYRIHTRDVYLYGGRGLLNVSQISLEFTDSDNCWNTGWGMVGLLDMLPPPYRPQQVKVLTLSNADCERQTYDAFPGAGDRKFIQDDMICAGRTGRRTWKGDSGGPLVCKKKGTWLQAGVVSWGFYSDRPSIGVYTPFTHVTCYPTAIPRPFTHVTCYLMAVPSTLTHVTCYPTAVPRPFTHVTCYLMAVPSTLTHITCYMMAVPRPFTHITCYPMAVPSTLTHAFNHATCYTTAIPSTLTHVTCYTMAVPRPITHVTCYTIAAHGCVLYLSLENDLVGIVGGHNAPPGKWPWQVSLRVYSYHWASWAHICGGSLIHPQWVLTAAHCIFWKDTDPSIYRIHAGDVYLYGGRGLLNVSRIIVHPNYVTAGLGADVALLQLSLPPPYRLQQASVQVLENAVCEQPYRNASGHTGDRQLILDDMLAETPAT

SEQ ID NO: 917143 - protein, 877 aa, Homo sapiens
MATPVPLSPTVLAVIQAPLSSIPPPCPPPPPARAPLDSGAWVRSSTRHAEPLPVLQRPLLECGRGTPFRRRRPGPSHSLTEPRSVTVPLLRSTVLGLRTAPPPRPPAPLPSSRFVPLTGGEIRSHSAPGSSEDRSLTVPGLGVTVRGPGVGTFEEEDRALRGSPSCIEVHAGCLGPRGRPGAAPWTAGDFVPRPLRPRPRVSVSDVLVVAALALRTLRLRQRGLAAPAPARPRPPTSCLSPNTAALPCGGPFSVSPARPVHFGAMNDQYHRAARDGYLELLKEATRKELNAPDEDGMTPTLWAAYHGNLESLRLIVSRGYCPVPEHVVGAGDPSFLPSPWAAPWAQHQSWLPPHSPPRPAKARHLLSHSGLPGLALLPADTALPADMQAHTSHTLIPGWGPAHTTHCQDSSLVPPECFPCRGDPDKCDIWGNTPLHLAASNGHLHCLSFLVSFGANIWCLDNDYHTPLDMAAMKGHMECVRYLDSIAAKQSSLNPKLVGKLKDKAFREAERRIPECAKLQRRHHERMERRYRRELAERSDTLSFSSLTSSTLSRRLQHLALGSHLPYSQATLHGTARGKTKMQKKLERRKQGGEGTFKVSEDGRKRRSLSGLQLGSDVMFVRQGTYANPKEWGRAPLRDMFLSDEDSVSRATLAAEPAHSEVSTDSGHDSLFTRPGLGTMVFRRNYLSSGLHGLGREDGGLDGVGAPRGRLQSSPSLDDDSLGSANSLQDRSCGEELPWDELDLGLDEDLEPETSPLETFLASLHMEDFAALLRQEKIDLEALMLCSDLDLRSISVPLGPRKKILGAVRRRRQAMERRRPWRTQSYNRGLLSPDQNELQVATTYGGVSRSSQLPALQPPSPGARTSWGDSFESLSAP

SEQ ID NO: 917144 - protein, 68 aa, Homo sapiens
MSEKTRQNKLAEAKKKFTDYRQWNIAGVGTRATDTKKKKINNGTNPETTTSEGCHSPEDTQQNRAQLK

SEQ ID NO: 917145 - protein, 738 aa, Homo sapiens
MALTLRQPLRRVAIHLRMWVLAGRSPEDKGHKGRSREKKASHQHQEALRREIEESPRISPAACIIPGTLQESYSGLSLLCPHGTRRQTGITNEELKKKNAELQEKLRLAESEKSEIQLNVKELKRKLERAKFLLPQEEMWRQEEELREQEKKIRKQEEKMWRQEERLREQEGKMREQEEKMRRQEKRLREQEKELREQEKELREQKKLREQEEQMQEQEEKMWEQEEKMREQEEKMWRQEERLWEQEKQMREQEQKMRDQEERMWEQDERLREKEERMREQEKMWEQVEKMREEKKMQEQEKKTRDQEEKMQEEERIREREKKMREEEETMREQEEKMQKQEENMWEQEEKEWQQQRLPEQKEKLWEQEKMQEQEEKIWEQEEKIRDQEEMWGQEKKMWRQEKMREQEDEQEKQMWEQEEKMRDQEQKMWDQEERMWEQDERLREKEERMREQKKMWQQVEKMREEKKTQEQEKKTWDQEEKMREEERMREREKKMREEEEMMREQEEKMQEQEEKMREQEEKMWEQEEKMQEQEEKMWEQEEKMWEQEEKMWEQQRLPEQKEKLWEHEKMQEQEIQEQKMWDQKERMWEQDERLREKEERMREQKMWQQVEKMREKKKTQEEKMQEGSRRRRCGSRRRRCGSRRRRCWSTEEKMQGQEEKMREQEEKMQGQEEKMREQEEKMRGQEENMWGQEEKMWGQEEKMWGQEEMREKEERILDHKEKMQERLPEHEERSAQD

SEQ ID NO: 917146 - protein, 145 aa, Homo sapiens
MATQISTRGSQCTIGQEEYSLYSSLSEDELVQMAIEQSLADKTRGPTTAEATASACTNRQPAHFYPWTSPTSSSQSQDFLKQRHPDMTPPTTAMHGCNFKGSNSQKSKEKQLVLTSPALSECSSTNLMMASASQTSFLGLPGTPS

SEQ ID NO: 917147 - protein, 135 aa, Homo sapiens
MALSGATLNATLTVRTPEVKSSVTQDCSPLQIPVTCSGSSDYPHFYPTWLQIGSSHDPSSGMDGGALTDTSLTDSYFSTSFIGVNGFGSPVETKYPLMQTGSCCVTQAEVQWRNHGPLQLQPSRHKQYSSLASAS

SEQ ID NO: 917148 - protein, 693 aa, Homo sapiens
MKPVHERSQECLPPKKRDLPVTSEDMGRTTSCSTNHTPSSDASEWSRGVVVAGQSQAGARVSLGGDGAEAITGLTVDQYGMLYKVAVPPATFSPTGLPSVVNMSPLPPTFNVASSLIQHPGIHYPPLHYAQLPSTSLQFIGSPYSLPYAVPPNFLPSPLLSPSANLATSHLPHFVPYASLLAEGATPPPQAPSPAHSFNKAPSATSPSGQLPHHSSTQPLDLAPGRMPIYYQMSRLPAGYTLHETPPAGASPVLTPQESQSALEAAAANGGQRPRERNLVRRESEALDSPNSKGEGQGLVPVVECVVDGQLFSGSQTPRVEVAAPAHRGTPDTDLEVQRVVGALASQDYRVVAAQRKEEPSPLNLSHHTPDHQGEGRGSARNPAELAEKSQARGFYPQSHQEPVKHRPLPKAMVVANGNLVPTGTDSGLLPVGSEILVASSLDVQARATFPDKEPTPPPITSSHLPSHFMKGAIIQLATGELKRVEDLQTQDFVRSAEVSGGLKIDSSTVVDIQESQWPGFVMLHFVVGEQQSKVSIEVPPEHPFFVYGQGWSSCSPGRTTQLFSLPCHRLQVGDVCISISLQSLNSNSVSQASCAPPSQLGPPRERPERTVLGSRELCDSEGKSQPAGEGSRVVEPSQPESGAQACWPAPSFQRYSMQGEEARAALLRPSFIPQEVLPPPNTISYPLILPDL

SEQ ID NO: 917149 - protein, 220 aa, Homo sapiens
MFTEYQALKGQNHPPTGPALGPGHPAGAGCAERHAELWDSGAQETDNERSAQGTSAPLLPLLQRFQSIICRKDAPHSEGDMHMRQVWEATCLWRRLRSVRADFLVSTEPSLKHALLNQYQKRTTKIVACFVGPSFVLGSVQGMSPELSLCLVPAPPLIGVDVFLNSLKQTVVTLASSADVLSTEQSASQAMLQSGWSMLLPTAEKQARALCSPALRSFRQ

SEQ ID NO: 917150 - protein, 138 aa, Homo sapiens
SPASARPSGRERRRDRGRRLSQRLLGGCVRTPAGRGGPALRVRPETWEEAGEKMPSESLCLAARARLDSKWLKTDIQMESCSVAQAGVQWCHLGSLQALPPGFMPLSCLSLLSSWNYRRPPSYLVNFCIFSRDGVLPC

SEQ ID NO: 917151 - protein, 136 aa, Homo sapiens
QGCSDSKRTLMPLNPFPIGTVPTSWNKEQGPCLCGYSPPAGPPKTTDASYGAGLGTARLSLAIHPPGVGSNSFLSVAAESGGKLQRMDKTHRPSVHLLCFVNLFSNVKHSIAVVRHHLKTYHLGKGILLKIYKNHS

SEQ ID NO: 917152 - protein, 135 aa, Homo sapiens
AATAMVSAKGIQDACAMRTPLKGHTVARSPPAEMIHSQIQKPAEHRIQRQWGSKPAVLAAHQLSCLRFLGLITHCGDLGPVADNERVPASQHWRKGDCKCRQTLPSFLPLWVTVSFCANQRLRLKEGCADRTNPE

SEQ ID NO: 917153 - protein, 114 aa, Homo sapiens
MQKEMEQDVKRLGQAAWATAIPRLEKLKLMLAQETLQLMRAKELYLNCKRAEIQGKMEDLPEQEKNINVVDELEIQFYEIQLELYEVKFEILKNKEILLTTQLDSLERLIKVKP

SEQ ID NO: 917154 - protein, 131 aa, Homo sapiens
MQKEMEQDVKRLGQAAWATAIPRLEKLKLMLAQETLQLMRAKELYLNCKRAEIQGKMEDLPEQEKNINVVDELEIQFYEIQLELYEVKFEILKNKEILLTTQLDSLERLIKEKQDEVVYYDPCESPEELSH

SEQ ID NO: 917155 - protein, 207 aa, Homo sapiens
MVALMKVYQEEDEAYQELVTVATTFFQYLLRPFRAMEKLQLYKSLDEDDLGPRRVVALEKEAEEWTRRAGEAVVSIQDITVNYFKETVKALAGMQKEMEQDVKRLGQAAWATAIPRLEKLKLMLAQETLQLMRAKELYLNCKRAEIQGKMEDLPEQEKNINVVDELEIQFYEIQLELYEVKFEILKNKEILLTTQLDSLERLIKVKP

SEQ ID NO: 917156 - protein, 166 aa, Homo sapiens
MIISVISCRLQWTPLRKVITEENRCQQFGREGLGLNTQTNYSKSHQGGRCLPSAHGVSQSPKYSSPEQSHLYCQMQKPQPGARRCLDSSKSCRSSRPLATVIEFPVKALACSSSSPGLMPGPGDERTNKITLPSGSFQSKETQEAQHNVMISVTWLSPGGHKKRGL

SEQ ID NO: 917157 - protein, 285 aa, Homo sapiens
MHTKKRVSSFRGNKIGLKDVITLRRHVETKVRAKIRKRKVTTKINRHDKINGKRKTARKQKMFQRAQELRRRAEDYHKCKIPPSARKPLCNWVRMVAAEHRHSSGLPYWLYLTAETLKNRMGRQPPPPTQQHSITDNSLSLKTPPECLLTPLPPSVDDNIKECPLAPLPPSPLPPSVDDNLKECLFVLLPPSPLPPSVDDNLKTPPLATQEAEVEKPPKPKRWRVDEVEQSPKPKRRRVDEVEQSPKPKRQREAEAQQLPKPKRRRLSKLRTRHCTQAWAIRINP

SEQ ID NO: 917158 - protein, 216 aa, Homo sapiens
LQVRMAAAEHRHSSGLPYWLYLTAETLKNRMGRQPPPPTQQHSITDNSLSLKTPPECLLTPLPPSVDDNIKECPLAPLPPSPLPPSVDDNLKECLFVPLPPSPLPPSVDDNLKECLFVPLPPSPLPPSVDDNLKTPPLATQEAEVEKPPKPKRWRVDEVEQSPKPKRRRVDEVEQSPKPKRQREAEAQQLPKPKRRRLSKLRTRHCTQAWAIRINP

SEQ ID NO: 917159 - protein, 160 aa, Homo sapiens
MHTKKRVSSFRGNKIGLKDVITLRRHVETKVRAKIRKRKVTTKINRHDKINGKRKTARKQKMFQRAQELRRRAEDYHKCKIPPSARKPLCNWVSLFVFLAFEHSLPGQDMDTFFSLQLCAQALQREMAERKAAYRHHSPIPVGNRVVQKHLHPHPVGPLI

SEQ ID NO: 917160 - protein, 151 aa, Homo sapiens
GTFRGLWMWADIITNTVTEGFLYPGVSCLGVLEEANHTWAWRMSVKFYCVEVALSGRRIHKGALLNDQLLVSSSADVLLLMCGCPLGCVCGTGRGVGVENGYYRYRMGRGRPGWCREMQQLGRKCLSSPRKVTSGFVNSSIAAQLTLVVSC

SEQ ID NO: 917161 - protein, 137 aa, Homo sapiens
MMECNLFIYYYYYYFQFFILSSEVHVQDVQVCYRDKLRGYMKNSRLQQQSGPSAANQLEFAGGPLQTLFAWVSPVEVAEQQILQNGKCCCLILPVEASSQRGTRLYEVSVGPYWEVSPRNFYLCLKMQFKSSHFLEM

SEQ ID NO: 917162 - protein, 149 aa, Homo sapiens
YRCMSLCLTYYYFILINGSIDATRTMPQVNISGVHLLLWIGGIYIPSVSSDHSLMVHNEIFLIWFGCVPTQISHGSSHNSYGKESVGESPRLSLACCHVRPDFAIIVRPPQPRGTGLTLYPGWSAVEQSRLTVASISGVQAILPSQPPE

SEQ ID NO: 917163 - protein, 515 aa, Homo sapiens
MLHPETSPGRGHLLAVLLALLGTTWAEVWPPQLQEQAPMAGALNRKESFLLLSLHNRLRSWVQPPAADMRRLDWSDSLAQLAQARAALCGIPTPSLASGLWRTLQVGWNMQLLPAGLASFVEVVSLWFAEGQRYSHAAGECARNATCTHYTQLVWATSSQLGCGRHLCSAGQTAIEAFVCAYSPGGNWEVNGKTIIPYKKGAWCSLCTASVSGCFKAWDHAGGLCEVPRNPCRMSCQNHGRLNISTCHCHCPPGYTGRYCQVRCSLQCVHGRFREEECSCVCDIGYGGAQCATKVHFPFHTCDLRIDGDCFMVSSEADTYYRARMKCQIKSQKVQDILAFYLGRLETTNEVIDSDFETRNFWIGECPADWGNPGPWRLPADGKGVLRAWSPERGQLLTPFPGEGPGREHMGAASAGKRGQKGSWQQTPGSEWANLDYPGPGLTYKTAKDSFRWATGEHQAFTSFAFGQPDNHGFGNCVELQASAAFNWNDQRCKTRNRYICQFAQEHISRWGPGS

SEQ ID NO: 917164 - protein, 174 aa, Homo sapiens
ACVSRGRSAELEGARSVHTCSRGAESVFVCPGEDLQNWRETELCMCVPGEQRVCTCVQGKICRIGERRSVHVCPGGAWSGHACPRGTSVQGKEEGANPSNCVTFHNGGSDARLREEKLPQWSLLPTLNIGNRGEGQALHLHPGVSTHRVVLREWLSLSGPHNITSLKMIPPLSK

SEQ ID NO: 917165 - protein, 277 aa, Homo sapiens
MPPDADRPVESRVVPPGPYRATKLWNEVTTSFRAGMPLRKHRQHFKKYGNCFTAGEAGDWLYDLLRNNSNFGPEVTRQQLLRKFLKNRIIEDIKGRWGSENVDDNNQLFRFPATLPLKTLPRRHPELRKNSIENFSKDKDSIFKLQNLSRRTAEKHGLHLSQENAEKIKHEIINEDQENAVDDRELSQEDVEEVWRYFILIYLQTILEVDLDELLAGRLVSFLMDHDQEILQVPSYLQTAVEKHLDYLKRGHIESPGDGLFAPLPTYSYEDEDVKEV

SEQ ID NO: 917166 - protein, 411 aa, Homo sapiens
RYVNQTHEQQLVISIFPAVSQAPGHFAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPELQLEESCAEAQDGELDGLWTTITIFITLFLLSVCYSATVTFFKVKWIFSSVVDLKQTIIPDYRNMIGQGA

SEQ ID NO: 917167 - protein, 414 aa, Homo sapiens
MITVTRIGYGDLSESDYCVQGALLTVSSVAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPELQLEESCAEAQDGELDGLWTTITIFITLFLLSVCYSATVTFFKVKWIFSSVVDLKQTIIPDYRNMIGQGA

SEQ ID NO: 917168 - protein, 400 aa, Homo sapiens
MPDRGVVLVLRDTCWCLNELWLSICKKSEFLAFTSGGTAALGCLVKDYFPEPVTVSWNSGALTSGVHTFPAVLQSSGLYSLSSVVTVPSSSLGTQTYICNVNHKPSNTKVDKKVAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPELQLEESCAEAQDGELDGLWTTITIFITLFLLSVCYSATVTFFKVKWIFSSVVDLKQTIIPDYRNMIGQGA

SEQ ID NO: 917169 - protein, 381 aa, Homo sapiens
MAPPLLQPPPRAHRTSGGTAALGCLVKDYFPEPVTVSWNSGALTSGVHTFPAVLQSSGLYSLSSVVTVPSSSLGTQTYICNVNHKPSNTKVDKKVAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPELQLEESCAEAQDGELDGLWTTITIFITLFLLSVCYSATVTFFKVKWIFSSVVDLKQTIIPDYRNMIGQGA

SEQ ID NO: 917170 - protein, 208 aa, Homo sapiens
MYQPSWKPPHVPDQMGHTPVSTESELAVSRGKENLGPQFLQQAAHEAKPNLCGNGPRMVRALSILVSFPIVDYCFQLNTHERKPNMLLMQSHKISRGSQLPCCGDAQGALRRGPCDEELRGLGPKASGELRSPVSSHISKYSGSTSSIPSQYLNFNLMKDLEPSSATPRLLTHRYCVRHLESQIVGDEKDLRNHEKHHGRGDWGALEP

SEQ ID NO: 917171 - protein, 292 aa, Homo sapiens
MVKTPELLSPGPWLLSLHQTVTVHLLSRLPRQPPLPSPPCRRAYAQPPCNALITDTQTHPSPSSPLDHTSAGPQKWDPDVTPSDSKAHNRPLQKGTYTASWHPPQHIQHASSAENSDRVPRPPLARTPYQGPLSRPPASCAPGGGARLSPRPLRPQVNPKGERSGRGARSGLPQRRAAERGPGSWLRSALALPIRLPPQRLPRPGPVPPPPPPLTSSAPPAPVLPPPPPPETVPPQRRRRRRREEAGAAQPTPTQSSERPTAFPRTDPRGMTLRRAGPPGGLSGCRHDMADS

SEQ ID NO: 917172 - protein, 292 aa, Homo sapiens; identical to SEQ ID NO: 917171

SEQ ID NO: 917173 - protein, 127 aa, Homo sapiens
MATVEHLNPSMTLFCTSAHEVLCNCTSHKPKIALPLHFQYLLSTLEKKKKYSLSLYLYELPLNFVVGLNQIIFRILTCYTCCELSSIIILVDLRGMIGEVDLEEDSPFDSVRTITQTQDHSDIQGRG

SEQ ID NO: 917174 - protein, 245 aa, Homo sapiens
PGEAESMRSGLGAALGGSGPGPQTRRGPAGPARLPLGSSAAAGLGHPCQRGPADSAVHTRGGRGRCSARGATCRLVWALPRGCCGAVWRLPWLSLAPSAAPGASWLCRCCPLPGPQGPGSTWRRLLASRFRCSKKSAVQQLTPLLLRSPQVAIFLAGAGRALGSGRPPCSGRRRLSVPAARGGEGATSRHWAPAASPAAGGAGKKDARKRKAPAGPRVARGCAPWFLAREQLLGPPLAKLLPEKL

SEQ ID NO: 917175 - protein, 142 aa, Homo sapiens
MVKLSIVLTPQFLSHDQSQFTKELQQHVKSVTCPCEYLRKVINSLAVYRHRETDFGVGVRDHPGQHGKTPSPQKLDNLIIIIIGFLRRYTFNILFCTSCLCVSILTFCRGILVITNKNKLYKTIHVSGLHYEYVVLPKKSGK

SEQ ID NO: 917176 - protein, 125 aa, Homo sapiens
KVRMWCRSVHFQYKLFLPRQVILHLGTVFNFPFSTPILAPGTEHVIQVRHHRRLLLVKFSFAYCGEMRSLPAGGGVAETQMDLRLSDSHLYGWYVTHLSSGGLSKDYQSPDNFTRTWSQGELAIG

SEQ ID NO: 917177 - protein, 125 aa, Homo sapiens; identical to SEQ ID NO: 917176

SEQ ID NO: 917178 - protein, 125 aa, Homo sapiens; identical to SEQ ID NO: 917176

SEQ ID NO: 917179 - protein, 125 aa, Homo sapiens; identical to SEQ ID NO: 917176

SEQ ID NO: 917180 - protein, 125 aa, Homo sapiens; identical to SEQ ID NO: 917176

SEQ ID NO: 917181 - protein, 196 aa, Homo sapiens
MEERGRRSVDEEKRTRRRESRQEITREGRAKSGAGRGTENNNTGTEAIKKGIRRRVTIEKRGHAEKKKNTTRDYGYLDNVKTKRRCEKSESNYKLRGKRRETMTPQHKGREKRNREESGGAEGGEEDAGKSGGGGGGAAQCELVAPKQSEWRDTPSGCREVQGVEWSHRIIDPYDSGRKTRHVTHDRPQLSTRQED

SEQ ID NO: 917182 - protein, 122 aa, Homo sapiens
MQRLWWQDRQEAIGATAPLWWFTCPPVAGVAPPVRSPEQNTPQATRLMKANSVSPLVFGDIKAVPKGLPSLLTLEGLLSGVDPLMANVVCLMLKDPPPLTALLGFLPLKRNEHGNPLKGIFK

SEQ ID NO: 917183 - protein, 174 aa, Homo sapiens
MVWTDNRRCFSGLLPAGLGAAWEPRVGEIKLKEDSVFVILRASKSIRAAAAAARRHDGQPKTVRSSCLDKKATGCHPGPCVRIPTAQPCTSAVCNEKGWDESGRARVGAVSKAVFKEWKEEWGKDLGSIGSARFPFVSLYNGFVRNAKPGIQRRKYPTMPRKERSCCFVEGVGV

SEQ ID NO: 917184 - protein, 147 aa, Homo sapiens
MQNRYAMCRSGLSRDLQTPGSTSFTSFLPPATGPETSQITSSQQIHSFTHLPFYEFIRPVVIEHSVCSRHCARYKGWYTAQERDSVLDFMGITFWWRTPAWNKESQLRLYPAKILKSAIKKVHNDRAQFLDSGVGHLGQAVKSQAGN

SEQ ID NO: 917185 - protein, 267 aa, Homo sapiens
MGQESGSQPPAALMPRDFQQVELKSQEAQSLQQQRGQYLGHLKQPGSLDQLQQQEAQGKAVAKMARQKLQETQGRELLRTGPQEGQPGNLCAFSPSFLASQEHLEATSQQNQQLQAQLSLMALPGEGDLESRETVVAFFNSAGTSAQEEQRMCCQPLAHPVASSQKKPEAAAPAPGTGGKYITPYGSQGTVPKMRHREEEEIVRLAQDREEMKVNLLEMQGQVLRLVRDHNEGHGKFLATAQNPADEPTLGAPAPQELVCADKQDGQ

SEQ ID NO: 917186 - protein, 174 aa, Homo sapiens [sequence omitted]

SEQ ID NO: 917187 - protein, 561 aa, Homo sapiens
VASRFAELKSGDAAIVDIVPGKPMCAESFSDHPLLSCFAVGDVRQTVAVGVIKAVDKKAAGAGKVTRKLRRDVYGAERDVAAAAGLETCQVFPNYHIYPPTAPHVAYMQPKANAPSFFMADELRQELINRHLITMAQIDQADMPAVPTEVDSYHSLFPLEPLPPPNRIQKSSNFGYITSCYKAVNSKDDLPYCLRRIHGFRLVNTKCMVLVDMWKKIQHSNIVTLREVFTTKAFAEPSLVFAYDFHAGGETMMSRHFNDPNADAYFTKRKWGQHEGPLPRQHAGLLPESLIWAYIVQLSSALRTIHTAGLACRVMDPTKILITGKTRLRVNCVGVFDVLTFDNSQNNNPLALMAQYQQADLISLGKVVLALACNSLAGIQRENLQKAMELVTINYSSDLKNLILYLLTDQNRMRSVNDIMPMIGARFYTQLDAAQMRNDVIEEDLAKEVQNGRLFRLLAKLGTINERPEFQKDPTWSETGDRYLLKLFRDHLFHQVTEAGAPWIDLSHIISCLNKLDAGVPEKISLISRDEKSVLVVTYSDLKRCFENTFQELIAAANGQL

SEQ ID NO: 917188 - protein, 147 aa, Homo sapiens
MMTMAVFKAETAAAGSQEECSVEEHTHRHQHAGRPLTGKTTRCLAGAVGGALGPPSRPTPGKTISLLAPPSAKSCDDCTMNMQDVTIGGSWIKGKKTSFYGVTSHGISGDPVSPILPPSLAFWWGFPVLVGVLQGRLVLQGAQGCGR

SEQ ID NO: 917189 - protein, 147 aa, Homo sapiens; identical to SEQ ID NO: 917188

SEQ ID NO: 917190 - protein, 144 aa, Homo sapiens
AEGGGRPSRRQRRRRFVVKEDGHGDSSVVRVVGAGHQRELLHAWLLGATACGPLACLTVVGGGGDRDCSTTKVAFLALPAQLLHARRRRRHLEPATPRLASLREGGINGDCSAPEWRAGGCSQGWGSGLQQWTGCSSGQVVGAL

SEQ ID NO: 917191 - protein, 170 aa, Homo sapiens
DKGRRPRVSMHTTSENTDRAAPPKCWQATVHVDSPPQGKNQGRKVHSTRLGSMLMYKTPRIVRPPQPCGTIPELGTLNTHSAVSAIQGHSQSMLKLLLSGAFAIYSGTWVPSFLVSIFSRSQKKRRERASGGTVYGPFMEVTPGVTSAYVPLDRIQLNGHTRGIVPGFAG

SEQ ID NO: 917192 - protein, 149 aa, Homo sapiens
MPDAVVTTPAIWEDSRQTLTLLPRLECSGVIIAHCSFKPLGLNDPPTSATQEAGTTGAPPAQATSTASPIRVRIAAPGALRIGPGCFSEEGTLSPSRLHSCLDGRCMGGEGNHTNRDMDGLVQNINTLFAYVYVTQRNHGNNKFPITMQ

SEQ ID NO: 917193 - protein, 99 aa, Homo sapiens
WDSPPPPPGTPWPVLSSCPRSFPLRHLGSGSVLLTQGQEPPGGPRCTPSPGDINGQPHTREDCGTRGAQDWAGLLLRRGDIEPKQAALLLGRKVHGWGG

SEQ ID NO: 917194 - protein, 972 aa, Homo sapiens
VPLWYRIVRVQGSQRCSRNGERWCSSVIVVDLSVSCYMSGRSRGSPYSEILITSRKRQVKSAVNELGSDSESESSLSGEELVTKPVGGNYGKQPLLLSEDEEDTKRVVRSAKDKRFEELTNLIRTIRNAMKIRDVTKCLEEFELLGKAYGKAKSIVDKEGVPRFYIRILADLEDYLNELWEDKEGKKKMNKNNAKALSTLRQKIRKYNRDFESHITSYKQNPEQSADEDAEKNEEDSEGSSDEDEDEDGVSAATFLKKKSEAPSGESRKFLKKMDDEDEDSEDSEDDEDWDTGSTSSDSDSEEEEGKQTALASRFLKKAPTTDEDKKAAEKKREDKAKKKHDRKSKRLDEEEEDNEGGEWERVRGGVPLVKEKPKMFAKGTEITHAVVIKKLNEILQARGKKGTDRAAQIELLQLLVQIAAENNLGEGVIVKIKFNIIASLYDYNPNLATYMKPEMWGKCLDCINELMDILFANPNIFVGENILEESENLHNADQPLRVRGCILTLVERMDEEFTKIMQNTDPHSQEYVEHLKDEAQVCAIIERVQRYLEEKGTTEEVCRIYLLRILHTYYKFDYKAHQRQLTPPEGSSKSEQDQAENEGEDSAVLMERLCKYIYAKDRTDRIRTCAILCHIYHHALHSRWYQARDLMLMSHLQDNIQHADPPVQILYNRTMVQLGICAFRQGLTKDAHNALLDIQSSGRAKELLGQGLLLRSLQERNQEQEKVERRRQVPFHLHINLELLECVYLVSAMLLEIPYMAAHESDARRRMISKQFHHQLRVGERQPLLGPPESMREHVVAASKAMKMGDWKTCHSFIINEKMNGKVWDLFPEADKVRTMLVRKIQEESLRTYLFTYSSVYDSISMETLSDMFELDLPTVHSIISKMIINEELMASLDQPTQTVVMHRTEPTAQQNLALQLAEKLGSLVENNERVFDHKQGTYGGYFRDQKDGYRKNEGYMRRGGYRQQQSQTAY

SEQ ID NO: 917195 - protein, 831 aa, Homo sapiens
MVLSPQTSCPWHCGQLSGYLLHPRSATRADLEDYLNELWEDKEGKKKMNKNNAKALSTLRQKIRKYNRDFESHITSYKQNPEQSADEDAEKNEEDSEGSSDEDEDEDGVSAATFLKKKSEAPSGESRKFLKKMDDEDEDSEDSEDDEDWDTGSTSSDSDSEEEEGKQTALASRFLKKAPTTDEDKKAAEKKREDKAKKKHDRKSKRLDEEEEDNEGGEWERVRGGVPLVKEKPKMFAKGTEITHAVVIKKLNEILQARGKKGTDRAAQIELLQLLVQIAAENNLGEGVIVKIKFNIIASLYDYNPNLATYMKPEMWGKCLDCINELMDILFANPNIFVGENILEESENLHNADQPLRVRGCILTLVERMDEEFTKIMQNTDPHSQEYVEHLKDEAQVCAIIERVQRYLEEKGTTEEVCRIYLLRILHTYYKFDYKAHQRQLTPPEGSSKSEQDQAENEGEDSAVLMERLCKYIYAKDRTDRIRTCAILCHIYHHALHSRWYQARDLMLMSHLQDNIQHADPPVQILYNRTMVQLGICAFRQGLTKDAHNALLDIQSSGRAKELLGQGLLLRSLQERNQEQEKVERRRQVPFHLHINLELLECVYLVSAMLLEIPYMAAHESDARRRMISKQFHHQLRVGERQPLLGPPESMREHVVAASKAMKMGDWKTCHSFIINEKMNGKVWDLFPEADKVRTMLVRKIQEESLRTYLFTYSSVYDSISMETLSDMFELDLPTVHSIISKMIINEELMASLDQPTQTVVMHRTEPTAQQNLALQLAEKLGSLVENNERVFDHKQGTYGGYFRDQKDGYRKNEGYMRRGGYRQQQSQTAY

SEQ ID NO: 917196 - protein, 708 aa, Homo sapiens
MVIDLIDLLCICIFSVMYCIELTWCTSMCSTSSDSDSEEEEGKQTALASRFLKKAPTTDEDKKAAEKKREDKAKKKHDRKSKRLDEEEEDNEGGEWERVRGGVPLVKEKPKMFAKGTEITHAVVIKKLNEILQARGKKGTDRAAQIELLQLLVQIAAENNLGEGVIVKIKFNIIASLYDYNPNLATYMKPEMWGKCLDCINELMDILFANPNIFVGENILEESENLHNADQPLRVRGCILTLVERMDEEFTKIMQNTDPHSQEYVEHLKDEAQVCAIIERVQRYLEEKGTTEEVCRIYLLRILHTYYKFDYKAHQRQLTPPEGSSKSEQDQAENEGEDSAVLMERLCKYIYAKDRTDRIRTCAILCHIYHHALHSRWYQARDLMLMSHLQDNIQHADPPVQILYNRTMVQLGICAFRQGLTKDAHNALLDIQSSGRAKELLGQGLLLRSLQERNQEQEKVERRRQVPFHLHINLELLECVYLVSAMLLEIPYMAAHESDARRRMISKQFHHQLRVGERQPLLGPPESMREHVVAASKAMKMGDWKTCHSFIINEKMNGKVWDLFPEADKVRTMLVRKIQEESLRTYLFTYSSVYDSISMETLSDMFELDLPTVHSIISKMIINEELMASLDQPTQTVVMHRTEPTAQQNLALQLAEKLGSLVENNERVFDHKQGTYGGYFRDQKDGYRKNEGYMRRGGYRQQQSQTAY

SEQ ID NO: 917197 - protein, 913 aa, Homo sapiens
MSRFFTTGSDSESESSLSGEELVTKPVGGNYGKQPLLLSEDEEDTKRVVRSAKDKRFEELTNLIRTIRNAMKIRDVTKCLEEFELLGKAYGKAKSIVDKEGVPRFYIRILADLEDYLNELWEDKEGKKKMNKNNAKALSTLRQKIRKYNRDFESHITSYKQNPEQSADEDAEKNEEDSEGSSDEDEDEDGVSAATFLKKKSEAPSGESRKFLKKMDDEDEDSEDSEDDEDWDTGSTSSDSDSEEEEGKQTALASRFLKKAPTTDEDKKAAEKKREDKAKKKHDRKSKRLDEEEEDNEGGEWERVRGGVPLVKEKPKMFAKGTEITHAVVIKKLNEILQARGKKGTDRAAQIELLQLLVQIAAENNLGEGVIVKIKFNIIASLYDYNPNLATYMKPEMWGKCLDCINELMDILFANPNIFVGENILEESENLHNADQPLRVRGCILTLVERMDEEFTKIMQNTDPHSQEYVEHLKDEAQVCAIIERVQRYLEEKGTTEEVCRIYLLRILHTYYKFDYKAHQRQLTPPEGSSKSEQDQAENEGEDSAVLMERLCKYIYAKDRTDRIRTCAILCHIYHHALHSRWYQARDLMLMSHLQDNIQHADPPVQILYNRTMVQLGICAFRQGLTKDAHNALLDIQSSGRAKELLGQGLLLRSLQERNQEQEKVERRRQVPFHLHINLELLECVYLVSAMLLEIPYMAAHESDARRRMISKQFHHQLRVGERQPLLGPPESMREHVVAASKAMKMGDWKTCHSFIINEKMNGKVWDLFPEADKVRTMLVRKIQEESLRTYLFTYSSVYDSISMETLSDMFELDLPTVHSIISKMIINEELMASLDQPTQTVVMHRTEPTAQQNLALQLAEKLGSLVENNERVFDHKQGTYGGYFRDQKDGYRKNEGYMRRGGYRQQQSQTAY

SEQ ID NO: 917198 - protein, 812 aa, Homo sapiens
MSCHPRQSIPQTSHKEGRAVVLELESKKWRVENQENVSNLVIEDTNVHEHSCPISEATKQNPEQSADEDAEKNEEDSEGSSDEDEDEDGVSAATFLKKKSEAPSGESRKFLKKMDDEDEDSEDSEDDEDWDTGSTSSDSDSEEEEGKQTALASRFLKKAPTTDEDKKAAEKKREDKAKKKHDRKSKRLDEEEEDNEGGEWERVRGGVPLVKEKPKMFAKGTEITHAVVIKKLNEILQARGKKGTDRAAQIELLQLLVQIAAENNLGEGVIVKIKFNIIASLYDYNPNLATYMKPEMWGKCLDCINELMDILFANPNIFVGENILEESENLHNADQPLRVRGCILTLVERMDEEFTKIMQNTDPHSQEYVEHLKDEAQVCAIIERVQRYLEEKGTTEEVCRIYLLRILHTYYKFDYKAHQRQLTPPEGSSKSEQDQAENEGEDSAVLMERLCKYIYAKDRTDRIRTCAILCHIYHHALHSRWYQARDLMLMSHLQDNIQHADPPVQILYNRTMVQLGICAFRQGLTKDAHNALLDIQSSGRAKELLGQGLLLRSLQERNQEQEKVERRRQVPFHLHINLELLECVYLVSAMLLEIPYMAAHESDARRRMISKQFHHQLRVGERQPLLGPPESMREHVVAASKAMKMGDWKTCHSFIINEKMNGKVWDLFPEADKVRTMLVRKIQEESLRTYLFTYSSVYDSISMETLSDMFELDLPTVHSIISKMIINEELMASLDQPTQTVVMHRTEPTAQQNLALQLAEKLGSLVENNERVFDHKQGTYGGYFRDQKDGYRKNEGYMRRGGYRQQQSQTAY

SEQ ID NO: 917199 - protein, 825 aa, Homo sapiens
HSGSWRLVQGITPCSALNIALSCCGVCHMPGLGAPGPVTNCGFSSPVWNAPLPELPNPSAGEMGKSIFTCYKQNPEQSADEDAEKNEEDSEGSSDEDEDEDGVSAATFLKKKSEAPSGESRKFLKKMDDEDEDSEDSEDDEDWDTGSTSSDSDSEEEEGKQTALASRFLKKAPTTDEDKKAAEKKREDKAKKKHDRKSKRLDEEEEDNEGGEWERVRGGVPLVKEKPKMFAKGTEITHAVVIKKLNEILQARGKKGTDRAAQIELLQLLVQIAAENNLGEGVIVKIKFNIIASLYDYNPNLATYMKPEMWGKCLDCINELMDILFANPNIFVGENILEESENLHNADQPLRVRGCILTLVERMDEEFTKIMQNTDPHSQEYVEHLKDEAQVCAIIERVQRYLEEKGTTEEVCRIYLLRILHTYYKFDYKAHQRQLTPPEGSSKSEQDQAENEGEDSAVLMERLCKYIYAKDRTDRIRTCAILCHIYHHALHSRWYQARDLMLMSHLQDNIQHADPPVQILYNRTMVQLGICAFRQGLTKDAHNALLDIQSSGRAKELLGQGLLLRSLQERNQEQEKVERRRQVPFHLHINLELLECVYLVSAMLLEIPYMAAHESDARRRMISKQFHHQLRVGERQPLLGPPESMREHVVAASKAMKMGDWKTCHSFIINEKMNGKVWDLFPEADKVRTMLVRKIQEESLRTYLFTYSSVYDSISMETLSDMFELDLPTVHSIISKMIINEELMASLDQPTQTVVMHRTEPTAQQNLALQLAEKLGSLVENNERVFDHKQGTYGGYFRDQKDGYRKNEGYMRRGGYRQQQSQTAY

SEQ ID NO: 917200 - protein, 234 aa, Homo sapiens
RRTSKLPLARDPTDTGNFGFKNMLDTRVEGDVDVPKTVKVKGTAGLSQNSTLEVQTLSVAPKALETVQERKLAADHPFLKEMQDQGENLYVVNGGGGDGAGDKGHEVTLEALPKDVLLSKETVGAILYFVGALTELSEAQQKLLVKSMEKKILPVESTMEQNFLLDKEGVFPLQPELLSSLGDEELTLTEALVGLSGLEVQRSGPQYMWHPDTLPRLCALYAGLSLLQQLTKAS

SEQ ID NO: 917201 - protein, 173 aa, Homo sapiens
MVWKLSNLGCVAGAGKFYQQETAYDYYLDTNMPLPPVRSSQGLRPSTLCFLNAADFSDTFTAFSSTLCHAQSTTILHSKEHTHLLGTQSLAHRCSKSEEELTGLLTAGLLSCWLKCLHWAGGEWGLSGLPHCPLVLYRLPWAVWEALPKRPWEHLQAPSQPELLINCSDLLKA

SEQ ID NO: 917202 - protein, 184 aa, Homo sapiens
MTFFSRLAEKRLEEGVPLLILTRVSYGLAPVLQVLQAGQLEQGVARAWVPPEEHSPDTVRGLEAALQYQPRSWAIQGFSVELGKPGLLRDTVEGVGNPCPVPWHGGGLLIPGQVQATVAAGQQPECEPQSWLPGGGRRAEREATLRGGGVQEFFLWYLPPLGSRTHWLRFTDATTEAWRGQIPL

SEQ ID NO: 917203 - protein, 147 aa, Homo sapiens
EEVAQMIIKPDKPPRSAVHKEADGVNPVQIQSPGHEKSYFFSSSLKTGKMKIPPYSGEGEPFCSIQAFNRLDQISISVHQLSQPRNTLSDTARMLYQICEHLANLRDIASSVPGHSNKANIAIKMNVVLAGMKTILISLNISIELLG

SEQ ID NO: 917204 - protein, 148 aa, Homo sapiens [sequence omitted]

SEQ ID NO: 917205 - protein, 329 aa, Homo sapiens
LITLFQDFKQAALISRTNGSLCHATAMCHHRINEFEEAVNFFTWALKINPCFLDAYVGRGNSYMEYGHDEATKQAQKDFLKALHINPAYIKARISFGYNLQAQGKFQKAWNHFTIAIDTDPKNYLAYEGRAVVCLQMGNNFAAMQDINAAMKISTTAEFLTNRGVIHEFMGHKQNAMKDYQDAITLNPKYSLAYFNAGNIYFHHRQFSQASDYFSKALKFDPENEYVLMNRAITNTILKKYEEAKEDFANVIESCPFWAAVYFNRAHFYYCLKQYELAEEDLNKALSLKPNDALVYNFRAKVRGKIGLIEEAMADYNQALDLEDYASVI

SEQ ID NO: 917206 - protein, 329 aa, Homo sapiens; identical to SEQ ID NO: 917205

SEQ ID NO: 917207 - protein, 140 aa, Homo sapiens
MGSNTGIGGGRTADPNNFRLLKGGGENGREEWKGKRKNICLGAPRRTLCTLIKTIIHDLSSVFGFIHRKGLERGTAIQVNTVHYPYAREDELLRAYKSRSSDALESQSRQNAKNAWSYKDHVVATLTSRAWHKTKKKKGK

SEQ ID NO: 917208 - protein, 176 aa, Homo sapiens
MPLTSVRREQWFFSSGLEKGKEGIQKQKYGQPFRMGHCSAGSRKGFATDKKRSVTAKKVSPDIAKCPLKEKESPCSFPMRKEDSAVSQQQKTLCFSGLLSFVIEFGSPAYAHAIIERGFKTMAYVPVPLTGSERRRGEKSSNENKSWYWKKVESFLEGQTTEACFSNLEYIYKKSS

SEQ ID NO: 917209 - protein, 176 aa, Homo sapiens; identical to SEQ ID NO: 917208

SEQ ID NO: 917210 - protein, 143 aa, Homo sapiens
MGSEAAQLLEAADFAARKHRQQRRKDPEGTPYINHPIGVARILTHEAGITDIVVLQAALLHDTVEDTDTTLDEVELHFGAQVRRLVEEVTDDKTLPKLERKRLQVEQAPHSSPGAKLVKLADKLYNLRDLNRCTPEGTLSYGL

SEQ ID NO: 917211 - protein, 143 aa, Homo sapiens; identical to SEQ ID NO: 917210

SEQ ID NO: 917212 - protein, 143 aa, Homo sapiens; identical to SEQ ID NO: 917210

SEQ ID NO: 917213 - protein, 164 aa, Homo sapiens
TSQHQQPEALSLGAMRMQCEPTSRLLLHTRGQQGFRAIGKLLSASINPVPSGEPAPVTYAISCPVIPNLDLGQMEVPQLSCMEKPKPGDFSQPQPPPLGFLQYLFTLQWDKTHSCSQTRPRWLDPVPWHRLGLCLLAILFLTFSIWGIQYKSKREEVAFVKGER

SEQ ID NO: 917214 - protein, 339 aa, Homo sapiens
VILLKIGDSVERIMGMSTWLPDNVTFEEGALIDPLSVGIHACRRGGVTLGHKVLVCGAGAIGVVTLLVAKAMGAAQVVVTDLSATRLSKAKEIGADLVLQISKESPQEIARKVEGLLGCKPEVTIECTGQRPPSRQASTVTADYCLFCLPDLGTDKLPMPDSPLSDPPATYGKLAENCPAALGAEEAVGEREERVPPWQCREFQLESASPLLHCHRQWSPCGKGQKEAEAQRGTMDLCVIDLPMATRSGGTLVLVGLGSEMTTVPLLHAAIREVDIKGVFRYCNTWPVAISMLASKSVNVKPLVTHRFPLEKALEAFETFKKGLGLKIMLKCDPSDQNL

SEQ ID NO: 917215 - protein, 264 aa, Homo sapiens
MCMLQCMLSQTHEDPSILDRQPSVLTGNPRAASYDLNAHLKLQRIPDAVIYMDEHAPVNRCHLHVGFHACKRGRFTLSHNVLVCGASPIVMVTSFVREGNAEQLKYLCASDLSATRLSKAKEIGADLVLQISKESPQEIARKVEGLLGCKPEVTIECTGAEASIQAGIYATRSGGTLVLVGLGSEMTTVPLLHAAIREVDIKGVFRYCNTWPVAISMLASKSVNVKPLVTHRFPLEKALEAFETFKKGLGLKIMLKCDPSDQNL

SEQ ID NO: 917216 - protein, 140 aa, Homo sapiens
MASGQARPPFEEESPQPSTTVRSPEVVVDDEVPGPSDESEEELEEELELERAPEPEDTWVVETLCGLKMKLKRKRASSVLPEHHEAFNRLLGDPVVQKFLAWDKDLRVSDKYLLAMVIAYFSRAGLFSWQYQRIHFFLAL

SEQ ID NO: 917217 - protein, 164 aa, Homo sapiens
MAHVYVWLLPVLPHVLQTSTPLSTTHFECVVTHLSLPPEVWFRAWYTKSALWIFVSINPWAQGDLLVGQSKELLLWDLNLSPLPNLGLHTAGKKGQLRRACSVIPPLDAAPDSPPPSSSAHRPMLASGIFQLLRIHVSKCVQTMEGSTEELSLLLAANTSLPAM

SEQ ID NO: 917218 - protein, 141 aa, Homo sapiens
GVSRGVKAAMNRVLCAPAAGAVRALRLIGWASRSLHPLPGSRDRAHPAAEEEDDPDRPIEFSSSKANPHRWSVGHTMGKGHQRPWWKVLPLSCFLVALIIWCYLREESEADQWLRQVWGEVPEPSDRSEEPETPAAYRART

SEQ ID NO: 917219 - protein, 141 aa, Homo sapiens; identical to SEQ ID NO: 917218

SEQ ID NO: 917220 - protein, 144 aa, Homo sapiens
RLVGLGVTRHRGMNRVLCAPAAGAVRALRLIGWASRSLHPLPGSRDRAHPAAEEEDDPDRPIEFSSSKANPHRWSVGHTMGKGHQRPWWKVLPLSCFLVALIIWCYLREESEADQWLRQVWGEVPEPSDRSEEPETPAAYRART

SEQ ID NO: 917221 - protein, 315 aa, Homo sapiens
MFVRLVKQTQCLGVSLKTAIYDKNNQNNEGISHRKSLRISDGQDKGIFAIVCKEQVLDGLLDSPKMRTSLQAVALWGQKAPPHSITAIMITDDQRTIVTGSQEGQLCLWNLSHELKTGKGLNAQGYAPLSVMTGKDSMLFSEMEPSGLLRKKISAKELLFGHSASVTCLARARDFSKQPYIVSAAENGEMCVWNVTNGQCMEKATLPYRHTAICYYHCSFRMTGEGWLLCCGEYQDVLIIDAKTLAVVHSFRSSQFPDWINCMCIVHSMRIQEDSLLVVSVAGELKVWDLSSSINSIQVGLGTLLFFPYNFKHIH

SEQ ID NO: 917222 - protein, 161 aa, Homo sapiens
MSLKASARGVKAWGQRLQDSKHCECSVAQLGVGLCDGKKHPKVDVARDGRSHRRGGKDSDRVPRERRVLVIREFSPHDCGPMAYNQIPTYSTSTVSPAKPPCRKSQHSVNVGFASHEYCIFHPHSVEKELRGKFCQPWPALGHQWTSPELVVKIPGDRSSE

SEQ ID NO: 917223 - protein, 195 aa, Homo sapiens [sequence omitted]

SEQ ID NO: 917224 - protein, 134 aa, Homo sapiens
MYLAFQISHNIALPCLFVSISQYFPKPTGATWAWQAMVTMYPQSRQKSTAKFSRTIVSQLPCLKVRAHGDSKLPAGLHLLLHDKRFHADSIWGNLAGPRRSFLWVICHPPWVESQRSAAGPTAGFACLFPTASL

SEQ ID NO: 917225 - protein, 37 aa, Homo sapiens
MLANRKAARGRAGLSPARRGRRCPEEEGDPARDGRPA

SEQ ID NO: 917226 - protein, 152 aa, Homo sapiens
KECMSEKEAICKFTLLPSWGSSNCLPCFYSLCGAATGARAEQAALLPTWRTLKPEGLCRKLLFGPSGFPEEPLFLLLARGLQSIWILKFSIPYAQDLRARPRCGAQLGESRGTQGTAGAHPTNAGRHHRHLGPPFQYFAQCLGYPRGSVPAC

SEQ ID NO: 917227 - protein, 503 aa, Homo sapiens
QICLDLPRNLTANEKYEMFLNQARKNTDKEYNKCEMLDHFDVITEEVPEDEPAEVSAHLQMEVERLIVQSYVLEHQKTTTPDPMDDPCFSHRSRRKLAKIQLPEYILDFGYIILGEVRTHIIKIINTSHFPVSFHADKRVLHETGFSTELDRVKNLPHCETEIFEVRFDPQGANLPVGSKEVILPIKVVGGPTVHICLQAKVTIPTMTLSRGKVDFATIQCGQCLVETIQLSNHLQVPCEWFVQSQKPVDKLEKHMPKYLRQKLRAELKPKTRIFEIQPISGVLDPGEKSNVQVKFMPKEEKFYSQTLVFQIAQSAQKLTLLARGQGLEPRLEFSPSVLDLGPLLLCAPGDEAEVIVKNPCNFPIEFYSLEFDQQYLIEEKQILRKLKGYDSYNTLLLPPHNPGEKLPPELYEYFKEIKKSKEEQMRAKYLENLAQENETGALKAGGGHSHKQKTSPSIVLRPNSNRRAVLCSQNCALSGPPPLSYPIICPGALVCLAIKVPR

SEQ ID NO: 917228 - protein, 486 aa, Homo sapiens
MFLNQARKNTDKEYNKCEMLDHFDVITEEVPEDEPAEVSAHLQMEVERLIVQSYVLEHQKTTTPDPMDDPCFSHRSRRKLAKIQLPEYILDFGYIILGEVRTHIIKIINTSHFPVSFHADKRVLHETGFSTELDRVKNLPHCETEIFEVRFDPQGANLPVGSKEVILPIKVVGGPTVHICLQAKVTIPTMTLSRGKVDFATIQCGQCLVETIQLSNHLQVPCEWFVQSQKPVDKLEKHMPKYLRQKLRAELKPKTRIFEIQPISGVLDPGEKSNVQVKFMPKEEKFYSQTLVFQIAQSAQKLTLLARGQGLEPRLEFSPSVLDLGPLLLCAPGDEAEVIVKNPCNFPIEFYSLEFDQQYLIEEKQILRKLKGYDSYNTLLLPPHNPGEKLPPELYEYFKEIKKSKEEQMRAKYLENLAQENETGALKAGGGHSHKQKTSPSIVLRPNSNRRAVLCSQNCALSGPPPLSYPIICPGALVCLAIKVPR

SEQ ID NO: 917229 - protein, 192 aa, Homo sapiens
MGLVNIGLSCAASGFTFDDYTMHWVRQAPGKGLEWVSLISWDGGSTYYADSVKGRFTISRDNSKNSLYLQMNSLRTEDTALYYCAKDTQDPVTPSSGSAQISAELVRLLRVEHRTWLQHQPWHGRQRAALGAWVRCIVLPAGGGREVLTQGPETVGSIQNIHFYFISVDDIETNMQSVNNGDSYICPNCFIP

SEQ ID NO: 917230 - protein, 120 aa, Homo sapiens
MPHPDILCRGIKKVTQVSPGYLKRLIVQVLKNPWTEFSQLLPQGKNCCCQGEEAYLIQTVNQSKTQADTQNPTAGGDGGNPGGQHGEEWFPVEGRKMVKAQPRRRLGSSAKVVICVVPIR

SEQ ID NO: 917231 - protein, 749 aa, Homo sapiens
MNTRGMKASSSDSFLRCVQSMGKPMKGNTGGHCCFIQLDKNVVAVKAQICPKRCVCQILSPNLATLCAKKGLLFVPPNIDRRTVELRLADNFVTNIKRKDFANMTSLVDLTLSRNTISFITPHAFADLRNLRALHLNSNRLTKITNDMFSGLSNLHHLILNNNQLTLISSTAFDDVFALEELDLSYNNLETIPWDAVEKMVSLHTLSLDHNMIDNIPKGTFSHLHKMTRLDVTSNKLQKLPPDPLFQRAQVLATSGIISPSTFALSFGGNPLHCNCELLWLRRLSREDDLETCASPPLLTGRYFWSIPEEEFLCEPPLITRHTHEMRVLEGQRATLRCKARGDPEPAIHWISPEGKLISNATRSLVYDNGTLDILITTVKDTGAFTCIASNPAGEATQIVDLHIIKLPHLLNSTNHIHEPDPGSSDISTSTKSGSNTSSSNGDTKLSQDKIVVAEATSSTALLKFNFQRNIPGIRMFQIQYNGTYDDTLVYRMIPPTSKTFLVNNLAAGTMYDLCVLAIYDDGITSLTATRVVGCIQFTTEQDYVRCHFMQSQFLGGTMIIIIGGIIVASVLVFIIILMIRYKVCNNNGQHKVTKVSNVYSQTNGAQIQGCSVTLPQSVSKQAVGHEENAQCCKATSDNVIQSSETCSSQDSSTTTSALPPSWTSSTSVSQKQKRKTGTKPSTEPQNEAVTNVESQNTNRNNSTALQLASRPPDSVTEGPTSKRAHIKPNALLTNVDQIVQETQRLELI

SEQ ID NO: 917232 - protein, 666 aa, Homo sapiens
MNTRGMKASSSDSFLRCVQSMGKPMKGNTGGHCCFIQLDKNVVAVKAQICPKRCVCQILSPNLATLCAKKGLLFVPPNIDRRTVELRLADNFVTNIKRKDFANMTSLVDLTLSRNTISFITPHAFADLRNLRALHLNSNRLTKITNDMFSGLSNLHHLILNNNQLTLISSTAFDDVFALEELDLSYNNLETIPWDAVEKMVSLHTLSLDHNMIDNIPKGTFSHLHKMTRLDVTSNKLQKLPPDPLFQRAQVLATSGIISPSTFALSFGGNPLHCNCELLWLRRLSREDDLETCASPPLLTGRYFWSIPEEEFLCEPPLITRHTHEMRVLEGQRATLRCKARGDPEPAIHWISPEGKLISNATRSLVYDNGTLDILITTVKDTGAFTCIASNPAGEATQIVDLHIIKLPHLLNSTNHIHEPDPGSSDISTSTKSGSNTSSSNGDTKLSQDKIVVAEATSSTALLKFNFQRNIPGIRMFQIQYNGTYDDTLVYRMIPPTSKTFLVNNLAAGTMYDLCVLAIYDDGITSLTATRVVGCIQFTTEQDYVRCHFMQSQFLGGTMIIIIGGIIVASVLVFIIILMIRYKVCNNNGQHKVTKVSNVYSQTNGAQIQGCSVTLPQSVSKQAVGHEENAQCCKATSDNVIQSSETCSSQDSTYLLLSGSDLQEKS

SEQ ID NO: 917233 - protein, 872 aa, Homo sapiens
MAVALDSQIDAPLEVEGCLIMKVEKDPEWASEPILEGSDSSETFRKCFRQFCYEDVTGPHEAFSKLWELCCRWLKPEMRSKEQILELLVIEQFLTILPEKIQAWAQKQCPQSGEEAVALVVHLEKETGRLRQQVSSPVHREKHSPLGAAWEVADFQPEQVETQPRAVSREEPGSLHSGHQEQLNRKRERRPLPKNGLHSSNKRSILRSNYVKEKSVHAIQVPARSAGKTWREQQQWGLEDEKIAGVHWSYEETKTFLAILKESRFYETLQACPRNSQVYGAVAEWLRECGFLRTPEQCRTKFKSLQKSYRKVRNGHMLEPCAFFEDMDALLNPAARAPSTDKPKEMIPVPRLKRIAISAKEHISLVEEEEAAEDSDDDEIGIEFIRKSEIHGAPVLFQNLSGVHWGYEETKTFLDILRETRFYEALQACHRKSKLYGAVAEQLRECGFLRTPEQCRTKFKSLQKSYRKVKNGHVLESCAFYKEMDALINSRASAPSPSTPEEVPSPSRQERGGIEVEPQEPTGWEPEETSQEAVIEDSCSERMSEEEIVQEPEFQGPPGLLQSPNDFEIGSSIKEDPTQIVYKDMEQHRALIEKSKRVVSQSTDPSKYRKRECISGRQWENLQGIRQGKPMSQPRDLGKAVVHQRPFVGKRPYRLLKYGESFGRSTRLMCRMTHHKENPYKCGVCGKCFGRSRSLIRHQRIHTGEKPFKCLDCGKSFNDSSNFGAHQRIHTGEKPYRCGECGKCFSQSSSLIIHQRTHTGEKPYQCGECGKSFTNSSHFSAHRRVHTGENPYKCVDCEKSFNNCTRFREHRRIHTGEKPYGCAQCGKRFSKSSVLTKHREVHVREKPLPHPPSLYCPENPHKGKTDEFRKTF

SEQ ID NO: 917234 - protein, 160 aa, Homo sapiens
MRIQHLFNRSTKNPIILKETSKAGKTCQMIVRRIYVAHLSGAHVSCLYARYDLVSASSTPALLCSVMLGLGVCELPFPGSPASWLPVMFCQNKALSGVQKARRGKGKKGLQFCKRAAMVHHSVVHSRSSTHFKRHNGNDKKTDTKDKLYQPKYQQNGEKS

SEQ ID NO: 917235 - protein, 134 aa, Homo sapiens
RRRRGPPCQWERGAGLPAGRSGGPPSSLPARPLSLSGRLSILSPVARLLRGSPAAGAAEPRPGYLRKRDVVVGRNKPARPRIRLGGVRTDSDFSFPMSTFIEHLICDTRGCKKRNAAGGEKPELFLCEPLPPGP

SEQ ID NO: 917236 - protein, 1176 aa, Homo sapiens
MALSLWPLLLLLLLLLLLSFAVTLAPTGPHSLDPGLSFLKSLLSTLDQAPQGSLSRSRFFTFLANISSSFEPGRMGEGPVGEPPPLQPPALRLHDFLVTLRGSPDWEPMLGLLGDMLALLGQEQTPRDFLVHQAGVLGGLVEVLLGALVPGGPPTPTQPPCTRDGPSDCVLAADWLPSLLLLLEGTRWQALVQVQPSVDPTNATGLDGREAAPHFLQGLLGLLTPTGELGSKEALWGGLLRTVGAPLYAAFQEGLLRVTHSLQDEVFSILGQPEPDTNGQCQGGNLQQLLLWGVRHNLSWDVQALGFLSGSPPPPPALLHCLSTGVPLPRASQPSAHISPRQRRAITVEALCENHLGPAPPYSISNFSIHLLCQHTKPATPQPHPSTTAICQTAVWYAVSWAPGAQGWLQACHDQFPDEFLDAICSNLSFSALSGSNRRLVKRLCAGLLPPPTSCPEGLPPVPLTPDIFWGCFLENETLWAERLCGEASLQAVPPSNQAWVQHVCQGPTPDVTASPPCHIGPCGERCPDGGSFLVMVCANDTMYEVLVPFWPWLAGQCRISRGGNDTCFLEGLLGPLLPSLPPLGPSPLCLTPGPFLLGMLSQLPRCQSSVPALAHPTRLHYLLRLLTFLLGPGAGGAEAQGMLGRALLLSSLPDNCSFWDAFRPEGRRSVLRTIGEYLEQDEEQPTPSGFEPTVNPSSGISKMELLACFSAYLHMPPENLQQLVLSAEREAAQGFLTLMLQGKLQGKLQVPPSEEQALGRLTALLLQRYPRLTSQLFIDLSPLIPFLAVSDLMRFPPSLLANDSVQQGYRGSEENSLEEDKGLRPMTPRSLAAIRDYSPGMRPEQKEALAKRLLAPELFGEVPAWPQELLWAVLPLLPHLPLENFLQLSPHQIQALEDSWPAAGLGPGHARHVLRSLVNQSVQDGEEQVRRLGPLACFLSPEELQSLVPLSDPTGPVERGLLECAANGTLSPEGRLSLEELCSLHLLLPGLSPQTLQAIPRRVLVGACSCLAPELSRLSACQTAALLQTFRQPIPTTWPDCLLPLLPLKLLQLDSLALLANRRRYWELPWSEQQAQFLWKKMQVPTNLTLRNLQALGTLAGGMSCEFLQQINSMVDFLEVVHMIYQLPTRVRGSLRACIWAELQRRMAMPEPEWTTVGPELNGLDSKLLLDLPIK

SEQ ID NO: 917237 - protein, 322 aa, Homo sapiens
MVRVDSVLKEVQMKCSEASKGGRISSGGKIGQWFVTLPKKPYSAPVSQMESIPATSEAASPPAILVTVESPEMDLNDFVKIPLTFGGVVEGEEEDRAVMHLRLCGDDSPMSESLHFIKLPRTVLVDEDARPEEKELRKTKASSVISDEIKISSTEIERIYSSQSQVEDQESLQTCEQNEMLSIGIEEVFDILPLFGVLQPHSSHQISFTFYGHANIIAQAKALCEVEEGPTYEITLKGEASLVNYSFDTKDIHYGLQLFDHVTEREITLTNMGKVGFEFKVLTDHQSSPDNLLPGVPLILPVSVSKWWEGPEFKPTSPTPKQ

SEQ ID NO: 917238 - protein, 170 aa, Homo sapiens
IRVASVDMELLHFVPKRALPGFTIALEVHRRPYTRAQPWAHPKRAHLHPRVETPHISFLSSAPPLCPWYSGSNPWLRNPLKPRLAALFQRSAAPRLHFSGAASLQEDHRNKPKGHRGQMYQRTPLKSRRISTKTISVFLVAFCPSKWKVEVSEKSTERTCSKLKPQTPKA

SEQ ID NO: 917239 - protein, 170 aa, Homo sapiens; identical to SEQ ID NO: 917238

SEQ ID NO: 917240 - protein, 162 aa, Homo sapiens
MELISHKIPSSISVSLQVTRLGLKMQHNYHFPTPRGSFSFRQREKPVGRPSGSEEGKSFRWEEQRGEGSKGDSPLLEIRPVPPRAGQHCPGGTSGAAGLGSLAPPVPATHAPIAIGFTWNSPPATPRGYYGENLLLFLGPKIKGAFSVSAFIPWTLPELILG

SEQ ID NO: 917241 - protein, 237 aa, Homo sapiens
TRSLPPRSTPRPPAAHAAGPGSRRPAPAPRAPPPPPPSKAGLGLELLMEKVPGEMEIERRERKRELSEAERKAVQAMWARLYANCEDVGVAILVRFFVNFPSAKQYFSQFKHMEDPLEMERSPQLRKHACRVMGALNTVVENLHDPDKVSSVLALVGKAHALKHKVEPVYFKILSGVILEVVAEEFASDFPPETQRAWAKLRGLIYSHVTAAYKEVGWVQQVPNATTPPATLPSSGP

SEQ ID NO: 917242 - protein, 213 aa, Homo sapiens
AGTGPGVLGIRRRAKPGWAWSCSWRKCQARWRSSAGSGSEELSEAERKAVQAMWARLYANCEDVGVAILVRFFVNFPSAKQYFSQFKHMEDPLEMERSPQLRKHACRVMGALNTVVENLHDPDKVSSVLALVGKAHALKHKVEPVYFKILSGVILEVVAEEFASDFPPETQRAWAKLRGLIYSHVTAAYKEVGWVQQVPNATTPPATLPSSGP

SEQ ID NO: 917243 - protein, 237 aa, Homo sapiens; identical to SEQ ID NO: 917241

SEQ ID NO: 917244 - protein, 273 aa, Homo sapiens
TRSLPPRSTPRPPAAHAAGPGSRRPAPAPRAPPPPPPSKAGLGLELLMEKVPGEMEIERRERKRELSEAERKAVQAMWARLYANCEDVGVAILVRFFVNFPSAKQYFSQFKHMEDPLEMERSPQLRKHACRVMGALNTVVENLHDPDKVSSVLALVGKAHALKHKVEPVYFKPTGHTALFGAVGPLTPPPSLAAPRAEGRVLKTLLDAPFLGAKEAGGIPDSTSPKEASVAARVPPWSCWEAALAAWMLTPARRAERGPLFLAFLLTVRERPS

SEQ ID NO: 917245 - protein, 167 aa, Homo sapiens
MIFTINDNKKKNSCNLSNPGLVQFCSGERCHIHYLQPWRHRQSHDSSWANLSLGGEDMREQPCASQEEEALPRIQRNPYHGVPGHPKEMPTVLSDQWPPPGEKDFSLPITRMEEKARGPEERQEKDGDRGVDSRGESSPLHAYPPMVADAIDNTGFATGLEILARTH

SEQ ID NO: 917246 - protein, 649 aa, Homo sapiens
MWPQARLPPHPAMAEETRQSKLAAAKRKLKEYWQRNSPGVPAGAKRNRKTNGSIHETATSGGCHSPGDSATGIHGESPTSSATLKDLESPCQELAVVPDSRSVKVSQLKNTIKSLKQQKKQVVHQLEEVNMISLFARDMTARFGGHSDVEAPSLVSPTPSLGKKAHPPESTPSPTGSLITRSHGWACPGAGAVEKKANNEKQKAERELEGESFGPHLNSLITEESKDLAVRLQHSLQRKGELERALSAVTATQKKKAERQFSSRSKARTEWKLEQSMREQALLKAQLTQGPFPLCFGQVCSLKKEKKHDKYRVETLERSLSKLKNQMAEPLPPEPPAVPSEAELQHLRKELERVAGALQAQVEYNQRISLLNEGQKERLREQQERLPEQEERLQQLAEPQNSFKELNNENKSVLQLEQQVKELQEKLGKERLEAASQQKQQLTAQLSLMALPGEGDGGGHLDSEGEEAPRPIPSIPQDLESREAMSSFMDHLEEKADLSELVKKQELRFIQYWQERCHQKIHHLLSEPGGRAKDAALGGGHHQAGAQGGDEDEAAGAAADGIAAYSNYNNGHRKFLAAAHNPADEPGPGAPAPQELGAADKHGGEAREDPLLDKPTAQPIVQDHQEHPGLGNNCCVPFFCWAWLPRRRR

SEQ ID NO: 917247 - protein, 190 aa, Homo sapiens
TEVKVWEPPPRFQKMYGNAWMPRQKFAAGVGTSWGTSARAVQKGNVGWEPTHKVPTGAPPSGAVRLGTLSSRPQNGGSTDSLHCAPGKAVDTQHQPMKVAMREAVPCKATGAELPKTMGIPLLLKAQFLRLSPHNLSDAKQEPQIVVPVLYRTNPDVVPDSYSFWLTSYKSGFPQPPPQKEVELPPPPTE

SEQ ID NO: 917248 - protein, 176 aa, Homo sapiens
MEAWPWVWTASVGPSPCAAAFCPGHPSLCRQLQEPASCTGRPCPLQAASGSCLLPWPPFSLQAAFRKAPVEAGQPEHVDFGSRSCPALLILWPSNWVLMLAFLCIKPGGFASFTPLCPGHHVCERAGWCFVALRSVAEAQVWVSRARRDLAVRVCASVSAVGLRHVCPGDQHVWDP

SEQ ID NO: 917249 - protein, 176 aa, Homo sapiens; identical to SEQ ID NO: 917248

SEQ ID NO: 917250 - protein, 685 aa, Homo sapiens
MESEEDYVEEKESEKCVKEGVTNPSNSSQQALLKADYKALKNGVPSPIMATKIPKKVIAPVDTGDLEAGRRKRRRKRRSLAINLTNCKYESVRRAAQMCGLKEVGEDEEWTLYWTDCAVSLERVMDMKRFQKINHFPGMTEICRKDLLARNLNRMYKLYPSEYNIFPRTWCLPAEKSSMRPRESLDAQKPFDQALSAHSYGDFQSYGRQRKARTYICKPDSGCQGRGIFITRNPREIKPGEHMICQQYISKPLLIDGFKFDMRVYVLITSCDPLRIFTYEEGLARFATTPYMEPSHNNLDNVCMHLTNYAINKHNENFVRDGAVGSKRKLSTLNIWLQEHSYNPGELWGDIEDIIIKTIISAHSVLRHNYRTCFPQYLNGGTCACFEILGFDILLDHKLKPWLLEECRFGIPSALIFTTDSCLDQEVKDALLCDAMTLVNLRGCDKRKVMEEDKRRVKERLFQCYRQPRESRKEKTESSHVAMLDQERYEDSHLGKYRRIYPGPDTEKYARFFKHNGSLFQETAASKAREECARQQLEEIRLKQEQQETSGTKRQKARDQNQGESAGEKSRPRAGLQSLSTHLAYRNRNWEKELLPGQLDTMRPQEIVEEEELERMKALLQRETLIRSLGIVEQLTRLQHPGPQGQKKLHENMTSSKLQLQTFSFTGNLLSIFLSQNNPTLMTDK

SEQ ID NO: 917251 - protein, 565 aa, Homo sapiens
MESEEDYVEEKESEKCVKEGVTNPSNSSQQALLKADYKALKNGVPSPIMATKIPKKVIAPVDTGDLEAGRRKRRRKRRSLAINLTNCKYESVRRAAQMCGLKEVGEDEEWTLYWTDCAVSLERVMDMKRFQPLLIDGFKFDMRVYVLITSCDPLRIFTYEEGLARFATTPYMEPSHNNLDNVCMHLTNYAINKHNENFVRDGAVGSKRKLSTLNIWLQEHSYNPGELWGDIEDIIIKTIISAHSVLRHNYRTCFPQYLNGGTCACFEILGFDILLDHKLKPWLLEECRFGIPSALIFTTDSCLDQEVKDALLCDAMTLVNLRGCDKRKVMEEDKRRVKERLFQCYRQPRESRKEKTESSHVAMLDQERYEDSHLGKYRRIYPGPDTEKYARFFKHNGSLFQETAASKAREECARQQLEEIRLKQEQQETSGTKRQKARDQNQGESAGEKSRPRAGLQSLSTHLAYRNRNWEKELLPGQLDTMRPQEIVEEEELERMKALLQRETLIRSLGIVEQLTRLQHPGPQGQKKLHENMTSSKLQLQTFSFTGNLLSIFLSQNNPTLMTDK

SEQ ID NO: 917252 - protein, 134 aa, Homo sapiens
MPLGPPWIDIKLYTGYFLVTLGNSTLCSLRAAVCRPQNEKIGPEQLVWPCECRRNNIRVVYLGGQQLREQPAAHCVARVSCGPPVKDSPAHDKPARCSCKLTFKVSRLPRSWSKGLFGQAYEARVRRAVSDGAI

SEQ ID NO: 917253 - protein, 134 aa, Homo sapiens; identical to SEQ ID NO: 917252

SEQ ID NO: 917254 - protein, 423 aa, Homo sapiens
MAGPFSRLLSARPGLRLLALAGAGSLAAGFLLRPEPVRAASERRRLYPPSAEYPDLRKHNNCMASHLTPAVYARLCDKTTPTGWTLDQCIQTGVDNPGHPFIKTVGMVAGDEETYEVFADLFDPVIQERHNGYDPRTMKHTTDLDASKIRSGYFDERYVLSSRVRTGRSIRGLSLPPACTRAERREVERVVVDALSGLKGDLAGRYYRLSEMTEAEQQQLIDDHFLFDKPVSPLLTAAGMARDWPDARGIWHNNEKSFLIWVNEEDHTRVISMEKGGNMKRVFERFCRGLKEVERLIQERGWEFMWNERLGYILTCPSNLGTGLRAGVHIKLPLLSKVKELWGYRGVSRFPKILENLRLQKRGTGGVDTAATGGVFDISNLDRLGKSEDQIPGGDPTTRRKRGTIIPPDLGFISFALVGHGSP

SEQ ID NO: 917255 - protein, 277 aa, Homo sapiens
MNTTPGIYMPIKIRSGYFDERYVLSSRVRTGRSIRGLSLPPACTRAERREVERVVVDALSGLKGDLAGRYYRLSEMTEAEQQQLIDDHFLFDKPVSPLLTAAGMARDWPDARGIWHNNEKSFLIWVNEEDHTRVISMEKGGNMKRVFERFCRGLKEVERLIQERGWEFMWNERLGYILTCPSNLGTGLRAGVHIKLPLLSKYRFPKILENLRLQKRGTGGVDTAATGGVFDISNLDRLGKSEDQIPGGDPTTRRKRGTIIPPDLGFISFALVGHGSP

SEQ ID NO: 917256 - protein, 390 aa, Homo sapiens
KNLFKPCFQLFRMCLAVELLMTWWLCVSSFVELLAAEFLMTWWLCVSSFEEPLAVELLMTWWLCVSSFEEPLAAEFLMTWWLYVSSFEEPLAAELLMTWWLCVSSFAEPLAVELLMTCVVDSLHLLDKGMIRVPGGAEETQVTETVESQKAELLCVSQYSAWWSGSVGRAPAGTQVQRPQGAARARLELRLTLCALRGAHIDEKDWQTCQGMQIRVLAGTKLSLWLQGEQRTVLAVLKLELSVENWTFVCSPASQCVRTFSGDHCRMSQNHAWVKDPFKVQDRPMDFRRTKLEKCGDRVQLQLAVRSLPLLSAVSGRSSEHTEKAFRCPSLSSCISSWGCNVLSCLSHSGPSWSIACRWEARGFPGSAFKRFAKRQRMLFLSPNILKTVS

SEQ ID NO: 917257 - protein, 274 aa, Homo sapiens
MKLPKGTRSSVYFAQHPEKEPLPSRQEVKQTPVIMAKIKGPGPAKYLRPSCTGYIDHDISMFKAPAYTLHSRHSEKRMVCHSSPGPCYLLDPKITRFGMSSCPQVPMEERISNLRLNPTLASCQYYFEKIHPPGERRAPQYTFGYRRPYRVMDLNPAPNQYQMPLLLGPNTPVSRAAPCYSLASRDKNWFYKEDVAGGPGPTTYARPEPSIYQNRSPTYSMAKRFAYPLDLTPRPGPGSHEVQQVTVHKPHIPAFTMGIKHSLHLCPLVIDIRD

SEQ ID NO: 917258 - protein, 329 aa, Homo sapiens
STVKVSLPQRTFCTSGPGDGPGGSAMEDEVPAFFQVVNFTCQVRSKHTQTILLSNRTNQTWNLHPIFEGEHWEGPEFITLEAHQQNKPYEITYRPRTMNLENRKHQGTLFFPLPDGTGWLYALHGTSELPKAVANIYREVPCKTPYTELLPITNWLNKPQRFRVIVEILKPEKPDLSITMKGLDYIDVLSGSKKDYKLNFFSHKEGTYAAKALDNRQHNTAILEKEGKLMTNPHDYPGSLPKDNFLDYNSVIFRNEVTNEFLYYNVSFRVIPSGIIKTIEMVTPVRQVASASIKLENPLPYSVTFSTECQMPDIALPSQFVVPANSEPT

SEQ ID NO: 917259 - protein, 170 aa, Homo sapiens
MISDGCSFRTSINPECILGSAVLGFLLMFAARMKSDKRQSAQKSGWFIANTCCEGGVDLTSLRQMKLQRPMSMLTDVKHFLSSGGNVNEKNDEGVTLKWDEKEQALRKEENQEDEMSSEPSENFEEAGGMIDYQILLSDVTSLAVFPNARNLHMMVPLLSLYKHPAYPVS

SEQ ID NO: 917260 - protein, 138 aa, Homo sapiens
MKQCLALTPGVECSGMIMGNGSLTSWAKEILTLASQSAWITDVNHHTEPTLVISDMICYQKGNGLITDKVLVVWIEDETSHNIPLIQSLIQSKALMLFKSVKAERVIEWLNELKNRIQPCAACKTLSFKDKYRVKAGK

SEQ ID NO: 917261 - protein, 347 aa, Homo sapiens
QGRAEGGKGVPGRRNSKHRDLEKVSSGPGPGPGDTWDLEMIQTQCLPLGSLHPGGEGAHVYEERHQVSVSRTDDVGCVVPSECLRACGAEVGCSNIAYPKLVMELMPIGLRGLMIAVMLAALMSSLTSIFNSSSTLFTMDIWRRLRPRSGERELLLVGRYGGGGQLVIVALIGVSVAWIPVLQDSNSGQLFIYMQSVTSSLAPPVTAVFVLGVFWRRANEQGAFWGLIAGLVVGATRLVLEFLNPAPPCGEPDTRPAVLGSIHYLHFAVALFALSGAVVVAGSLLTPPPQSVQIENLTWWTLAQDVPLGTKAGDGQTPQKHAFWARVCGFNAILLMCVNIFFYAYFA

SEQ ID NO: 917262 - protein, 230 aa, Homo sapiens
MTVDYRKLNQVVSPIAAAVPDVVLLLEQINTSPDTWYAAIDLANAFFSIPVHKAQQKQFAFSWQGQQYTFTVLPQGYISSLALCHNLIRRDLDGFLLLQNITLLVHYVDDIMLIGSKLHPVSRTSLKDSSEGKSSQWAELQAVHLVVHFAGRNTVTRTHNDNSIKLEVKIDTRTLWAPPTFKSMKPKKGVTVLAGVIDPGYQDEISLLLHNGDAEGSVYLVTPKILWRQQ

SEQ ID NO: 917263 - protein, 136 aa, Homo sapiens [sequence omitted]

SEQ ID NO: 917264 - protein, 230 aa, Homo sapiens; identical to SEQ ID NO: 917262

SEQ ID NO: 917265 - protein, 230 aa, Homo sapiens; identical to SEQ ID NO: 917262

SEQ ID NO: 917266 - protein, 136 aa, Homo sapiens
PVSKISIMLMQWIAESYGKKSKYFNFIRNCQAISKVAESFYIPTSDVCFSRQKFPASSIRAAFAGVIEAITREYTKCIQFEGIITSLGQSQKPQSIASPALCGGKSKLEDHPGFMGRRPNKCECWKGDFPVGQLWR

SEQ ID NO: 917267 - protein, 144 aa, Homo sapiens
MSSSSCSLSSISLSPLPSLPSSCCHHDCPVIFTVLITITTCTITIITIIVAVIITIIVTIIITSHLLLNITISFTITISISTVVISTTTSIMAASMLDHLLCAWHHAKLFAHIVSFNFHRDPMKPSCYSHFRGEENEDPKGYTV

SEQ ID NO: 917268 - protein, 4242 aa, Homo sapiens
MPVPHRWPGRAVAKGAELATRPAPPCPVRPGRGALCSKALGGARTAAPASERAAELPERPGPRAPSGRRSAAGRGRSPIQPRARHAVRRPRLSRGLRARAGLGTAGPCARCPNDAARRARPPGAGPGPGACGSGRWRRGPGAAAGPCEPPCLCGLAPGAACRVNCSGRGRGLRTLGPALRIPADATALTAMAKADGDVKKYGSKRGALALTHGHSLLRDVSHNLLRALDVGLLANLSALAELPGPQHLPLPCRNLSGNPFECDCGLAWLPQWAEEQQVRVVQPEAATCAGPGSLAGQPLLGIPLLDSGCGEEYVACLPDNSSGTVAAVSFSAAHEGLLQPEACSAFCFSTGQGLAALSEQGWCLCGAAQPSSASFACLSLCSGPPAPPAPTCRGPTLLQHVFPASPGATLVGPHGPLASGQLAAFHIAAPLPVTATRWDFGDGSAEVDAAGPAASHRYVLPGRYHVTAVLALGAGSALLGTDVQVEAAPAALELVCPSSVQSDESLDLSIQNRGGSGLEAAYSIVALGEEPARAVHPLCPSDTEIFPGNGHCYRLVVEKAAWLQAQEQCQAWAGAALAMVDSPAVQRFLVSRVTRSLDVWIGFSTVQGVEVGPAPQGEAFSLESCQNWLPGEPHPATAEHCVRLGPTGWCNTDLCSAPHSYVCELQPGGPVQDAENLLVGAPSGDLQGPLTPLAQQDGLSAPHEPVEVMVFPGLRLSREAFLTTAEFGTQELRRPAQLRLQVYRLLSTAGTPENGSEPESRSPDNRTQLAPACMPGGRWCPGANICLPLDASCHPQACANGCTSGPGLPGAPYALWREFLFSVPAGPPAQYSVTLHGQDVLMLPGDLVGLQHDAGPGALLHCSPAPGHPGPRAPYLSANASSWLPHLPAQLEGTWGCPACALRLLAQREQLTVLLGLRPNPGLRLPGRYEVRAEVGNGVSRHNLSCSFDVVSPVAGLRVIYPAPRDGRLYVPTNGSALVLQVDSGANATATARWPGGSLSARFENVCPALVATFVPACPWETNDTLFSVVALPWLSEGEHVVDVVVENSASRANLSLRVTAEEPICGLRATPSPEARVLQGVLVRYSPVVEAGSDMVFRWTINDKQSLTFQNVVFNVIYQSAAVFKLSLTASNHVSNVTVNYNVTVERMNRMQGLQVSTVPAVLSPNATLALTAGVLVDSAVEVAFLWTFGDGEQALHQFQPPYNESFPVPDPSVAQVLVEHNVTHTYAAPGEYLLTVLASNAFENLTQQVPVSVRASLPSVAVGVSDGVLVAGRPVTFYPHPLPSPGGVLYTWDFGDGSPVLTQSQPAANHTYASRGTYHVRLEVNNTVSGAAAQADVRVFEELRGLSGAPVVVSAAVQTGDNITWTFDMGDGTVLSGPEATVEHVYLRAQNCTVTVGAGSPAGHLARSLHVLVFVLEVLRVEPAACIPTQPDARLTAYVTGNPAHYLFDWTFGDGSSNTTVRGCPTVTHNFTRSGTFPLALVLSSRVNRAHYFTSICVEPEVGNVTLQPERQFVQLGDEAWLVACAWPPFPYRYTWDFGTEEAAPTRARGPEVTFIYRDPGSYLVTVTASNNISAANDSALVEVQEPVLVTSIKVNGSLGLELQQPYLFSAVGRGRPASYLWDLGDGGWLEGPEVTHAYNSTGDFTVRVAGWNEVSRSEAWLNVTVKRRVRGLVVNASRTVVPLNGSVSFSTSLEAGSDVRYSWVLCDRCTPIPGGPTISYTFRSVGTFNIIVTAENEVGSAQDSIFVYVLQLIEGLQVVGGGRYFPTNHTVQLQAVVRDGTNVSYSWTAWRDRGPALAGSGKGFSLTVLEAGTYHVQLRATNMLGSAWADCTMDFVEPVGWLMVAASPNPAAVNTSVTLSAELAGGSGVVYTWSLEEGLSWETSEPFTTHSFPTPGLHLVTMTAGNPLGSANATVEVDVQVPVSGLSIRASEPGGSFVAAGSSVPFWGQLATGTNVSWCWAVPGGSSKRGPHVTMVFPDAGTFSIRLNASNAVSWVSATYNLTAEEPIVGLVLWASSKVVAPGQLVHFQILLAAGSAVTFRLQVGGANPEVLPGPRFSHSFPRVGDHVVSVRGKNHVSWAQAQVRIVVLEAVSGLQVPNCCEPGIATGTERNFTARVQRGSRVAYAWYFSLQKVQGDSLVILSGRDVTYTPVAAGLLEIQVRAFNALGSENRTLVLEVQDAVQYVALQSGPCFTNRSAQFEAATSPSPRRVAYHWDFGDGSPGQDTDEPRAEHSYLRPGDYRVQVNASNLVSFFVAQATVTVQVLACREPEVDVVLPLQVLMRRSQRNYLEAHVDLRDCVTYQTEYRWEVYRTASCQRPGRPARVALPGVDVSRPRLVLPRLALPVGHYCFVFVVSFGDTPLTQSIQANVTVAPERLVPIIEGGSYRVWSDTRDLVLDGSESYDPNLEDGDQTPLSFHWACVASTQATSPLVLGLQREAGGCALNFGPRGSSTVTIPRERLAAGVEYTFSLTVWKAGRKEEATNQTVLIRSGRVPIVSLECVSCKAQAVYEVSRSSYVYLEGRCLNCSSGSKRGRWAARTFSNKTLVLDETTTSTGSAGMRLVLRRGVLRDGEGYTFTLTVLGRSGEEEGCASIRLSPNRPPLGGSCRLFPLGAVHALTTKVHFECTGWHDAEDAGAPLVYALLLRRCRQGHCEEFCVYKGSLSSYGAVLPPGFRPHFEVGLAVVVQDQLGAAVVALNRSLAITLPEPNGSATGLTVWLHGLTASVLPGLLRQADPQHVIEYSLALVTVLNEYERALDVAAEPKHERQHRAQIRKNITETLVSLRVHTVDDIQQIAAALAQCMGPSRELVCRSCLKQTLHKLEAMMLILQAETTAGTVTPTAIGDSILNITGDLIHLASSDVRAPQPSELGAESPSRMVASQAYNLTSALMRILMRSRVLNEEPLTLAGEEIVAQGKRSDPRSLLCYGGAPGPGCHFSIPEAFSGALANLSDVVQLIFLVDSNPFPFGYISNYTVSTKVASMAFQTQAGAQIPIERLASERAITVKVPNNSDWAARGHRSSANSANSVVVQPQASVGAVVTLDSSNPAAGLHLQLNYTLLDGHYLSEEPEPYLAVYLHSEPRPNEHNCSASRRIRPESLQGADHRPYTFFISPGSRDPAGSYHLNLSSHFRWSALQVSVGLYTSLCQYFSEEDMVWRTEGLLPLEETSPRQAVCLTRHLTAFGASLFVPPSHVRFVFPEPTADVNYIVMLTCAVCLVTYMVMAAILHKLDQLDASRGRAIPFCGQRGRFKYEILVKTGWGRGSGTTAHVGIMLYGVDSRSGHRHLDGDRAFHRNSLDIFRIATPHSLGSVWKIRVWHDNKGLSPAWFLQHVIVRDLQTARSAFFLVNDWLSVETEANGGLVEKEVLAASKGLVPWSHSVEGDAALLRFRRLLVAELQRGFFDKHIWLSIWDRPPRSRFTRIQRATCCVLLICLFLGANAVWYGAVGDSAYSTGHVSRLSPLSVDTVAVGLVSSVVVYPVYLAILFLFRMSRSKVAGSPSPTPAGQQVLDIDSCLDSSVLDSSFLTFSGLHAEQAFVGQMKSDLFLDDSKSWPDLLSDPSIVGSNLRQLARGQAGHGLGPEEDGFSLASPYSPAKSFSASGLVEGLRKVLLPAWCASLAHGLSLLLVAVAVAVSGSATFLASFLGWEPLKVLLEALYFSLVAKRLHPDEDDTLVESPAVTPVSARVPRVRPPHGFALFLAKEEARKVKRLHGMLRSLLVYMLFLLVTLLASYGDASCHGHAYRLQSAIKQELHSRAFLAITRGLWPWMAHVLLPYVHGNQSSPELGPPRLRQSLLVYMLFLLVTLLASYGDASCHGHAYRLQSAIKQELHSRAFLAITRYGHPELWPWMAHVLLPYVHGNQSSPELGPPRLRQVGAPSPALSGVAAVTSQEPTLTPPAPAGLGGFHSPSATPALARPAVGLHAAVTLRLEFPAAGRALAALSVRPFALRRLSAGLSLPLLTSFFFRPPEPCPPQVCLLLFAVHFAVAEARTWHREGRWRVLRLGAWARWLLVALTAATALVRLAQLGAADRQWTRFVRGRPRRFTSFDQVAHVSSAARGLAASLLFLLLVKGCKKTDFSSAAAQHVRFVRQWSVFGKTLCRALPELLGVTLGLVVLGVAYAQLAILLLPAADGLSVILGRLGTRCEPEPSRLQAVFEALLTQFDRLNQATEDVYQLEQQLHSLQGRRSSRAPAGSSRGPSPGLRPALPSRLARASRGVDLATGPSRTPFRAKNKVHPSST

SEQ ID NO: 917269 - protein, 154 aa, Homo sapiens
MIPLQAVRQAVAQTVEELKLKPTMMNLVEAQLMNPDATARQEAVISLGVLGIRSPQVFHLLLDLLDAENHQAVKKSLQETLILCASIDPWIQNKLKNKVLSVYEAPKTNVKAEPTRFQKEPENPEELTIQDFRSLPEDASQAPMRKQSILIFRE

SEQ ID NO: 917270 - protein, 290 aa, Homo sapiens
APLAGKGKQLEEKMRTQVGDEGKLVPVLQTLIKKSSSEASLEAALCLGFLRPCSNMVQEFLLQCLCQGLKTQRMKALRMLVKVMHVHSAPVIKAILDQLCSSSVLEDRFEATQMLKTIGLEQIQAQGLEELTFNLLRRKTHNEPFLGVLGIRSPQVFHLLLDLLDAENHQAVKKSLQETLILCASIDPWIQNKLKNKVLSVYEAPKTNVKAEPTRFQKEPENPEELTIQDFRLAKLNPLFIAKSITKVGQKKTPAFPPCCSKPRKHRPQVIGPWQPRIKKQLRVLAEIAK

SEQ ID NO: 917271 - protein, 193 aa, Homo sapiens
LILIPLQAVRQAVAQTVEELKLKPTMMNLVEAQLMNPDATARQEAVISLGVLGIRSPQVFHLLLDLLDAENHQAVKKSLQETLILCASIDPWIQNKLKNKVLSVYEAPKTNVKAEPTRFQKEPENPEELTIQDFRLAKLNPLFIAKSITKVGQKKTPAFPPCCSKPRKHRPQVIGPWQPRIKKQLRVLAEIAK

SEQ ID NO: 917272 - protein, 161 aa, Homo sapiens
DTVKGMMSSFTGAVLDVHAVSTEMLSFGKRAFYHCFYALTVSLEKHGSLYLGAEERVQAAQKDTPALSTENCMEVMDLYDLTVPLPGSSQNLCPTSELGLPPSYCDHTWWKERGSSLGYCIRTLIPFMKRSLNTFQRRPKAPPPATVTMELRFQHMPCGGS

SEQ ID NO: 917273 - protein, 154 aa, Homo sapiens
METGLQLHAWSPYSNRSNFSLINYYDLKALTNNTKVLKSSRVSIVFWGTKHVTFHKIVMATDSSFACSPGVSGDSSHSLATASRSNSALSCGYALGVADAAGSAGGALWQREGIAHRRCRWVHGSVLRGGRGVSNAKLRQQKQQPQQTEQPTWI

SEQ ID NO: 917274 - protein, 222 aa, Homo sapiens
SSSPMRVIQRGPDPGREQPCWLHSPGITMACFSLDEVPGGFPKTSGPDKILLEFLSCQVLSPSLNLNEKQNNQMYKEFEFQLYKYRETAAKELKTALTYAVVSKIGGFLTSLTSRRKPQTLTAGSAGGPGAASSPAGLGAKMLTPWGQRRPAALSVGPAEPAPIQHSRWPTRAMRGPGSCPVARVGTEAKEALRASEGCQHAVTSHCGDKIGEQVISEPSGI

SEQ ID NO: 917275 - protein, 159 aa, Homo sapiens
LTLQNPSQTCPLTLLEPQLDAVVAHAPEHQPGEGGLGLGHQDEEDPAVEAELDAEDLTLEHLKEEEIWLIFRAEKQIQNYLKKQVTPLFIHFRNNTNNWREIPENLMDQYSEVNAISTACSNGVPECEEMVSGLFKQWMENPNNNPSSLNLSTVWDPLV

SEQ ID NO: 917276 - protein, 133 aa, Homo sapiens
RGPRDTARDDRRGEQFRNATLVNEADKLRAALACSKELWILNRLWCSWTWVFSNIQLGTPSSPWMRVPTSHHVPHMPLPGCSKEEPPLGRVWWLIPVIPALWKTEVDGSPEVRSSRPAWPTWRNPVSTKNTKN

SEQ ID NO: 917277 - protein, 375 aa, Homo sapiens
MASEQPCPGLSLSTAQNDLFSTSGNEWVLLNLNVTGYYRVNYDEENWRKIQTQLQRDHSAIPVINRAQIINDAFNLASAHKVPVTLALNNTLFLIEERQYMPWEAALSSLSYFKLMFDRSEVYGPMKNYLKKQVTPLFIHFRNNTNNWREIPENLMDQYSEVNAISTACSNGVPECEEMVSGLFKQWMENPNNNPIHPNLRSTVYCNAIAQGGEEEWDFAWEQFRNATLVNEADKLRAALACSKELWILNRYLSYTLNPDLIRKQDATSTIISITNNVIGQGLVWDFVQSNWKKLFNDYGGGSFSFSNLIQAVTRRFSTEYELQQLEQFKKDNEETGFGSGTRALEQALEKTKANIKWVKENKEVVLQWFTENSK

SEQ ID NO: 917278 - protein, 498 aa, Homo sapiens
LLSAPSPPPQGASVLRMLSSFLSEDVFKQGLASYLHTFAYQNTIYLNLWDHLQEAVNNRSIQLPTTVRDIMNRWTLQMGFPVITVDTSTGTLSQEHFLLDPDSNVTRPSEFNYVWIVPITSIRDGRQQQDYWLIDVRAQNDLFSTSGNEWVLLNLNVTGYYRVNYDEENWRKIQTQLQRDHSAIPVINRAQIINDAFNLASAHKVPVTLALNNTLFLIEERQYMPWEAALSSLSYFKLMFDRSEVYGPMKNYLKKQVTPLFIHFRNNTNNWREIPENLMDQYSEVNAISTACSNGVPECEEMVSGLFKQWMENPNNNPIHPNLRSTVYCNAIAQGGEEEWDFAWEQFRNATLVNEADKLRAALACSKELWILNRYLSYTLNPDLIRKQDATSTIISITNNVIGQGLVWDFVQSNWKKLFNDYGGGSFSFSNLIQAVTRRFSTEYELQQLEQFKKDNEETGFGSGTRALEQALEKTKANIKWVKENKEVVLQWFTENSK

SEQ ID NO: 917279 - protein, 498 aa, Homo sapiens; identical to SEQ ID NO: 917278

SEQ ID NO: 917280 - protein, 498 aa, Homo sapiens; identical to SEQ ID NO: 917278

SEQ ID NO: 917281 - protein, 379 aa, Homo sapiens
LLSAPSPPPQGASVLRMLSSFLSEDVFKQGLASYLHTFAYQNTIYLNLWDHLQEAVNNRSIQLPTTVRDIMNRWTLQMGFPVITVDTSTGTLSQEHFLLDPDSNVTRPSEFNYVWIVPITSIRDGRQQQDYWLIDVRAQNDLFSTSGNEWVLLNLNVTGYYRVNYDEENWRKIQTQLQRDHSAIPVINRAQIINDAFNLASAHKVPVTLALNNTLFLIEERQYMPWEAALSSLSYFKLMFDRSEVYGPMKNYLKKQVTPLFIHFRNNTNNWREIPENLMDQYSEVNAISTACSNGVPECEEMVSGLFKQWMENPNNNPKKKTKKKKKILCGGHLGHERKSFIKTHFWVGDAGPRVRCSLHTWRPYRWCSPERNPRPRRT

SEQ ID NO: 917282 - protein, 137 aa, Homo sapiens
LLSAPSPPPQGASVLRMLSSFLSEDVFKQGLASYLHTFAYQNTIYLNLWDHLQEAVNNRSIQLPTTVRDIMNRWTLQMGFPVITVDTSTGTLSQEHFLLDPDSNVTRPSEFNYVWIVPITSIRDGRQQQDYWLIDVR

SEQ ID NO: 917283 - protein, 84 aa, Homo sapiens
MGTLKWEWKARGLRELLLKAVQGPSRTENLLFFWQLEQFKKDNEETGFGSGTRALEQALEKTKANIKWVKENKEVVLQWFTENS

SEQ ID NO: 917284 - protein, 375 aa, Homo sapiens; identical to SEQ ID NO: 917277

SEQ ID NO: 917285 - protein, 498 aa, Homo sapiens; identical to SEQ ID NO: 917278

SEQ ID NO: 917286 - protein, 498 aa, Homo sapiens; identical to SEQ ID NO: 917278

SEQ ID NO: 917287 - protein, 498 aa, Homo sapiens; identical to SEQ ID NO: 917278

SEQ ID NO: 917288 - protein, 365 aa, Homo sapiens
LLSAPSPPPQGASVLRMLSSFLSEDVFKQGLASYLHTFAYQNTIYLNLWDHLQEAVNNRSIQLPTTVRDIMNRWTLQMGFPVITVDTSTGTLSQEHFLLDPDSNVTRPSEFNYVWIVPITSIRDGRQQQDYWLIDVRAQNDLFSTSGNEWVLLNLNVTGYYRVNYDEENWRKIQTQLQRDHSAIPVINRAQIINDAFNLASAHKVPVTLALNNTLFLIEERQYMPWEAALSSLSYFKLMFDRSEVYGPMKNYLKKQVTPLFIHFRNNTNNWREIPENLMDQYSEVNAISTACSNGVPECEEMVSGLFKQWMENPNNNPIHPNLRSTVYCNAIAPAPHANPALGLAWHLSPSALGLISGKPSSRAR

SEQ ID NO: 917289 - protein, 273 aa, Homo sapiens
LLSAPSPPPQGASVLRMLSSFLSEDVFKQGLASYLHTFAYQNTIYLNLWDHLQEAVNNRSIQLPTTVRDIMNRWTLQMGFPVITVDTSTGTLSQEHFLLDPDSNVTRPSEFNYVWIVPITSIRDGRQQQDYWLIDVRAQNDLFSTSGNEWVLLNLNVTGYYRVNYDEENWRKIQTQLQRDHSAIPVINRAQIINDAFNLASAHKVPVTLALNNTLFLIEERQYMPWEAALSSLSYFKLMFDRSEVYGPMKVRRCMVGFKNQFAPVPESALLGS

SEQ ID NO: 917290 - protein, 216 aa, Homo sapiens
LLSAPSPPPQGASVLRMLSSFLSEDVFKQGLASYLHTFAYQNTIYLNLWDHLQEAVNNRSIQLPTTVRDIMNRWTLQMGFPVITVDTSTGTLSQEHFLLDPDSNVTRPSEFNYVWIVPITSIRDGRQQQDYWLIDVRAQNDLFSTSGNEWVLLNLNVTGYYRVNYDEENWRKIQTQLQRDHSAIPVINRAQIINDAFNLARTTGRSWITPLVSGWI

SEQ ID NO: 917291 - protein, 259 aa, Homo sapiens
FFFFFFFFTSTIFYLAAGNSVLQKVELLVHYDTKLFQKAILAQMTANQGLLKLRPPYSTLQIASSSAQRKHADVQGKEFPKADLHGIMDMLWTLHRTCCCSFKLGWAKVEKALALIEGLAGRSSLCSPSPPELEAAQSTEICARISKRMAIKNTGSSAEAPVVISPNRYWPSPPNEIAILTLWQSKGGKVGGWDGMKHMKRLNQDNIYYSVDVDTKSPAMATMPYSHILTIPTLLHPCASSACEMLVSPPPGTHGLPTH

SEQ ID NO: 917292 - protein, 253 aa, Homo sapiens
MTALGLHVLAPPDSSQSEARLPTHGSRRFNSLGHEGRFLLNQGSPGFRRKFLRGGAEPAFRMSPYLPGPCHRASLLGCGWVHSPCCITLHRSVGGLGGPVTAGLCCLRALGWQAPQAPQAPAASTGSTGSRRPPQASTGLHRLPQASTGSTGSTGSRRPPQAPAASTGSTGSTGSRSLHRPPQRPADLHRPPQASTGSRGPPQASTGSRGPPQASTGSRGPPAGLLQSGSPLRFLEGWYGPTTCESDPAVMEV

SEQ ID NO: 917293 - protein, 253 aa, Homo sapiens; identical to SEQ ID NO: 917292

SEQ ID NO: 917294 - protein, 586 aa, Homo sapiens
TWVEPDPEPGSDILGYINIIDPNIWNPQPSQMNRIKIRDTSQASAQHQLWKQSQDSRPRPEPCPPPEPSAPQDGVPAENGLPQGDPEPLPPVPKPRTVPVADVLARDSSDIGWVLELPKEEAPQNGTDHRLPRMAGPGHAPLQRQLSVTQDDPESLGVGLPNGLDGVEEEDDDDYVTLSDQDSHSGSSGRGPGPRRPSVASSVSEEYFEVREHSVPLRRRHSEQVANGPTPPPRRQLSAPHITRGTFVGPQGGSPWAQSRGREEADALKRMQAQRSTDKEAQGQQFHHHRVPASGTRDKDGFPGPPRYRSAADSVQSSTRNAGPAMAGPHHWQAKGGQVPRLLPDPGSPRLAQNARPMTDGRATEEHPSPFGIPYSKLSQSKHLKARTGGSQWASSDSKRRAQAPRDRKDPYAACPSLEPHLLRPQPRLMTRRADRPPGPTRAHWDGRKVGWAGDVGTHLVGAPVPGGHDGQAKGHPGPRQVPCVGVSKHVHGVCTWQVAGGVGNGPGGNGLGVGCLQLPVTTDLVKSWRGQGGTGTVWWLRGPDSLGSPLPSSHKKLPDASNLSFFHLIFPSVWKGVRVEGCFFF

SEQ ID NO: 917295 - protein, 586 aa, Homo sapiens; identical to SEQ ID NO: 917294

SEQ ID NO: 917296 - protein, 586 aa, Homo sapiens; identical to SEQ ID NO: 917294

SEQ ID NO: 917297 - protein, 586 aa, Homo sapiens; identical to SEQ ID NO: 917294

SEQ ID NO: 917298 - protein, 586 aa, Homo sapiens; identical to SEQ ID NO: 917294

SEQ ID NO: 917299 - protein, 400 aa, Homo sapiens
MVSEGGPLAEQQGAMAQNVYGPGVRIGNWNEDVYLEEELMKDFLEKRDKGKLLIQRSRRLKQNLLRPMQLSVTEDGYIHYGDKVMLVNPDDPDTEADVFLRGDLSLCMTPDEIQSHLKDELEVPCGLSAVQAKTPIGRNTFIILSVHRDATGQVLRYGQDFCLGITGGFDNKMLYLSSDHRTLLKSSKRSWLQEVYLTDEVSHVNCWQAAFPDPQLRLEYEGFPVPANAKILINHCHTNRGLAAHRHLFLSTYFGKEAEVVAHTYLDSHRVEKPRNHWMLVTGNPRDASSSMLDLPKPPTEDTRAMEQAMGLDTQLEYVVSNMTSRYINNLLLASELDFDGNLEYWQGETGSPGCSRCMDLCTVTLAHSTSAATSSGAQSQIVESILRAVCSHSLYRKCH

SEQ ID NO: 917300 - protein, 157 aa, Homo sapiens
VFYTFQSRQDMPSEDVLSLQVSLVNLDMKCYPDRVDYIDKVLETAAEIFNKLNLEQYVTFFYFDYESRKSMSCYVLSSVLDYNTEIVSQDQVDSIMNLVSTLIQDQPDQPVEDPDPEDFADEQSVVGPSFICCALRTLTSSTWTVVLCSVSYVICTE

SEQ ID NO: 917301 - protein, 226 aa, Homo sapiens
LYLVPEALDPLFMDPDLAYGTYTGSCGHVMHAVCWQKYFEAVQLSSQQRIHVDLFDLESGEYLCPLCKSLCNTVIPIIPLQPQKINSENADALAQLLTLARWIQTVLARISGYNIRHAKGENPIPIFFNQGMGDSTLEFHSILSFGVESSIKYSNSIKEMVILFATTIYRIGLKVPPDERDPRVPMLTWSTCAFTIQAIGKAHKKTGLEVSVRINFDHSFLNSFFH

SEQ ID NO: 917302 - protein, 142 aa, Homo sapiens
MPGPNSLKSQERCHLMVLTGRLWMSNLSASHTEPEARLAAPVNGMESQGISCILSVQLSDATVVYDDRGQLRFSEETYHLMAEAFTKNSSRYVLLICKLGSDPRATWSLGDLLLPGTESHSLSLTNISGSVFQVKLFCQCHE

SEQ ID NO: 917303 - protein, 140 aa, Homo sapiens
SQGQVPAGMLAAAAPLQGEPPTSCPAHLPHWKVTHPLFGLGSLMFLITQEDGHATGRPRTLHPADGCSRDCQTETTPHTQKAPKSQSLILFLERHCIILDHKICVIGFVSKTWDSGDKTSLQGYLCHCILAAFEAKHFNI

SEQ ID NO: 917304 - protein, 122 aa, Homo sapiens
FSGTGTSWDVGSSRSPARRTSHFLSRTPASLESDAPTVWPRQPDVSHHTGRRSCYRKTSDFASSRCEFKFQLCNLQAQRWICWEAKQAYLQSPQLAWAPPKTLTSFCIHNFVVFSLQKAAQI

SEQ ID NO: 917305 - protein, 214 aa, Homo sapiens
MSPPHPTGTPVHQLNETIDYNEQFTWRLKENYAAEYANALEKGLPDPVLYLAEKFTPSSPCGLYHQYHLAGHYASATLWVAFCFWLLSNVLLSTPAPLYGGLALLTTGAFALFGVFALASISSVPLCPLRLGSSALTTQYGAAFWVTLATGVLCLFLGGAVVSLQYVRPSALRTLLDQSAKDCSQERGGSPLILGDPLHKQAALPDLKCITTNL

SEQ ID NO: 917306 - protein, 436 aa, Homo sapiens
MSFPHFGHPYRGASQFLASASSSTTCCESTQRSVSDVASGSTPAPALCCAPYDSRLLGSARPELGAALGIYGAPYAAAAAAQSYPGYLPYSPEPPSLYGALNPQYEFKEAAGSFTSSLAQPGAYYPYERTLGQYQYERYGAVELSGAGRRKNATRETTSTLKAWLNEHRKNPYPTKGEKIMLAIITKMTLTQVSTWKENKMTWAPKNKGGEERKAEGGEEDSLGCLTADTKEVTASQEARGLRLSDLEDLEEEEEEEEEAEDEEVVATAGDRLTEFRKGAQSLPGPCAAAREGRLERRECGLAAPRFSFNDPSGSEEADFLSAETGSPRLTMHYPCLEKPRIWSLAHTATASAVEGAPPARLGHEVLSAVMIPGQPPASARRLSVPRDSACDESSCIPKAFGNPKFALQGLPLNCAPCPRRSEPVVQCQYPSGAEG

SEQ ID NO: 917307 - protein, 183 aa, Homo sapiens
MKPRGITGFFLLCSFFLPPVSLGWDLWSLRKKGQGPSSIFSLPLPLPCTPLLPTFPDPIDHSSMWCPVCFSMFARKVRSLAPPFLERHEKERVAFMLKVGRGPPGEAGSLGASPRNARRWQMANTCPEALERDEGGKKLGEEEEEADARPEFLRREEAGWERGNDKAAPLVVAGARKRGLRGS

SEQ ID NO: 917308 - protein, 183 aa, Homo sapiens; identical to SEQ ID NO: 917307

SEQ ID NO: 917309 - protein, 226 aa, Homo sapiens
TATTRRKMRTTAAPSGHTCQQITTAPTDGAPGGPFSGISDKWQPLLSTVTGVHRYKWLKQNVQDLYPQSPLLSTIAEFALKEEPVDLEVWQCPESNSLSLFEREPLTDCLKDVDLIPPFNRMLLEVTFGKLYAWTVQNILNVLMDASAKFKELGIQPVPLQTITSENPLGPSLGSIPQARFLLMMLSMLTLQHSANNLDLLLNSGTLALTQTALRLIVLPDVELLI

SEQ ID NO: 917310 - protein, 435 aa, Homo sapiens
MFLGQNITDEELKEKNAELQEKLRLVESEKSEIQLNVKDLKRKLERAQLLLPQASSCSPGGCGSPIRLGPWSRDHQQLQVEADRLGKELQSVSAKLQAQVEENELWNLLNQQQEEKMWRQEEKIQEQEEKMCEQELKIREQEEKMWRQEEKMHEQEEKIREQEDKMWRQEEKIREQEEKIREQEEKMWRQEEKIREQDEKIQEQEEEMWRQEEKIREQEEKRQEKMWRQEKKMREQDEKIREQEEEMWRQEEKIRELEEMMQDQEEKLREVEEKMQEEEEKMQEQEEKIQRQEEKIQEQEEKTWRQEKLLKQEEKIWEQEEKMWRQEEKMWEQEEKMQEQEEKMQRQEEKMREQEVRLWQQEEKMQEQEVRLQELEERLGKLGQKAELLGGAGRESGSQRLPTLTPILQVELKSQEAQSLQQQQDHYRGHLQQHN

SEQ ID NO: 917311 - protein, 197 aa, Homo sapiens
MWGGGGAWLGAGTGGVPAAPRTFAPTSPASEAGELDQQPPGASESPSPGLPRSPERWDAGLGSRQRNMAPWTLWRCCQRVVGWVPVLFITFVVVWSYYAYVVELCVFTIFGNEENGKTVVYLVAFHLFFVMFVWSYWMTIFTSPASPSKEFYLSNSEKERYEKEFSQERQQEILRRAARALPIYTTSASKSLMQSTK

SEQ ID NO: 917312 - protein, 131 aa, Homo sapiens [sequence omitted]

SEQ ID NO: 917313 - protein, 432 aa, Homo sapiens
MWGGGGAWLGAGTGGVPAAPRTFAPTSPASEAGELDQQPPGASESPSPGLPRSPERWDAGLGSRQRNMAPWTLWRCCQRVVGWVPVLFITFVVVWSYYAYVVELCVFTIFGNEENGKTVVYLVAFHLFFVMFVWSYWMTIFTSPASPSKEFYLSNSEKERYEKEFSQERQQEILRRAARALPIYTTSASKTIRYCEKCQLIKPDRAHHCSACDSCILKMDHHCPWVNNCVGFSNYKFFLLFLLYSLLYCLFVAATVLEYFIKFWTNELTDTRAKFHVLFLFFVSAMFFISVLSLFSYHCWLVGKNRTTIESFRAPTFSYGPDGNGFSLGCSKNWRQVFGDEKKYWLLPIFSSLGDGCSFPTRLVGMDPEQASVTNQNEYARSSGSNQPFPIKPLSESKNRLLDSESQWLENGAEEGIVKSGTNNHVTVAIEN

SEQ ID NO: 917314 - protein, 177 aa, Homo sapiens
MFVWSYWMTIFTSPASPSKEFYLSNSEKERYEKEFSQERQQEILRRAARALPIYTTSASKTIRYCEKCQLIKPDRAHHCSACDSIGSTTWEPEPLLWFLWGRQGKQILDWLAAGIAEDSGIGAISSCLVPGPGMMKAEDCCLLECKRQIEEVVLSVGSGLFSLCMKDVLLARKISLR

SEQ ID NO: 917315 - protein, 422 aa, Homo sapiens
MWGGGGAWLGAGTGGVPAAPRTFAPTSPASEAGELDQQPPGASESPSPGLPRSPERWDAGLGSRQRNMAPWTLWRCCQRVVGWVPVLFITFVVVWSYYAYVVELCVFTIFGNEENGKTVVYLVAFHLFFVMFVWSYWMTIFTSPASPSKEFYLSNSEKERYEKEFSQERQQEILRRAARALPIYTTSASKTIRYCEKCQLIKPDRAHHCSACDSCILKMDHHCPWVNNCVGFSNYKFFLLFLLYSLLYCLFVAATVLEYFIKFWTNELTDTRAKFHVLFLFFVSAMFFISVLSLFSYHCWLVGKNRTTIESFRAPTFSYGPDGNGFSLGCSKNWRQVFGDEKKYWLLPIFSSLGDGCSFPTRLVGMDPEQASVTNQNEYARSSGSNQPFPIKPLSESKNRLLDSESQWLENGAEEGIVKSGV

SEQ ID NO: 917316 - protein, 422 aa, Homo sapiens; identical to SEQ ID NO: 917315

SEQ ID NO: 917317 - protein, 107 aa, Homo sapiens
MHSGGAKHPGWVAETTMYTCFSQEARQGPCKRLVDRHAYRIDMSQSCGLEPMRGSAVFVPDGELLLQLVTQVPRWGKEGNGENLQHSGSHHPGRDQSCLRIAQAAAG

SEQ ID NO: 917318 - protein, 281 aa, Homo sapiens
MQAVHSRCTPWCHGTCTNPMECARVFHTGGARLVLCGKNWERLENLYDALISVADPSKQTFTPKLVLLDLSDISCVPDVAKEVLDCYGCVDILINNASVKVKGPAHKISLELDKKIMDANYFGPITLTKALLPNMISRRTGQIVLVNNIQGKFGIPFRTTYAASKHAALGFFDCLRAEVEEYDVVISTVSPTFIRSYHVYPEQGNWEASIWKFFFRKLTYGVHPVEVAEEVMRTVRRKKQEVFMANPIPKAAVYVRTFFPEFFFAVVACGVKEKLNVPEEG

SEQ ID NO: 917319 - protein, 229 aa, Homo sapiens
MQAVHSRCTPWCHGTCTNPMECARVFHTGGARLVLCGKNWERLENLYDALISVADPSKQTFTPKLVLLDLSDISCVPDVAKEVLDCYGCVDILINNASVKVKGPAHKISLELDKKIMDANYFGPITLTKALLPNMISRRTGQIVLVNNIQGKFGIPFRTTFFFRKLTYGVHPVEVAEEVMRTVRRKKQEVFMANPIPKAAVYVRTFFPEFFFAVVACGVKEKLNVPEEG

SEQ ID NO: 917320 - protein, 747 aa, Homo sapiens
MHLQQAEEKGQPPIRPLPRLKPLKLGPNRHLSRFGSTFIMIREWVPGITKVRGSFLGSRCSKLKEYQQRNSPGVPAGVKMKKKNTGSSPETATFGGCHSPGAIQDILKVLVSNLNHSNGVALPHWISGSICLAFLPNIQFQAIDILTLEKADLKTTLYHTKRAARHFEEESKDLAGRLQYSLQRIQELERALSAVSTQQQEEDRDGVSCPEGSMVISRYFCVWLLEAAAVGELGGTVESEHWMQSSEAKCLPCPFLASSSCREAVLQWRLQQTIKEQALLNAHVTQEQDERLREQEEWRVREQERLCEQNERLREQQKTLREQGERLRKQEQRLCKQEERLRKEEERLRKQEKRLWDQEERLWDQEERLWEKEERLQKQEERLMLSQNHKLDKQLAEPQCSFEDLNNENKSALQLEQQVKELQERLGEKETVTSAPSKKGWEEPAASHQNQQLETQLSLVALPGEGDGGQHLDSEEEEAPRPTPNIPEDLESREATEEQARLCGQWKVRRLCHLHLAHLVALAWKEPEAEAPAPGTGGDFVCGESYQALKEAMEKVKSGFMDLPKEKVGRKEQVEKLELGFVQLSGATDGMREYITEYESQGAVPNTRHQEKEDIIRLAQKEEEMKVKLLELQELVLPLVGDHEGHGKFLTAAQNPADEPAPGAPAPQELGAADEQGDFYEVSLDDSEEPAPGAAGEGSPHDNPTAQQIVQLPPVMQDTQEHPGLPGNPCVSFFYQAAENREINIII

SEQ ID NO: 917321 - protein, 747 aa, Homo sapiens; identical to SEQ ID NO: 917320

SEQ ID NO: 917322 - protein, 152 aa, Homo sapiens
MCLFLSLAAQVTCLARAGVAAEEEPQLLLSSFERKLPAGGWLEGLEPCLCGHQPPRAPKRKENRKSTPLWPRRLPIRSPHPRRLPAGRLALLAWTGPGGELQAAKSPLPGAEELGGRAQALLLPGAATRNPLRLGCVQGVGPARRTAASADV

SEQ ID NO: 917323 - protein, 205 aa, Homo sapiens
WFINCDRLLIRAPVYKSFRMKHYPFTSLQTFRSFRVMNNAVNIHVQVFMWTFEDIHRYPLMCRDRNGKLKAGAKVTLFISEYHSFLESSSSFSRSYWLSALNPESLRFQCTGQLLSQLQLPPSDGGGSSGAAAAVKAAAVGGGAPGAVPSVEPVGDTGLCSRSCLQYIWSSQSLTWSQCLCWCLVLPAPQQQLVCLAVRSGRIPH

SEQ ID NO: 917324 - protein, 205 aa, Homo sapiens; identical to SEQ ID NO: 917323

SEQ ID NO: 917325 - protein, 205 aa, Homo sapiens; identical to SEQ ID NO: 917323

SEQ ID NO: 917326 - protein, 205 aa, Homo sapiens; identical to SEQ ID NO: 917323

SEQ ID NO: 917327 - protein, 653 aa, Homo sapiens
IIRADFLLAVFMMESTGVEKTPPEILQKSFLRELVAPVHPAPGEEKGREPALRGGLSLTPPLMSQKTGRKLPAPGCGGACCSAPALAGALYTGRRGASAGPGGGRRAGKARGVVCRFPSAKERSALSCAQSLRPDLKKREGERAKGAIQRARQAGRRPRAAPARALAPRPGGRWVSAAAGPQHPGAPRREWEGGEGAGAREGKVSEPGAGAAGDGNRPDAGAEPGHRKLCSGGESGVRGGRRKLVSGRGAPGIGASASGWRLSLWVLCVTSGPQPAGPPGSGRRCAGGCARVPRPPPPGPRPRPSGAADCFHSSRHAWAGKILNAAWAGRRTAAAQRLQDRERCGARPGDPGTRGSGRTGAGEGAGTGGPGTGGAAAVSRVSKMEKAGPVVDHSGEGGISRLSRPALLQKPSGGTWSKLNVVDAVFTVKIRFKERLGAQPLGSDRFSHCLSCSEPPYSKDGDGGSHIQGLMRRIQRGNPHPGLTDIASQTEDLAQPRRAYQRMASSPELPTEDEQGSWGIDDLHISLQGKENRAGQEGSGVGGVTILDRTVRVDLLDEVLSEPGFEGGICRSNPGGGDGDLGQGGGDGGGEKWSYPEYIVRVDLTGYLEALDMKRERKGGGNLDEGGKSGVWFLEAGEENDHLYQMLLMGPAG

SEQ ID NO: 917328 - protein, 164 aa, Homo sapiens
MSPKLKTIMAAHLFRSTSSPQYSYWGTGATLHCAAGQLPAGRARTALRRRPLAEGELREPALPLGSWFCPERRKRHLQFQPVAAGTATTATAKPELLIGRRRYVLQLHCLHRQCEEGLRWGLTDTCGARGHQTAGSQRQPPPCWLLWLPPGCPDMHCLEPNGTS

SEQ ID NO: 917329 - protein, 116 aa, Homo sapiens
VCVQAQYPTTGIATLTHGQSPQVVFCFREAERLQLRMDCLSPSLHMFTEAEAKSEISLPTILPQAVSFFPTHLLQHLLTFVTVSNFRMNRCRSNISLECSFTSNLLTMISSSIFIF

SEQ ID NO: 917330 - protein, 145 aa, Homo sapiens
MENEFDKSTELGFRRWVITNSSKLKEDILTQCKEAKNHEKRLEELLTGISSLEKNISDLIELKNIARELQQAYTSINSQIDQVEERISEIEDQLNEIKTNDKNHVSISIDAEKAFDKSQYPFMLKTKNNKLGIDGMHVKNHKSYL

SEQ ID NO: 917331 - protein, 150 aa, Homo sapiens
MAHSFLRTSRRVKWLTVVIPSLWEAEGGESRGQEIETILANMVKPCLYKKLAGHGGAHLYSQLLERLRQEDRLNPGSGGCSESRLHPEIAPLYPSLATGTPSHTNKKTKNNNKKNISLPQKETLYPFAVTPHSSLPQQPIICFLPVVDIS

SEQ ID NO: 917332 - protein, 153 aa, Homo sapiens
MPGGRRCHVQQKEKGPRLHAQLTRLFPEERAFADLDSFPQGPQASPRVHRPVAETLKVEMWKKGPTDCPRSRMLQSSREALGEICPHGFLIFVHQQGDVYDPGLQHTFLGRVENSTSQFFLEILRATLREQRTYKCCPIHGDSPWPLGLSEQR

SEQ ID NO: 917333 - protein, 156 aa, Homo sapiens
MVIILCDPWRWQEALDIHGVGAPPEAVGILLDVVWAWKEGQWRQWMILFLADHWMWQGVLGHVWCGLLQVLRSPERVSTLNCMSIGGGNPSPVAPEASWQWKGRGPCMRVPHSLLSGSQSDDFIVPWKPCRIQHVLCSSGSPSCTFEENPEVEVDL

SEQ ID NO: 917334 - protein, 163 aa, Homo sapiens
EPTLKRIMFLSLEITQSIPTTKQGSAFLLFIITHFVLVPAAVIEYYALGSFNNKHLLLTVLEPEKIKVLAVPVSGGNTLPGLWIVIFPTNIRVIEVLVTTQRTWTGQCHAQMKEYSTAAKRNGFDLHEEEEERFESGHSALSPCDCPATPWNSAESPQQEGLT

SEQ ID NO: 917335 - protein, 780 aa, Homo sapiens
MPAPPQESTENLVPFLDTWDSAGEQPLEPEQFLASQQDLKDKLSPQERLPVSPKKLKKDPAQRWSLAEIIGIARQLSTPQSQKQTLQNEYSSTDTPYPSSLPPELRVKSDEPPGPSEQVGPSQFHLEPETQNPETLEDIQSSSLQQEAPAQLPQLLEEEPSSMQQEAPALPPESSMESLTLPNHEVSVQPPGEDQAYYHLPNITVKPADVEVTITSEPTNETESSQAQQETPIQFPEEVEPSATQQEAPIEPPVSPMEHELSISEQQQPVQPSESSREVESSLTQQETPGQPPEHHEVTVSPPGHHQTHHLDSPSVSVKPPDVQLTIAAEPSAEVGTSLVHQEATARLSGSGNDVEPPAIQHGGPPLLPESSEEAGPLAVQQETSFQSPEPINNENPSPTQQEAAAEHPQTAEEGESSLTHQEAPAQTPEFPNVVVAQPPEHSHLTQATVQPLDLGFTITPESMTEVELSPTMKETPTQPPKKVVPQLRVYQGVTNPTPGQDQAQHPVSPSVTVQLLDLGLTITPEPTTEVGHSTAPKRTIVSPKHPEVTLPHPDQVQTQHSHLTRATVQPLDLGFTITPKSMTEVEPSTALMTTAPPPGHPEVTLPPSDKGQAQHSHLTQATVQPLDLELTITTKPTTEVKPSPTTEETSTQPPDLGLAIIPEPTTETGHSTALEKTTAPHPDRVQSLHRSLTEVTGPPTELEPAQDSLVQSESYTQNKALTAPEEQKASTSTNICELCTCGDEMLSCIDLNPEQRLRQVPVPEPNTHNGTFTIFLGTE

SEQ ID NO: 917336 - protein, 920 aa, Homo sapiens
MPAPPQESTENLVPFLDTWDSAGEQPLEPEQFLASQQDLKDKLSPQERLPVSPKKLKKDPAQRWSLAEIIGIARQLSTPQSQKQTLQNEYSSTDTPYPSSLPPELRVKSDEPPGPSEQVGPSQFHLEPETQNPETLEDIQSSSLQQEAPAQLPQLLEEEPSSMQQEAPALPPESSMESLTLPNHEVSVQPPGEDQAYYHLPNITVKPADVEVTITSEPTNETESSQAQQETPIQFPEEVEPSATQQEAPIEPPVSPMEHELSISEQQQPVQPSESSREVESSLTQQETPGQPPEHHEVTVSPPGHHQTHHLDSPSVSVKPPDVQLTIAAEPSAEVGTSLVHQEATARLSGSGNDVEPPAIQHGGPPLLPESSEEAGPLAVQQETSFQSPEPINNENPSPTQQEAAAEHPQTAEEGESSLTHQEAPAQTPEFPNVVVAQPPEHSHLTQATVQPLDLGFTITPESMTEVELSPTMKETPTQPPKKVVPQLRVYQGVTNPTPGQDQAQHPVSPSVTVQLLDLGLTITPEPTTEVGHSTAPKRTIVSPKHPEVTLPHPDQVQTQHSHLTRATVQPLDLGFTITPKSMTEVEPSTALMTTAPPPGHPEVTLPPSDKGQAQHSHLTQATVQPLDLELTITTKPTTEVKPSPTTEETSTQPPDLGLAIIPEPTTETGHSTALEKTTAPHPDRVQSLHRSLTEVTGPPTELEPAQDSLVQSESYTQNKALTAPEEQKASTSTNICELCTCGDEMLSCIDLNPEQRLRQVPVPEPNTHNGTFTILNFQGNYISYIDGNVWKAYSWTEKLILRENNLTELHKDSFEGLLSLQYLDLSCNKIQSIERHTFEPLPFLKFINLSCNVITELSFGTFQAWHGMQFLHKLILPSHMACCLCQLKNSIEAVCRQSSCIAQCCLSTPTLSLDGGVCS

SEQ ID NO: 917337 - protein, 875 aa, Homo sapiens
MPAPPQESTENLVPFLDTWDSAGEQPLEPEQFLASQQDLKDKLSPQERLPVSPKKLKKDPAQRWSLAEIIGIARQLSTPQSQKQTLQNEYSSTDTPYPSSLPPELRVKSDEPPGPSEQVGPSQFHLEPETQNPETLEDIQSSSLQQEAPAQLPQLLEEEPSSMQQEAPALPPESSMESLTLPNHEVSVQPPGEDQAYYHLPNITVKPADVEVTITSEPTNETESSQAQQETPIQFPEEVEPSATQQEAPIEPPVSPMEHELSISEQQQPVQPSESSREVESSLTQQETPGQPPEHHEVTVSPPGHHQTHHLDSPSVSVKPPDVQLTIAAEPSAEVGTSLVHQEATARLSGSGNDVEPPAIQHGGPPLLPESSEEAGPLAVQQETSFQSPEPINNENPSPTQQEAAAEHPQTAEEGESSLTHQEAPAQTPEFPNVVVAQPPEHSHLTQATVQPLDLGFTITPESMTEVELSPTMKETPTQPPKKVVPQLRVYQGVTNPTPGQDQAQHPVSPSVTVQLLDLGLTITPEPTTEVGHSTAPKRTIVSPKHPEVTLPHPDQVQTQHSHLTRATVQPLDLGFTITPKSMTEVEPSTALMTTAPPPGHPEVTLPPSDKGQAQHSHLTQATVQPLDLELTITTKPTTEVKPSPTTEETSTQPPDLGLAIIPEPTTETGHSTALEKTTAPHPDRVQSLHRSLTEVTGPPTELEPAQDSLVQSESYTQNKALTAPEEQKASTSTNICELCTCGDEMLSCIDLNPEQRLRQVPVPEPNTHNGTFTILNFQGNYISYIDGNVWKAYSWTEKLILRENNLTELHKDSFEGLLSLQYLDLSCNKIQSIERHTFEPLPFLKFINLSCNVITELSFGTFQAWHGMQFLHKL

SEQ ID NO: 917338 - protein, 141 aa, Homo sapiens [sequence omitted]

SEQ ID NO: 917339 - protein, 1085 aa, Homo sapiens
MSPPLNSLKIWLEFGHYFALVFPSAPYLSHPLQVSTFCCSKCQAHSTHIRQACLSSHALTCPAAPSLHSHTGAQNPISWEVQRFDGWYNNLMEHRWGSKGSRLQRLVPASYADGVYQPLGEPHLPNPRDLSNTISRGPAGLASLRNRTVLGVFFAPPPALPAGYHVLSDLVSVETPGCPAEFLNIRIPPGDPMFDPDQRGDVVLPFQRSRWDPETGRSPSNPRDPPRTPAGPRPSLARRRPSTRAHPPRAPQANQVTGWLDGSAIYGSSHSWSDALRSFSRGQLASGPDPAFPRDSQNPLLMWAAPDPATGQNGPRGLYGEATGAGRGRLGVCECGLPRSRYRSSPPLRPHALGLLWFRYHNLWAQRLARQHPDWEDEELFQHARKGSSPPTRSAVRAPRRPPFRNIAVYEWLPSFLQKTLPEYTGYRPFLDPSISPEFVVASEQFFSTMVPPGVYMRNASCHFRKVLNKGFQSSQALRVCNNYWIRENPNLNSTQEVNELLLGMASQISELEDNIVVEDLRDYWPGPGKFSRTDYVASSIQRGRDMGLPSYSQALLAFGLDIPRNWSDLNPNVDPQVLEATAALYNQDLSQLELLLGGLLESHGDPGPLFSAIVLDQFVRLRDGDRYWFENTRNGLFSKKEIEDIRNTTLRDVLVAVINIDPSALQPNVFVWHKGAPCPQPKQLTTDGLPQCAPLTVLDFFEGSSPGFAITIIALCCLPLVSLLLSGVVAYFRGREHKKLQKKLKESVKKEAAKDGVPAMEWPGPKERSSPIIIQLLSDRCLQVLNRHLTVLRVVQLQPLQQVNLILSNNRGCRTLLLKIPKEYDLVLLFSSEEERGAFVQQLWDFCVRWALGLHVAEMSEKELFRKAVTKQQRERILEIFFRHLFAQVLDINQADAGTLPLDSSQKVREALTCELSRAEFAESLGLKPQDMFVESMFSLADKDGNGYLSFREFLDILVVFMKGSPEDKSRLMFTMYDLDENGFLSKDEFFTMMRSFIEISNNCLSKAQLAEVVESMFRESGFQDKEELTWEDFHFMLRDHDSELRFTQLCVKGGGGGGNGIRDIFKQNISCRVSFITRTPGER

SEQ ID NO: 917340 - protein, 557 aa, Homo sapiens
LTFMPDKDIGLQGTGVNVDNSDQHVPQGGISDVFNCAPCPQPKQLTTDGLPQCAPLTVLDFFEGSSPGFAITIIALCCLPLVSLLLSGVVAYFRGREHKKLQKKLKESVKKEAAKDGVPAMEWPGPKERSSPIIIQLLSDRCLQVLNRHLTVLRVVQLQPLQQVNLILSNNRGCRTLLLKIPKEYDLVLLFSSEEERGAFVQQLWDFCVRWALGLHVAEMSEKELFRKAVTKQQRERILEIFFRHLFAQVLDINQADAGTLPLDSSQKVREALTCELSRAEFAESLGLKPQDMFVESMFSLADKDGNGYLSFREFLDILVVFMKGSPEDKSRLMFTMYDLDENGFLSKDEFFTMMRSFIEISNNCLSKAQLAEVVESMFRESGFQDKEELTWEDFHFMLRDHDSELRFTQLCVKGGGGGGNGIRDIFKQNISCRVSFITRTPGERSHPQGLGPPAPEAPELGGPGLKKRFGKKAAVPTPRLYTEALQEKMQRGFLAQKLQQYKRFVENYRRHIVCVAIFSAICVGVFADRAYYYGFALPPSDIAQTTLVGIILSRGT

SEQ ID NO: 917341 - protein, 624 aa, Homo sapiens
TSSVQQPDDAAPCCSLSQLELLLGGLLESHGDPGPLFSAIVLDQFVRLRDGDRYWFENTRNGLFSKKEIEDIRNTTLRDVLVAVINIDPSALQPNVFVWHKGAPCPQPKQLTTDGLPQCAPLTVLDFFEGSSPGFAITIIALCCLPLVSLLLSGVVAYFRGREHKKLQKKLKESVKKEAAKDGVPAMEWPGPKERSSPIIIQLLSDRCLQVLNRHLTVLRVVQLQPLQQVNLILSNNRGCRTLLLKIPKEYDLVLLFSSEEERGAFVQQLWDFCVRWALGLHVAEMSEKELFRKAVTKQQRERILEIFFRHLFAQVLDINQADAGTLPLDSSQKVREALTCELSRAEFAESLGLKPQDMFVESMFSLADKDGNGYLSFREFLDILVVFMKGSPEDKSRLMFTMYDLDENGFLSKDEFFTMMRSFIEISNNCLSKAQLAEVVESMFRESGFQDKEELTWEDFHFMLRDHDSELRFTQLCVKGGGGGGNGIRDIFKQNISCRVSFITRTPGERSHPQGLGPPAPEAPELGGPGLKKRFGKKAAVPTPRLYTEALQEKMQRGFLAQKLQQYKRFVENYRRHIVCVAIFSAICVGVFADRAYYYGFALPPSDIAQTTLVGIILSRGTA

SEQ ID NO: 917342 - protein, 169 aa, Homo sapiens
GASSTGLSPRAEAIRAALQVLIFSKNGSVCLMDVAKREIICAFAPPGAFPLEVPWKPVFAVSPDHPCFLLRGDYSHETASTDDAGIQYSVFYFNFEACPLLENISKNCTIPQRDLDNMAFPQALPLEKRCERFLQKSYRKLEKNPEKEEEHWARLQRYSLSLQRENFKK

SEQ ID NO: 917343 - protein, 437 aa, Homo sapiens
SGGSRSFFQTTLGEMIEVPPPGQGRGVQPGISPFWEGQAGGYPEGTTFKSPLEVFAKIKDCYGLGSGQNHFIKDSQWEQQAEIFNASYKKYLDREWEEEPLSTATFYFLLPSCLFAMPPEVKGPSGMACVLGIHWTRSHNFFLYSLNRTLKDKADPEGVWPCAAPIAVSQLSCSSSYLVLACEDGVLTLWDLAKGFPLGVAALPQGCFCQSIHFLKYFSVHKGQNMYPEGQVKSQMKCVVLCTDASLHLVEASGTQGPTISVLVERPVKHLDKTICAVAPVPALPGMVLIFSKNGSVCLMDVAKREIICAFAPPGAFPLEVPWKPVFAVSPDHPCFLLRGDYSHETASTDDAGIQYSVFYFNFEACPLLENISKNCTIPQRDLDNMAFPQALPLEKRCERFLQKSYRKLEKNPEKEEEHWARLQRYSLSLQRENFKK

SEQ ID NO: 917344 - protein, 437 aa, Homo sapiens; identical to SEQ ID NO: 917343

SEQ ID NO: 917345 - protein, 169 aa, Homo sapiens; identical to SEQ ID NO: 917342

SEQ ID NO: 917346 - protein, 159 aa, Homo sapiens
MAFVFQIRMCPPDLHAVQFLGQTNSRLLIGNEQEFLQLLMLPPSRNNEGKSMRTKPRHRRKAAIKVSEKRSRSLIILLILVHTHTHTLPMVSASDNTQLGIGTQPVPYTIQDATVGTGMTSSKVTLSGPEGASEENFSSFLVFPACYFQTRVPFLMFSQ

SEQ ID NO: 917347 - protein, 78 aa, Homo sapiens
TFCTYVAWIVFRRQHLTEIEEEVGRLFRTNMFNIPRRRREDEESGGEKKRMTFVQFRYDLLTFLCSGVFLFFLSFLFF

SEQ ID NO: 917348 - protein, 405 aa, Homo sapiens
MKPELLNSEDEETRLREIKQLNQKSYSQFAAEDSVQWLLKHHPHFTPAAEVKEKGKKGKAVHFAETDGPASDRLTDKRLAAKDDKSAKAVEKRGQQGTITLDDVKFVTLLLLQDTEMQRICSFTTFMRNKNLDNFLMALLYYLSHYLEKNSLEKKPKSYMVGLVEKKEMELVLSELEAAQRYLAQKYCILVLGLAVPDKHHMCCGKEKISDTQKDWKFFESFYTFCTYVAWIVFRRQHLTEIEEEVGRLFRTNMFNIPRRRREDEESGGEKKRMTFVQFRRMMAKRPAIKKAINMRSPVMSTLLPSLREKAQNVFEKKYHQVDVRFPAEMQKHVGTLDSVPMPVVGILGEPRCLFNPHTLHPLDPEENTKSFGRYPSLMENNNMRIQDTLDLVMKTLSSHTSCPK

SEQ ID NO: 917349 - protein, 131 aa, Homo sapiens
MDEARSHHSQQTNTGTENQTPYVLTHKWELNNENIRTQGGEHHTWGPVGAIHLFVSLLLQVSEISAALSPRLLIPTFPLHPGCHPAEMLHSVVGAVGVSEVLLSFLSYGHQSDVRAAEFCLVSSEFIGGTG

SEQ ID NO: 917350 - protein, 173 aa, Homo sapiens
ASTRQWGRSPSAGTMWKTWSRHDLQDAQWFCVITDSKGFRRRPVGSGQDMPSLALGASSALAPTLAVLEEPFSPPLHCGSPFLGWPRPEPAPSACWEVWRERCGLRAALAGQRKFLVGVDSAGPALGEAGRPARKPGAVRGLAPGPAFAVLDFSPGLSCFPAGQGLGPAARHA

SEQ ID NO: 917351 - protein, 140 aa, Homo sapiens
MTIQRQVTILAGTRGSWSKSCAAEEGSEWELWKEEETGSPSELHEASGQERKQESEVSTLGTVARSDDLSKAALGLENLASLDFLGLPGRTGDQSRSDTMTLVKCLLPTYLIHKMGMVPTVEAFCQDDKSHLHKEHVVDT

SEQ ID NO: 917352 - protein, 137 aa, Homo sapiens
MWSVLMELRWVEPSWRTTARAVQREIVGCKPSHRLPTGAVPSGAARKESLSSRPQNGSSTDSLHLAPGKATDTQGLPVKAAGRGGYTLQSHRGRAAKAMGAHLLHQCDLDMRHGVKGNHFGALRFDCCQALNKSHKI

SEQ ID NO: 917353 - protein, 430 aa, Homo sapiens
MINGSQGGMQLACLNKFMGWQTEELYGDFEDLETGDVHKGKSGPDTQRNKEEIDPDKEESAKKKHLDKKRKLKEMFDEEYDEGESTYFDDLKGEMQKQAQLNRTEFEDQDDEARVPYEGFRPGVYVRVEIENVPCEFVQNFDPHYPIILGGLGNSEGNVGDVQVGPFAAYLVPKALWISPPSIILHSHPPQMHLKKHRWYKKILKSRDPIIFSVGWRRFQTIPLYYIEDHNGRQRLLKYTPQHMHCGAAFWEGAFRASFEDKLLMSDIVFMRTWYPVSIPAFYNPVTSLLKPVGEKDTWSGMWTTGQLRLAYGVRLKANKDSLYKKKEKIKNKPKTQAKDRRRLAVMREPHERKILTLLDALSMVHSQKMKKAKEQRHLHNKEHFRAKQKEEEEKLKWQKDLRKKLFQIQGQKERRNQKSSLKGAEGQFQ

SEQ ID NO: 917354 - protein, 430 aa, Homo sapiens; identical to SEQ ID NO: 917353

SEQ ID NO: 917355 - protein, 72 aa, Homo sapiens
RIIWGFALEARIRHEAGPSPLMHHYGNSDILDVTPVIPTALTPGQAPLCIYWSGPWALAENLLRAQCRSCDA

SEQ ID NO: 917356 - protein, 432 aa, Homo sapiens
LLLLVLAIMYVFASHHFRRRSFRGFWLTHHLYILLYALLIIHGSYALIQLPTFHIYFLVPAIIYGGDKLVSLSRKKVEISVVKAELLPSGVTYLQFQRPQGFEYKSGQWVRIACLALGTTEYHPFTLTSAPHEDTLNLHIRAVGPWTTRLRRSTHPQRAMAVLDTQRCPSLGTMLPGFWHWQRISAFPYPESRSSSRPKASLGEDRGASEKTRMFCILPLPVSPFLVSELGQGQAHFISPLSWQLYLDGPFGEGHQEWHKFEVSVLVGGGIGVTPFASILKDLVFKSSLGSQMLCKKIYFIWVTRTQRQFEWLADIIQEVEENDHQDLVSVHIYVTQLAEKFDLRTTMLYICERHFQKVLNRSLFTGLRSITHFGRPPFEPFFNSLQEVHPQVRKIGVFSCGPPGMTKNVEKACQLVNRQDRAHFMHHYENF

SEQ ID NO: 917357 - protein, 157 aa, Homo sapiens
KDLKYFENSEIMHTRNVQLKTKREQDDILQSHARCRHVECEAFLPASPRSRSLPHLPFHLPDCALPVALGLRVQHFCNSFFCKGKVDSCKLDPLLYPANAESPASPLVFKWLYKRGSSTAISNNAIRILLTCATIQIHNSLRTLFRVDHMGAFIKLW

SEQ ID NO: 917358 - protein, 373 aa, Homo sapiens
GRQFFHRRQGMGHRMLMVLPAILPSFVFYVLSPKVTLRNPGSSGRKERPEAGTGSWLGRTRNQVINTLADHRHRGTDFGGSPWLLIITVFLRSYKFAISLCTSYLCVSFLKTIFPSQNGHDGSTDVQQRARRSNRRRQEGIKIVLEDIFTLWRQVETKVRAKIRKMKVTTKVNRHDKINGKRKTAKEHLRKLSMKEREHGEKERQVSEAEENGKLDMKEIHTYMEMFQRAQALRRRAEDYYRCKITPSARKPLCNRVRMAAVEHRHSSGLPYWPYLTAETLKNRMGHQPPPPTQQHSIIDNSLSLKTPSECLLYPLPPSADDNLKTPPECLLTPLPPSALPSADDNLKTPAECLLYPLPPSADDNLKKLTKNK

SEQ ID NO: 917359 - protein, 117 aa, Homo sapiens
MKVTTKVNRHDKINGKRKTAKEHLRKLSMKEREHGEKERQVSEAEENGKLDMKEIHTYMEMFQRAQALRRRAEDYYRCKITPSARKPLCNRDDNLKTPPECVCSLPFHPQRMIISRN

SEQ ID NO: 917360 - protein, 154 aa, Homo sapiens
AGSPSPTPAGQQVLDVDSCLDSSVLDSSFLTFEASTLSEGSTGGPAALAQLGLKTLCTSQQAFAGQMKSDFFLEDSKQVINTLADHRHRGTDFGGSPWLLIITVFLRSYKFAISLCTSYLWVINTLADHRHRGTDFGGSWLIITVFLRSYKFAI

SEQ ID NO: 917361 - protein, 291 aa, Homo sapiens
KHIHIGVYLFHIQFAISLCTSYLCVSFLKTIFPSQNGHDGSTDVQQRARRSNRRRQEGIKIVLEDIFTLWRQVETKVRAKIRKMKVTTKVNRHDKINGKRKTAKEHLRKLSMKEREHGEKERQVSEAEENGKLDMKEIHTYMEMFQRAQALRRRAEDYYRCKITPSARKPLCNRVRMAAVEHRHSSGLPYWPYLTAETLKNRMGHQPPPPTQQHSIIDNSLSLKTPSECLLYPLPPSADDNLKTPPECLLTPLPPSALPSADDNLKTPAECLLYPLPPSADDNLKKLTKNK

SEQ ID NO: 917362 - protein, 228 aa, Homo sapiens
MLLSWRRWLVETKVRAKIRKMKVTTKVNRHDKINGKRKTAKEHLRKLSMKEREHGEKERQVSEAEENGKLDMKEIHTYMEMFQRAQALRRRAEDYYRCKITPSARKPLCNRVRMAAVEHRHSSGLPYWPYLTAETLKNRMGHQPPPPTQQHSIIDNSLSLKTPSECLLYPLPPSADDNLKTPPECLLTPLPPSALPSADDNLKTPAECLLYPLPPSADDNLKKLTKNK

SEQ ID NO: 917363 - protein, 227 aa, Homo sapiens
MKVTTKVNRHDKINGKRKTAKEHLRKLSMKEREHGEKERQVSEAEENGKLDMKEIHTYMEMFQRAQALRRRAEDYYRCKITPSARKPLCNRVRMAAVEHRHSSGLPYWPYLTAETLKNRMGHQPPPPTQQHSIIDNSLSLKTPSECLLTPLPPSALPSADDNLKTPAECLLYPLPPSADDNLKTPPECLLTPLPPSAPPSVDDNLKTPPECVCSLPFHPQRMIISRN

SEQ ID NO: 917364 - protein, 158 aa, Homo sapiens
MKVTTKVNRHDKINGKRKTAKEHLRKLSMKEREHGEKERQVSEAEENGKLDMKEIHTYMEMFQRAQALRRRAEDYYRCKITPSARKPLCNRVRMAAVEHRHSSGLPYWPYLTAETLKNRMGHQPPPPTQQHSIIDNSLSLKTPSECRASALSPSTLSG

SEQ ID NO: 917365 - protein, 158 aa, Homo sapiens; identical to SEQ ID NO: 917364

SEQ ID NO: 917366 - protein, 122 aa, Homo sapiens
MKVTTKVNRHDKINGKRKTAKEQEMFQRAQALRRRAEDYYRCKITPSARKPLCNRVRMAAVEHRHSSGLPYWPYLTAETLKNRMGHQPPPPTQQHSIIDNSLSLKTPSECRASALSPSTLSG

SEQ ID NO: 917367 - protein, 109 aa, Homo sapiens
MKVTTKVNRHDKINGKRKTAKEHLRKLSMKEREHGEKERQVSEAEENGKLDMKEIHTYMEMFQRAQALRRRAEDYYRCKITPSARKPLCNRCTYNLVLPGSEKKYYSHA

SEQ ID NO: 917368 - protein, 130 aa, Homo sapiens
MKEREHGEKERQVSEAEENGKLDMKEIHTYMEMFQRAQALRRRAEDYYRCKITPSARKPLCNRVRMAAVEHRHSSGLPYWPYLTAETLKNRMGHQPPPPTQQHSIIDNSLSLKTPSECRASALSPSTLSG

SEQ ID NO: 917369 - protein, 112 aa, Homo sapiens
AGSPSPTPAGQQVLDVDSCLDSSVLDSSFLTFEASTLSEGSTGGPAALAQLGLKTLCTSQQAFAGQMKSDFFLEDSKSDLEEPWELRKEGAPRSRDRELVGEDQKSGYQYSG

SEQ ID NO: 917370 - protein, 112 aa, Homo sapiens; identical to SEQ ID NO: 917369

SEQ ID NO: 917371 - protein, 107 aa, Homo sapiens
MKEIHTYMEMFQRAQALRRRAEDYYRCKITPSARKPLCNRVRMAAVEHRHSSGLPYWPYLTAETLKNRMGHQPPPPTQQHSIIDNSLSLKTPSECRASALSPSTLSG

SEQ ID NO: 917372 - protein, 208 aa, Homo sapiens
MKVTTKVNRHDKINGKRKTAKEHLRKLSMKEREHGEKERQVSEAEENGKLDMKEIHTYMEMFQRAQALRRRAEDYYRCKITPSARKPLCNRVRMAAVEHRHSSGLPYWPYLTAETLKNRMGHQPPPPTQQHSIIDNSLSLKTPSECLLYPLPPSADDNLKTPPECLLTPLPPSALPSADDNLKTPAECLLYPLPPSADDNLKKLTKNK

SEQ ID NO: 917373 - protein, 208 aa, Homo sapiens; identical to SEQ ID NO: 917372

SEQ ID NO: 917374 - protein, 158 aa, Homo sapiens; identical to SEQ ID NO: 917364

SEQ ID NO: 917375 - protein, 109 aa, Homo sapiens; identical to SEQ ID NO: 917367

SEQ ID NO: 917376 - protein, 153 aa, Homo sapiens
MKVTTKVNRHDKINGKRKTAKEHLRKLSMKEREHGEKERQVSEAEENGKLDMKEIHTYMEMFQRAQALRRRAEDYYRCKITPSARKPLCNRVRMAAVEHRHSSGLPYWPYLTAETLKNRMGHQPPPPTQQHSIIDNSLSLKTPSECLLTPLLS

SEQ ID NO: 917377 - protein, 108 aa, Homo sapiens
MKVTTKVNRHDKINGKRKTAKEQDYYRCKITPSARKPLCNRVRMAAVEHRHSSGLPYWPYLTAETLKNRMGHQPPPPTQQHSIIDNSLSLKTPSECRASALSPSTLSG

SEQ ID NO: 917378 - protein, 107 aa, Homo sapiens; identical to SEQ ID NO: 917371

SEQ ID NO: 917379 - protein, 117 aa, Homo sapiens; identical to SEQ ID NO: 917359

SEQ ID NO: 917380 - protein, 112 aa, Homo sapiens; identical to SEQ ID NO: 917369

SEQ ID NO: 917381 - protein, 154 aa, Homo sapiens
RCLSQESYRRHRHMWIWFRRCDLALEPEPDEMMKEALGSLGSHSPQMAEAPDMPVTSFQMIPATLLHEGPRVTTAPVISVDTQSLRGIIWAANLTWRPESRNSGNGTLPAFSGRVLVAPSDPGLLLVYVAPGENASYLWRSCSNLYLSPRQCPL

SEQ ID NO: 917382 - protein, 168 aa, Homo sapiens
MWSKVETYEPCDGHLEREKGRRLEIGLFTLSAKAADKALDATGPGWGLRHCCASQIPGDVGVAGVPGTHGLCHTSQYHQTLARVYTSSETGITSSCLKRDTQATLLCLPTKLLSPRSSRHLLELSVKSTTGKAFLHRATSVQCPSRLSQCCVSACVPKQHPWYHMDRL

SEQ ID NO: 917383 - protein, 160 aa, Homo sapiens
LSLLSPELMVPVAGRPLCRSSSMELLLLLPLHIPREQMLLAGAMAKLLRASWVVSVKSLLPVGCWSQRSELGWVGSMGHGCSSGILQMLSGWHPLAEVTLRGGDRGASPPGVTGCRKEEHTSQYKATPTATWAQKACQNQGCCSRSCYIHSAEKTHSSVD

SEQ ID NO: 917384 - protein, 170 aa, Homo sapiens
FHFFCDSSVTSGHLGVYMQDLLPWEKGWGQSWPTTATGTNLPLCCQSSRLKARLEGRSLCTSDYDPSIIYLSIYLSIYLSFIYLSSIYYLSSIYLSSIYYLSSVYHLSIYLSIYLSIYLSIYLSVFTAINTMTASHSNTLDPGVKSSSSTNQLCNLEQVLIFSTSHFSLL

SEQ ID NO: 917385 - protein, 644 aa, Homo sapiens
HLSSASVMLGAADWSSVTHAGDVCKCLCGLRSKAQVCSRSAGLGVYLPGAGLSQLSLSAGKYTDLKITIPRPSVASTQSTSGSFHCGQQPEKKDLQPMEPTVELYSPRENFSGLVVTEGEPPSGGSRTDLGLQIDHIGHDMLPNIRESNKSQDLGPKELPDHNRLVVREFENLPGETEEKSILLESDNEDEKLSRGQHCIEISSLPGDLVIVEKDHSATTEPLDVTKTQTFSVVPNQDKNNEIMKLLTVGTSEISSRDIDPHVEGQIGQVAEMQKNKISKDDDIMSEDLPGHQGDLSTFLHQEGKREKITPRNGELFHCVSENEHGAPTRKDMVRSSFVTRHSRIPVLAQEIDSTLESSSPVSAKEKLLQKKAYQPDLVKLLVEKRQFKSFLGDLSSASDKLLEEKLATVPAPFCEEEVLTPFSRLTVDSHLSRSAEDSFLSPIISQSRKSKIPRPVSWVNTDQVNSSTSSQFFPRPPPGKPPTRPGVEARLRRYKVLGSSNSDSDLFSRLAQILQNGSQKPRSTTQCKSPGSPHNPKTPPKSPVVPRRSPSASPRSSSLPRTSSSSPSRAGRPHHDQRSSSPHLGRSKSPPSHSGSSSSRRSCQQEHCKPSKNGLKGSGSLHHHSASTKTPQGKSKPASKLSR

SEQ ID NO: 917386 - protein, 584 aa, Homo sapiens
FIGTSLFIATSLFIGTSLFIGTSLFIGTQPEKKDLQPMEPTVELYSPRENFSGLVVTEGEPPSGGSRTDLGLQIDHIGHDMLPNIRESNKSQDLGPKELPDHNRLVVREFENLPGETEEKSILLESDNEDEKLSRGQHCIEISSLPGDLVIVEKDHSATTEPLDVTKTQTFSVVPNQDKNNEIMKLLTVGTSEISSRDIDPHVEGQIGQVAEMQKNKISKDDDIMSEDLPGHQGDLSTFLHQEGKREKITPRNGELFHCVSENEHGAPTRKDMVRSSFVTRHSRIPVLAQEIDSTLESSSPVSAKEKLLQKKAYQPDLVKLLVEKRQFKSFLGDLSSASDKLLEEKLATVPAPFCEEEVLTPFSRLTVDSHLSRSAEDSFLSPIISQSRKSKIPRPVSWVNTDQVNSSTSSQFFPRPPPGKPPTRPGVEARLRRYKVLGSSNSDSDLFSRLAQILQNGSQKPRSTTQCKSPGSPHNPKTPPKSPVVPRRSPSASPRSSSLPRTSSSSPSRAGRPHHDQRSSSPHLGRSKSPPSHSGSSSSRRSCQQEHCKPSKNGLKGSGSLHHHSASTKTPQGKSKPASKLSR

SEQ ID NO: 917387 - protein, 667 aa, Homo sapiens
PSDEEPEVLQVLEASPQDEKLQLGPWAENDHLKKETSGVVLALSAEGPPTAASEQYTDRLELQPGAASQFIAATPTSLMEAQAEGPLTAITIPRPSVASTQSTSGSFHCGQQPEKKDLQPMEPTVELYSPRENFSGLVVTEGEPPSGGSRTDLGLQIDHIGHDMLPNIRESNKSQDLGPKELPDHNRLVVREFENLPGETEEKSILLESDNEDEKLSRGQHCIEISSLPGDLVIVEKDHSATTEPLDVTKTQTFSVVPNQDKNNEIMKLLTVGTSEISSRDIDPHVEGQIGQVAEMQKNKISKDDDIMSEDLPGHQGDLSTFLHQEGKREKITPRNGELFHCVSENEHGAPTRKDMVRSSFVTRHSRIPVLAQEIDSTLESSSPVSAKEKLLQKKAYQPDLVKLLVEKRQFKSFLGDLSSASDKLLEEKLATVPAPFCEEEVLTPFSRLTVDSHLSRSAEDSFLSPIISQSRKSKIPRPVSWVNTDQVNSSTSSQFFPRPPPGKPPTRPGVEARLRRYKVLGSSNSDSDLFSRLAQILQNGSQKPRSTTQCKSPGSPHNPKTPPKSPVVPRRSPSASPRSSSLPRTSSSSPSRAGRPHHDQRSSSPHLGRSKSPPSHSGSSSSRRSCQQEHCKPSKNGLKGSGSLHHHSASTKTPQGKSKPASKLSR

SEQ ID NO: 917388 - protein, 150 aa, Homo sapiens
MTASPGEEENHLSQEKWLYTYFNLKSSGLHLSPVLDASCPQTSDSEFFSFWTPGLTPVVCQGLSGHWPHNEGCTVGFPTSEVLGLRLIHYWLSRSSTCRQPIVGFYLVTMLGTGGGIPLQKTKTNNASENFRMVDRDLKERRHMTPKDIC

SEQ ID NO: 917389 - protein, 115 aa, Homo sapiens
MGKRYIARNQEGLGPIVHDRKSQTLPVSRNRTGMMHARLQQLGSLDNSLTFNHSYGHSDADVLHQSLLEANIATEVCLTALDTLSLFTLAFKNQLLGGYQTRRMRKCSISWDWAI

SEQ ID NO: 917390 - protein, 1658 aa, Homo sapiens
IKYNRKISADFHVDLNHFSVRQMLATTSPALMNGSGQSPSVLKGILHEAAMQYPKQGIFSVTCPHPDIFLVARIEKVLQGSITHCAEPYMKSSDSSKVAQKVLKNAKQACQRLGQYRMPFAWAARTLFKDASGNLDKNARFSAIYRQDSNKLSNDDMLKLLADFRKPEKMAKLPVILGNLDITIDNVSSDFPNYVNSSYIPTKQFETCSKTPITFEVEEFVPCIPKHTQPYTIYTNHLYVYPKYLKYDSQKSFAKARNIAICIEFKDSDEEDSQPLKCIYGRPGGPVFTRSAFAAVLHHHQNPEFYDEIKIELPTQLHEKHHLLLTFFHVSCDNSSKGSTKKRDVVETQVGYSWLPLLKDGRVVTSEQHIPVSANLPSGYLGYQELGMGRHYGPEIKWVDGGKPLLKISTHLVSTVYTQDQHLHNFFQYCQKTESGAQALGNELVKYLKSLHAMEGHVMIAFLPTILNQLFRVLTRATQEEVAVNVTRVIIHVVAQCHEEGLESHLRSYVKYAYKAEPYVASEYKTVHEELTKSMTTILKPSADFLTSNKLLKYSWFFFDVLIKSMAQHLIENSKVKLLRNQRFPASYHHAVETVVNMLMPHITQKFRDNPEASKNANHSLAVFIKRCFTFMDRGFVFKQINNYISCFAPGDPKTLFEYKFEFLRVVCNHEHYIPLNLPMPFGKGRIQRYQDLQLDYSLTDEFCRNHFLVGLLLREVGTALQEFREVRLIAISVLKNLLIKHSFDDRYASRSHQARIATLYLPLFGLLIENVQRINVRDVSPFPVNAGMTVKDESLALPAVNPLVTPQKGSTLDNSLHKDLLGAISGIASPYTTSTPNINSVRNADSRGSLISTDSGNSLPERNSEKSNSLDKHQQSSTLGNSVVRCDKLDQSEIKSLLMCFLYILKSMSDDALFTYWNKASTSELMDFFTISEVCLHQFQYMGKRYIASVRKISSVLGISVDNGYGHSDADVLHQSLLEANIATEVCLTALDTLSLFTLAFKNQLLADHGHNPLMKKVFDVYLCFLQKHQSETALKNVFTALRSLIYKFPSTFYEGRADMCAALCYEILKCCNSKLSSIRTEASQLLYFLMRNNFDYTGKKSFVRTHLQVIISVSQLIADVVGIGGTRFQQSLSIINNCANSDRLIKHTSFSSDVKDLTKRIRTVLMATAQMKEHENDPEMLVDLQYSLAKSYASTPELRKTWLDSMARIHVKNGDLSEAAMCYVHVTALVAEYLTRKGVFRQGCTAFRVITPNIDEEASMMEDVGMQDVHFNEDVLMELLEQCADGLWKAERYELIADIYKLIIPIYEKRRDFERLAHLYDTLHRAYSKVTEVMHSGRRLLGTYFRVAFFGQGFFEDEDGKEYIYKEPKLTPLSEISQRLLKLYSDKFGSENVKMIQDSGKVNPKDLDSKYAYIQVTHVIPFFDEKELQERKTEFERSHNIRRFMFEMPFTQTGKRQGGVEEQCKRRTILTAIHCFPYVKKRIPVMYQHHTDLNPIEVAIDEMSKKVAELRQLCSSAEVDMIKLQLKLQGSVSVQVNAGPLAYARAFLDDTNTKRYPDNKVKLLKEVFRQFVEACGQALAVNERLIKEDQLEYQEEMKANYREMAKELSEIMHEREICPLEEKTSVLPNSLHIFNAISGTPTSTMVHGMTSSSSVV

SEQ ID NO: 917391 - protein, 1681 aa, Homo sapiens
IKYNRKISADFHVDLNHFSVRQMLATTSPALMNGSGQSPSVLKGILHEAAMQYPKQGIFSVTCPHPDIFLVARIEKVLQGSITHCAEPYMKSSDSSKVAQKVLKNAKQACQRLGQYRMPFAWAARTLFKDASGNLDKNARFSAIYRQDSNKLSNDDMLKLLADFRKPEKMAKLPVILGNLDITIDNVSSDFPNYVNSSYIPTKQFETCSKTPITFEVEEFVPCIPKHTQPYTIYTNHLYVYPKYLKYDSQKSFAKARNIAICIEFKDSDEEDSQPLKCIYGRPGGPVFTRSAFAAVLHHHQNPEFYDEIKIELPTQLHEKHHLLLTFFHVSCDNSSKGSTKKRDVVETQVGYSWLPLLKDGRVVTSEQHIPVSANLPSGYLGYQELGMGRHYGPEIKWVDGGKPLLKISTHLVSTVYTQDQHLHNFFQYCQKTESGAQALGNELVKYLKSLHAMEGHVMIAFLPTILNQLFRVLTRATQEEVAVNVTRVIIHVVAQCHEEGLESHLRSYVKYAYKAEPYVASEYKTVHEELTKSMTTILKPSADFLTSNKLLKYSWFFFDVLIKSMAQHLIENSKVKLLRNQRFPASYHHAVETVVNMLMPHITQKFRDNPEASKNANHSLAVFIKRCFTFMDRGFVFKQINNYISCFAPGDPKTLFEYKFEFLRVVCNHEHYIPLNLPMPFGKGRIQRYQDLQLDYSLTDEFCRNHFLVGLLLREVGTALQEFREVRLIAISVLKNLLIKHSFDDRYASRSHQARIATLYLPLFGLLIENVQRINVRDVSPFPVNAGMTVKDESLALPAVNPLVTPQKGSTLDNSLHKDLLGAISGIASPYTTSTPNINSVRNADSRGSLISTDSGNSLPERNSEKSNSLDKHQQSSTLGNSVVRCDKLDQSEIKSLLMCFLYILKSMSDDALFTYWNKASTSELMDFFTISEVCLHQFQYMGKRYIASVRKISSVLGISVDNGYGHSDADVLHQSLLEANIATEVCLTALDTLSLFTLAFKNQLLADHGHNPLMKKVFDVYLCFLQKHQSETALKNVFTALRSLIYKFPSTFYEGRADMCAALCYEILKCCNSKLSSIRTEASQLLYFLMRNNFDYTGKKSFVRTHLQVIISVSQLIADVVGIGGTRFQQSLSIINNCANSDRLIKHTSFSSDVKDLTKRIRTVLMATAQMKEHENDPEMLVDLQYSLAKSYASTPELRKTWLDSMARIHVKNGDLSEAAMCYVHVTALVAEYLTRKEAVQWEPPLLPHSHSACLRRSRGGVFRQGCTAFRVITPNIDEEASMMEDVGMQDVHFNEDVLMELLEQCADGLWKAERYELIADIYKLIIPIYEKRRDFERLAHLYDTLHRAYSKVTEVMHSGRRLLGTYFRVAFFGQGFFEDEDGKEYIYKEPKLTPLSEISQRLLKLYSDKFGSENVKMIQDSGKVNPKDLDSKYAYIQVTHVIPFFDEKELQERKTEFERSHNIRRFMFEMPFTQTGKRQGGVEEQCKRRTILTAIHCFPYVKKRIPVMYQHHTDLNPIEVAIDEMSKKVAELRQLCSSAEVDMIKLQLKLQGSVSVQVNAGPLAYARAFLDDTNTKRYPDNKVKLLKEVFRQFVEACGQALAVNERLIKEDQLEYQEEMKANYREMAKELSEIMHEREICPLEEKTSVLPNSLHIFNAISGTPTSTMVHGMTSSSSVV

SEQ ID NO: 917392 - protein, 1693 aa, Homo sapiens
IKYNRKISADFHVDLNHFSVRQMLATTSPALMNGSGQSPSVLKGILHEAAMQYPKQGIFSVTCPHPDIFLVARIEKVLQGSITHCAEPYMKSSDSSKVAQKVLKNAKQACQRLGQYRMPFAWAARTLFKDASGNLDKNARFSAIYRQDSNKLSNDDMLKLLADFRKPEKMAKLPVILGNLDITIDNVSSDFPNYVNSSYIPTKQFETCSKTPITFEVEEFVPCIPKHTQPYTIYTNHLYVYPKYLKYDSQKSFAKARNIAICIEFKDSDEEDSQPLKCIYGRPGGPVFTRSAFAAVLHHHQNPEFYDEIKIELPTQLHEKHHLLLTFFHVSCDNSSKGSTKKRDVVETQVGYSWLPLLKDGRVVTSEQHIPVSANLPSGYLGYQELGMGRHYGPEIKWVDGGKPLLKISTHLVSTVYTQDQHLHNFFQYCQKTESGAQALGNELVKYLKSLHAMEGHVMIAFLPTILNQLFRVLTRATQEEVAVNVTRVIIHVVAQCHEEGLESHLRSYVKYAYKAEPYVASEYKTVHEELTKSMTTILKPSADFLTSNKLLKYSWFFFDVLIKSMAQHLIENSKVKLLRNQRFPASYHHAVETVVNMLMPHITQKFRDNPEASKNANHSLAVFIKRCFTFMDRGFVFKQINNYISCFAPGDPKTLFEYKFEFLRVVCNHEHYIPLNLPMPFGKGRIQRYQDLQLDYSLTDEFCRNHFLVGLLLREVGTALQEFREVRLIAISVLKNLLIKHSFDDRYASRSHQARIATLYLPLFGLLIENVQRINVRDVSPFPVNAGMTVKDESLALPAVNPLVTPQKGSTLDNSLHKDLLGAISGIASPYTTSTPNINSVRNADSRGSLISTDSGNSLPERNSEKSNSLDKHQQSSTLGNSVVRCDKLDQSEIKSLLMCFLYILKSMSDDALFTYWNKASTSELMDFFTISEVCLHQFQYMGKRYIASVRKISSVLGISVDNGYGHSDADVLHQSLLEANIATEVCLTALDTLSLFTLAFKNQLLADHGHNPLMKKVFDVYLCFLQKHQSETALKNVFTALRSLIYKFPSTFYEGRADMCAALCYEILKCCNSKLSSIRTEASQLLYFLMRNNFDYTGKKSFVRTHLQVIISVSQLIADVVGIGGTRFQQSLSIINNCANSDRLIKHTSFSSDVKDLTKRIRTVLMATAQMKEHENDPEMLVDLQYSLAKSYASTPELRKTWLDSMARIHVKNGDLSEAAMCYVHVTALVAEYLTRKDLLSGDAFPHVLEAVQWEPPLLPHSHSACLRRSRGGVFRQGCTAFRVITPNIDEEASMMEDVGMQDVHFNEDVLMELLEQCADGLWKAERYELIADIYKLIIPIYEKRRDFERLAHLYDTLHRAYSKVTEVMHSGRRLLGTYFRVAFFGQGFFEDEDGKEYIYKEPKLTPLSEISQRLLKLYSDKFGSENVKMIQDSGKVNPKDLDSKYAYIQVTHVIPFFDEKELQERKTEFERSHNIRRFMFEMPFTQTGKRQGGVEEQCKRRTILTAIHCFPYVKKRIPVMYQHHTDLNPIEVAIDEMSKKVAELRQLCSSAEVDMIKLQLKLQGSVSVQVNAGPLAYARAFLDDTNTKRYPDNKVKLLKEVFRQFVEACGQALAVNERLIKEDQLEYQEEMKANYREMAKELSEIMHEREICPLEEKTSVLPNSLHIFNAISGTPTSTMVHGMTSSSSVV

SEQ ID NO: 917393 - protein, 740 aa, Homo sapiens
MDFFTISEVCLHQFQYMGKRYIARTGMMHARLQQLGSLDNSLTFNHSYGHSDADVLHQSLLEANIATEVCLTALDTLSLFTLAFKNQLLADHGHNPLMKKVFDVYLCFLQKHQSETALKNVFTALRSLIYKFPSTFYEGRADMCAALCYEILKCCNSKLSSIRTEASQLLYFLMRNNFDYTGKKSFVRTHLQVIISVSQLIADVVGIGGTRFQQSLSIINNCANSDRLIKHTSFSSDVKDLTKRIRTVLMATAQMKEHENDPEMLVDLQYSLAKSYASTPELRKTWLDSMARIHVKNGDLSEAAMCYVHVTALVAEYLTRKGVFRQGCTAFRVITPNIDEEASMMEDVGMQDVHFNEDVLMELLEQCADGLWKAERYELIADIYKLIIPIYEKRRDFERLAHLYDTLHRAYSKVTEVMHSGRRLLGTYFRVAFFGQGFFEDEDGKEYIYKEPKLTPLSEISQRLLKLYSDKFGSENVKMIQDSGKVNPKDLDSKYAYIQVTHVIPFFDEKELQERKTEFERSHNIRRFMFEMPFTQTGKRQGGVEEQCKRRTILTAIHCFPYVKKRIPVMYQHHTDLNPIEVAIDEMSKKVAELRQLCSSAEVDMIKLQLKLQGSVSVQVNAGPLAYARAFLDDTNTKRYPDNKVKLLKEVFRQFVEACGQALAVNERLIKEDQLEYQEEMKANYREMAKELSEIMHEREICPLEEKTSVLPNSLHIFNAISGTPTSTMVHGMTSSSSVV

SEQ ID NO: 917394 - protein, 545 aa, Homo sapiens
DEDAVFADVVGIGGTRFQQSLSIINNCANSDRLIKHTSFSSDVKDLTKRIRTVLMATAQMKEHENDPEMLVDLQYSLAKSYASTPELRKTWLDSMARIHVKNGDLSEAAMCYVHVTALVAEYLTRKGVFRQGCTAFRVITPNIDEEASMMEDVGMQDVHFNEDVLMELLEQCADGLWKAERYELIADIYKLIIPIYEKRRDFERLAHLYDTLHRAYSKVTEVMHSGRRLLGTYFRVAFFGQGFFEDEDGKEYIYKEPKLTPLSEISQRLLKLYSDKFGSENVKMIQDSGKVNPKDLDSKYAYIQVTHVIPFFDEKELQERKTEFERSHNIRRFMFEMPFTQTGKRQGGVEEQCKRRTILTAIHCFPYVKKRIPVMYQHHTDLNPIEVAIDEMSKKVAELRQLCSSAEVDMIKLQLKLQGSVSVQVNAGPLAYARAFLDDTNTKRYPDNKVKLLKEVFRQFVEACGQALAVNERLIKEDQLEYQEEMKANYREMAKELSEIMHEREICPLEEKTSVLPNSLHIFNAISGTPTSTMVHGMTSSSSVV

SEQ ID NO: 917395 - protein, 1246 aa, Homo sapiens
IKYNRKISADFHVDLNHFSVRQMLATTSPALMNGSGQSPSVLKGILHEAAMQYPKQGIFSVTCPHPDIFLVARIEKVLQGSITHCAEPYMKSSDSSKVAQKVLKNAKQACQRLGQYRMPFAWAARTLFKDASGNLDKNARFSAIYRQDSNKLSNDDMLKLLADFRKPEKMAKLPVILGNLDITIDNVSSDFPNYVNSSYIPTKQFETCSKTPITFEVEEFVPCIPKHTQPYTIYTNHLYVYPKYLKYDSQKSFAKARNIAICIEFKDSDEEDSQPLKCIYGRPGGPVFTRSAFAAVLHHHQNPEFYDEIKIELPTQLHEKHHLLLTFFHVSCDNSSKGSTKKRDVVETQVGYSWLPLLKDGRVVTSEQHIPVSANLPSGYLGYQELGMGRHYGPEIKWVDGGKPLLKISTHLVSTVYTQDQHLHNFFQYCQKTESGAQALGNELVKYLKSLHAMEGHVMIAFLPTILNQLFRVLTRATQEEVAVNVTRVIIHVVAQCHEEGLESHLRSYVKYAYKAEPYVASEYKTVHEELTKSMTTILKPSADFLTSNKLLKYSWFFFDVLIKSMAQHLIENSKVKLLRNQRFPASYHHAVETVVNMLMPHITQKFRDNPEASKNANHSLAVFIKRCFTFMDRGFVFKQINNYISCFAPGDPKTLFEYKFEFLRVVCNHEHYIPLNLPMPFGKGRIQRYQDLQLDYSLTDEFCRNHFLVGLLLREVGTALQEFREVRLIAISVLKNLLIKHSFDDRYASRSHQARIATLYLPLFGLLIENVQRINVRDVSPFPVNAGMTVKDESLALPAVNPLVTPQKGSTLDNSLHKDLLGAISGIASPYTTSTPNINSVRNADSRGSLISTDSGNSLPERNSEKSNSLDKHQQSSTLGNSVVRCDKLDQSEIKSLLMCFLYILKSMSDDALFTYWNKASTSELMDFFTISEVCLHQFQYMGKRYIASVRKISSVLGISVDNGYGHSDADVLHQSLLEANIATEVCLTALDTLSLFTLAFKNQLLADHGHNPLMKKVFDVYLCFLQKHQSETALKNVFTALRSLIYKFPSTFYEGRADMCAALCYEILKCCNSKLSSIRTEASQLLYFLMRNNFDYTGKKSFVRTHLQVIISVSQLIADVVGIGGTRFQQSLSIINNCANSDRLIKHTSFSSDVKDLTKRIRTVLMATAQMKEHENDPEMLVDLQYSLAKSYASTPELRKTWLDSMARIHVKNGDLSEAAMCYVHVTALVAEYLTRKEAVVKSQ

SEQ ID NO: 917396 - protein, 849 aa, Homo sapiens
IKYNRKISADFHVDLNHFSVRQMLATTSPALMNGSGQSPSVLKGILHEAAMQYPKQGIFSVTCPHPDIFLVARIEKVLQGSITHCAEPYMKSSDSSKVAQKVLKNAKQACQRLGQYRMPFAWAARTLFKDASGNLDKNARFSAIYRQDSNKLSNDDMLKLLADFRKPEKMAKLPVILGNLDITIDNVSSDFPNYVNSSYIPTKQFETCSKTPITFEVEEFVPCIPKHTQPYTIYTNHLYVYPKYLKYDSQKSFAKARNIAICIEFKDSDEEDSQPLKCIYGRPGGPVFTRSAFAAVLHHHQNPEFYDEIKIELPTQLHEKHHLLLTFFHVSCDNSSKGSTKKRDVVETQVGYSWLPLLKDGRVVTSEQHIPVSANLPSGYLGYQELGMGRHYGPEIKWVDGGKPLLKISTHLVSTVYTQDQHLHNFFQYCQKTESGAQALGNELVKYLKSLHAMEGHVMIAFLPTILNQLFRVLTRATQEEVAVNVTRVIIHVVAQCHEEGLESHLRSYVKYAYKAEPYVASEYKTVHEELTKSMTTILKPSADFLTSNKLLKYSWFFFDVLIKSMAQHLIENSKVKLLRNQRFPASYHHAVETVVNMLMPHITQKFRDNPEASKNANHSLAVFIKRCFTFMDRGFVFKQINNYISCFAPGDPKTLFEYKFEFLRVVCNHEHYIPLNLPMPFGKGRIQRYQDLQLDYSLTDEFCRNHFLVGLLLREVGTALQEFREVRLIAISVLKNLLIKHSFDDRYASRSHQARIATLYLPLFGLLIENVQRINVRDVSPFPVNAGMTVKDESLALPAVNPLVTPQKGSTLDNSLHKDLLGAISGIGNAPCSCGLLSTITLKVSWSQ

SEQ ID NO: 917397 - protein, 384 aa, Homo sapiens
QKGMLQCSAAHGKRSSSRTWQGVEVGLAEKSLSVSASSSPSLYQLLRNQRFPASYHHAVETVVNMLMPHITQKFRDNPEASKNANHSLAVFIKRCFTFMDRGFVFKQINNYISCFAPGDPKEFREVRLIAISVLKNLLIKHSFDDRYASRSHQARIATLYLPLFGLLIENVQRINVRDVSPFPVNAGMSGVQKSKIKVSVGLVPTGGSWAMLLSQLLMLQATFGALWLVVASRQSLPLSSLGVRSPWCLLEVRLDIRDAKTVKDESLALPAVNPLVTPQKGSTLDNSLHKDLLGAISGIASPYTTSTPNINSVRNADSRGSLISTDSGNSLPERNSEKSNSLDKHQQSSTLGNSVVRCDKLDQSEIKSLLMCFLYILKSMSDDK

SEQ ID NO: 917398 - protein, 1702 aa, Homo sapiens
IKYNRKISADFHVDLNHFSVRQMLATTSPALMNGSGQSPSVLKGILHEAAMQYPKQGIFSVTCPHPDIFLVARIEKVLQGSITHCAEPYMKSSDSSKVAQKVLKNAKQACQRLGQYRMPFAWAARTLFKDASGNLDKNARFSAIYRQDSNKLSNDDMLKLLADFRKPEKMAKLPVILGNLDITIDNVSSDFPNYVNSSYIPTKQFETCSKTPITFEVEEFVPCIPKHTQPYTIYTNHLYVYPKYLKYDSQKSFAKARNIAICIEFKDSDEEDSQPLKCIYGRPGGPVFTRSAFAAVLHHHQNPEFYDEIKIELPTQLHEKHHLLLTFFHVSCDNSSKGSTKKRDVVETQVGYSWLPLLKDGRVVTSEQHIPVSANLPSGYLGYQELGMGRHYGPEIKWVDGGKPLLKISTHLVSTVYTQDQHLHNFFQYCQKTESGAQALGNELVKYLKSLHAMEGHVMIAFLPTILNQLFRVLTRATQEEVAVNVTRVIIHVVAQCHEEGLESHLRSYVKYAYKAEPYVASEYKTVHEELTKSMTTILKPSADFLTSNKLLKYSWFFFDVLIKSMAQHLIENSKVKLLRNQRFPASYHHAVETVVNMLMPHITQKFRDNPEASKNANHSLAVFIKRCFTFMDRGFVFKQINNYISCFAPGDPKTLFEYKFEFLRVVCNHEHYIPLNLPMPFGKGRIQRYQDLQLDYSLTDEFCRNHFLVGLLLREVGTALQEFREVRLIAISVLKNLLIKHSFDDRYASRSHQARIATLYLPLFGLLIENVQRINVRDVSPFPVNAGMTVKDESLALPAVNPLVTPQKGSTLDNSLHKDLLGAISGIASPYTTSTPNINSVRNADSRGSLISTDSGNSLPERNSEKSNSLDKHQQSSTLGNSVVRCDKLDQSEIKSLLMCFLYILKSMSDDALFTYWNKASTSELMDFFTISEVCLHQFQYMGKRYIARTGMMHARLQQLGSLDNSLTFNHSYGHSDADVLHQSLLEANIATEVCLTALDTLSLFTLAFKNQLLADHGHNPLMKKVFDVYLCFLQKHQSETALKNVFTALRSLIYKFPSTFYEGRADMCAALCYEILKCCNSKLSSIRTEASQLLYFLMRNNFDYTGKKSFVRTHLQVIISVSQLIADVVGIGGTRFQQSLSIINNCANSDRLIKHTSFSSDVKDLTKRIRTVLMATAQMKEHENDPEMLVDLQYSLAKSYASTPELRKTWLDSMARIHVKNGDLSEAAMCYVHVTALVAEYLTRKEAVQWEPPLLPHSHSACLRRSRGGVFRQGCTAFRVITPNIDEEASMMEDVGMQDVHFNEDVLMELLEQCADGLWKAERYELIADIYKLIIPIYEKRRDFERLAHLYDTLHRAYSKVTEVMHSGRRLLGTYFRVAFFGQGNYQFTDSETDVEGFFEDEDGKEYIYKEPKLTPLSEISQRLLKLYSDKFGSENVKMIQDSGKVNPKDLDSKYAYIQVTHVIPFFDEKELQERKTEFERSHNIRRFMFEMPFTQTGKRQGGVEEQCKRRTILTAIHCFPYVKKRIPVMYQHHTDLNPIEVAIDEMSKKVAELRQLCSSAEVDMIKLQLKLQGSVSVQVNAGPLAYARAFLDDTNTKRYPDNKVKLLKEVFRQFVEACGQALAVNERLIKEDQLEYQEEMKANYREMAKELSEIMHEREICPLEEKTSVLPNSLHIFNAISGTPTSTMVHGMTSSSSVV

SEQ ID NO: 917399 - protein, 1586 aa, Homo sapiens
IKYNRKISADFHVDLNHFSVRQMLATTSPALMNGSGQSPSVLKGILHEAAMQYPKQGIFSVTCPHPDIFLVARIEKVLQGSITHCAEPYMKSSDSSKVAQKVLKNAKQACQRLGQYRMPFAWAARTLFKDASGNLDKNARFSAIYRQDSNKLSNDDMLKLLADFRKPEKMAKLPVILGNLDITIDNVSSDFPNYVNSSYIPTKQFETCSKTPITFEVEEFVPCIPKHTQPYTIYTNHLYVYPKYLKYDSQKSFAKARNIAICIEFKDSDEEDSQPLKCIYGRPGGPVFTRSAFAAVLHHHQNPEFYDEIKIELPTQLHEKHHLLLTFFHVSCDNSSKGSTKKRDVVETQVGYSWLPLLKDGRVVTSEQHIPVSANLPSGYLGYQELGMGRHYGPEIKWVDGGKPLLKISTHLVSTVYTQDQHLHNFFQYCQKTESGAQALGNELVKYLKSLHAMEGHVMIAFLPTILNQLFRVLTRATQEEVAVNVTRVIIHVVAQCHEEGLESHLRSYVKYAYKAEPYVASEYKTVHEELTKSMTTILKPSADFLTSNKLLKYSWFFFDVLIKSMAQHLIENSKVKLLRNQRFPASYHHAVETVVNMLMPHITQKFRDNPEASKNANHSLAVFIKRCFTFMDRGFVFKQINNYISCFAPGDPKTLFEYKFEFLRVVCNHEHYIPLNLPMPFGKGRIQRYQDLQLDYSLTDEFCRNHFLVGLLLREVGTALQEFREVRLIAISVLKNLLIKHSFDDRYASRSHQARIATLYLPLFGLLIENVQRINVRDVSPFPVNAGMTVKDESLALPAVNPLVTPQKGSTLDNSLHKDLLGAISGIASPYTTSTPNINSVRNADSRGSLISTDSGNSLPERNSEKSNSLDKHQQSSTLGNSVVRCDKLDQSEIKSLLMCFLYILKSMSDDALFTYWNKASTSELMDFFTISEVCLHQFQYMGKRYIASVRKISSVLGISVDNGYGHSDADVLHQSLLEANIATEVCLTALDTLSLFTLAFKNQLLADHGHNPLMKKVFDVYLCFLQKHQSETALKNVFTALRSLIYKFPSTFYEGRADMCAALCYEILKCCNSKLSSIRTEASQLLYFLMRNNFDYTGKKSFVRTHLQVIISVSQLIADVVGIGGTRFQQSLSIINNCANSDRLIKAAMCYVHVTALVAEYLTRKGVFRQGCTAFRVITPNIDEEASMMEDVGMQDVHFNEDVLMELLEQCADGLWKAERYELIADIYKLIIPIYEKRRDFERLAHLYDTLHRAYSKVTEVMHSGRRLLGTYFRVAFFGQGFFEDEDGKEYIYKEPKLTPLSEISQRLLKLYSDKFGSENVKMIQDSGKVNPKDLDSKYAYIQVTHVIPFFDEKELQERKTEFERSHNIRRFMFEMPFTQTGKRQGGVEEQCKRRTILTAIHCFPYVKKRIPVMYQHHTDLNPIEVAIDEMSKKVAELRQLCSSAEVDMIKLQLKLQGSVSVQVNAGPLAYARAFLDDTNTKRYPDNKVKLLKEVFRQFVEACGQALAVNERLIKEDQLEYQEEMKANYREMAKELSEIMHEREICPLEEKTSVLPNSLHIFNAISGTPTSTMVHGMTSSSSVV

SEQ ID NO: 917400 - protein, 1004 aa, Homo sapiens
LTNAIWKVQRNIMFMVAHYIPLNLPMPFGKGRIQRYQDLQLDYSLTDEFCRNHFLVGLLLREVGTALQEFREVRLIAISVLKNLLIKHSFDDRYASRSHQARIATLYLPLFGLLIENVQRINVRDVSPFPVNAGMTVKDESLALPAVNPLVTPQKGSTLDNSLHKDLLGAISGIASPYTTSTPNINSVRNADSRGSLISTDSGNSLPERNSEKSNSLDKHQQSSTLGNSVVRCDKLDQSEIKSLLMCFLYILKSMSDDALFTYWNKASTSELMDFFTISEVCLHQFQYMGKRYIASVRKISSVLGISVDNGYGHSDADVLHQSLLEANIATEVCLTALDTLSLFTLAFKNQLLADHGHNPLMKKVFDVYLCFLQKHQSETALKNVFTALRSLIYKFPSTFYEGRADMCAALCYEILKCCNSKLSSIRTEASQLLYFLMRNNFDYTGKKSFVRTHLQVIISVSQLIADVVGIGGTRFQQSLSIINNCANSDRLIKHTSFSSDVKDLTKRIRTVLMATAQMKEHENDPEMLVDLQYSLAKSYASTPELRKTWLDSMARIHVKNGDLSEAAMCYVHVTALVAEYLTRKGVFRQGCTAFRVITPNIDEEASMMEDVGMQDVHFNEDVLMELLEQCADGLWKAERYELIADIYKLIIPIYEKRRDFERLAHLYDTLHRAYSKVTEVMHSGRRLLGTYFRVAFFGQGFFEDEDGKEYIYKEPKLTPLSEISQRLLKLYSDKFGSENVKMIQDSGKVNPKDLDSKYAYIQVTHVIPFFDEKELQERKTEFERSHNIRRFMFEMPFTQTGKRQGGVEEQCKRRTILTAIHCFPYVKKRIPVMYQHHTDLNPIEVAIDEMSKKVAELRQLCSSAEVDMIKLQLKLQGSVSVQVNAGPLAYARAFLDDTNTKRYPDNKVKLLKEVFRQFVEACGQALAVNERLIKEDQLEYQEEMKANYREMAKELSEIMHEREICPLEEKTSVLPNSLHIFNAISGTPTSTMVHGMTSSSSVV

SEQ ID NO: 917401 - protein, 451 aa, Homo sapiens
MATAQMKEHENDPEMLVDLQYSLAKSYASTPELRKTWLDSMARIHVKNGDLSEAAMCYVHVTALVAEYLTRKGVFRQGCTAFRVITPNIDEEASMMEDVGMQDVHFNEDVLMELLEQCADGLWKAERYELIADIYKLIIPIYEKRRDFERLAHLYDTLHRAYSKVTEVMHSGRRLLGTYFRVAFFGQGFFEDEDGKEYIYKEPKLTPLSEISQRLLKLYSDKFGSENVKMIQDSGKVNPKDLDSKYAYIQVTHVIPFFDEKELQERKTEFERSHNIRRFMFEMPFTQTGKRQGGVEEQCKRRTILTAIHCFPYVKKRIPVMYQHHTDLNPIEVAIDEMSKKVAELRQLCSSAEVDMIKLQLKLQGSVSVQVNAGPLAYARAFLDDTNTKRYPDNKVKLLKEVFRQFVEACGQALAVNERLIKEDQLEYQEEMKANYREMAKELSEIMHELG

SEQ ID NO: 917402 - protein, 1114 aa, Homo sapiens
IKYNRKISADFHVDLNHFSVRQMLATTSPALMNGSGQSPSVLKGILHEAAMQYPKQGIFSVTCPHPDIFLVARIEKVLQGSITHCAEPYMKSSDSSKVAQKVLKNAKQACQRLGQYRMPFAWAARTLFKDASGNLDKNARFSAIYRQDSNKLSNDDMLKLLADFRKPEKMAKLPVILGNLDITIDNVSSDFPNYVNSSYIPTKQFETCSKTPITFEVEEFVPCIPKHTQPYTIYTNHLYVYPKYLKYDSQKSFAKARNIAICIEFKDSDEEDSQPLKCIYGRPGGPVFTRSAFAAVLHHHQNPEFYDEIKIELPTQLHEKHHLLLTFFHVSCDNSSKGSTKKRDVVETQVGYSWLPLLKDGRVVTSEQHIPVSANLPSGYLGYQELGMGRHYGPEIKWVDGGKPLLKISTHLVSTVYTQDQHLHNFFQYCQKTESGAQALGNELVKYLKSLHAMEGHVMIAFLPTILNQLFRVLTRATQEEVAVNVTRVIIHVVAQCHEEGLESHLRSYVKYAYKAEPYVASEYKTVHEELTKSMTTILKPSADFLTSNKLLKYSWFFFDVLIKSMAQHLIENSKVKLLRNQRFPASYHHAVETVVNMLMPHITQKFRDNPEASKNANHSLAVFIKRCFTFMDRGFVFKQINNYISCFAPGDPKTLFEYKFEFLRVVCNHEHYIPLNLPMPFGKGRIQRYQDLQLDYSLTDEFCRNHFLVGLLLREVGTALQEFREVRLIAISVLKNLLIKHSFDDRYASRSHQARIATLYLPLFGLLIENVQRINVRDVSPFPVNAGMTVKDESLALPAVNPLVTPQKGSTLDNSLHKDLLGAISGIASPYTTSTPNINSVRNADSRGSLISTDSGNSLPERNSEKSNSLDKHQQSSTLGNSVVRCDKLDQSEIKSLLMCFLYILKSMSDDALFTYWNKASTSELMDFFTISEVCLHQFQYMGKRYIASVRKISSVLGISVDNGYGHSDADVLHQSLLEANIATEVCLTALDTLSLFTLAFKNQLLADHGHNPLMKKVFDVYLCFLQKHQSETALKNVFTALRSLIYKFPSTFYEGRADMCAALCYEILKCCNSKLSSIRTEASQLLYFLMRNNFDYTGKKSFVRTHLQVRVV

SEQ ID NO: 917403 - protein, 216 aa, Homo sapiens
ERSCTVGWRSRGTAWNPGRPRGERSASGRGRRAPKAAGEVKPPQPAGGTLGGRDGGRWRRRTLQRRRGWRRGGSRAGTGLGTGRSSAAGRQRRGAGTAPAAGPRPRGRRLPPHLLHGWPATPPAMMPGQIPDPSVTTGSLPGLGPLTGLPSSALTVEELKYADIRNLGAMIAPLHFLEVKLGKRPQPVKSEVHRQHGLRVGKLSPLLGEAHLAEQL

SEQ ID NO: 917404 - protein, 174 aa, Homo sapiens
MVAGWPATPPAMMPGQIPDPSVTTGSLPGLGPLTGLPSSALTVEELKYADIRNLGAMIAPLHFLEVKLGKRPQPVKSELDEEEERRKRRREKNKVAAARCRNKKKERTEFLQRESERLELMNAELKTQIEELKQERQQLILMLNRHRPTCIVRTDSVKTPESEGNPLLEQLEKK

SEQ ID NO: 917405 - protein, 287 aa, Homo sapiens
ERSCTVGWRSRGTAWNPGRPRGERSASGRGRRAPKAAGEVKPPQPAGGTLGGRDGGRWRRRTLQRRRGWRRGGSRAGTGLGTGRSSAAGRQRRGAGTAPAAGPRPRGRRLPPHLLHGWPATPPAMMPGQIPDPSVTTGSLPGLGPLTGLPSSALTVEELKYADIRNLGAMIAPLHFLEVKLGKRPQPVKSELDEEEERRKRRREKNKVAAARCRNKKKERTEFLQRESERLELMNAELKTQIEELKQERQQLILMLNRHRPTCIVRTDSVKTPESEGNPLLEQLEKK

SEQ ID NO: 917406 - protein, 174 aa, Homo sapiens; identical to SEQ ID NO: 917404

SEQ ID NO: 917407 - protein, 133 aa, Homo sapiens
APTLGRGQSDVIGKALEAFLWSPGKSRSSLGVGSRFFYGWDGCAGITAASVQWLLLNPATAPCLLMKQCRDGVEGTGDAGCLPWGRNGNLVLDGTLLPVSVQLCSGLQGGGDLRGNRGRGQVLGPISAPSTQP

SEQ ID NO: 917408 - protein, 163 aa, Homo sapiens
MMPGQIPDPSVTTGSLPGLGPLTGLPSSALTVEELKYADIRNLGAMIAPLHFLEVKLGKRPQPVKSELDEEEERRKRRREKNKVAAARCRNKKKERTEFLQRESERLELMNAELKTQIEELKQERQQLILMLNRHRPTCIVRTDSVKTPESEGNPLLEQLEKK

SEQ ID NO: 917409 - protein, 153 aa, Homo sapiens
MYALNQCPIYGTDSPMARIHGSRNQRGEVALLTITPSDPLAKFLLPVPATLCSAGLEVLVPEGGTLPPVYTTTIPLKWKLILPPGHFGLLLPLCQQAKKEVTVLAGVIDPGYQDKISLLLHNGGSNLGTVHCRSNNNMGTRWPWSLTSSSVLR

SEQ ID NO: 917410 - protein, 811 aa, Homo sapiens
AYFLILVQRILLELDMQNIQDNLAKHLSEGQKRKLTFGITILGDPQILLLDEPTTGLDPFSRDQVWSLLRERRADHVILFSTQSMDEADILADRKVIMSNGRLKCAGSSMFLKRRWGLGYHLSLHRNEICNPEQITSFITHHIPDAKLKTENKEKLVYTLPLERTNTFPDLFSDLDKCSDQGVTGYDISMSTLNEVFMKLEGQSTIEQDFEQVEMIRDSESLNEMELAHSSFSEMQTAVSDMGLWRMQVFAMARLRFLKLKRQTKVLLTLLLVFGIAIFPLIVENIMYAMLNEKIDWEFKNELYFLSPGQLPQEPRTSLLIINNTGLPSCAPQIRSLSIRHDPDYSFRAYLTPLHSSTLSSESNIEDFIKSLKHQNILLEVDDFENRNGTDGLSYNGAIIVSGKQKTKQLNLSTFTILSQKLSKMFRISPQSRDAKPNPEEPIDEDEDIQTERIRTATALTTSILDEKPVIIASCLHKEYAGQKKSCFSKRKKKIAARNISFCVQEGEILGLLGPNGAGKSSSIRMISGITKPTAGEVELKGCSSVLGHLGYCPQENVLWPMLTLREHLEVYAAVKGLRKADARLAIARLVSAFKLHEQLNVPVQKLTAGITRKLCFVLSLLGNSPVLLLDEPSTGIDPTGQQQMWQAIQAVVKNTERGVLLTTHNLAEAEALCDRVAIMVSGRLRCIGSIQHLKNKLGKDYILELKVKETSQVTLVHTEILKLFPQAAGQERYSSLLTYKLPVADVYPLSQTFHKLEAVKHNFNLEEYSLSQCTLEKVFLELSKEQEVGNFDEEIDTTMRWKLLPHSDEP

SEQ ID NO: 917411 - protein, 905 aa, Homo sapiens
MLRKERSKQLQQSPTPTCPTPELGSPLPSRTGSLTDEPADPARVSSRQRLELVALVYSSCIAENLVPNLFLELFFVFQLLTARRMVTAKDSDPELSPAVLGQVLSNLDKGTLKLLAENERLLCFSPALQGRLRAAYEGSVAKPETDNRANFSSDRAFHTFKKQRAMMGQLSAACSHSHFVRLFQKQLLQMCQSPGGAGGTVLGEAPDVLSMLGADKLGRLWRLQERLMAPQSSGGPCPPPTFPGCQGFFRDFILSASSFQFNQHLMDSLSLKIQELNGLALPQHEPNDEDGESDVDWQGERKQFAVVLLSLRLLAKFLGFVAFLPYRGPEPPPTGELQDSILALRSQVPPVLDVRTLLQRGLQARRAVLTVPWLVEFLSFADHVVPLLEYYRDIFTLLLRLHRSLVLSQESEGKMCFLNKLLLLAVLGWLFQIPTVPEDLFFLEEGPSYAFEVDTVAPEHGLDNAPVVDQQLLYTCCPYIGELRKLLASWVSGSSGRSGGFMRKITPTTTTSLGAQPSQTSQGLQAQLAQAFFHNQPPSLRRTVEFVAERIGSNCVKHIKATLVADLVRQAESLLQEQLVTQGEEGGDPAQLLEILCSQLCPHGAQALALGREFCQRKSPGAVRALLPEETPAAVLSSAENIAVGLATEKACAWLSANITALIRREVKAAVSRTLRAQGPEPAARGERRGCSRACEHHAPLPSHLISEIKDVLSLAVGPRDPDEGVSPEHLEQLLGQLGQTLRCRQFLCPPAEQHLAKCSVELASLLVADQIPILGPPAQYRLERGQARRLLHMLLSLWKEDFQGPVPLQLLLSPRNVGLLADTRPREWDLLLFLLRELVEKGLMGRMEIEACLGSLHQAQWPGDFAEELATLSNLFLAEPHLPEPQLRACELVQPNRGTVLAQS

SEQ ID NO: 917412 - protein, 175 aa, Homo sapiens
MKAPWQSPGQDLQASEKKRIKELKLTRSPHQMLDPSFTIFPSNSQAPLLQVCWSLLEVHSRPCFPGYHQRRLQNSKDCCPFLPLEALSQRGTCQIPAGALLYEVSDNPCWEVSPSALSKGDGSFIYKPLTGAAAFLSEMSCPERRNLERQSGYSGFAELQLTLPSSSFQAALFTL

SEQ ID NO: 917413 - protein, 174 aa, Homo sapiens
MFAEYMNDCNILIFISLCVGIKRWGLWKVSRSWGYSPAENIEIVAKQTFDKEMSMVEGSQMLLIKTTEEGPPEAIFGAAPPILGPECQDPGARTISSLCSLQSDAVLLGCPSCGSSGSRCSSDGLSGGHKQEAFVTSTWCQLCRHTECKSCENVATSTQLPRDALENFCDQAQT

SEQ ID NO: 917414 - protein, 366 aa, Homo sapiens
MARLWGALSLWPLWAAVPWGGAAAVGVRACSSTAAPDGVEGPALRRSYWRHLRRLVLGPPEPPFSHVCQVGDPVLRGVAAPVERAQLGGPELQRLTQRLVQVMRRRRCVGLSAPQLGVPRQVLALELPEALCRECPPRQRALRQMEPFPLRVFVNPSLRVLDSRLVTFPEGCESVAGFLACVPRFQAVQISGAGGGDRGCWSSARVSSARLRESAEVVALYSELDNLITRVGNQVERLVMDRDEGRFPVRRGAAVYICHLLLPLVNGNSQDRGQGAVTSFAGLDPNGEQVVWQASGWAARIIQHEMDHLQGCLFIDKMDSRTFTNVYWMKTELEEDVRNVCPEISYGQNVGYNLRRKITPKGVDIS

SEQ ID NO: 917415 - protein, 670 aa, Homo sapiens
ELQTRAGTDPRNVSPGCRPHSTSSNSSKLPFMHSVLPISGSSDFCSRANHVVLENETDSDPTPNDCFEPVSPEFCGKEAIRIKNLKKEYAGKCERVEALKGSVTVYNHTLSRMADIENISKFTGFCPQSNVQFGFLTVKENLRLFAKIKGILPHEVEKEVQRVVQELEMENIQDILAQNLSGGQNRKLTFGIAILGDPQVLLLDEPTAGLDPLSRHRIWNLLKEGKSDRVILFSTQFIDEADILADRKVFISNGKLKCAGSSLFLKKKWGIGYHLSLHLNERCDPESITSLVKQHISDAKLTAQSEEKLVYILPLERTNKFPELYRDLDRCSNQGIEDYGVSITTLNEVFLKLEGKSTIDESDIGIWGQLQTDGAKDIGSLVELEQVLSSFHETRKTISGVALWRQQVCAIAKVRFLKLKKERKSLWTIFIPQLLEHLFYESYQKSYPWELSPNTYFLSPGQQPQDPLTHLLVINKTGEHGAEMQLLNVVLVERFPPKNMNSQEKNKLWSTIDNFLHSLRRQNIAIEVDAFGTRNGTDDPSYNGAIIVSGDEKDHRFSIACNTKRLNCFPVLLDVISNGLLGIFNSSEHIQTDRSTFFEEHMDYEYGYRSNTFFWIPMAASFTPYIAMSSIGDYKVRRVKVFTCFLYLENPSHTLTTINLHASGKSNFCT

SEQ ID NO: 917416 - protein, 2326 aa, Homo sapiens
EYKPPSPSRASKRHQRVLATRVRNITKKSSHLPLGSPLKRQQNTRDPDTMVPLTDFSPVMDHSREKDNDLSDTDSNYSLDSLSCVYAKALIEPLKPEERKWDFPEPENSESDDSQLSEDSLAEKRYQSPKNRLGGNRPTNNRGQPRTRTRASVRGFTAASDSDLLAQTHRSFSLDSLIDAEEELGEDQQEEPFPGSADEIPTETFWHLEDSSLPVMDQEAICRLGPINYRTAARLDAVLPMSSSFYLDPQFQPHCELQPHCELQPHCELQPHCEQAESQVEPSYSEQADSLQGMQLSRESPLMSMDSWFSCDSKINPSSPPGIVGSLCPSPDMQEFHSCKGERPGYWPNTEELKPSDAETVLPYSSKLHQGSTELLCSARDEHTASAADTSRLSLWGIQRLIQPGADGTFQGRCIPDMTQQGSSEASHNSSVSNVLAASATTLTHVGSTHERDWSALQQKYLLELSCPVLEAIGAPKPAYPYLEEDSGSLAQASSKGGDTLLPVGPRVSSNLNLNNFPVHLSRIRRLRAEKEQDSLNAKLEGVSDFFSTSEKEASYDETYSADLESLSASRSTNAQVFATENAIPDSMTEACEVKQNNLEECLQSCRKPGLMTSSDEDFFQKNACHSNVTTATKADHWSQGWAPLRKNSAVQPGQLSPDSHYPLEEEKTDCQESSKEAVRRHINVSFALPSGPELYLHSAPWNPLSSSLQPPLLETFYVTKSRDALTETALEIPACREVRVPSPPPREAWGFGHNHQALQGAYLKNNLPVLLQNQNSKIASSQQVTAEIPVDLNTREVIRESGKCPGNITEESHDSVYSSVTQNRHFLPSTSTKVCEFENQVVILNKKHSFPALEGGEVTAQSCCGASSDSTESGKSLLFRESEAREEEELDQNTVLRQTINVSLEKDMPGESAVSLKSRSVDRRVSSPVMVAQGGGPTPKWEGKNETGLLEKGLRPKDSSEEFKLPGTKPAYERFQLVACPQERNPSECKSQEMLNPNREPSGKKQNKRVNNTDEMARLIRSVMQLENGILEIESKQNKQVHASHTPGTDKELVFQDQKEQEKTDHAFRPDSSGNPLPSKDQPSSPRQTDDTVFRDSEAGAMEVNSIGNHPQVQKITPNPFRSREGVRESEPVREHTHPAGSDRPARDICDSLGKHTTCREFTNTSLHPQRMKALARALPLQPRLERSSKNNGQFVKASASLKGQPWGLGSLEELETVKGFQESQVAEHVSSSNQEEPKAQGKVEEMPMQRGGSLQEENKVTQKFPSLSQLCRDTFFRQETVSPLLSRTEFCTAPLHQDLSNTLPLNSPRWPRRCLHVPVALGISSLDCVLDLTMLKIHNSPLVTGVEHQDQSTETRSHSPEGNVRGRSSEAHTAWCGSVRSMAMGSHSQSGVPESIPLGTEDRISASTSPQDHGKDLRITLLGFSTSEDFASEAEVAVQKEIRVSSLNKVSSQPEKRVSFSLEEDSDQASKPRQKAEKETEDVGLTSGVSLAPVSLPRVPSPEPRLLEPSDHASMCLAILEEIRQAKAQRKQLHDFVARGTVLSYCETLLEPECSSRVAGRPQCKQIDQSSSDQTRNEGEAPGFHVASLSAEAGQIDLLPDERKVQATSLSADSFESLPNTETDREPWDPVQAFSHAAPAQDRKRRTGELRQFAGASEPFICHSSSSEIIEKKKDATRTPSSADPLAPDSPRSSAPVEEVRRVVSKKVVAALPSQAPYDDPRVTLHELSQSVPQETAEGIPPGSQDSSPEHQEPRTLDTTYGEVSDNLLVTAQGEKTAHFESQSVTCDVQNSTSASGPKQDHVQCPEASTGFEEVPSRAYEMDETGEISRGPDVHLTHGLEPKDVNREFRLTESSTCEPSTVAAVLSRAQGCRSPSAPDVRTGSFSHSATDGSVGLIGVPEKKVAEKQASTELEAASFPAGMYSEPLRQFRDSSVGDQNAQVCQTNPEPPATTQGPHTLDLSEGSAESKLVVEPQHECLENTTRCFLEKPQFSTELRDHNRLDSQAKFVARLKHTCSPQEDSPWQEEEQHRDQASGGGEGFAQGVNPLPDEDGLDGCQILDAGREEVAVAKPPVSKILSQGFKDPATVSLRQNETPQPAAQRSGHLYTGREQPAPNHRGSLPVTTIFSGPKHSRSSPTPQFSVVGSSRSLQELNLSVEPPSPTDEDTQGPNRLWNPHLRGYSSGKSVARTSLQAEDSNQKASSRLDDGTTDHRHLKPATPPYPMPSTLSHMPTPDFTTSWMSGTLEQAQQGKREKLGVQVRPENWCSQMDKGMLHFGSSDISPYALPWRPEEPARISWKQYMSGSAVDVSCSQKPQGLTLSNQH

SEQ ID NO: 917417 - protein, 836 aa, Homo sapiens
EYKPPSPSRASKRHQRVLATRVRNITKKSSHLPLGSPLKRQQNTRDPDTMVPLTDFSPVMDHSREKDNDLSDTDSNYSLDSLSCVYAKALIEPLKPEERKWDFPEPENSESDDSQLSEDSLAEKRYQSPKNRLGGNRPTNNRGQPRTRTRASVRGFTAASDSDLLAQTHRSFSLDSLIDAEEELGEDQQEEPFPGSADEIPTETFWHLEDSSLPVMDQEAICRLGPINYRTAARLDAVLPMSSSFYLDPQFQPHCELQPHCELQPHCELQPHCEQAESQVEPSYSEQADSLQGMQLSRESPLMSMDSWFSCDSKINPSSPPGIVGSLCPSPDMQEFHSCKGERPGYWPNTEELKPSDAETVLPYSSKLHQGSTELLCSARDEHTASAADTSRLSLWGIQRLIQPGADGTFQGRCIPDMTQQGSSEASHNSSVSNVLAASATTLTHVGSTHERDWSALQQKYLLELSCPVLEAIGAPKPAYPYLEEDSGSLAQASSKGGDTLLPVGPRVSSNLNLNNFPVHLSRIRRLRAEKEQDSLNAKLEGVSDFFSTSEKEASYDETYSADLESLSASRSTNAQVFATENAIPDSMTEACEVKQNNLEECLQSCRKPGLMTSSDEDFFQKNACHSNVTTATKADHWSQGWAPLRKNSAVQPGQLSPDSHYPLEEEKTDCQESSKEAVRRHINVSFALPSGPELYLHSAPWNPLSSSLQPPLLETFYVTKSRDALTETALEIPACREVRVPSPPPREAWGFGHNHQALQGAYLKNNLPVLLQNQNSKIASSQQVTAEIPVDLNTREVIRESGKCPGNITEESHDSVYSSVTQNRHFLPSTSTKDM

SEQ ID NO: 917418 - protein, 180 aa, Homo sapiens
MSNIIYGHLRLSDHSIQLTTLEGGKLQAIGSLFNLFGPQFPHRSLGRSLGSSDLICPGSFWDLFIKHQDDSYDSAVGTLEPARVSTLVHLLQVRSPLCHAPRALRPGGPGLVRGLRCSLSHVHLRGLPFLPSQGLDARACEAGISEDLRREGMSEQEYEYVSFEWKHCYASIKHPALTEM

SEQ ID NO: 917419 - protein, 181 aa, Homo sapiens
MRLSFFQILNHILTPNICHSTASMFPCLCPARVIQQEKEIKGIQIGRAEIKLFLFADYIILYPENPKDSSKRLLELINDFVFCLFATQVISKSSERVVLMERINAYPNSHKLAYLQGNITLAFEERGYAGIQTRKCVTISEVAKSNNEMEKDVKDVTVNVGHPQGSLWQDNAGASPLHETD

SEQ ID NO: 917420 - protein, 323 aa, Homo sapiens [sequence omitted]

SEQ ID NO: 917421 - protein, 263 aa, Homo sapiens
MADFTGAARTRARRSRLPSPYSLPSGEAPPGDRQASPSSAASGVRGPPLSTRGQPCPGRLARSRTPRLQSKVGQRRAGSQPERPTGCRNASVGRRGWLHPCAAFLCQPRLKLLRPSFLAASPRPRPPQLQELRAVLLAVDAQRVQVLLAVALRHLGQPLHQARQLQVGAECLRPRGGLAAGAENGAIRRRLPGHAALGRRGRNCGRTRLSRARRTAAGTAGRTAPGAGGRAQPTWRAWVEEDSFLLAGSPSPACHPLIPQVYG

SEQ ID NO: 917422 - protein, 263 aa, Homo sapiens; identical to SEQ ID NO: 917421

SEQ ID NO: 917423 - protein, 197 aa, Homo sapiens
GPLPPTAMEDEQLDSLEGWAPVRQGLFADAERHRLRFLVAWNGAEGKLAVTCHDLTAQQPQRREGARLGLEPKPKAAVSPPSCRVPAQLPCSRPTGPAGSRPRAALWPPLERCSPQLDVGGGGAWSLGLGLWALLWQARAGPGEVALQELCGQLERYLGAAAHGCGGATVRHAVFAAKGRAADCESPREFRERALRA

SEQ ID NO: 917424 - protein, 131 aa, Homo sapiens
MQKEMEQDVKRFGQAAWATAIPRLEKLKLMLAQETLQLMRAKELYLNRKRAEIQGKMEDLPEQEKNINVVDELEMQFYEIQLELYEVKFEILKNEEILLTTQLDSLKRLIKEIFNFYEVVFIDFFPYGFCF

SEQ ID NO: 917425 - protein, 302 aa, Homo sapiens
MSLLRILTCQASCEITRPHVCEDALHLESTKLSSRPTRLRSLHLRAWASSSGMRGGPAARPVRHCGRRPRGLQDPDPKMAAPSEVAAIAPGEGDGGGGGFGSWLDGRLEALGVDRAVYGAYILGILQEEEEEEKLDALQGILSAFLEEDSLLNICKEIVERWSETQNVVTKVKKEDEVQAIATLIEKQAQIVVKPRMVSEEEKQRKAALLAQYADVTDEEDEADEKDDSGATTMNIGSDKLLFRNTNVEDVLNARKLERDSLRDESQRKKEQDKLQRERDKLAKQERKEKEKKRTQRGERKR

SEQ ID NO: 917426 - protein, 225 aa, Homo sapiens
AVLAGIFGIAIAPGEGDGGGGGFGSWLDGRLEALGVDRAVYGAYILGILQEEEEEEKLDALQGILSAFLEEDSLLNICKEIVERWSETQNVVTKVKKEDEVQAIATLIEKQAQIVVKPRMVSEEEKQRKAALLAQYADVTDEEDEADEKDDSGATTMNIGSDKLLFRNTNVEDVLNARKLERDSLRDESQRKKEQDKLQRERDKLAKQERKEKEKKRTQRGERKR

SEQ ID NO: 917427 - protein, 202 aa, Homo sapiens
GRVGRATLFGGPAGLSLASTVFGREQIRGLSYQPPTVPPISLSAFLEEDSLLNICKEIVERWSETQNVVTKVKKEDEVQAIATLIEKQAQIVVKPRMVSEEEKQRKAALLAQYADVTDEEDEADEKDDSGATTMNIGSDKLLFRNTNVEDVLNARKLERDSLRDESQRKKEQDKLQRERDKLAKQERKEKEKKRTQRGERKR

SEQ ID NO: 917428 - protein, 231 aa, Homo sapiens
MSLLRILTCQASCEITRPHVCEDALHLESTKLSSRPTRLRSLHLRAWASSSGMRGGPAARPVRHCGRRPRGLQDPDPKMAAPSEVAAIAPGEGDGGGGGFGSWLDGRLEALGVDRAVYGAYILGILQEEEEEEKLDALQGILSAFLEEDSLLNICKEIVERWSETQNVVTKVKKEDEVQAIATLIEKQAQIVVKPRMVSEEEKQRKAALLAQYADVTDEEEYPFWSLGTIP

SEQ ID NO: 917429 - protein, 232 aa, Homo sapiens
MSLLRILTCQASCEITRPHVCEDALHLESTKLSSRPTRLRSLHLRAWASSSGMRGGPAARPVRHCGRRPRGLQDPDPKMAAPSEVAAIAPGEGDGGGGGFGSWLDGRLEALGVDRAVYGAYILGILQEEEEEEKLDALQGILSAFLEEDSLLNICKEIVERWSETQNVVTKVKKEDEVQAIATLIEKQAQIVVKPRMVSEEEKQRKAALLAQYADVTDEEDSVPKHQCGRCP

SEQ ID NO: 917430 - protein, 112 aa, Homo sapiens
MDTKLGLHGLSFPFSMAPEPCPLNCQALRRQQMPMSSVQVLPMWTSGSVSLFSLIQPCSSFHHLPDEVQAIATLIEKQAQIVVKPRMVSEEEKQRKAALLAQYADVTDEEEY

SEQ ID NO: 917431 - protein, 198 aa, Homo sapiens
PCPSSRSLEWKLTLGSLSGAMTPQQLGVHSSSHALDGAGGLGVLLLGGRVDHKVHHPVAAAKFIPGKEPDKVAIEDHGVEASEEIIDDDSVHFAELKAALVTRYPIWPNPLTQTLTIVSWMRLTLHEQMELFASSEGQMSSPERQLLSDEELTYECIRCPNKVSLELESGITETFQKRAEVTQGRPWELGFGPVGSAW

SEQ ID NO: 917432 - protein, 198 aa, Homo sapiens; identical to SEQ ID NO: 917431

SEQ ID NO: 917433 - protein, 102 aa, Homo sapiens
ILSSQWLVWRPTDFILRTDLQAPRLPTDLPGMGGNRELVGKQEDSGLSTEPHLLCGTHRAVSLQSSSHHLCKGRLSPPFCDEEMEAPGGKMQPGPEAPGGCA

SEQ ID NO: 917434 - protein, 198 aa, Homo sapiens; identical to SEQ ID NO: 917431

SEQ ID NO: 917435 - protein, 102 aa, Homo sapiens; identical to SEQ ID NO: 917433

SEQ ID NO: 917436 - protein, 236 aa, Homo sapiens
MRRSSGFGGQKGQGPSCSFTGCWCCRGDDVAESDDSPFAQCGYNIQEKHLGKLHRAASRGEVSKVECILSSGSADLDERDKKKRTALHLACANGHPEVVALLVDRGCQLDVFDNKNRTALLKAVQCQEEECATILLEHGADPDLPDVYGNTTLHYAIYNEDIPMTKKLLLHHANIESANKACRVQPHRVGGFSPRVRRRESVEIKTQDKQIKDSWARGTTTTKMRRPVVAQNARLR

SEQ ID NO: 917437 - protein, 137 aa, Homo sapiens
IIKLLDGKRSQTVGILISSLHLEMKDIQQAIFNVDDSVVDLETLAALYENRAQEDELVKIRKYYETSKEEELKLLDKPEQFLHELAQIPNFAERAQCIIFRSVFSEGITSLHRKVEIITRASKQLLILLVPSLPTAY

SEQ ID NO: 917438 - protein, 181 aa, Homo sapiens
IIKLLDGKRSQTVGILISSLHLEMKDIQQAIFNVDDSVVDLETLAALYENRAQEDELVKIRKYYETSKEEELKLLDKPEQFLHELAQIPNFAERAQCIIFRSVFSEGITSLHRKVEIITRASKDLLHVKSVKDILALILAFGNYMNGGNRTRGQADGYSLEILPKLKDVKSRVFIFHNKFP

SEQ ID NO: 917439 - protein, 165 aa, Homo sapiens
MCATLLDTPAHSGSVSPTSDDSAAAPKTPWGINIIKKNKKAAPRAFGVRLEECQPATENQVGLCHTPEQARQGETKAQRHVPLIVAARCHIVEARGLESTGFYRVPGNNAVVSSLQEQLNPGPGDINQQDERWQDLNVINSLLKSFFRKLPEPLFTAAICPGDIC

SEQ ID NO: 917440 - protein, 181 aa, Homo sapiens
MCATLLDTPAHSGSVSPTSDDSAAAPKTPWGINIIKKNKKAAPRAFGVRLEECQPATENQVGLCHTPEQARQGETKAQRHVPLIVAARCHIVEARGLESTGFYRVPGNNAVVSSLQEQLNPGPGDINQQDERWQDLNVINSLLKSFFRKLPEPLFTADKYNDFIEANCIEDVRRGFGSLDN

SEQ ID NO: 917441 - protein, 343 aa, Homo sapiens
MATLGHTFPFYAGPKPTFPMDTTLASIIMIFLTALATFIVILPGIRGKTRLFWLLRVVTSLFIGAAILAVNFSSEWSVGQVSTNTSYKAFSSEWISADIGLQVGLGGVNITLTGTPVQQLNETINYNEEFTWRLGENYAEEYAKALEKGLPDPVLYLAEKFTPRSPCGLYRQYRLAGHYTSAMLWVAFLCWLLANVMLSMPVLVYGGYMLLATGIFQLLALLFFSMATSLTSPCPLHLGASVLHTHHGPAFWITLTTGLLCVLLGLAMAVAHRMQPHRLKAFFNQSVDEDPMLEWSPEEGGLLSPRYRSMADSPKSQDIPLSEASSTKAYCKEAHPKDPDCAL

SEQ ID NO: 917442 - protein, 359 aa, Homo sapiens
MATLGHTFPFYAGPKPTFPMDTTLASIIMIFLTALATFIVILPGIRGKTRLFWLLRVVTSLFIGAAILAVNFSSEWSVGQVSTNTSYKAFSSEWISADIGLQVGLGGVNITLTGTPVQQLNETINYNEEFTWRLGENYAEEYAKALEKGLPDPVLYLAEKFTPRSPCGLYRQYRLAGHYTSAMLWQVEVPGPVLTGSWLSRVAFLCWLLANVMLSMPVLVYGGYMLLATGIFQLLALLFFSMATSLTSPCPLHLGASVLHTHHGPAFWITLTTGLLCVLLGLAMAVAHRMQPHRLKAFFNQSVDEDPMLEWSPEEGGLLSPRYRSMADSPKSQDIPLSEASSTKAYCKEAHPKDPDCAL

SEQ ID NO: 917443 - protein, 129 aa, Homo sapiens
SETNLRGLQTWKRVPLAKVTGEESIKVGAKEPDIKEENEHQELGRAPREGVGKRGTACPHLEDLANPSNKLGSVKLHSLSTTQDTGDQNNSKEKVMRCTEKFREYSKAAEDIKNRISQKKRHFYPSNPQ

SEQ ID NO: 917444 - protein, 212 aa, Homo sapiens
MLQTADGTFHIQPLIGFSPTRPAPQRCCWWSALWGRVEREALRERLCMRASVHGASLDPCGCGMGACCLPGSILRAMLGGLATSILAPTLGSQYGGCPHFTDGDTGLEMPHHLCRTTSDGGGPPEEALEDSSGQSPVSSEGQRHCRPPTLVAVSGTGILGVLEADCREALPQRSHVVGPWWDVLAPGGLEAPAGGQLGPVFLEEAVLPCGYL

SEQ ID NO: 917445 - protein, 530 aa, Homo sapiens
MSTAIREVGVWRQTRTLLLKNYLIKCRTKKSSVQEILFPLFFLFWLILISMMHPNKKYEEVPNIELNPMDKFTLSNLILGYTPVTNITSSIMQKVSTDHLPDVIITEEYTNEKEMLTSSLSKPSNFVGVVFKDSMSYELRFFPDMIPVSSIYMDSRAGCSKSCEAAQYWSSGFTVLQASIDAAIIQLKTNVSLWKELESTKAVIMGETAVVEIDTFPRGVILIYLVIAFSPFGYFLAIHIVAEKEKKIKEFLKIMGLHDTAFCGIQKTYRKKGENVEALRNLSFDIYEGQITALLGHSGTGKSTLMNILCGLCPPSDGFASIYGHRVSEIDEMFEARKMIGICPQLDIHFDVLTVEENLSILASIKGIPANNIIQEVQKVLLDLDMQTIKDNQAKKLSGGQKRKLSLGIAVLGNPKILLLDEPTAGMDPCSRHIVWNLLKYRKANRVTVFSTHFMDEADILAGLFSALDSHSNLGVISYGVSMTTLEDVFLKLEVEAEIDQADLYFLKPGDKPHKYKTSLLLQNSAGESV

SEQ ID NO: 917446 - protein, 530 aa, Homo sapiens; identical to SEQ ID NO: 917445

SEQ ID NO: 917447 - protein, 169 aa, Homo sapiens
SSSHHIAMCKDHRKKTLEAVKQNLDCLNSDLEKDLQKLDMENQVLLRKIKEKEETISSLERKLALSLEEAKEEEELNYVIDEQEESLRELELETAKLEKSNAILSRNVVEVQKKISGLFTNIGLEEETTKQILEEMKARLQKSTESCAKQEEELAKAEAMSLPLRVCPG

SEQ ID NO: 917448 - protein, 153 aa, Homo sapiens
MPLKSACQVWPLQHKYKESDDTRRRACPTPLARTLLGGLRLFSWRPPDFRLLTSEPGCFVLQHGLSELLETSQNCSYSQIHMITVDCQIHMITPPQVPFWLIEPGADPRNGNEEERPHEDKVAICKPGRGPSPEPEPDQNLANPLSKMSIISA

SEQ ID NO: 917449 - protein, 313 aa, Homo sapiens
MSYLLAADIIHSVNIMKEVRRALCNAATDDSKLLLLSAVGSVFCSGLDYSYLIGRLSSDRRKESTRIAEAIRDFVKAFIQFKKPIVVAINGPALGLGASILPLCDIVWASEKAWFQTPYATIRLTPAGCSSYTFPQILGVALKQVWTGESTDDSWHVGSTCCVLGWAVNAVHAPVRQDSCDPHFADVETEAREVYPTSPQAGTQPWMVLGLTDANEMLFCGRKLTAQEACSRGLVSQVFWPTTFSQEVMLRVKEMASCSAVVLEESKCLVRSFLKSVLEDVNEKECLMLKQLWSSSKGLDSLFSYLQDKIYEV

SEQ ID NO: 917450 - protein, 156 aa, Homo sapiens
MSSYISHFLDLCHAHPYLENSHSSNTEVAFSSSRASNHLLLCDRYDRCPRQVTSPALPNAGSLIVGKHTTSNKVQLSDTGTPHRLSQPLQGRDAKKTCTFPATQNCLLHGMVLTGETLKDHRSWRFHVSLSSNIRWVQNRRKRTQDSRATELLIGG

SEQ ID NO: 917451 - protein, 782 aa, Homo sapiens
VTILAAQQKSPLPRRRLWVCISLESQSSQHVPHLKDFISSPLSCGTLPGLQLPSSPDKASLRMRRQQQLSKSLGDSKNRHKKPKDPKPKVKKLKYHQYIPPDQKAEKSPPPMDSAYARLLQQQQLFLQLQILSQQQQQQQHRFSYLGMHQAQLKEPNEQMVRNPNSSSTPLSNTPLSPVKNSFSGQTGVSSFKPGPLPPNLDDLKVSELRQQLRIRGLPVSGTKTALMDRLRPFQDCSGNPVPNFGDITTVTFPVTPNTLPNYQSSSSTSALSNGFYHFGSTSSSPPISPASSDLSVAGSLPDTFNDASPSFGLHPSPVHVCTEESLMSSLNGGSVPSELDGLDSEKDKMLVEKQKVINELTWKLQQEQRQVEELRMQLQKQKRNNCSEKKPLPFLAASIKQEEAVSSCPFASQVPVKRQSSSSECHPPACEAAQLQPLGNAHCVESSDQTNVLSSTFLSPQCSPQHSPLGAVKSPQHISLPPSPNNPHFLPSSSGAQGEGHRVSSPISSQVCTAQIHEFNAFLHILPMQMAGLHSSDKVGPKFSIPSPTFSKSSSAISEVTQPPSYEDAVKQQMTRSQQMDELLDVLIESGEMPADAREDHSCLQKVPKIPRSSRSPTAVLTKPSASFEQASSGSQIPFDPYATDSDEHLEVLLNSQSPLGKMSDVTLLKIGSEEPHFDGIMDGFSGKAAEDLFNAHEILPGPLSPMQTQFSPSSVDSNGLQLSFTESPWETMEWLDLTPPNSTPGFSALTTSSPSIFNIDFLDVTDLNLNSSMDLHLQQW

SEQ ID NO: 917452 - protein, 222 aa, Homo sapiens
GNPCPKSPCVQQKQMTRSQQMDELLDVLIESGEMPADAREDHSCLQKVPKIPRSSRSPTAVLTKPSASFEQASSGSQIPFDPYATDSDEHLEVLLNSQSPLGKMSDVTLLKIGSEEPHFDGIMDGFSGKAAEDLFNAHEILPGPLSPMQTQFSPSSVDSNGLQLSFTESPWETMEWLDLTPPNSTPGFSALTTSSPSIFNIDFLDVTDLNLNSSMDLHLQQW

SEQ ID NO: 917453 - protein, 134 aa, Homo sapiens
MSRTVSPPDPTRNKKTPLPTSMVPTSPGRLCCLAVHSSGSGIGDFGWNRGCALTQNRDSNTGCVRDRSEVIFMYYGAVCSQSIHVLLFSHQKHLTPAIGVHGGGHQFLCWLRSFSEGMDNSLPPWKKAEMSVQI

SEQ ID NO: 917454 - protein, 166 aa, Homo sapiens
MRNNNLSFKGVLKRQEGGNEKRMTVFLSLKGAQYLLSQQVYTVSTPECHQPKPDQRRVPCYSECKPCSRAGHGILRPLPSPIGSVLPASALPPAHWVPAVRASLLFNGMRPMPLLGTQDPGPRTRVQQRPFTEAILPKRPLRNGVFYFAFCTGRTNGEKSPEIGLV

SEQ ID NO: 917455 - protein, 158 aa, Homo sapiens
MADEALFLLLHNEMVSGVYKSAEQGEVENGRCITKLENMGFRVGQGLIERFTKDTARFKDELDIMKFICKDFWTTVFKKQIDNLRTNHQGIYVLQDNKFRLLTQMSAGKQYLEHASKYLAFTCGLIRGGLSNLGIKSIVTAEVSSMPACKFQVMIQKL

SEQ ID NO: 917456 - protein, 158 aa, Homo sapiens; identical to SEQ ID NO: 917455

SEQ ID NO: 917457 - protein, 158 aa, Homo sapiens; identical to SEQ ID NO: 917455

SEQ ID NO: 917458 - protein, 158 aa, Homo sapiens; identical to SEQ ID NO: 917455

SEQ ID NO: 917459 - protein, 130 aa, Homo sapiens
MADEALFLLLHNEMVSGVYKSAEQGEVENGRCITKLENMGFRVGQGLIERFTKDTARFKDELDIMKFICKDFWTTVFKKQIDNLRTNHQYLAFTCGLIRGGLSNLGIKSIVTAEVSSMPACKFQVMIQKL

SEQ ID NO: 917460 - protein, 143 aa, Homo sapiens
MQHQVQCHFTGLPFSFLKTFTTLALFVHPSRSAEKHSPHTLHVSCEWIFHFTCQFWKTLNLCVDGKLKFSGIFAPHSPNFSKELFQCYFSLVSLFSLSLLEYNFIRSPQSTIDKLTLKNTACNVVLVYVTRLQLTASASFHRV

SEQ ID NO: 917461 - protein, 134 aa, Homo sapiens
MQWAKCALSSEILASSPAERMRLAQRSPSEYAFSLCWVPGIVLGTGNKGYLLLLIDYLMLYNLSGYKQQSVICNIRKATVSFRGSKRASYLPKVTQPVLMALDSDLGILVLEPLILTQGASVPPQDRVWLQRGP

SEQ ID NO: 917462 - protein, 895 aa, Homo sapiens
QLINGNHTANKWKPFSCEFNMEANQCPLVVEPSYPDLVINVGEVTLGEENRKKLQKIQRDQEKERVMRAACALLNSGGGVIRMAKKVEHPVEMGLDLEQSLRELIQSSDLQAFFETKQQGRCFYIFVKSWSSGPFPEDRSVKPRLCSLSSSLYRRSETSVRSMDSREAFCFLKTKRKPKILEEGPFHKIHKGVYQELPNSDPADPNSDPADLIFQKDYLEYGEILPFPESQLVEFKQFSTKHFQEYVKRTIPEYVPAFANTGGGYLFIGVDDKSREVLGCAKENVDPDSLRRKIEQAIYKLPCVHFCQPQRPITFTLKIVNVLKRGELYGYACMIRVNPFCCAVFSEAPNSWIVEDKYVCSLTTEKWVGMMTDTDPDLLQLSEDFECQLSLSSGPPLSRPVYSKKGLEHKKELQQLLFSEACSIIQLKKKKTYAMIRSWAVDLNLQEKPGVICDALLIAQNSTPILYTILREQDAEGQDYCTRTAFTLKQKLVNMGGYTGKVCVRAKVLCLSPESSAEALEAAVSPMDYPASYSLAGTQHMEALLQSLVIVLLGFRSLLSDQLGCEVLNLLTAQQYEIFSRSLRKNRELFVHGLPGSGKTIMAMKIMEKIRNVFHCEAHRILYVCENQPLRNFISDRNICRAETRKTFLRENFEHIQHIVIDEAQNFRTEDGDWYGKAKSITRRAKGGPGILWIFLDYFQTSHLDCSGLPPLSDQYPREELTRIVRNADPIAKYLQKEMQVIRSNPSFNIPTGCLEVFPEAEWSQGVQGTLRIKKYLTVEQIMTCVADTCRRFFDRGYSPKDVAVLVSTAKEVEHYKYELLKAMRKKRVVQLSDACDMLGDHIVLDSVRRFSGLERSIVFGIHPRTADPAILPNVLICLASRAKQHLYIFPWGGH

SEQ ID NO: 917463 - protein, 895 aa, Homo sapiens; identical to SEQ ID NO: 917462

SEQ ID NO: 917464 - protein, 895 aa, Homo sapiens; identical to SEQ ID NO: 917462

SEQ ID NO: 917465 - protein, 877 aa, Homo sapiens
QLINGNHTANKWKPFSCEFNMEANQCPLVVEPSYPDLVINVGEVTLGEENRKKLQKIQRDQEKERVMRAACALLNSGGGVIRMAKKVEHPVEMGLDLEQSLRELIQSSDLQAFFETKQQGRCFYIFVKSWSSGPFPEDRSVKPRLCSLSSSLYRRSETSVRSMDSREAFCFLKTKRKPKILEEGPFHKIHKGVYQELPNSDPADPNSDPADLIFQKDYLEYGEILPFPESQLVEFKQFSTKHFQEYVKRTIPEYVPAFANTGGGYLFIGVDDKSREVLGCAKENVDPDSLRRKIEQAIYKLPCVHFCQPQRPITFTLKIVNVLKRGELYGYACMIRVNPFCCAVFSEAPNSWIVEDKYVCSLTTEKWVGMMTDTDPDLLQLSEDFECQLSLSSGPPLSRPVYSKKGLEHKKELQQLLFSEACSIIQLKKKKTYAMIRSWAVDLNLQEKPGVICDALLIAQNSTPILYTILREQDAEGQDYCTRTAFTLKQKLVNMGGYTGKVCVRAKVLCLSPESSAEALEAAVSPMDYPASYSLAGTQHMEALLQSLVIVLLGFRSLLSDQLGCEVLNLLTAQQYEIFSRSLRKNRELFVHGLPGSGKTIMAMKIMEKIRNVFHCEAHRILYVCENQPLRNFISDRNICRAETRKTFLRENFEHIQHIVIDEAQNFRTEDGDWYGKAKSITRRAKGGPGILWIFLDYFQTSHLDCSGLPPLSDQYPREELTRIVRNADPIAKYLHLEVFPEAEWSQGVQGTLRIKKYLTVEQIMTCVADTCRRFFDRGYSPKDVAVLVSTAKEVEHYKYELLKAMRKKRVVQLSDACDMLGDHIVLDSVRRFSGLERSIVFGIHPRTADPAILPNVLICLASRAKQHLYIFPWGGH

SEQ ID NO: 917466 - protein, 211 aa, Homo sapiens
IIWPRQPKSTGQQALMLFCTTAMSPFRTKVHIPYDFSRSTDRKTSAILSLSTLQLVQQHQRFSSDHGIHWSYHMLQYPETSDLAVLWTVLVKVQLWYQLADEIGHGPFYPKSHQLPQQQGKGHRKSSDRCYVTQSSGNITGNSSRYVRREISHNGACTIFGRAGGGEVTFFKAFRENQRHQQASMLPLAPGPSLLFVDFKHQLKLMGPACL

SEQ ID NO: 917467 - protein, 232 aa, Homo sapiens
MRAPSDSRHRPAARPPPGAVTPARRFRSAHIWLSHCAAGPGSIFFSTLIMTTQVITCKTRRMNNSQCKMLENICFAGLVYQSPTLCLNGVQVPEAIDFYIVKCGNITSCPKTIVSSSLHCLWSILKVENYQTALQVEYFVRINEHNFCTAIATNAITITITITTITTTITITTTTINTYTITTISTIISTIIITMPPPPPLPLPMPEWKRSGGARCLRQNFLPQILHYHHCC

SEQ ID NO: 917468 - protein, 169 aa, Homo sapiens
MALCQYLEEHAEELNFQDAKILEIGAGPGLVSIVASILGAQVTATDLPDVLGNLQYNLLKNTLQCTAHLPEVKELVWGEDLDKNFPKSAFYYDYVLASDVVYHHYFLDKLLTTMVYLSQPGTVLLWANKFRFSTDYEFLDKFKQVFDTTLLAEYPESSVKLFKGILKWD

SEQ ID NO: 917469 - protein, 178 aa, Homo sapiens
SLIISPLQAMALCQYLEEHAEELNFQDAKILEIGAGPGLVSIVASILGAQVTATDLPDVLGNLQYNLLKNTLQCTAHLPEVKELVWGEDLDKNFPKSAFYYDYVLASDVVYHHYFLDKLLTTMVYLSQPGTVLLWANKFRFSTDYEFLDKFKQVFDTTLLAEYPESSVKLFKGILKWD

SEQ ID NO: 917470 - protein, 245 aa, Homo sapiens
MCGNIKETVKSLRHQQINTVQNLRAKTFEGGVCPVLSWAPGVGSARKLCLREPAAGDFPARTWRVEDGGWKDSVQLRLGGIPRLLGPQERLHVLEHGALGRQGAPECATPPNLLPCCVGQPGSRCRGSAPARWPPPGREDACPRTAPVFPSPLFGPGGRGPRRRAREPGDPAIDSNREAAVYSNTAPPGPSPGNAARPGAPSAWRGHPPSQLPWAAASPARPRPLPSPDIIRRVRGLSGPREAVR

SEQ ID NO: 917471 - protein, 586 aa, Homo sapiens
MTQSLICSLILDKPPLLFGLVFPEEVEKKANNERQKAERVLEVQIQTLIIQKEELNTDLYHMERSLRYFEEESKDLAVRLQHSLQCKGELERALSAVIATEKKKANQLSSCSKAHTEWELEQSLQDQALLKAQLTQLKESFQQLQLERDECAEHIEGERARWHQRMSKMSQEICTLKKEKQDMRWVEQLEWSLSKLKNQTAEPLPPEPPAVPSEVELQHLRKELERVAGELQSQVKNNQHISLLNRRQEERIREQEERLRKQEERLQEQHEKLRQLAKPQSVFEELNNENKSTLQLEQQVKELQEKLGEVELKSQEVQSLQQQPDHYLGHLQQYVATYQQQVAAYQQLTCEKEALRMLTSCPQVAFFKSAGASAQEKQAQLQEQVKEQRVCCQRLAHPVASAQKEPEAARGPGAPGPGGESVSGETHRALQEVTEKLAHARTHLRLLHDLKMPPEGRSLPRCDCNILAPEQLYGPPEGEGRPEAIRGAPASEPCPPAGKSITFYQNQGAVPKMQHWEEDTIRLELREEMKVKLLELQQMVLRLTATTTMGTENSWPLPTTLLMSPVQEPQPPRSLGLQTSMVIFVR

SEQ ID NO: 917472 - protein, 579 aa, Homo sapiens
MDVVEVAGSWWAQEREDIIMKYEKGHRAGLPEDKGPKPFRSYNNNVDHLGIVHETELPPLTAREAKQIRREISRKSKWVDMLGDWEKYKSSRKLIDRAYKGMPMNIRGPMWSVLLNIEEMKLKNPGRYQIMKEKGKRSSEHIQRIDRDISGTLRKHMFFRDRYGTKQRELLHILLAYEEYNPEVGYCRDLSHIAALFLLYLPEEDAFWALVQLLASERHSPAGDFTAQMAGPSRGSKDQQEHVVATSQSKTMGHQDKKDLCGQCSPLGCLIRILIDGISLGLTLRLWDVYLVEGEQALMPITRIAFKVQQKRLTKTSRCGPWARFCNRFVDTWARDEDTVLKHLRASMKKLTRKQGDLPPPAKPEQGSSASRPVPASRGGKTLCKGDRQAPPGPPARFPRPIWSASPPRAPRSSTPCPGGAVREDTYPVGTQGVPSPALAQGGPQGSWRFLQWNSMPRLPTDLDVEGPWFRHYDFRQSCWVRAISQEDQLAPCWQAEHPAERVRSAFAAPSTDSDQGTPFRARDEQQLSFLEEEQLLLLVTSTFRNGDYSVNRQGDDLSAQATPGHAGHLPAPVIIIAI

SEQ ID NO: 917473 - protein, 598 aa, Homo sapiens
YTAKAHLGIVQSCPSWESAPQEGPCPPFPVPSPGLSPELERDRASPFWGSAPRLGPLQAPCSSSALPGLPYSETELPPLTAREAKQIRREISRKSKWVDMLGDWEKYKSSRKLIDRAYKGMPMNIRGPMWSVLLNIEEMKLKNPGRYQIMKEKGKRSSEHIQRIDRDISGTLRKHMFFRDRYGTKQRELLHILLAYEEYNPEVGYCRDLSHIAALFLLYLPEEDAFWALVQLLASERHSPAGDFTAQMAGPSRGSKDQQEHVVATSQSKTMGHQDKKDLCGQCSPLGCLIRILIDGISLGLTLRLWDVYLVEGEQALMPITRIAFKVQQKRLTKTSRCGPWARFCNRFVDTWARDEDTVLKHLRASMKKLTRKQGDLPPPAKPEQGSSASRPVPASRGGKTLCKGDRQAPPGPPARFPRPIWSASPPRAPRSSTPCPGGAVREDTYPVGTQGVPSPALAQGGPQGSWRFLQWNSMPRLPTDLDVEGPWFRHYDFRQSCWVRAISQEDQLAPCWQAEHPAERVRSAFAAPSTDSDQGTPFRARDEQQLSFLEEEQLLLLVTSTFRNGDYSVNRQGDDLSAQATPGHAGHLPAPVIIIAI

SEQ ID NO: 917474 - protein, 630 aa, Homo sapiens
MDVVEVAGSWWAQEREDIIMKYEKAPSGLQGHRAGLPEDKGPKPFRSYNNNVDHLGIVHETELPPLTAREAKQIRREISRKSKWVDMLGDWEKYKSSRKLIDRAYKGMPMNIRGPMWSVLLNIEEMKLKNPGRYQIMKEKGKRSSEHIQRIDRDISGTLRKHMFFRDRYGTKQRELLHILLAYEEYNPPLFQRKPLLQRKPLQSPLPSPMNESSQVTSALPGDVLPWCLWLLQEVGYCRDLSHIAALFLLYLPEEDAFWALVQLLASERHSPAGDFTAQMAGPSRGSKDQQEHVVATSQSKTMGHQDKKDLCGQCSPLGCLIRILIDGISLGLTLRLWDVYLVEGEQALMPITRIAFKVQQKRLTKTSRCGPWARFCNRFVDTWARDEDTVLKHLRASMKKLTRKQGDLPPPAKPEQGSSASRPVPASRGGKTLCKGDRQAPPGPPARFPRPIWSASPPRAPRSSTPCPGGAVREDTYPVGTQGVPSPALAQGGPQGSWRFLQWNSMPRLPTDLDVEGPWFRHYDFRQSCWVRAISQEDQLAPCWQAEHPAERVRSAFAAPSTDSDQGTPFRARDEQQLSFLEEEQLLLLVTSTFRNGDYSVNRQGDDLSAQATPGHAGHLPAPVIIIAI

SEQ ID NO: 917475 - protein, 478 aa, Homo sapiens
MPMNIRGPMWSVLLNIEEMKLKNPGRYQIMKEKGKRSSEHIQRIDRDISGTLRKHMFFRDRYGTKQRELLHILLAYEEYNPEVGYCRDLSHIAALFLLYLPEEDAFWALVQLLASERHSPAGDFTAQMAGPSRGSKDQQEHVVATSQSKTMGHQDKKDLCGQCSPLGCLIRILIDGISLGLTLRLWDVYLVEGEQALMPITRIAFKVQQKRLTKTSRCGPWARFCNRFVDTWARDEDTVLKHLRASMKKLTRKQGDLPPPAKPEQGSSASRPVPASRGGKTLCKGDRQAPPGPPARFPRPIWSASPPRAPRSSTPCPGGAVREDTYPVGTQGVPSPALAQGGPQGSWRFLQWNSMPRLPTDLDVEGPWFRHYDFRQSCWVRAISQEDQLAPCWQAEHPAERVRSAFAAPSTDSDQGTPFRARDEQQLSFLEEEQLLLLVTSTFRNGDYSVNRQGDDLSAQATPGHAGHLPAPVIIIAI

SEQ ID NO: 917476 - protein, 208 aa, Homo sapiens
CGAAAARRSRRRLLFMRLRRAGRTPPQRRRPQGRSGPSPRLPARPPGGGLVTSAAGTCSRSRCPPLPAGRRSPLRAVPCPAPRTASSPGPPDAGLAPPQPCGPQGAPPHARPAPRPLPSHWLRPPSPRFLRRGWGSLAGRLAGPSHPLRRRRTVPSPIAGSVILKPRSTHSSRPLARRSSLHWLAAPVRFLGEFSTSRQEEAPASLGA

SEQ ID NO: 917477 - protein, 208 aa, Homo sapiens; identical to SEQ ID NO: 917476

SEQ ID NO: 917478 - protein, 226 aa, Homo sapiens
LPGMYKLQCNNCATNGATERKQAAGSGAGYALPSALQSIPQGSYATARFLVAKRPTTGHLEKEFMFHCRKQPGSPSRGLGLLWPWPDIEFVPRQDKLTQSSVLVPQICACQTRPNWLNEQPATSAGVRLEEVDQPPTLPSQGSGWPCSHSLSGCHLMADGAKALGKADGPWPYLFVRRTDVPCPAAMSPSGALVTQECGFISCKALWNPADIIMIIKQNTQRNCQP

SEQ ID NO: 917479 - protein, 141 aa, Homo sapiens
MVHGERSSSEPRWGERFKPRPGSLLRFQSTLVIAEHANDSLAPITLNTITAATRLGGEVSCLVAGTKCDKVAQDLCKVAGIAKVLVAQHDVYKGLLPEELTPLILATQKQFNYTHICAGASAFGKKWGFAIAAQALLELLA

SEQ ID NO: 917480 - protein, 188 aa, Homo sapiens
MTIYTEQDLYNHVVPKPRNKRVPILPFVIGAGVLGGVGTGTGGITTSIQFYYKLSQELNGDMERVSDSLVTLQDQLNSLAANRSCKATNGSSNGAPDAIHEKQLALLHYEQVEKFTAHLVTQKRSGGQGDHHQSLQQVFHFLLISKPVGPGVTQGDLTRSTLCAAQVYQPWNDAHFPCVTTNSLQFLL

SEQ ID NO: 917481 - protein, 157 aa, Homo sapiens
MTSCSKGQLLIGGHLLLIGGHVLLQVTQVMVWLLLQTLSLLALQLHLQEDPGCAFSSAWSCRDCSNSHSVCALLQLDNWMVKSEKFQSGEPGHFHTVPLNRARARPNIQLGRGRQSSYQGEAEMAQQETCPQNATNAPGQAHPWDQIIFVTRRKPTK

SEQ ID NO: 917482 - protein, 441 aa, Homo sapiens
MLLSGAPPAGSRPGPRTQGSAGGGPGGSRRGAGGAGAGPGGGGSGGVAKWLREHLGFRGGGGGGGGSKPAPPEPDYRPPAPSPAAPPAPPPDILAAYRLQRERDFEDPYSGGSSGSAALATPVAPGPTPPPRHGSPPHRLIRVETPGPPAPPADERISGPPASSDRLAILEDYADPFDVQETGEGSAGASGAPEKVPENDGYMEPYEAQKMMAEIRGSKETATQPLPLYDTPYEPEEDGATPEGEGAPWPRESRLPEDDERPPEEYDQPWEWKKERISKAFAAQFEGPEKSCLSPGREEKGRLPPRLSAGNPKSAKPLSMEPSSPLGEWTDPALPLENQVWYHGAISRTDAENLLRLCKEASYLVRNSETSKNDFSLSLKSSQGFMHMKLSRTKEHKYVLGQNSPPFSSVPEIVHHYASRKLPIKGAEHMSLLYPVAIRTL

SEQ ID NO: 917483 - protein, 364 aa, Homo sapiens
ETCLDCKPVSVEFGCMRSSSGWLPPGAAADERISGPPASSDRLAILEDYADPFDVQETGEGSAGASGAPEKVPENDGYMEPYEAQKMMAEIRGSKETATQPLPLYDTPYEPEEDGATPEGEGAPWPRESRLPEDDERPPEEYDQPWEWKKERISKAFAVDIKVIKDLPWPPPVGQLDSSPSLPDGDRDISGPASPLPEPSLEDSSAQFEGPEKSCLSPGREEKGRLPPRLSAGNPKSAKPLSMEPSSPLGEWTDPALPLENQVWYHGAISRTDAENLLRLCKEASYLVRNSETSKNDFSLSLKSSQGFMHMKLSRTKEHKYVLGQNSPPFSSVPEIVHHYASRKLPIKGAEHMSLLYPVAIRTL

SEQ ID NO: 917484 - protein, 295 aa, Homo sapiens
MLLSGAPPAGSRPGPRTQGSAGGGPGGSRRGAGGAGAGPGGGGSGGVAKWLREHLGFRGGGGGGGGSKPAPPEPDYRPPAPSPAAPPAPPPDILAAYRLQRERDFEDPYSGGSSGSAALATPVAPGPTPPPRHGSPPHRLIRVETPGPPAPPADERISGPPASSDRLAILEDYADPFDVQETGEGSAGASGAPEKVPENDGYMEPYEAQKMMAEIRGSKETATQPLPLYDTPYEPEEDGATPEGEGAPWPRESRLPEDDERPPEEYDQPWEWKKERISKAFAGESWWRGQVSWGL

SEQ ID NO: 917485 - protein, 440 aa, Homo sapiens
MYDGAPPAGSRPGPRTQGSAGGGPGGSRRGAGGAGAGPGGGGSGGVAKWLREHLGFRGGGGGGGGSKPAPPEPDYRPPAPSPAAPPAPPPDILAAYRLQRERDFEDPYSGGSSGSAALATPVAPGPTPPPRHGSPPHRLIRVETPGPPAPPADERISGPPASSDRLAILEDYADPFDVQETGEGSAGASGAPEKVPENDGYMEPYEAQKMMAEIRGSKETATQPLPLYDTPYEPEEDGATPEGEGAPWPRESRLPEDDERPPEEYDQPWEWKKERISKAFAAQFEGPEKSCLSPGREEKGRLPPRLSAGNPKSAKPLSMEPSSPLGEWTDPALPLENQVWYHGAISRTDAENLLRLCKEASYLVRNSETSKNDFSLSLKSSQGFMHMKLSRTKEHKYVLGQNSPPFSSVPEIVHHYASRKLPIKGAEHMSLLYPVAIRTL

SEQ ID NO: 917486 - protein, 295 aa, Homo sapiens
MLLSGAPPAGSRPGPRTQGSAGGGPGGSRRGAGGAGAGPGGGGSGGVAKWLREHLGFRGGGGGGGGSKPAPPEPDYRPPAPSPAAPPAPPPDILAAYRLQRERDFEDPYSGGSSGSAALATPVAPGPTPPPRHGSPPHRLIRVETPGPPAPPADERISGPPASSDRLAILEDYADPFDVQETGEGSAGASGAPEKVPENDGYMEPYEAQKMMAEIRGSKETATQPLPLYDTPYEPEEDGATPEGEGAPWPRESRLPEDDERPPEEYDQPWEWKKERISKAFAARLENHRILIFFL

SEQ ID NO: 917487 - protein, 932 aa, Homo sapiens
MGVSRSASTVIAYAMKEYGWNLDRAYDYVKERRTVTKPNPSFMRQLEEYQGILLASKQRHNKLWRSHSDSDLSDHHEPICKPGLELNKKDITTSADQIAEVKTMESHPPIPPVFVEHMVPQDANQKGLCTKERMICLEFTSREFHAGQIEDELNLNDINGCSSGCCLNESKFPLDNCHASKALIQPGHVPEMANKFPDLTVEDLETDALKADMNVHLLPMEELTSPLKDPPMSPDPESPSPQPSCQTEISDFSTDRIDFFSALEKFVELSQETRSRSFSHSRMEELGGGRNESCRLSVVEVAPSKVTADDQRSSSLSNTPHASEESSMDEEQSKAISELVSPDIFMQSHSENAISVKEIVTEIESISQGVGQIQLKGDILPNPCHTPKKNSIHELLLERAQTPENKPGHMEQDEDSCTAQPELAKDSGMCNPEGCLTTHSSIADLEEGEPAEGEQELQGSGMHPGAKWYPGSVRRATLEFEERLRQEQEHHGAAPTCTSLSTRKNSKNDSSVADLAPKGKSDEAPPEHSFVLKEPEMSKGKGKYSGSEAGSLSHSEQNATVPAPRVLEFDHLPDPQEGPGSDTGTQQEGVLKDLRTVIPYQESETQAVPLPLPKRVEIIEYTHIVTSPNHTGPGSEIATSEKSGEQGLRKVNMEKSVTVLCTLDENLNRTLDPNQVSLHPQVLPLPHSSSPEHNRPTDHPTSILSSPEDRGSSLSTALETAAPFVSHTTHLLSASLDYLHPQTMVHLEGFTEQSSTTDEPSAEQVSWEESQESPLSSGSEVPYKDSQLSSADLSLISKLGDNTGELQEKMDPLPVACRLPHSSSSENIKSLSHSPGVVKERAKEIESRVVFQAGLTKPSQMRRSASLAKLGYLDLCKDCLPEREPASCESPHLKLLQPFLRTDSGMHAMEDQESLENPGVICKEHALYWLIL

SEQ ID NO: 917488 - protein, 1030 aa, Homo sapiens
MGVSRSASTVIAYAMKEYGWNLDRAYDYVKERRTVTKPNPSFMRQLEEYQGILLASKQRHNKLWRSHSDSDLSDHHEPICKPGLELNKKDITTSADQIAEVKTMESHPPIPPVFVEHMVPQDANQKGLCTKERMICLEFTSREFHAGQIEDELNLNDINGCSSGCCLNESKFPLDNCHASKALIQPGHVPEMANKFPDLTVEDLETDALKADMNVHLLPMEELTSPLKDPPMSPDPESPSPQPSCQTEISDFSTDRIDFFSALEKFVELSQETRSRSFSHSRMEELGGGRNESCRLSVVEVAPSKVTADDQRSSSLSNTPHASEESSMDEEQSKAISELVSPDIFMQSHSENAISVKEIVTEIESISQGVGQIQLKGDILPNPCHTPKKNSIHELLLERAQTPENKPGHMEQDEDSCTAQPELAKDSGMCNPEGCLTTHSSIADLEEGEPAEGEQELQGSGMHPGAKWYPGSVRRATLEFEERLRQEQEHHGAAPTCTSLSTRKNSKNDSSVADLAPKGKSDEAPPEHSFVLKEPEMSKGKGKYSGSEAGSLSHSEQNATVPAPRVLEFDHLPDPQEGPGSDTGTQQEGVLKDLRTVIPYQESETQAVPLPLPKRVEIIEYTHIVTSPNHTGPGSEIATSEKSGEQGLRKVNMEKSVTVLCTLDENLNRTLDPNQVSLHPQVLPLPHSSSPEHNRPTDHPTSILSSPEDRGSSLSTALETAAPFVSHTTHLLSASLDYLHPQTMVHLEGFTEQSSTTDEPSAEQVSWEESQESPLSSGSEVPYKDSQLSSADLSLISKLGDNTGELQEKMDPLPVACRLPHSSSSENIKSLSHSPGVVKERAKEIESRVVFQAGLTKPSQMRRSASLAKLGYLDLCKDCLPEREPASCESPHLKLLQPFLRTDSGMHAMEDQESLENPGAPHNPEPTKSFVEQLTTTECIVQSKPVERPLVQYAKEFGSSQQYLLPRAGLELTSSEGGLPVLQTQGLQCACPAPGLAVAPRQQHGRTHPLRRLKKANDKKRTTNPFYNTM

SEQ ID NO: 917489 - protein, 138 aa, Homo sapiens
MLEMHGCTGNLTCLADRHCRSQAGLEHSRFWHLRVVLKPVPHRYGELTAFQVKFMRIPRAEKKTASLEEENSNVTEIWEAEVKVQGFSSGWKLILERRKPRSVSSKICTKMPNRKTQLPIPSEIPSAWNSMDHSSANH

SEQ ID NO: 917490 - protein, 148 aa, Homo sapiens
MGTMQRHLADGPASAEGNGSVKAIVFKSLETPIKKSQSRITKPKHHVRYPQQNQVKRCPYKCQALSHTNQTTIVRRRQRGKRGTSDVLTNNPKLTTDSHLKAQQANLRRAVKSGWELSRLEFPGKTDVARDVWDLCTLDTNHPNLPSR

SEQ ID NO: 917491 - protein, 902 aa, Homo sapiens
MEANHCSLGVYPSYPDLVIDVGEVTLGEENRKKLQKTQRDQERARVIRAACALLNSGGGVIQMEMANRDERPTEMGLDLEESLRKLIQYPYLQAFFETKQHGRCFYIFVKSWSGDPFLKDGSFNSRICSLSSSLYCRSGTSVLHMNSRQAFDFLKTKERQSKYNLINEGSPPSKIMKAVYQNISESNPAYEVFQTDTIEYGEILSFLESPSIEFKQFSTKHIQQYVENIIPEYISAFANTEGGYLFIGVDDKSRKVLGCAKEQVDPDSLKNVIARAISKLPIVHFCSSKPRVEYSTKIVEVFCGKELYGYLCVIKVKAFCCVVFSEAPKSWMVREKYIRPLTTEEWVEKMMDADPEFPPDFAEAFESQLSLSDSPSLCRPVYSKKGLEHKADLQQHLFPGTDCQFLHQERRKSFNTFRGKQIHERLCPADPGVHSDNATSLLGMIPPGHLECTPESLWKELSLQHEGLKELIHKQMRPFSQGIVILSRSWAVDLNLQEKPGVICDALLIAQNSTPILYTILREQDAEGQDYCTRTAFTLKQKLVNMGGYTGKVCVRAKVLCLSPESSAEALEAAVSPMDYPASYSLAGTQHMEALLQSLVIVLLGFRSLLSDQLGCEVLNLLTAQQYEIFSRSLRKNRELFVHGLPGSGKTIMAMKIMEKIRNVFHCEAHRILYVCENQPLRNFISDRNICRAETRETFLREKFEHIQHIVIDEAQNFRTEDGDWYRKAKTITQREKDCPGVLWIFLDYFQTSHLGHSGLPPLSAQYPREELTRVVRNADEIAEYIQQEMQLIIENPPINIPHGYLAILSEAKWVPGVPGNTKIIKNFTLEQIVTYVADTCRCFFERGYSPKDVAVLVSTVTEVEQYQSKLLKAMRKKMVVQLSDACDMLGVHIVLDSDLLH

SEQ ID NO: 917492 - protein, 197 aa, Homo sapiens
ICEAKVNNGVGAARMINSDAPKGLRDRNRAGRIPSILTASRARLPWQPRRSTTRALERFASRGRAAPPVGLAPATEPAARRRRSLGHRSVKIFKGMCFAIYASESTCQIKVCCLNMITRKAKSLFLDFFSYKPPIDTYPLLYGAQMKDIGHLQHLAQRLQWNRRAVNICGMHGWTKDLSPHSRMPSMLEHVKHYMSC

SEQ ID NO: 917493 - protein, 168 aa, Homo sapiens
ICEAKVNNGVGAARMINSDAPKGLRDRNRAGRIPSILTASRARLPWQPRRSTTRALERFASRGRAAPPVGLAPATEPAARRRRSLGHITRKAKSLFLDFFSYKPPIDTYPLLYGAQMKDIGHLQHLAQRLQWNRRAVNICGMHGWTKDLSPHSRMPSMLEHVKHYMSC

SEQ ID NO: 917494 - protein, 168 aa, Homo sapiens; identical to SEQ ID NO: 917493

SEQ ID NO: 917495 - protein, 139 aa, Homo sapiens
MTTGSTRGYLGGHGLGVGVKVQRRNSSLGQPLSEGPPAMAASGGQGPSGHWRGQSSSFLSDPREGKWQLVLAHGPSPIPAAPPQQPPPRLTAVVSRWAEGWGGGFPTLDSSGLQRPAHRTTEGVRPQIAVLKDNDNTHF

SEQ ID NO: 917496 - protein, 138 aa, Homo sapiens
MANNGLSKTSLLDNPVIDNRSKMVRIVTRTIAVTNQQHCSDTYNVCINLLTLTTALSIPVLNKNVTTPERMPVTCFAGPSSTAVSKRPSATGGGGRCPSNHRPPETKLQRPGQGECGQGKLSWGIFEFVMILSLTRTG

SEQ ID NO: 917497 - protein, 138 aa, Homo sapiens; identical to SEQ ID NO: 917496

SEQ ID NO: 917498 - protein, 1618 aa, Homo sapiens
PPAPRVPMQPWQCLRRFALAWWERTAEGRARSPREEAGPRDPGGRGEPGEQARGKMTSCVNVAQGQPEDRVEGYIRDPERSSPPMLSADDAEYPREYRTLGGGGGGGSGGRRFSNVGLVHTSERRHTVIAAQSLEALSGLQKADADRKRDAFMDHLKSKYPQHALALRGQQDRMREQAGVSGDRGDAATSLRRSSAGLRRRGRAEGGGRERGCARRRAAPRQVESRLPGRLGPGPARRRPRRLSHCSKGHRRRRPRLRRRPGERRARAGGSRGPPSPAGRRTWGWGPRTYTCGRSKGERLWGPGSPPRVGRGAGTRRWGPAPRHREPSRGGGRPGHCRLCTGVRICTDTFWYGRWASGLQAVAAALGESGWDEGETEGCGLALVVSLELSHSLSVTSTSGPSLLPLAHFYAAFLLPRPTPTQWTFPGLDMGSDKQRGGGVLILGSSHPARPLQTRSSRHTQGAQPGLADQAAKLSYASAESLETMSEAELPLGFSRMNRFRQSLPLSRSASQTKLRSPAHFPSVSAPPALPPLPFPCPSSFNCLESSGCLERLESRPGAPAGSMRGAWVHLHSGAASSLRPCRCGAGAAPKSSPRSPGGRRGDGSSDSEGGVSFAGVLFLQFGEETRRVHITHEVSSLDTLHALIAHMFPQKLTMGMLKSPNTAILIKDEARNVFYELEDVRDIQDRSIIKIYRKEPLYAAFPGSHLTNGDLRREMVYASRESSPTRRLNNLSPAPHLASGSPPPGLPSGLPSGLQSGSPSRSRLSYAGGRPPSYAGSPVHHAAERLGGAPAAQGVSPSPSAILERRDVKPDEDLASKAGGMVLVKGEGLYADPYGLLHEGRLSLAAAAGDPFAYPGAGGLYKRGSVRSLSTYSAAALQSDLEDSLYKAAGGGGPLYGDGYGFRLPPSSPQKLADVAAPPGGPPPPHSPYSGPPSRGSPVRQSFRKDSGSSSVFAESPGGKTRSAGSASTAGAPPSELFPGPGERSLVGFGPPVPAKDTETRERMEAMEKQIASLTGLVQSALLRGSEPETPSEKIEGSNGAATPSAPCGSGGRSSGATPVSGPPPPSASSTPAGQPTAVSRLQMQLHLRGLQNSASDLRGQLQQLRKLQLQNQESVRALLKRTEAELSMRVSEAARRQEDPLQRQRTLVEEERLRYLNDEELITQQLNDLEKSVEKIQRDVSHNHRLVPGPELEEKALVLKQLGETLTELKAHFPGLQSKMRVVLRVEVEAVKFLKEEPQRLDGLLKRCRGVTDTLAQIRRQVDEGVWPPPNNLLSQSPKKVTAETDFNKSVDFEMPPPSPPLNLHELSGPAEGASLTPKGGNPTKGLDTPGKRSVDKAVSVEAAERDWEEKRAALTQYSAKDINRLLEETQAELLKAIPDLDCASKAHPGPAPTPDHKPPKAPHGQKAAPRTEPSGRRGSDELTVPRYRTEKPSKSPPPPPPRRSFPSSHGLTTTRTGEVVVTSKKDSAFIKKAESEELEVQKPQVKLRRAVSEVARPASTPPIMASAIKDEDDEDRIIAELESGGGSVPPMKVVTPGASRLKAAQGQAGSPDKSKHGKQRAEYMRIQAQQQATKPSKEMSGSNETSSPVSEKPSASRTSIPVLTSFGARNSSISF

SEQ ID NO: 917499 - protein, 255 aa, Homo sapiens
MSFELNQMRANGNTTSNKNSAAMDAEIVLRSLMDFLDKTLSLSAKICEKTVLKRVLKELWKLVLNKIEKQIVLPPLTDQTGPQMIFIAAKDLGQLSKLKEHMIREDARGLTPRQCAIMEVVLATIKQYFHAGGNGLKKNFLEKSPDLQSLRYALSLYTQTTDALIKKFIDTQTSQKIIENVSTSQKSQMQAQTSEPNKSYTTEIIKNPHITQLLTMIKPNGQHQSPVNKSCFLLVLLNQPKPHPHGKAPGQSSRP

SEQ ID NO: 917500 - protein, 378 aa, Homo sapiens
MGISGAGKARDPRIFFMDVSFSIHAPTLCFCSLAHELRLSCMERKKVQIRSMDPSALASDRFNLILADTNSDRLFTVNDVKVGGSKYGIINLQSLKTPTLKVFMHENLYFTNRKWSLACLEGSHTLHSPIPLAGIDRPGMLCSFRIPGAWSCAWSLNIQANNCFSTGLSRRVLLTNVVTGHRQSFGTNSDVLAQQFALMAPLLFNGCRSGEIFAIDLRCGNQGKGWKATRLFHDSAVTSVRILQDEQYLMASDMAGKVGDHGLSQATGSRGPVPCQIKLWDLRTTKCVRQYEGHVNEYAYLPLHVHEEEGILVAVGQDCYTRIWSLHDARLLRTIPSPYPASKADIPSVAFSSRLGGSRGAPGLLMAVGQDLYCYSYS

SEQ ID NO: 917501 - protein, 284 aa, Homo sapiens
MDEESELIQPQDQSCWAFLPDLCLCRVFWWLGDRDRSRAALVCRKWNQMMYSAELWRYRTITFSGRPSRVHASEVESAVWYVKKFGRYLEHLEVKFMNPYNAVLTKKFQVTMRGLLSCLSKSNNRLKSLSIQYLELDRLVWRNSIRSSFISSLSFFLKKMGKRLDYLNLKGARLTVEQGCQILDSLSYMRNENVISELNIEDYFSHHLAVYNSPQFKKTMSTFHNLVSLNLNYNCISDELLENLCENASTLRTINIKCHVHDPHGQVIWGDPDQEHQSEKLLFQ

SEQ ID NO: 917502 - protein, 784 aa, Homo sapiens
TVTVAVGTILNWVTKEAFLMRHHLSRYLKGTVTLDRSNKGFHNCYQVREESDIISLSQEPDEHPGDIFFKQTPTKDILTELYKLTTERERLLTNLLSSDHILGITMGNQEGKLQELSVSLAPEDDCFQSAGDWQGELPVGPLNKRSTHGNKKPRRSSGRRESFGALPQKRTKRKGRGGRESAPLMGKDKICSSHSLPLSRTRPNLWVLEEKGNLLPNGALACSLQRRESCPPDIPKTPDTDLGFGSFETAFKDTGLGREVLPPDCSSTEAGGDGIRRPPSGLEHQQTGLSESHQDPEKHPEAEKDEMEKPAKRTCKQKPVSKVVAKVQDLSSQVQRVVKTHSKGKETIAIRPAAHAEFVPKADLLTLPGAEAGAHGSRRQGKERQGDRSSQSPAGETASISSVSASAEGAVNKVPLKVIESEKLDEAPEGKRLGFPVHTSVPHTRPETRNKRRAGLPLGGHKSLFLDLPHKVGPDSSQPRGDKKKPSPPAPAALGKVFNNSASQSSTHKQTSPVPSPLSPRLPSPQQHHRILRLPALPGEREAALNDSPCRKSRVFSGCVSADTLEPPSSAKVTETKGASPAFLRAGQPRLVPGETLEKSLGPGKTTAEPQHQSPPAFHWDLQQHFQEPVIRTVSISCASNLIKEEAGKGKESRSGNQRKKAIQRGPWITHSPERKQIPARLKAQGKACVVTGAQTGEINGGDPLSGTVVSGRDTQRRGSCGDKYPGLTLLWTTSCKPPLTEPTRKQSVKEPSQGLWSTGSAFHGQEQVEKNGEWIWRSQWESG

SEQ ID NO: 917503 - protein, 234 aa, Homo sapiens
MSCPGCAEPRGFPILLLADQGLCIMTLTVPHIWLPPPRYYLMSSSAGSQTGVLRSGDAACSLQRRSLANTRSCPPEQNIVSLNISIGVPSLHRGPPLSGGVHSKTPSGSLKLGKGAYSVETLDKGGRVSRVGSVTLLRVPSAHPPPASGPVAGSQGNLSKVVASETTAPYQAPSLDPSCHLPAVCPGTHGSSPAAPQHPGLGHVSAASRNPVLLLTIKLCRAPSGNRSPKERGL

SEQ ID NO: 917504 - protein, 342 aa, Homo sapiens
MLGAMFRAGTPMPPNLNSQGGGHYFIDRDGKAFRHILNFLRLGRLDLPRGYGETALLRAEADFYQIRPLLDALRELEASQGTPAPTAALLHADVDVSPRLVHFSARRGPHHYELSSVQVDTFRANLFCTDSECLGALRARFGVASGDRAEGSPHFHLEWAPRPVELPEVEYGRLGLQPLWTGGPGERREVVGTPSFLEEVLRVALEHGFRLDSVFPDPEDLLNSRSLRFVPGILVHICVADYSVCDVRMSRPVWDEVSMNKVTEKTHRVLRVMEIKEAVSSLPSYWSWLRKTKLPEYTREGGSTTLYNCSTCKGTEVSCWPRKRCFPGPHAHLGPAPPCPDP

SEQ ID NO: 917505 - protein, 342 aa, Homo sapiens; identical to SEQ ID NO: 917504

SEQ ID NO: 917506 - protein, 272 aa, Homo sapiens
MEEESGEELGLDRSTPKDFHFYHMDLYDSEDRLHLFPEENTRMRKVVQAEMANESRGAGDGKAQRDLQEEVDELVHLYGLEDDHELGDEFVDENIPRTGVSEYPPYMMKRRDPAREQRDWRLSGEAAEAEDLGFGGWGSAGQCQDLREAYRYTHGRASEEYECYVIPEEEDEEEAADVFCVTCKTPIRAFQKVFDEHKEHEVIPLNEALESAKDEIHKNMYKLEKQIIEMENFANHLEEVFITVEVRAHLKTSSDSHFFHQWLCQAAVSGMS

SEQ ID NO: 917507 - protein, 376 aa, Homo sapiens
LVFWSLFIMSLQLLSLKEFLRGNGLAAGKMNISIDLDTNYAELVLNVGRVTLGENNRKKMKDCQLRKQQNENVSRAVCALLNSGGGVIKAEVENKGYSYKKDGIGLDLENSFSNMLPFVPNFLDFMQNGNYFHIFVKSWSLETSGPQIATLSSSLYKRDVTSAKVMNASAALEFLKDMEKTGGRAYLRPEFPAKRACVDVQEESNMEALAADFFNRTELGYKEKLTFTESTHVEIKNFSTEKLLQRITEILPQYVSAFANTDGGYLFVGLNEDKEVIGFKAEKSYLTKLEEVTKNSIGKLPVHHFCVEKGTINYLCKFLGVYDKGRLCGYVYALRVERFCCAVFAKKPDSWHVKDNRVKQLTEKEWIQFMVDSEPG

SEQ ID NO: 917508 - protein, 376 aa, Homo sapiens; identical to SEQ ID NO: 917507

SEQ ID NO: 917509 - protein, 376 aa, Homo sapiens; identical to SEQ ID NO: 917507

SEQ ID NO: 917510 - protein, 126 aa, Homo sapiens
RRPSAGGMSLYDRNAFRHVWGGHGDWGEEEKKTRVEKQTGSEDWEKNASIYWSFTTEQVNGLGTLEWVWPWGITQPLFRAFYFPSSIKSRNNDKNGGRFVSHHYPAPPLLFVHVERPLGLRCPPPV

SEQ ID NO: 917511 - protein, 471 aa, Homo sapiens
MPLEVLDVTKIIKYVSNFAEMEQEPQNGEPAEIKIIREAYKKAFLFVNKGLNTDELGQKEEAKNYYKQGIGHLLRGISISSKESEHTGPGWESARQMQQKMKETLQNVRTRLEILEKGLATSLQNDLQEVPKLYPEFPPKDMCEKLPEPQSFSSAPQHAEVNGNTSTPSAGAVAAPASLSLPSQSCPAEAPPAYTPQAAEGHYTVSYGTDSGEFSSVGEEFYRNHSQPPPLETLGLDADELILIPNGVQIFFVNPAGEVSAPSYPGYLRIVRFLDNSLDTVLNRPPGFLQVCDWLYPLVPDRSPVLKCTAGAYMFPDTMLQAAGCFVGVVLSSELPEDDRELFEDLLRQMSDLRLQANWNRAEEENEFQIPGRTRPSSDQLKEASGTDVKQLDQGNKDAKDTSSEEVNLSHIVPCEPVPEEKPKELPEWSEKVAHNILSGEFIGFKRPCCSRRVITGFNLFKACCGMGYWR

SEQ ID NO: 917512 - protein, 125 aa, Homo sapiens
MVKGFAAFLPLPFPWVHTALSGHRVLLITVLVVEGIAVAQKTQDGQNIGIKHIPATQCGIWVRTSNGGHFASPNYPDSYPPNKECIYILEAAPRQRIELTFDEHYYIEPSFECRSLLWREKPSIN

SEQ ID NO: 917513 - protein, 237 aa, Homo sapiens
MGAPRPPLQWIPRRGRGRSCLPVPRRASALLGPRAVDGTGRRGAGGGARRGARAAREPTVGLGHGGPQDLSSPQGSGEAAAGRRWGRSGAVAAAPSRERRATAAATSALRRSAGQLGNMALERLLLVLKVLLITVLVVEGIAVAQKTQDGQNIGIKHIPATQCGIWVRTSNGGHFASPNYPDSYPPNKECIYILEDPDFTLPRRDQQQISAERGKTGRKNGTTPEDAGLLNGSRCIQ

SEQ ID NO: 917514 - protein, 146 aa, Homo sapiens
QRPAYNNGMLFIFKVLQQLLLRYREALWFSKKHTQTLESERPDSPVYDINICGLEGHCLISPPESNFSWAVEIGHTIANSDTALPLSCLSLPPVISLNGSGSLTVPGVLGVKAAHARSCFPPGNVEPRRPRKSDQLQIPKLVFLHP

SEQ ID NO: 917515 - protein, 261 aa, Homo sapiens
MGQPELPPDPCCAPRALIPGHSLLSPSPRPSDLDSFKGSEKAQVTVGPLFPGAKLLASCLFKPSVLETGQHPPRRHRPSLSCSAANVKKWEIELQTLRESNARLTTALQESAASVEQWKRQFSICRDENDRLRNKIDELEEQCSEINREKEKNTQLKRRIEELEAELREKETELKDLRKQSEIIPQLMSECEYVSEKLEAAERDNQNLEDKVRSLKTDIEESKYRQRHLKVELKSFLEVLDGKIDDLHDFRRGLSKLGTDN

SEQ ID NO: 917516 - protein, 168 aa, Homo sapiens
MPPAPLALEPTECSTGQHLSVIKTLRFHPGAVKQTGLTTRHVAEPQRKPRLLLLRKIQAPRPLWAVAAQAIFDFSLSFIPRILYVKEYLALPSKYPESNHFSPPPMLPPWSKPPSSNGAISMVFPLDHCSGLLTAIASYFHLVPPTIYSQHIGRIILPTYLDLPVLST

SEQ ID NO: 917517 - protein, 140 aa, Homo sapiens
LSKLMQERKTKYRMFLLIAPLHSSLGDRAIDSSSKKKKKGKETVFTIHQAGVDHHKGLAEVEENSRRSGPTNFNPVLFKSQLYCFMYFEDIERMYNMYIMHVHELYWNQVVPYPLDTTKPASHCPWWGILFRSAISMWPM

SEQ ID NO: 917518 - protein, 305 aa, Homo sapiens
MLLLLTVGSQPSLKAITLTVKVCGFTPEIKRVYEPTGRKKLQTPKEQTLDTPNVRIVTLTATVRGVHPRSFFLEVAETKSAPKGTNCGHIRFSGIIVLGSLDNREIAFSEAHDKHPTVNISMLLCPSHGAWGLRDCAVRQQLTSPAVGLVLPATTSPSCHHVKKDVFASPSTVIVNFPWKSIDDQVMLAATVLKALTLLKGASSHLCRIVVGTGKQSGTELCLFSRNVTSEIGSFNLHMGRGHTDMQTDADTWRPTIKRRNPDNDHIKGDQYGLKTRGSFSESSGQQKTVKIPMQCGEGEGPPKT

SEQ ID NO: 917519 - protein, 149 aa, Homo sapiens
HIFIIMEHIEVVYTYLNGNKNAQIRRNKLASHSSHVEAWCNGVHGIAPTTESYPAQYQQRWSILLRTLVYCARKKMPPASLWHHCIRAQTCRPAVMLGRPRHKAQRTLVKWAVRRRQTQPWAGGAALLCCCSLWWEDCLSSEGQGCSEL

SEQ ID NO: 917520 - protein, 506 aa, Homo sapiens
AGRQEGWGEHWGAMERAEEPVVYQKLLPWEPSLESEEEVEEEETSEALVLNPRRHQDSSRNKAGGLPGTWARVVAALLLLAVGCSLAVRQLQNQGRSTGSLGSVAPPPGGHSHGPGVYHHGAIISPAGRELLVAGGNVVDAGVGAALCLAVVHPHATGLGAMFWGLFHDSSSGNSTALTSGPAQTLAPGLGLPAALPTLHLLHARFGRLPWPRLLVGPTTLAQEGFLVDTPLARALVARGTEGLCPLLCHADGTPLGAGARATNPQLAAVLRSAALAPTSDLAGDALLSLLAGDLGVEVPSAVPRPTLEPAEQLPVPQGILFTTPSPSAGPELLALLEAALRSGAPIPDPCPPFLQTAVSPESSALAAVDSSGSVLLLTSSLNCSFGSAHLSPSTGVLLSNLVAKSTTSAWACPLILRGSLDDTEADVLGLVASGTPDVARAMTHTLLRHLAARPPTQAQHQHQGQQEPTEHPSTCGQGTLLQVAAHTEHAHVSSVPHACCPFQGF

SEQ ID NO: 917521 - protein, 489 aa, Homo sapiens
AGRQEGWGEHWGAMERAEEPVVYQKLLPWEPSLESEEEVEEEETSEALVLNPRRHQDSSRNKAGGLPGTWARVVAALLLLAVGCSLAVRQLQNQGRSTGSLGSVAPPPGGHSHGPGVYHHGAIISPAGRELLVAGGNVVDAGVGAALCLAVVHPHATGLGAMFWGLFHDSSSGNSTALTSGPAQTLAPGLGLPAALPTLHLLHARFGRLPWPRLLVGPTTLAQEGFLVDTPLARALVARGTEGLCPLLCHADGTPLGAGARATNPQLAAVLRSAALAPTSDLAGDALLSLLAGDLGVEVPSAVPRPTLEPAEQLPVPQGILFTTPSPSAGPELLALLEAALRSGAPIPDPCPPFLQTAVSPESSALAAVDSSGSVLLLTSSLNCSFGSAHLSPSTGVLLSNLVAKSTTSAWACPLILRGSLDDTEADVLGLVASGTPDVARAMTHTLLRHLAARPPTQAQHQHQVSPMPAAPSRGSNRMGVGLAEGRVI

SEQ ID NO: 917522 - protein, 699 aa, Homo sapiens
MNLRKSGPSWINDKTCWHMNLGEWMIRVWNSEVQHKRKVIFFHALSFYYCNRINKKVNQDKIDEALSKYRNMWQGKKYYYYDVENMKFNEKLMLTNLVIFHKAPQQGIWKAPFLLLTVTPNGMFPNPQNIWAAELRALLLAQPTGCSLLSLAQWLSEPQMEEPAGSPRPTWLYGTLTRHREKTQGDEQSISKSYQRDTVNASPPRFLPVAPAWSQASSSLSGPIGCPLLACLVSDCILWVTCMHTRTSVEDSEIKYLALVLAHNECSIMFLDIIYPEKIIDFSGDLKTYSHRIINQYFYTRILMYFYDYFTFVILNFVCAYFISFSLDDLEEYLFERFLKESVLGITCQFNWFLCACVQIEIISVFIDFFLLLSLSLFYGFVHDMPYCYSSLIMKIFHGMNLLLFTILTAFSCVLICGLQNIKIFVKGFLFLLVIGRNDYLSEMFKTRADFKKLISNFLKLEVVYTFNSIVVIFYCGLRMWTHTFYFGEFIDAFFVHNIIDFVNDFCGHLKVGCTCLYGMDFDVKTFSFISFLVFIWIFLVKNYIIYKQPYFESQSKSLLDVPGFCLFHYIGWNFLDGDLNVDEMKGLLSCFSHVLLSLLLLLDLRYVHHCLLTYLIFLGLEEFWIRCFYSFSLFWCYFISNANVHECYVIVVDYTFPLREVFNDLKSQKHICFLFICVPKLGSLTFSCNCFCKVLFES

SEQ ID NO: 917523 - protein, 156 aa, Homo sapiens
MHAFLCLFLFSLPASSACVWPGTSWQNGGPPGPDSGPGLEPLLDNIDDFLIDFVVPPPLHFGFIYAQCFTCPCEDTDAQHAAVLPVVVVIPVLCVLPLYKLSRGSPVGPLGGRRPSSGRRRGWAAKNFIISPFLFSQNRSCVNNKWKSLSSKIQLP

SEQ ID NO: 917524 - protein, 215 aa, Homo sapiens [sequence omitted]

SEQ ID NO: 917525 - protein, 223 aa, Homo sapiens
MIQEDHEGSQDGGVHSSPVSSPSVSGPRRLVSCLSSQSSALSQSGGGSTSAAGIEARSRALRRRWCPAGIMLLALVCLLSCLLPSSEAKLYGRCELARVLHDFGLDGYRGYSLADSYALPYAGVCLAYFTSGFNAAALDYEADGSTNNGIFQINSRRWCSNLTPNVPNVCRMYCSDLLNPNLKDTVICAMKITQEPQGLGYWEAWRHHCQGKDLTEWVDGCDF

SEQ ID NO: 917526 - protein, 158 aa, Homo sapiens
VPNMVLFLPVCGPGVGDPCISGRSLFVSSSMLTSKSMPFDTTQVFSPTCSPRKLLLGLQNVIQIVTSFPNTSIPLIPKQQAKGNSHEASASTTGPQKQETLRTNRGIGLSPAASRQFSSCPDGFQKRNAWEHHDLCRLPSIITGRSHDHEHIAFSIQH

SEQ ID NO: 917527 - protein, 158 aa, Homo sapiens; identical to SEQ ID NO: 917526

SEQ ID NO: 917528 - protein, 158 aa, Homo sapiens; identical to SEQ ID NO: 917526

SEQ ID NO: 917529 - protein, 158 aa, Homo sapiens
MDSSSEIWSHWGSLSRGRRSNKELSHFLWECKLVAYPELFVPPDGFVVPLTSGVKHRPTYPITSFLECRSHTTETTVASILKSLLQGQGPIYIFKLMVSKAVVFPRSHGVSTIEPNQEEFQSPSHPTACMQDSRWARCISRAHSAAGDGGVADCVEVA

SEQ ID NO: 917530 - protein, 136 aa, Homo sapiens
MRPSRLYHISSPSLGRFYPRDPGSPQSPPPLPASGASETSGGGGGNLQVAPTPSAGSRRRPLRGRTARSQRRGPRAVGIEARRVAQARPGPEAPCPAQPPADPRAPPAAASTARRWASGGGARKVTAVAFLSALFT

SEQ ID NO: 917531 - protein, 136 aa, Homo sapiens; identical to SEQ ID NO: 917530

SEQ ID NO: 917532 - protein, 136 aa, Homo sapiens; identical to SEQ ID NO: 917530

SEQ ID NO: 917533 - protein, 136 aa, Homo sapiens; identical to SEQ ID NO: 917530

SEQ ID NO: 917534 - protein, 136 aa, Homo sapiens; identical to SEQ ID NO: 917530

SEQ ID NO: 917535 - protein, 193 aa, Homo sapiens [sequence omitted]

SEQ ID NO: 917536 - protein, 264 aa, Homo sapiens; identical to SEQ ID NO: 915526

SEQ ID NO: 917537 - protein, 103 aa, Homo sapiens
MLPGLVSNSWAKVILPPQPPKALGLLQRLKCSGTISAHCNLCLLGSSDSSASASQVAGITEMRSCSVARRGVQWYDDRSLQPQTPELKQSSCLSLPSCWNYRY

SEQ ID NO: 917538 - protein, 262 aa, Homo sapiens
MLPGLVSNSWAKVILPPQPPKALGLLQSWDLYPLLPLDIHAPGSQAFELGLGLIPLAPLVFRPLGLYWGYTTGFPGPPACRWQTVGLLSLHNPMRQYLTDRQKDIVQALKKVQPQTSFYLWRSPPTPLAALPKDPCGARQECPAWGPSELPGHFPLLPVPLYFSRLSKWTQPQRVCGSSWDSWFVLAVVLELKFTMQASACCSVHLSWSCNLVLPSICHDDCRNRHCFKGNGLAAHWPKQNSSKGSLTSKDTFSLHQRQERD

SEQ ID NO: 917539 - protein, 148 aa, Homo sapiens
MGQFYHHKNQEMSCFCPSVRISLEFKVSENRKHILGLQSTGPGSASTGWTLLGQPHGLLLTVVSCHQPVLSPACRVGLAAPGTASHAFLVLLKSPLWMVTLFMWPFLKQKVGSQAKSCLAVPRGMCCPPSLVMAGRGKTPLWSYEKCL

SEQ ID NO: 917540 - protein, 392 aa, Homo sapiens
PVHLPRVVVQWAVEHMCLALRGSIWVGEIPVWTTCGDEKNQSIIVSGESGAGKTVSAKYAMRYFATVGGSASETNIEEKVLASSPIMEAIGNAKTTRNDNSSRFGKYIQIGFDKRYHIIGANMRTYLLEKSRVVFQADDERNYHIFYQLCAAAGLPEFKELALTSAEDFFYTSQGGDTSIEGVDDAEDFEKTRQAFTLLGVKESHQMSIFKIIASILHLGSVAIQAERDGDSCSISPQDVYLSNFCRLLGVEHSQMEHWLCHRKLVTTSETYVKTMSLQQVINARNALAKHIYAQLFGWIVEHINKALHTSLKQHSFIGVLDIYGKSGKSGVQREQKEYWDEFLNTASHIREVEKNETLPPSQPSRCQGSRGLWLWPAHSCGGQLAWEQHRL

SEQ ID NO: 917541 - protein, 391 aa, Homo sapiens
PVHLPRVVVQWAVEHMCLALRGSIWVGEIPVWTTCGDEKNQSIIVSGESGAGKTVSAKYAMRYFATVGGSASETNIEEKVLASSPIMEAIGNAKTTRNDNSSRFGKYIQIGFDKRYHIIGANMRTYLLEKSRVVFQADDERNYHIFYQLCAAAGLPEFKELALTSAEDFFYTSQGGDTSIEGVDDAEDFEKTRQAFTLLGVKESHQMSIFKIIASILHLGSVAIQAERDGDSCSISPQDVYLSNFCRLLGVEHSQMEHWLCHRKLVTTSETYVKTMSLQQVINARNALAKHIYAQLFGWIVEHINKAPHPDVQHTFPSGKFSSELGRHTGWIISLNVSGPASFIRAMSLPSLCGLYLLWQTIFSTKWDGAGLSNRETRPTWMVHDLGRYKS

SEQ ID NO: 917542 - protein, 152 aa, Homo sapiens
MLSSLDLILKAVEPNRQRTHIVNFLTKFFVEAEFYYVAQDGLELLDSDLPTLASQSVGIMGVNHHAWPGFPNFLYQFTILPVAFESSHYFMCLPVLSFISLFNFSHSGDEHRKAVLTDQYEFARQKETWDVVAEDDDVKNKKGSKIVEQEWI

SEQ ID NO: 917543 - protein, 410 aa, Homo sapiens
MGPSAWCSHPGGTTPGRSRSVAEDGGKSLGCGWGGRWAEEGPALSFSGFGALSVDQSPPAQGVSAPSPSQPPSASPLPLTFPTPKDNLSLASDAHGFFQPLGLSFLLYLFCLFVHLMFLWARPWICFSLAFYILIFSYSLSLSLSLSPSLPPSLSPSLSPSLPLSLSLSSLSLSLLSLFSLSLLSPAIWALLLRASGLPAARQAHLLTSRSGIRRRRGWGQVRRPSPARAEAGSALAYPPPGPCPRPPLTGARGTQEREPLRAPSAVGVAAPDTDTASKRPHRGGGRRRRPRAATSPALGAVTVPRRPGLLQSTKTRGGRRGSERGRQRRRAGRQLQAEPRAPAGTGPFTRRGTQSCERILFSADSTPGRRLEVGLCLGLTRRETTELLPQPPAARNWKKKKKKKNPAGV

SEQ ID NO: 917544 - protein, 208 aa, Homo sapiens
MIHRTRVQAQELLSPWNQGAPPSEYIHVFTNQDAVEPYYVRCIKPNDKKSPQIFDDERCRHQVEYLGLLENVRVRRAGFAFRQTYEKFLHRLVGQKRVSKELTMTGSSQPYKDQSKEKMGQREQPGKRLYCGSKYKMISEEFTWPNHDLPSDKEAVKKLIERCGFQDDVAYGKTKIFIRTPRTLFTLEELRAQMLIRIVLFLQKETVR

SEQ ID NO: 917545 - protein, 127 aa, Homo sapiens
MHIKYIKYLHQCLMKGQFKCQVKRKELWPFRDPRPGSSPTLGCDSLFGALQFLESPSFWATPHSLVAAVEAACRVPGPAAALQRVGACASTCSCPALQQQPVKSIGLGDEFCFDDDVDDSQASDLGH

SEQ ID NO: 917546 - protein, 359 aa, Homo sapiens
MCSCRGVGLGEEPPECSCIFHDKDHTVGLIPAQWENVWRCPATREEVYVSTITSIQATYKRRQGDSSDTPGEVSSMAGSLYNAFSAANATQHHLFPGYNSKELLKEALVSAPREILVRMTHGRACVFIGLEGRQTLVKTWAVTVSLRYLKSGYPCCVRLIYDESYRDIQFFSIKYCFGRLPGQRPAFRQGVLASPPTQVPNATSKDFLDTMAASGKIVFVSTMWKSQEWMAGHGQCADLAGPIHPQRPLPSCPGCAEDAGMLRAVPPHGTRREVVRGEFALFNDAQYTVDLFSVSDLTRCLLGPDADLGDTILIVTFHPGRMPYGNATSEMVVGVSTTGQGDFLEEANFGEQALTLGLR

SEQ ID NO: 917547 - protein, 494 aa, Homo sapiens
MASALSYVSKFKSFVILFVTPLLLLPLVILMPAKVCVQYMKDTNMLFLGGLIVAVAVERWNLHKRIALRTLLWVGAKPARLMLGFMGVTALLSMWISNTATTAMMVPIVEAILQQMEATSAATEAGLELVDKGKAKELPGSQVIFEGPTLGQQEDQERKRLCKAMTLCICYAASIGGTATLTGTGPNVVLLGQMNELFPDSKDLVNFASWFAFAFPNMLVMLLFAWLWLQFVYMRFNFKKSWGCGLESKKNEKAALKVLQEEYRKLGPLSFAEINVLICFFLLVILWFSRDPGFMPGWLTVAWVEGETKYVSDATVAIFVATLLFIVPSQKPKFNFRSQTEEERKTPFYPPPLLDWKVTQEKVPWGIVLLLGGGFALAKGSEASGLSVWMGKQMEPLHAVPPAAITLILSLLVAVFTECTSNVATTTLFLPIFASMSRSIGLNPLYIMLPCTLSASFAFMLPVATPPNAIVFTYGHLKVADMVTQLFLFTPVGL

SEQ ID NO: 917548 - protein, 109 aa, Homo sapiens [sequence omitted]

SEQ ID NO: 917549 - protein, 109 aa, Homo sapiens [sequence omitted]

SEQ ID NO: 917550 - protein, 109 aa, Homo sapiens [sequence omitted]

SEQ ID NO: 917551 - protein, 104 aa, Homo sapiens [sequence omitted]

SEQ ID NO: 917552 - protein, 168 aa, Homo sapiens
MTVKGGVRGKVDRPRVATVLKVHNARDKLVAQIAGLQASKDQQLFDGIIVGSPGRSISPFGTKTFRQAEHKVTGTGGQVLQDGEEHDKTNEVHEHKPIATLLCYEKQMNILSVRSKTWGKWIYESWVIGTPRSRGGVTVLQNSFSPMLTYKTVLGDLSIKLQHALQKN

SEQ ID NO: 917553 - protein, 149 aa, Homo sapiens
SSGSWDRGSVTNMQLFVRAQELHTLEVTGQEMVAQIKAHVASLEGIAPEDQVVLLAGAPLEDEATLGQCGVEALTALEVAGRMLGGKVHGSLARAGKVRGQTPKVAKQEKKKKKRKKKTGQATRRMQYNRRFVNVVPTFSKKKGPNANS

SEQ ID NO: 917554 - protein, 137 aa, Homo sapiens
MKDVYLKTMRAVLSAISRGLYSACFPPLLPITEAGTERELSELWVDEKRPRTFSDRAQVQTSPTLFIRSTHSYRTQRGFVTGLPLMLTENNRGKSFDEEGIVPRAKCYGKVREIGGREEAIGLGRGNSTKLHWEGQI

SEQ ID NO: 917555 - protein, 153 aa, Homo sapiens
MFFPACEDRASRKGAHTRTQTYWHPDFRLPASRAVGSKCLVFKPSNLWFFIMVAQADRQYPNLGFQYFRHIIWISYSEIVNYAFQLDVSKNLVQWRKMMKDFPMGKASQTGSGAGDLQELGECILPCSLKRKETMSSIQSRPQRTQRLSAPWH

SEQ ID NO: 917556 - protein, 204 aa, Homo sapiens
MELSALHILASRLWRIPPASGDQRNTKALNPHSTWVAVFTPLCNYETHCLNKNLASLGCKTKAAGEVQGLRILQRPSVGFWEFCLETDDMAELLLGESKLEQYLKEHPLRQGASPRGPKPQLTEVRKHLTAALDRGNLKSEFLQESNLIMAKLNYVEGDYKEALNIYARVGLDDLPLTAVPPYRLRVIAEAYATKGSRSVARLV

SEQ ID NO: 917557 - protein, 845 aa, Homo sapiens
MELSALHILASRLWRIPPASGDQRNTKALNPHSTWVAVFTPLCNYETHCLNKNLASLGCKTKAAGEVQGLRILQRPSVGFWEFCLETDDMAELLLGESKLEQYLKEHPLRQGASPRGPKPQLTEVRKHLTAALDRGNLKSEFLQESNLIMAKLNYVEGDYKEALNIYARVGLDDLPLTAVPPYRLRVIAEAYATKGLCLEKLPISSSTSNLHVDREQDVITCYEKAGDIALLYLQEIERVILSNIQNRSPKPGPAPHDQELGFFLETGLQRAHVLYFKNGGTDGNIKEPRMWFRVIEQDETRNLTRGVGRFRELLRAVETRTTQNLRMTIARQLAEILLRGMCEQSYWNPLEDPPCQSPLDDPLRKGANTKTYTLTRRARVYSGENIFCPQENTEEALLLLLISESMANRDAVLSRIPEHKSDRLISLQSASVVYDLLTIALGRRGQYEMLSECLERAMKFAFEEFHLWYQFALSLMAAGKSARAVKVLKECIRLKPDDATIPLLAAKLCMGSLHWLEEAEKFAKTVVDVGEKTSEFKAKGYLALGLTYSLQATDASLRGMQEVLQRKALLAFQRAHSLSPTDHQAAFYLALQLAISRQIPEALGYVRQALQLQGDDANSLHLLALLLSAQKHYHDALNIIDMALSEYPENFILLFSKVKLQSLCRGPDEALLTCKHMLQIWKSCYNLTNPSDSGRGSSLLDRTIADRRQLNTITLPDFSDPETGNSPEAYFHGFPSLFSVSSVHATSVAASRVEQALSEVASSLQSSAPKQGPLHPWMTLAQIWLHAAEVYIGIGKPAEATACTQEAANLFPMSHNVLYMRGQIAELRGSMDEARRWYEEALAI

SEQ ID NO: 917558 - protein, 828 aa, Homo sapiens
MELSALHILASRLWRIPPASGDQRNTKALNPHSTWVAVFTPLCNYETHCLNKNLASLGCKTKAAGEVQGLRILQRPSVGFWEFCLETDDMAELLLGESKLEQYLKEHPLRQGASPRGPKPQLTEVRKHLTAALDRGNLKSEFLQESNLIMAKLNYVEGDYKEALNIYARVGLDDLPLTAVPPYRLRVIAEAYATKGLCLEKLPISSSTSNLHVDREQDVITCYEKAGDIALLYLQEIERVILSNIQNRSPKPGPAPHDQELGFFLETGLQRAHVLYFKNGGTDGNIKEPRMWFRVIEQDETRNLTRGVGRFRELLRAVETRTTQNLRMTIARQLAEILLRGMCEQSYWNPLEDPPCQSPLDDPLRKGANTKTYTLTRRARVYSGENIFCPQENTEEALLLLLISESMANRDAVLSRIPEHKSDRLISLQSASVVYDLLTIALGRRGQYEMLSECLERAMKFAFEEFHLWYQFALSLMAAGKSARAVKVLKECIRLKPDDATIPLLAAKLCMGSLHWLEEAEKFAKTVVDVGEKTSEFKAKGYLALGLTYSLQATDASLRGMQEVLQRKALLAFQRAHSLSPTDHQAAFYLALQLAISRQIPEALGYVRQALQLQGDDANSLHLLALLLSAQKHYHDALNIIDMALSEYPENFILLFSKVKLQSLCRGPDEALLTCKHMLQIWKSCYNLTNPSDSGRGSSLLDRTIADRRQLNTITLPDFSDPETGSVHATSVAASRVEQALSEVASSLQSSAPKQGPLHPWMTLAQIWLHAAEVYIGIGKPAEATACTQEAANLFPMSHNVLYMRGQIAELRGSMDEARRWYEEALAI

SEQ ID NO: 917559 - protein, 590 aa, Homo sapiens
MELSALHILASRLWRIPPASGDQRNTKALNPHSTWVAVFTPLCNYETHCLNKNLASLGCKTKAAGEVQGLRILQRPSVGFWEFCLETDDMAELLLGESKLEQYLKEHPLRQGASPRGPKPQLTEVRKHLTAALDRGNLKSEFLQESNLIMAKLNYVEGDYKEALNIYARVGLDDLPLTAVPPYRLRVIAEAYATKGLCLEKLPISSSTSNLHVDREQDVITCYEKAGDIALLYLQEIERVILSNIQNRSPKPGPAPHDQELGFFLETGLQRAHVLYFKNGGTDGNIKEPRMWFRVIEQDETRNLTRGVGRFRELLRAVETRTTQNLRMTIARQLAEILLRGMCEQSYWNPLEDPPCQSPLDDPLRKGANTKTYTLTRRARVYSGENIFCPQENTEEALLLLLISESMANRDAVLSRIPEHKSDRLISLQSASVVYDLLTIALGRRGQYEMLSECLERAMKFAFEEFHLWYQFALSLMAAGKSARAVKVLKECIRLKPDDATIPLLAAKLCMGSLHWLEEAEKFAKTVVDVGEKTSEFKAKGYLALGLTYSLQATDASLRGMQEVLQRKALLAFQRYNHKNEIIWKHSPMM

SEQ ID NO: 917560 - protein, 231 aa, Homo sapiens
MTSTRFSAVARASWLVSPPPQYVSQDAYPQIPPNPGELKEAGWGDQRLGSLWWAGVKGAWLVGLEGPRAQIPQLAQQLPSPERVRDSWKEDALFGYQFLNGANPVVLRRSAHLPARLVFPPGMEELQAQLEKELEQPLTSSCTQGGTLFEADFSLLDGIKANVSLCSQQHLAAPLVMLKLQPDGKLLPMVIQEEGSSDMGSDRRDGEDRWMRVQREMKERGKGSQARCLQK

SEQ ID NO: 917561 - protein, 608 aa, Homo sapiens
MEMESAAASTRFHQPHMERKMSAMACEIFNELRLEGKLCDVVIKVNGFEFSAHKNILCSCSSYFRALFTSGWNNTEKKVYNIPGISPDMMKLIIEYAYTRTVPITPDNVEKLLAAADQFNIMGIVRGCCEFLKSELCLDNCIGICKFTDYYYCPELRQKAYMFILHNFEEMVKVSAEFLELSVTELKDIIEKDELNVKQEDAVFEAILKWISHDPQNRKQHISILLPKVRLALMHAEYFMNNVKMNDYVKDSEECKPVIINALKAMYDLNMNGPSNSDFTNPLTRPRLPYAILFAIGGWSGGSPTNAIEAYDARADRWVNVTCEEESPRAYHGAAYLKGYVYIIGGFDSVDYFNSVKRFDPVKKTWHQVAPMHSRRCYVSVTVLGNFIYAMGGFDGYVRLNTAERYEPETNQWTLIAPMHEQRSDASATTLYGKVYICGGFNGNECLFTAEVYNTESNQWTVIAPMRSRRSGIGVIAYGEHVYAVGGFDGANRLRSAEAYSPVANTWRTIPTMFNPRSNFGIEVVDDLLFVVGGFNGFTTTFNVECYDEKTDEWYDAHDMSIYRSALSCCVVPGLANVEEYAARRDNFPGLALRDEVKYSASTSTLPV

SEQ ID NO: 917562 - protein, 72 aa, Homo sapiens
KGQGAEHHLERIRRSHQKHNAILASIKSSERDRLKAEWDQHNDCKILDSLVRARIKDAVQGFIINIEERRNK

SEQ ID NO: 917563 - protein, 472 aa, Homo sapiens
MYSQRFGTVQREVKGPTPKVVIVRSKPPKGQGAEHHLERIRRSHQKHNAILASIKSSERDRLKAEWDQHNDCKILDSLVRARIKDAVQGFIINIEERRNKLRELLALEENEYFTEMQLKKETIEEKKDRMREKTKLLKEKNEKERQDFVAEKLDQQFRERCEELRVELLSIHQKKVCEERKAQIAFNEELSRQKLVEEQMFSKLWEEDRLAKEKREAQEARRQKELMENTRLGLNAQITSIKAQRQATQLLKEEEARLVESNNAQIKHENEQDMLKKQKAKQETRTILQKALQERIEHIQQEYRDEQDLNMKLVQRALQDLQEEADKKKQKREDMIREQKIYHKYLAQRREEEKAQEKEFDRILEEDKAKKLAEKDKELRLEKEARRQLVDEVMCTRKLQVQEKLQREAKEQEERAMEQKHINESLKELNCEEKENFASQLNFVFLVETEFLHVGQAGLELLTSGDPPNLSL

SEQ ID NO: 917564 - protein, 203 aa, Homo sapiens
CEVIQRIPVRGDSLGRTILQKALQERIEHIQQEYRDEQDLNMKLVQRALQDLQEEADKKKQKREDMIREQKIYHKYLAQRREEEKAQEKEFDRILEEDKAKKLAEKDKELRLEKEARRQLVDEVMCTRKLQVQEKLQREAKEQEERAMEQKHINESLKELNCEEKENFASQLNFVFLVETEFLHVGQAGLELLTSGDPPNLSL

SEQ ID NO: 917565 - protein, 60 aa, Homo sapiens
MEEQMFSKLWEEDRLAKEKREAQEARRQKELMENTRLGLNAQITSIKAQRQATQLLKEEE

SEQ ID NO: 917566 - protein, 484 aa, Homo sapiens
MYSQRFGTVQREVKGPTPKVVIVRSKPPKGQGAEHHLERIRRSHQKHNAILASIKSSERDRLKAEWDQHNDCKILDSLVRARIKDAVQGFIINIEERRNKLRELLALEENEYFTEMQLKKETIEEKKDRMREKTKLLKEKNEKERQDFVAEKLDQQFRERCEELRVELLSIHQKKVCEERKAQIAFNEELSRQKLVEEQMFSKLWEEDRLAKEKREAQEARRQKELMENTRLGLNAQITSIKAQRQATQLLKEEEARLVESNNAQIKHENEQDMLKKQKAKQETRTILQKALQERIEHIQQEYRDEQDLNMKLVQRALQDLQEEADKKKQKREDMIREQKIYHKYLAQRREEEKAQEKEFDRILEEDKAKKLAEKDKELRLEKEARRQLVDEVMCTRKLQVQEKLQREAKEQEERAMEQKHINESLKELNCEEKENFARRQRLAQEYRKQLQMQIAYQQQSQEAEKEEKRREFEAGVAANKMFP

SEQ ID NO: 917567 - protein, 352 aa, Homo sapiens
MALKKSSPSLDSGDSDSEELPTFAFLKKEPSSTKRRQPEREEKIVVVDISDCEASCPPAPELFSPPVPEIAETVTQTQPVRLLSSESEDEEEFIPLAQRLTCKFLTHKQLSPEDSSSPVKSVLDHQNNEGASCDWKKQPFPKIPEVPLHDTPERSAADNKDLILDPCCQLPAYLSTCPGQSSSLAVTKTNSDILPPQKKTKPSQKVQGRGSHGCRQQRQARQKESTLRRQERKNAALVTRMKAQRPEECLKHIIVVLDPVLLQMEGGGQLLGALQTMECRCVIEAQAVPCSVTWRRRAGPSEGSLDSTMKGKETLQGFVTDITAKTAGKALSLVIVDQEKCFRFGFALVISC

SEQ ID NO: 917568 - protein, 197 aa, Homo sapiens
MKKNLFLWLKGLHKKTKPSQKVQGRGSHGCRQQRQARQKESTLRRQERKNAALVTRMKAQRPEECLKHIIVVLDPVLLQMEGGGQLLGALQTMECRCVIEAQAVPCSVTWRRRAGPSEDREDWVEEPTVLVLLRAEAFVSMIDNGKQGSLDSTMKGKETLQGFVTDITAKTAGKALSLVIVDQEKCFRFGFALVISC

SEQ ID NO: 917569 - protein, 542 aa, Homo sapiens
MALKKSSPSLDSGDSDSEELPTFAFLKKEPSSTKRRQPEREEKIVVVDISDCEASCPPAPELFSPPVPEIAETVTQTQPVRLLSSESEDEEEFIPLAQRLTCKFLTHKQLSPEDSSSPVKSVLDHQNNEGASCDWKKQPFPKIPEVPLHDTPERSAADNKDLILDPCCQLPAYLSTCPGQSSSLAVTKTNSDILPPQKKTKPSQKVQGRGSHGCRQQRQARQKESTLRRQERKNAALVTRMKAQRPEECLKHIIVVLDPVLLQMEGGGQLLGALQTMECRCVIEAQAVPCSVTWRRRAGPSEGSLDSTMKGKETLQGFVTDITAKTAGKALSLVIVDQEKCFSAQNPPRRGKQGANKQTKKQQQRQPEASIGSMVSRVDAEEALVDLQLHTEAQAQIVQSWKELADFTCAFTKAVAEAPFKKLRDETTFSFCLESDWAGGVKVDLAGRGLALVWRRQIQQLNRVSLEMASAVVNAYPSPQLLVQAYQQCFSDKERQNLLADIQVRRGEGVTSTSRRIGPELSRRIYLQMTTLQPHLSLDSAD

SEQ ID NO: 917570 - protein, 449 aa, Homo sapiens
MALKKSSPSLDSGDSDSEELPTFAFLKKEPSSTKRRQPEREEKIVVVDISDCEASCPPAPELFSPPVPEIAETVTQTQPVRLLSSESEDEEEFIPLAQRLTCKFLTHKQLSPEDSSSPVKSVLDHQNNEGASCDWKKQPFPKIPEVPLHDTPERSAADNKDLILDPCCQLPAYLSTCPGQSSSLAVTKTNSDILPPQKKTKPSQKVQGRGSHGCRQQRQARQKESTLRRQERKNAALVTRMKAQRPEECLKHIIVVLDPGPHMCLCPVLSYLRSGPPTDSPFSICCSALTDGRCSIPADLPPCAVFWVLWQDREDWVEEPTVLVLLRAEAFVSMIDNGKQGSLDSTMKGKETLQGFVTDITAKTAGKALSLVIVDQEKCFSLELLFFDFLPCTSAQNPPRRGKQGANKQTKKQQQRQPEASIGSMVSRVDAEEVRTSCCLNRAGYSLVT

SEQ ID NO: 917571 - protein, 571 aa, Homo sapiens [sequence omitted]

SEQ ID NO: 917572 - protein, 144 aa, Homo sapiens
MVSKEKYPVHESNPVIFKKTRHTDIQRSQGTITLEKSPHTEWLRRLSKEPVCLSTQNNPKQKQQSLRHPATRLQTILQGYKKEEGEGEGEEEEEEEEEEEEEEEEEEEGDLYVVNKHKKEKSSSSLETREMQIKTTMGYLLTPC

SEQ ID NO: 917573 - protein, 144 aa, Homo sapiens; identical to SEQ ID NO: 917572

SEQ ID NO: 917574 - protein, 144 aa, Homo sapiens; identical to SEQ ID NO: 917572

SEQ ID NO: 917575 - protein, 144 aa, Homo sapiens; identical to SEQ ID NO: 917572

SEQ ID NO: 917576 - protein, 144 aa, Homo sapiens; identical to SEQ ID NO: 917572

SEQ ID NO: 917577 - protein, 144 aa, Homo sapiens; identical to SEQ ID NO: 917572

SEQ ID NO: 917578 - protein, 144 aa, Homo sapiens; identical to SEQ ID NO: 917572

SEQ ID NO: 917579 - protein, 159 aa, Homo sapiens
MQLSSLPQFRPTCILFTWHQLKAKTPLCLSLFHAFLMKSQEKVSHPFIQHISIVQGIVEDVWAANSEPKVYEVETLSEKEEEEGKEEEEEEEEEEEEEEEEEEEEEEEEGEGEGEGEEEEEEEEEEEEEGEEGEGEEEEEEEEEEEEEEEEEEAEAATT

SEQ ID NO: 917580 - protein, 80 aa, Homo sapiens
RTHSTVPGACPPQKPADDFMGRSGVSPCCPSWSRILGLKPSAHTGLPRCCSISSSKMSQPSFEEEEKLDWGRIWGKMKPN

SEQ ID NO: 917581 - protein, 80 aa, Homo sapiens; identical to SEQ ID NO: 917580

SEQ ID NO: 917582 - protein, 159 aa, Homo sapiens; identical to SEQ ID NO: 917579

SEQ ID NO: 917583 - protein, 159 aa, Homo sapiens; identical to SEQ ID NO: 917579

SEQ ID NO: 917584 - protein, 159 aa, Homo sapiens; identical to SEQ ID NO: 917579

SEQ ID NO: 917585 - protein, 177 aa, Homo sapiens
MAPEKRPPHSDILESRPSLKASLLSSDLVGDGSFIYKPLTGAAAFLSVMPCPERRKLERQSGYSGFVALWRALPSPNFLVALFTLVSLKCSAPSWKTALADQFQEFPEMPGSFKQPAQLSRDVIEQELTNYQREGTKPLRRDLSSLPKHFPPGLTLNAGDQILTWYLVGTNPISSCF

SEQ ID NO: 917586 - protein, 157 aa, Homo sapiens
MNLSVLICKMGLFIPASACDTKKSRHREGKRLALGPTASSSTGANTEAPRFHGQGSLRYTLNADPGQRPRPPEATAEDFAANSFALSTTARGLLQGRITLRREEDTVSHERVSRQFRCSGSSPRPRPRTEAASSEKERTAAIALSAATTPKRIHLTG

SEQ ID NO: 917587 - protein, 489 aa, Homo sapiens
MNKSRWQSRRRHGRRSHQQNPWFRLRDSEDRSDSRAAQPAHDSGHGDDESPSTSSGTAGTSSVPELPGFYFDPEKKRYFRLLPGHNNCNPLTKESIRQKEMESKRLRLLQEEDRRKKIARMGFNASSMLRKSQLGFLNVTNYCHLAHELRLSCMERKKVQIRSMDPSALASDRFNLILADTNSDRLFTVNDVKVGGSKYGIINLQSLKTPTLKVFMHENLYFTNRKVNSVCWASLNHLDSHILLCLMGLAETPGCATLLPASLFVNSHPAGIDRPGMLCSFRIPGAWSCAWSLNIQANNCFSTGLSRRVLLTNVVTGHRQSFGTNSDVLAPLLFNGCRSGEIFAIDLRCGNQGKGWKATRLFHDSAVTSVRILQDEQYLMASDMAGKIKLWDLRTTKCVRQYEGHVNEYAYLPLHVHEEEGILVAVGQDCYTRIWSLHDARLLRTIPSPYPASKADIPSVAFSSRLGGSRGAPGLLMAVGQDLYCYSYS

SEQ ID NO: 917588 - protein, 496 aa, Homo sapiens
MNKSRWQSRRRHGRRSHQQNPWFRLRDSEDRSDSRAAQPAHDSGHGDDESPSTSSGTAGTSSVPELPGFYFDPEKKRYFRLLPGHNNCNPLTKESIRQKEMESKRLRLLQEEDRRKKIARMGFNASSMLRKSQLGFLNVTNYCHLAHELRLSCMERKKVQIRSMDPSALASDRFNLILADTNSDRLFTVNDVKVGGSKYGIINLQSLKTPTLKVFMHENLYFTNRKVNSVCWASLNHLDSHILLCLMGLAETPGCATLLPASLFVNSHPAGIDRPGMLCSFRIPGAWSCAWSLNIQANNCFSTGLSRRVLLTNVVTGHRQSFGTNSDVLAQQFALMAPLLFNGCRSGEIFAIDLRCGNQGKGWKATRLFHDSAVTSVRILQDEQYLMASDMAGKIKLWDLRTTKCVRQYEGHVNEYAYLPLHVHEEEGILVAVGQDCYTRIWSLHDARLLRTIPSPYPASKADIPSVAFSSRLGGSRGAPGLLMAVGQDLYCYSYS

SEQ ID NO: 917589 - protein, 434 aa, Homo sapiens
MNKSRWQSRRRHGRRSHQQNPWFRLRDSEDRSDSRAAQPAHDSGHGDDESPSTSSGTAGTSSVPELPGFYFDPEKKRYFRLLPGHNNCNPLTKESIRQKEMESKRLRLLQEEDRRKKIARMGFNASSMLRKSQLGFLNVTNYCHLAHELRLSCMERKKVQIRSMDPSALASDRFNLILADTNSDRLFTVNDVKVGGSKYGIINLQSLKTPTLKVFMHENLYFTNRKVNSVCWASLNHLDSHILLCLMGLAETPGCATLLPASLFVNSHPAGIDRPGMLCSFRIPGAWSCAWSLNIQANNCFSTGLSRRVLLTNVVTGHRQSFGTNSDVLAQQFALMAPLLFNGCRSGEIFAIDLRCGNQGKGWKATRLFHDSAVTSVRILQDEQYLMASDMAGKIKLWDLRTTKCVRQYEGHVNEYAYLPLHVHEEEGILVAGT

SEQ ID NO: 917590 - protein, 325 aa, Homo sapiens
MNKSRWQSRRRHGRRSHQQNPWFRLRDSEDRSDSRAAQPAHDSGHGDDESPSTSSGTAGTSSVPELPGFYFDPEKKRYFRLLPGHNNCNPLTKESIRQKEMESKRLRLLQEEDRRKKADTNSDRLFTVNDVKVGGSKYGIINLQSLKTPTLKVFMHENLYFTNRKAPLLFNGCRSGEIFAIDLRCGNQGKGWKATRLFHDSAVTSVRILQDEQYLMASDMAGKIKLWDLRTTKCVRQYEGHVNEYAYLPLHVHEEEGILVAVGQDCYTRIWSLHDARLLRTIPSPYPASKADIPSVAFSSRLGGSRGAPGLLMAVGQDLYCYSYS

SEQ ID NO: 917591 - protein, 115 aa, Homo sapiens
AFTCMWWRQNGNSGSLTPRPAHSATVACDGRLWVHYTDPVFLPEGWCGSRGTRRKGAAQPWGGSPAPPEAREENSGQESRVLLGEAEGKVREGVPLAVDMGLWALGLRSLLATAF

SEQ ID NO: 917592 - protein, 489 aa, Homo sapiens; identical to SEQ ID NO: 917587

SEQ ID NO: 917593 - protein, 396 aa, Homo sapiens [sequence omitted]

SEQ ID NO: 917594 - protein, 244 aa, Homo sapiens
MNKSRWQSRRRHGRRSHQQNPWFRLRDSEDRSDSRAAQPAHDSGHGDDESPSTSSGTAGTSSVPELPGFYFDPEKKRYFRLLPGHNNCNPLTKESIRQKEMESKRLRLLQEEDRRKKIARMGFNASSMLRKSQLGFLNVTNYCHLAHELRLSCMERKKVQIRSMDPSALASDRFNLILADTNSDRLFTVNDVKVGGSKYGIINLQSLKTPTLKVFMHENLYFTNRKVNSVCWASLNHLDSHILC

SEQ ID NO: 917595 - protein, 225 aa, Homo sapiens
MLNLEVFLYLEYCSLQILYYHFLQNITQDSPPGKSRFFFFFFFLRQSLALLPRLERSGASRLTASSASRVHAILLPQPPQQLGLQGCHRTALGHSQTYPLSFHLVVVEPHEFCKPLLIEVKQQHQLLLTNKALVLICLPHPRLPPAKAASGSLTSALCQPAFMLETPGCMMTNQSARKWFGTIRKAFSGSESKSESHSCSRSGLHGPCFDLHLQELLASVFAAGR

SEQ ID NO: 917596 - protein, 254 aa, Homo sapiens [sequence omitted]

SEQ ID NO: 917597 - protein, 178 aa, Homo sapiens [sequence omitted]

SEQ ID NO: 917598 - protein, 281 aa, Homo sapiens
WLHALPVMGPELGWGHPRGGDVCSSDSFNEDNTAFAKQVRSERPFFSSNPELDNLMIQAIQVLRFHLLELEKGKMPIDLVIEDRDGGCREDFEDYPASCPSLPDQNNIWIRDHEDSGSVHLGTPGPSSGGLASQSGDNSSDQGVGLDTSVASPSSGGEDEDLDQEPRRNKKRGIFPKVATNIMRAWLFQHLSHPYPSEEQKKQLAQDTGLTILQVNNWFINARRRIVQPMIDQSNRTGQGAAFSPEGQPIGGYTETEPHVAFRAPASVGMSLNSEGEWHYL

SEQ ID NO: 917599 - protein, 307 aa, Homo sapiens
MEDGGQREERKRNAKCGQPPRVKIEGSVMQVLDRRRQVGRAPQPPPQKRPPPGLSDPWGAGSASPRPHVAPAPMVPVPWMETASSGGQMWCSGIQSHFLPGHAWRTQQEEAQELGPAAQELGPATQAGLGTWQGLGILALDLGDLGGTGRGEMGGPAPAQCRPHPCTEAPPCHTPRRLPELKPRPQQREHPTPPPLQPVLLVKLPPSLQVGATPVRGCATCPQGTPLGIPGGGFWGRGGQSLVPVCVRDALHLQPGVVHGRGHGNSGPVDVTDDAERLLQRVVHVQHLVVLLCLLCQLLHQCVLVPT

SEQ ID NO: 917600 - protein, 419 aa, Homo sapiens [sequence omitted]

SEQ ID NO: 917601 - protein, 120 aa, Homo sapiens
MAFFEPKMREILEQNCTGDEDCNFFDCFSRCDLRVNKCGAQRVNNNLQVICDKIFRHWFSAPLKSSAVSFQLQLQLQEAVQECADPGVPSGNTRRAASSVFWKLRQLLQATLRELQEAEK

SEQ ID NO: 917602 - protein, 419 aa, Homo sapiens [sequence omitted]

SEQ ID NO: 917603 - protein, 419 aa, Homo sapiens [sequence omitted]

SEQ ID NO: 917604 - protein, 233 aa, Homo sapiens
MARAAGARGPAGWCRRRGRCGRGTLLAFAAWTAGWVLAAALLLRAHPGVLSERCTDEKSRRILAALVGPAAALPRAARPGRGDHTRSRSPAFPGTWVAVAPAGDMGSRHLRGVPEAHAPVPRMGTQPAVLCGRAGGVSPLFARIRPLSPDSLSVLPSPPLSPSSGRKFAGLIRVSREVPRPVSGRRARGASQCGVRDPGCHASVSRVRSAPAQPAFCDSTLSCQVTPYLTEPM

SEQ ID NO: 917605 - protein, 279 aa, Homo sapiens
MSNVYTAQSMQEIHEKVLNEVVGAMMYHTFSLTREDLENFKALRVIVQVGSGYDNVAIKAAGELEIAVCSIPSAAVEETADSTTGHILNLYWGNRSLYQALREGTRVQSVEQIGEVASVKARIRGEILGLIGFGRTQQEVAVRAKAFAGWDRAVPGIRGAALDVNESEPFSFARGLLKDAWNLICTPLTACYSQQVSLEMSEAVATEIRQAIISRIPGSLRNCVNKEFFVTSALWSVINQQEIHPELSGATYRYLPGMVGVAPGGLLQPGKTSSLETSQ

SEQ ID NO: 917606 - protein, 137 aa, Homo sapiens [sequence omitted]

SEQ ID NO: 917607 - protein, 602 aa, Homo sapiens
QEVLAPDSLSACSSPTDTASLATSCPSRPSRVSTTQMRPLKGTGCPGITTWYQKRCQPAGPMPKHLVRNTGLPSFIRWHSNCRVARAPWDPNLSLAKANWLPSGCGDRKEGPTSCWRSRCFSSGLSHSTATCSPQRCGCPSSRAFLAMAAVQCELNLSRAICPGAGPGLGSSRASCRPGPSGCSAGSSAGSSAVRVRFGGRQSTLSSHFPVLRHTSSGQDGRSGWLCSGRWRPARRAASCSGHMEAAVQAAEGHHQAELVEAAHALEQQDSWCSYTSWGSRPMNTSDPAGGGLPTQPGGGPPYFLCPPSVPKHPYSPHLSPHPLLPPPQRANAHEFESLGCDAILARRSQDRHSRGQLCEAMCSSPLGRKREKSLRLGFVPMVCSASDSHRCSAEPWERSGDLGRGRPGLSRRPTTGPPSVRPHTLPQARAWRKPRTARRRAAGPRRRKPRDARAHGPYASPPPGRARAPPRAPPALPTPTGRAPLCRPPARRPRRRRASASDSASVSRAGTRSPAPSSALALAGRAWTGERRSASAKSVSPAAAPPPREPFRVPENPAREIPGRPTHAGRFAVAKNQRPGTGRGTGVPKLFFGSSDERDSA

SEQ ID NO: 917608 - protein, 146 aa, Homo sapiens
MPVLVNENLSTEFGVSADEGRWLSGILDMKFHKNNEDDDLFKVKEILIQCFHFTVEDTGTHRGEVTCPQSCCSHQHSVVRSCPWRLGDAPALTLLLHWSSCHRFFWLNCVLTTKLRMLWLTNVLFSDSIGHGSPVLLGSNYGGMCL

SEQ ID NO: 917609 - protein, 120 aa, Homo sapiens
MWRSRMITGGAGPQPVSPPAPATPVKSSWHKKHGVCRHLEISTSTEVPGGSITKQAQNAVSASLYQESLSKSLSREISYPGHPAAGISTLFIKNIVSFFRVTECSTAYLLVSTKEEISCI

SEQ ID NO: 917610 - protein, 195 aa, Homo sapiens
YSSNIQMQAANNLNQENSRPLQEKNTESSENMTKFPSSRGKSTVSLNKNKQLSNSAVFVVSNNNLGVVKSAVDFQMKGKENLTGKGITQILGKSHGSLKLKRQPHIFESDGETEDPRLLQQQSENQAKEVGTSDHRLIVSKIAHRSKRKLCPESSKTSKKHHSDTVHYGQSSSSKKQILDSDKSKLKKSLIIHNA

SEQ ID NO: 917611 - protein, 94 aa, Homo sapiens
AAASPRDSHEHVHPQRGAGHCYGARQKAKPQTANREAAGTQGGRGGRIAGAQEFETCLGNILPPACQMLLMDSRSCRSDVARPPQHSAQGSQEE

SEQ ID NO: 917612 - protein, 138 aa, Homo sapiens
MRTNATADLTGGRAQAVMLTHPPAAPLLLCGPVTNSPWTGTDENVNTQRQSGPYEVTVREGAVESERTAGTQPLGSVSEPQRPAGLISWSPRDEGGNPWELAHGPKSNLSLPSLSISTRHSHQHHDSLQMLWKLLPFP

SEQ ID NO: 917613 - protein, 279 aa, Homo sapiens
DAQESKMFSCCFPTSRGCCFRNGGSESLFRQCRRRLIPHPRRLWPFVRRRTQVPQDSPGQALAGQATPEIPSGLPLYIVLVQEEIREPMEAQTHAPGPYADIAALAAPAVEPKPAWEEPPPERALEVEGAPAKDQPSQELPEIMAPTVATGLNAGAENVAGERSGREGVTSTAPASRSHAAPSPGHGGKHGGGDQGIQTGLLYLAGERLLSFARTTALLLQGLFIVLMLVGYISVQVVLKSIKTRLGRRVPAAPPALRRNLLLQAWMCVCNWASRLFAP

SEQ ID NO: 917614 - protein, 280 aa, Homo sapiens
MTQSFLRPPQKQQLPCFLYSLRNLRGVPKPQKSGSRQRSLQSVAKGPRAPGKPLLMPKPITNPGNKAHRSRMDAMHVDVASRKQAVLLPELVVLGRQHTYATGRPPGDTVGERDISPCCRLPLFLKPRFPPPLSGRSHPTHSQLIRQLGCLSPSCLTHCPTCSSCAGEPAFLMRRAPLVGVLCTEVPLCRRKGIKAPVNKWPQRGILNCKISGLNVSGSQSVGREAEEPWNSSRAVVEGRTRGAVGMSVEVQRLTSLEDRTWPLSSSVIMFQRNDRPPDH

SEQ ID NO: 917615 - protein, 272 aa, Homo sapiens
SLPGEWHETPSMALTSAALTHFLSRTHVASAHHPSRTHVASAYNSSHTRMASATCPGRTHVASAHHPGCTHVASAHRPGRTRVASAHRPGRTRVASAHRPGCTRVASAYRPGCTPWPLLNILAIPTWPTCVASAHRPSHTHVASAYRPSRTHVASAYRPSRTRVASAHHPSQTHVASAPSSQPLLFSKVKLQSLCRGPDEALLTCKHMLQIWKSCYNLTNPRARVGRTLAPGSVWWGLADGVGGRGPSGHSEFPLRLPAKPGGRSGELSSPY

SEQ ID NO: 917616 - protein, 188 aa, Homo sapiens
MMMMMMVMKVTVDDSDDDGDDEGDGNGDDGDEGDNDEDDDKGNEIDDGEGDGNGDDGEGDDEDDDNEGDDSDDDGEGDDDEVDDNGTDDGDDEGDGNGDDGDSHDGDGDDGDGDDEDDEGDDGEGDDYKGDGDDSDDDKGDNEGYGNGDDGDGDDSKDDEGVIKPYLAIKETVYHKEQHSLKGVDDGE

SEQ ID NO: 917617 - protein, 289 aa, Homo sapiens
TARFAVISFIAPSVPHLVLKCLLWMLQYVYCNIVVYWYQYLPLQKELYGDFEDLETGDMHKGKSGPDTQRNKEEIDPDEEESAKKKHLDKKRKLKEMFDAEYDEGESTYFDDLKGEMQKEAQENGSRGTGGCNCGKLLWGFAAERSREMKQFLVEEVESKGFELNHVEFEDQDDEARVQYDGFRPGMYIRVEIENVPCEFVQNFDPHYPIILGGLGNSEGNVGHVQMRLKKHRWYKKILKSQDPIIFSVGWRRFQTILLYYIEDHNGRQRLLKYTPQHMHCGAAFWGKI

SEQ ID NO: 917618 - protein, 170 aa, Homo sapiens
MPNIGTRLVSASVETSHVMARGHDGRSSQRISCIVAPEKNVTIRVRSLILVSAGRRKSSQEHCQDRDENRAHFSVSCDVRQAFQLCLLSPHGIVEAGNDPKFTTRKKLRIYNHKELNSANNPDALLEPSERNAACQHLDVISLYHFYIARAPTVAFLSVSFIQHLFLSFI

SEQ ID NO: 917619 - protein, 794 aa, Homo sapiens
MEMMLDKKQIQVIFLFKFKMGHKAAETTRSINNAFGPEIANKGTVQWWFKNFCKGDESREDEECCARPSKVGNDQLRAIIEADPLTTLEARPDRDYARGWWTAGCTDQAHPGPTGKKALFSPGLAAYTALKKDLAWRENLGIVSLVFKGMRLGEIKVNRLNRDKEVQKTGALRYGLNMRCLAARVNYKTLIIICALFTLVTVLLWNKCSSDKAIQFPRRSSSGFRVDGFEKRAAASESNNYMNHVAKQQSEEAFPQEQQKAPPVVGGFNSNVGSKVLGLKYEEIDCLINDEHTIKGRREGNEVFLPFTWVEKYFDVYGKVVQYDGYDRFEFSHSYSKVYAQRAPYHPDGVFMSFEGYNVEVRDRVKCISGVEGVPLSTQWGPQGYFYPIQIAQYGLSHYSKNLTEKPPHIEVYETAEDRDKNKPNDWTVPKGCFMANVADKSRFTNVKQFIAPETSEGVSLQLGNTKDFIISFDLKFLTNGSVSVVLETTEKNQLFTIHYVSNAQLIAFKERDIYYGIGPRTSWSTVTRDLVTDLRKGVGLSNTKAVKPTKIMPKKVVRLIAKGKGFLDNITISTTAHMAAFFAASDWLVRNQDEKGGWPIMVTRKLGEGFKSLEPGWYSAMAQGQAISTLVRAYLLTKDHIFLNSALRATAPYKFLSEQHGVKAVFMNKHDWYEEYPTTPSSFVLNGFMYSLIGLYDLKETAGEKLGKEARSLYERGMESLKAMLPLYDTGSGTIYDLRHFMLGIAPNLARWDYHTTHINQLQLLSTIDESPIFKEFVKRWKSYLKGSRAKHN

SEQ ID NO: 917620 - protein, 794 aa, Homo sapiens; identical to SEQ ID NO: 917619

SEQ ID NO: 917621 - protein, 454 aa, Homo sapiens
MEMMLDKKQIQVIFLFKFKMGHKAAETTRSINNAFGPEIANKGTVQWWFKNFCKGDESREDEECCARPSKVGNDQLRAIIEADPLTTLEARPDRDYARGWWTAGCTDQAHPGPTGKKALFSPGLAAYTALKKDLAWRENLGIVSLVFKGMRLGEIKVNRLNRDKEVQKTGALRYGLNMRCLAARVNYKTLIIICALFTLVTVLLWNKCSSDKAIQFPRRSSSGFRVDGFEKRAAASESNNYMNHVAKQQSEEAFPQEQQKAPPVVGGFNSNVGSKVLGLKYEEIDCLINDEHTIKGRREGNEVFLPFTWVEKYFDVYGKVVQYDGYDRFEFSHSYSKVYAQRAPYHPDGVFMSFEGYNVEVRDRVKCISGVEGVPLSTQWGPQGYFYPIQIAQYGLSHYSKNLTEKPPHIEVYETAEDRDKNKPNDWTVPKGCFMANVADKSRFTNVKQFIAPV

SEQ ID NO: 917622 - protein, 794 aa, Homo sapiens; identical to SEQ ID NO: 917619

SEQ ID NO: 917623 - protein, 371 aa, Homo sapiens
VRVFKDELQFNFKYKSAFILTIFVGIFSPTETSEGVSLQLGNTKDFIISFDLKFLTNGSVSVVLETTEKNQLFTIHYVSNAQLIAFKERDIYYGIGPRTSWSTVTRDLVTDLRKGVGLSNTKAVKPTKIMPKKVVRLIAKGKGFLDNITISTTAHMAAFFAASDWLVRNQDEKGGWPIMVTRKLGEGFKSLEPGWYSAMAQGQAISTLVRAYLLTKDHIFLNSALRATAPYKFLSEQHGVKAVFMNKHDWYEEYPTTPSSFVLNGFMYSLIGLYDLKETAGEKLGKEARSLYERGMESLKAMLPLYDTGSGTIYDLRHFMLGIAPNLARWDYHTTHINQLQLLSTIDESPIFKEFVKRWKSYLKGSRAKHN

SEQ ID NO: 917624 - protein, 812 aa, Homo sapiens
MEAFQELRKPSARLECDHCSFRGTDYENVQIHMGTIHPEFCDEMDAGGLGKMIFYQKSAKLFHCHKCFFTSKMYSNVYYHITSKHASPDKWNDKPKNQLNKETDPVKSPPLPEHQKIPCNSAEPKSIPALSMETQKLGSVLSPESPKPTPLTPLEPQKPGSVVSPELQTPLPSPEPSKPASVSSPEPPKSVPVCESQKLAPVPSPEPQKPAPVSPESVKATLSNPKPQKQSHFPETLGPPSASSPESPVLAASPEPWGPSPAASPESRKSARTTSPEPRKPSPSESPEPWKPFPAVSPEPRRPAPAVSPGSWKPGPPGSPRPWKSNPSASSGPWKPAKPAPSVSPGPWKPIPSVSPGPWKPTPSVSSASWKSSSVSPSSWKSPPASPESWKSGPPELRKTAPTLSPEHWKAVPPVSPELRKPGPPLSPEIRSPAGSPELRKPSGSPDLWKLSPDQRKTSPASLDFPESQKSSRGGSPDLWKSSFFIEPQKPVFPETRKPGPSGPSESPKAASDIWKPVLSIDTEPRKPALFPEPAKTAPPASPEARKRALFPEPRKHALFPELPKSALFSESQKAVELGDELQIDAIDDQKCDILVQEELLASPKKLLEDTLFPSSKKLKKDNQESSDAELSSSEYIKTDLDAMDIKGQESSSDQEQVDVESIDFSKENKMDMTSPEQSRNVLQFTEEKEAFISEEEIAKYMKRGKGKYYCKICCCRAMKKGAVLHHLVNKHNVHSPYKCTICGKAFLLESLLKNHVAAHGQSLLKCPRCNFESNFPRGFKKHLTHCQSRHNEEANKKLMEALEPPLEEQQI

SEQ ID NO: 917625 - protein, 276 aa, Homo sapiens
KLGTRPAEARKRALFPEPRKHALFPELPKSALFSESQKAVELGDELQIDAIDDQKCDILVQEELLASPKKLLEDTLFPSSKKLKKDNQESSDAELSSSEYIKTDLDAMDIKGQESSSDQEQVDVESIDFSKENKMDMTSPEQSRNVLQFTEEKEAFISEEEIAKYMKRGKGKYYCKICCCRAMKKGAVLHHLVNKHNVHSPYKCTICGKAFLLESLLKNHVAAHGQSLLKCPRCNFESNFPRGFKKHLTHCQSRHNEEANKKLMEALEPPLEEQQI

SEQ ID NO: 917626 - protein, 552 aa, Homo sapiens
MEAFQELRKPSARLECDHCSFRGTDYENVQIHMGTIHPEFCDEMDAGGLGKMIFYQKSAKLFHCHKCFFTSKMYSNVYYHITSKHASPDKWNDKPKNQLNKETDPVKSPPLPEHQKIPCNSAEPKSIPALSMETQKLGSVLSPESPKPTPLTPLEPQKPGSVVSPELQTPLPSPEPSKPASVSSPEPPKSVPVCESQKLAPVPSPEPQKPAPVSPESVKATLSNPKPQKQSHFPETLGPPSASSPESPVLAASPEPWGPSPAASPESRKSARTTSPEPRKPSPSESPEPWKPFPAVSPEPRRPAPAVSPGSWKPGPPGSPRPWKSNPSASSGPWKPAKPAPSVSPGPWKPIPSVSPGPWKPTPSVSSASWKSSSVSPSSWKSPPASPESWKSGPPELRKTAPTLSPEHWKAVPPVSPELRKPGPPLSPEIRSPAGSPELRKPSGSPDLWKLSPDQRKTSPASLDFPESQKSSRGGSPDLWKSSFFIEPQKPVFPETRKPGPSGPSESPKAASDIWKPVLSIDTEPRKPALFPEPAKTAPPASHLEEISRSES

SEQ ID NO: 917627 - protein, 812 aa, Homo sapiens; identical to SEQ ID NO: 917624

SEQ ID NO: 917628 - protein, 223 aa, Homo sapiens
MHAWLTEQPLGVLFPEELYGDFEDLETGDMHKGKSGPDTQNEDIENKEEIDPDEEESAKKKHLDKKRKLKEMFDAEYDEGESTYFDDLKGEMQKEAQLNHVEFEDQDDEARVQYDGFRPGMYVRVEIENVPCEFVQNFDPHYPIILGGLGNSEGNVGHVQMRLKKHRWYKKILKSQDPIIFSVGWRRFQTILLYYIEDHNGRQRLLKYTPQHMHCGAAFWGKI

SEQ ID NO: 917629 - protein, 161 aa, Homo sapiens
MNIQGQVWSVLLNIQEIKMKNPRKYQVMKEKGKRSSEHIHQVYLDMSWTLGNHIFFRDRYGVKSPGLTPRAQVRHLSSSSAEGISSSPRPPSAQAPASLGTHKWANQAQMAASPHPVSPGPAPLPGDDHEAQHPPYSGHPLSPNGGTVQGLQDHQEHVVPM

SEQ ID NO: 917630 - protein, 325 aa, Homo sapiens
MSGAVLWAHCRSENPCETGFKAIRSFLSKSESKTWRLALGQALHQAFQTQPFRSLLSSPTLCPAGSRPSARLFSSLALCFLLCKSVGSAGGFWDFLREQCQICGVRANSLRGSHTAHWAQLGAGHLLPGGARIPQETIMLMLSSIPQEPLLYQAHSRCRTCKDKSWWSLLLKREMEVKSQPTTGITEGPPLLSEPLTYTLSPQCAICGQHNCSSGHSQLSSTVIFPKGDKGCCSGPLPRNLPSLIVTLERSRALILHQLGRYSLAEKILRDAVQVNSTAHEVWNGLGEVLQAQGNDAAATECFLTALELEASSPAVPFTIIPRVL

SEQ ID NO: 917631 - protein, 425 aa, Homo sapiens
LSHRLSQSGLCQFFNVLTLISKSPCITCFVIMELDTLSISPLWGMSGISMAIGISGISSSEAPGGMKGSSLGSKAQGNLRHDALTGFGEEGGDEDKEDIKGQQGQQEGGAVLESGQPHTVQDEQAVGNAQCVLQEPRPAVLIAVGHPEDDHGCAQARQQQQRQRQRGPEAVRRPLAGPVAACSHCAHSQDEDDQHVVVDDGLWGCVHGHADDGLPTSVAEDVQHVSIVEHSHRDALLVTDPAHDEQPVGTLALSQPAFRVEAAVTPHDHGSGLAEGPLAGGAELGLVGGILTRAPGCLGAIIQGQEWGVVQVPGEGDVVGAEQDTVVLAPILRHHVGHAVLSPGHGADEEEEAHGEEEAQARHLLQFLLQHLRAAAQYPSQGQAWPFVTEQSGHLSWKPGPHLPSHKAVWSPAEGAAVGHRVPLE

SEQ ID NO: 917632 - protein, 95 aa, Homo sapiens
SPSLRRGRARGGGAGVHRGGRRGRFRSRGAYLIVDRGEDGRGQRRRRRWLWWRRQKESEQGRACDVSVYDEEDNVLRNGEEESEGNQVPGFHVEQ

SEQ ID NO: 917633 - protein, 174 aa, Homo sapiens
CPNEGMVSQLFPPHIRLFYRYQDLAPQLVPLDYTTCPDVKVPYELIGSMPELKDNPFRQRIAQVFSEDGDGHMTLDNFLDMFSVMSEMAPRDLKAYYAFKIYDFNNDDYICAWDLEQTVTKLTRGELSAEEVSLVCEKVLDEADGDHDGRLSLEDFQNMILRAPDFLSTFHIRI

SEQ ID NO: 917634 - protein, 138 aa, Homo sapiens
LIPRMASMKLANPATLLSLKNFCLGTKEVPRLKLQESRDPGSSGPSSPETSLSRSGTAPPPQQDLVGHRATALTPDSCPLPGPGEPTLRSRQDRHFLQHLLGMGMNYCVRALGIHEQNESVLSISKQKRPGLNHCEIF

SEQ ID NO: 917635 - protein, 164 aa, Homo sapiens
VTSPDPSALMSHTTAFPHVAATLSIMDSTFKAPSAVSPIPAVIPSPSHKPSKTKTSKSSKVKDLSTRSDESPSNKKRKPQSSTSSSSSSSSSSLQTSLSSPLSGPHKKNCVLNASSALNSYQAAPPYNSLSVHNSNNGVSPLSAKLEPSGRTSLPGGPADIVRQ

SEQ ID NO: 917636 - protein, 1446 aa, Homo sapiens
MAEAVKPQRRAKAKASRTKTKEKKKYETPQREESSEVSLPKTSREQEIPSLACEFKGDHLKVVTDSQLQDDASGQNESEMFDVPLTSLTISNEESLTCNTEPPKEGGEARPCVGDSAVTPKVHPGDNVGTKVETPKNFTEVEENMSVQGGLSESAPQSNFSYTQPAMENIQVRETQNSKEDKQGLVCSSEVPQNVGLQSSCPAKHGFQTPRVKKLYPQLPAEIAGEAPALVAVKPLLRSERLYPELPSQLELVPFTKEQLKILEPGSWLENVESYLEEFDSMAHQDRHEFYELLLNYSRCRKQLLLAEAELLTLTSDCQNAKSRLWQFKEEQMSVQGICADQVKVFSYHRYQRVEMNENALVELKKLFDAKSEHLHQTLALHSYTSVLSRLQVESYIYALLSSSAVLRSSAIHQQGRASKQTESIPSDLCQLKECISVLFMFTRRVNEDTQFHDDILLWLQKLVSVLQRVGCPGDHLFLLNHILRCPAGVSKWAVPFIQIKVLHNPSGVFHFMQSLALLMSPVKNRAEFMCHMKPSERKPSSSGPGSGTWTLVDEGGEEDEDPETSWILLNEDDLVTILAQFPFHELFQHLLGFKAKGDYLPETTRPQEMMKIFAFANSLVELLAVGLETFNRARYRQFVKRIGYMIRMTLGYVSDHWAQYVSHNQGSGLAQQPYSMEKLQVEFDELFLRAVLHVLKAKRLGIWLFMSEMPFGTLSVQMLWKLFYLMHQVESENLQQLSSSLQPAQCKQQLQDPEHFTNFEKCLSSMNSSEEICLLTTFAQMAQARRTNVDEDFIKIIVLEIYEVSYVTLSTRETFSKVGRELLGTITAVHPEIISVLLDRVQETIDQVGMVSLYLFKELPLYLWQPSASEIAVIRDWLLNYNLTVVKNKLACVILEGLNWGFAKQATLHLDQAVHAEVALMVLEAYQKYLAQKPYAGILSESMKQVSYLASIVRYGETPETSFNQWAWNLILRLKLHKNDYGIQPNCPAVPFSVTVPDMTESPTFHPLLKAVKAGMPIGCYLALSMTAVGHSIEKFCAEGIPLLGILVQSRHLRTVVHVLDKILPLFYPCQYYLLKNEQFLSHLLLFLHLDSGVPQGVTQQVTHKVAQHLTGASHGDNVKLLNSMIQAHISVSTQPNEVGPVAVLEFWVQALISQHLWYREQPILFLMDHLCKAAFQLMQEDCIQKLLYQQHKNALGYHCDRSLLSSLVSWIVAGNITPSFVEGLATPTQVWFAWTVLNMESIFEEDSQLRRVIEGELVINSAFTPDQALKKAQTQLKLPIVPSLQRLLIYRWAHQALVTPSDHPLLPLIWQKFFLLYLHRPGPQYGLPIDGCIGRRFFQSPAHINLLKEMKRRLTEVADFHHAASKALRVPAEGSEGLPESHSGTPGYLTSPELHKELVRLFNVYILWLEDENFQKGDTYIPSLPKHYDIHRLAKVMQNQQVKL

SEQ ID NO: 917637 - protein, 2579 aa, Homo sapiens
MAEAVKPQRRAKAKASRTKTKEKKKYETPQREESSEVSLPKTSREQEIPSLACEFKGDHLKVVTDSQLQDDASGQNESEMFDVPLTSLTISNEESLTCNTEPPKEGGEARPCVGDSAVTPKVHPGDNVGTKVETPKNFTEVEENMSVQGGLSESAPQSNFSYTQPAMENIQVRETQNSKEDKQGLVCSSEVPQNVGLQSSCPAKHGFQTPRVKKLYPQLPAEIAGEAPALVAVKPLLRSERLYPELPSQLELVPFTKEQLKILEPGSWLENVESYLEEFDSMAHQDRHEFYELLLNYSRCRKQLLLAEAELLTLTSDCQNAKSRLWQFKEEQMSVQGICADQVKVFSYHRYQRVEMNENALVELKKLFDAKSEHLHQTLALHSYTSVLSRLQVESYIYALLSSSAVLRSSAIHQQGRASKQTESIPSDLCQLKECISVLFMFTRRVNEDTQFHDDILLWLQKLVSVLQRVGCPGDHLFLLNHILRCPAGVSKWAVPFIQIKVLHNPSGVFHFMQSLALLMSPVKNRAEFMCHMKPSERKPSSSGPGSGTWTLVDEGGEEDEDPETSWILLNEDDLVTILAQFPFHELFQHLLGFKAKGDYLPETTRPQEMMKIFAFANSLVELLAVGLETFNRARYRQFVKRIGYMIRMTLGYVSDHWAQYVSHNQGSGLAQQPYSMEKLQVEFDELFLRAVLHVLKAKRLGIWLFMSEMPFGTLSVQMLWKLFYLMHQVESENLQQLSSSLQPAQCKQQLQDPEHFTNFEKCLSSMNSSEEICLLTTFAQMAQARRTNVDEDFIKIIVLEIYEVSYVTLSTRETFSKVGRELLGTITAVHPEIISVLLDRVQETIDQVGMVSLYLFKELPLYLWQPSASEIAVIRDWLLNYNLTVVKNKLACVILEGLNWGFAKQATLHLDQAVHAEVALMVLEAYQKYLAQKPYAGILSESMKQVSYLASIVRYGETPETSFNQWAWNLILRLKLHKNDYGIQPNCPAVPFSVTVPDMTESPTFHPLLKAVKAGMPIGCYLALSMTAVGHSIEKFCAEGIPLLGILVQSRHLRTVVHVLDKILPLFYPCQYYLLKNEQFLSHLLLFLHLDSGVPQGVTQQVTHKVAQHLTGASHGDNVKLLNSMIQAHISVSTQPNEVGPVAVLEFWVQALISQHLWYREQPILFLMDHLCKAAFQLMQEDCIQKLLYQQHKNALGYHCDRSLLSSLVSWIVAGNITPSFVEGLATPTQVWFAWTVLNMESIFEEDSQLRRVIEGELVINSAFTPDQALKKAQTQLKLPIVPSLQRLLIYRWAHQALVTPSDHPLLPLIWQKFFLLYLHRPGPQYGLPIDGCIGRRFFQSPAHINLLKEMKRRLTEVADFHHAASKALRVPAEGSEGLPESHSGTPGYLTSPELHKELVRLFNVYILWLEDENFQKGDTYIPSLPKHYDIHRLAKVMQNQQDLWMEYLNMERIYHEFQETVGLWTQAKLESHSTPCSLSVQLDFTDPLLAKERVLSNLRKHEAPQPPLALHPTKPPVPVISSAVLLSQKDATQLVCTDLNLLQQQARTAALRESQQVALDGELLDTMPKQYVNREEQTTLHLECRGSSGKKCQGAAVVTVQFEGMHKNEAISQQLHVLRKEVKQLQAEAAKPPSLNIVEAAVHAENLITALVNAYKLQPTPGIQKVGISLFFTIVDYVSDETQRHPPTRQFFTSCIEILGQVFISGIKSECRKVLETILKNSRLCSLLSPFFTPNAAPAEFIQLYEQVVKFLSEDNSDMIFMLLTKFDLKQWLSATKPPLSDRTRLLESIHLALTAWGLEPDEDILMPFNLFCKHWTYLLLYQFPDQYSDILRLLMQSSAEQLLSPECWKATLRALGCCAPSCQQGAASTEGAVLPSSSDALLSDKQVMETIQWLSDFFYKLRLSKMDFKSFGLFSKWSPYMADVKTFLGYLVKRLIDLEMTCLAQDPTASRKTVLKSLHSVIIQLFKPWILVLEDNESSQQRHYPWLESDTVVASSIVQLFTDCIDSLHESFKDKLLPGDAGALWLHLMHYCEACTAPKMPEFILYAFHSTYRKLPWKDLHPDQMLMEAFFKVERGSPKSCFLFLGSVLCEVNWVSVLSDAWNSSPHPETRSMIVCLLFMMILLAKEVQLVDQTDSPLLSLLGQTSSLSWHLVDIVSYQSVLSYFSSHYPPSIILAKESYAELIMKLLKVSAGLSIPTDSQKHLDAVPKCQAFTHQMVQFLSTLEQNGKITLAVLEQEMSKLLDDIIVFNPPDMDSQTRHMALSSLFMEVLMMMNNATIPTAEFLRGSIRTWIGQKMHGLVVLPLLTAACQSLASVRHMAETTEACITAYFKESPLNQNSGWGPILVSLQVPELTMEEFLQECLTLGSYLTLYVYLLQCLNSEQTLRNEMKVLLILSKWLEQVYPSSVEEEAKLFLWWHQVLQLSLIQTEQNDSVLTESVIRILLLVQSRQNLVAEERLSSGILGAIGFGRKSPLSNRFRVVARSMAAFLSVQVPMEDQIRLRPGSELHLTPKAQQALNALESMASSKQYVEYQDQILQATQFIRHPGHCLQDGKSFLALLVNCLYPEVHYLDHIR

SEQ ID NO: 917638 - protein, 2579 aa, Homo sapiens; identical to SEQ ID NO: 917637

SEQ ID NO: 917639 - protein, 2481 aa, Homo sapiens
MAEAVKPQRRAKAKASRTKTKEKKKYETPQREESSEVSLPKTSREQEIPSLACEFKGDHLKVVTDSQLQDDASGQNESEMFDVPLTSLTISNEESLTCNTEPPKEGGEARPCVGDSAVTPKVHPGDNVGTKVETPKNFTEVEENMSVQGGLSESAPQSNFSYTQPAMENIQVRETQNSKEDKQGLVCSSEVPQNVGLQSSCPAKHGFQTPRVKKLYPQLPAEIAGEAPALVAVKPLLRSERLYPELPSQLELVPFTKEQLKILEPGSWLENVESYLEEFDSMAHQDRHEFYELLLNYSRCRKQLLLAEAELLTLTSDCQNAKSRLWQFKEEQMSVQGICADQVKVFSYHRYQRVEMNENALVELKKLFDAKSEHLHQTLALHSYTSVLSRLQVESYIYALLSSSAVLRSSAIHQQGRASKQTESIPSDLCQLKECISVLFMFTRRVNEDTQFHDDILLWLQKLVSVLQRVGCPGDHLFLLNHILRCPAGVSKWAVPFIQIKVLHNPSGVFHFMQSLALLMSPVKNRAEFMCHMKPSERKPSSSGPGSGTWTLVDEGGEEDEDPETSWILLNEDDLVTILAQFPFHELFQHLLGFKAKGDYLPETTRPQEMMKIFAFANSLVELLAVGLETFNRARYRQFVKRIGYMIRMTLGYVSDHWAQYVSHNQGSGLAQQPYSMEKLQVEFDELFLRAVLHVLKAKRLGIWLFMSEMPFGTLSVQMLWKLFYLMHQVESENLQQLSSSLQPAQCKQQLQDPEHFTNFEKCLSSMNSSEEICLLTTFAQMAQARRTNVDEDFIKIIVLEIYEVSYVTLSTRETFSKVGRELLGTITAVHPEIISVLLDRVQETIDQVGMVSLYLFKELPLYLWQPSASEIAVIRDWLLNYNLTVVKNKLACVILEGLNWGFAKQATLHLDQAVHAEVALMVLEAYQKYLAQKPYAGILSESMKQVSYLASIVRYGETPETSFNQWAWNLILRLKLHKNDYGIQPNCPAVPFSVTVPDMTESPTFHPLLKAVKAGMPIGCYLALSMTAVGHSIEKFCAEGIPLLGILVQSRHLRTVVHVLDKILPLFYPCQYYLLKNEQFLSHLLLFLHLDSGVPQGVTQQVTHKVAQHLTGASHGDNVKLLNSMIQAHISVSTQPNEVGPVAVLEFWVQALISQHLWYREQPILFLMDHLCKAAFQLMQEDCIQKLLYQQHKNALGYHCDRSLLSSLVSWIVAGNITPSFVEGLATPTQVWFAWTVLNMESIFEEDSQLRRVIEGELVINSAFTPDQALKKAQTQLKLPIVPSLQRLLIYRWAHQALVTPSDHPLLPLIWQKFFLLYLHRPGPQYGLPIDGCIGRRFFQSPAHINLLKEMKRRLTEVADFHHAASKALRVPAEGSEGLPESHSGTPGYLTSPELHKELVRLFNVYILWLEDENFQKGDTYIPSLPKHYDIHRLAKVMQNQQDLWMEYLNMERIYHEFQETVGLWTQAKLESHSTPCSLSVQLDFTDPLLAKERVLSNLRKHEAPQPPLALHPTKPPVPVISSAVLLSQKDATQLVCTDLNLLQQQARTAALRESQQVALDGELLDTMPKQYVNREEQTTLHLECRGSSGKKCQGAAVVTVQFEGMHKNEAISQQLHVLRKEVKQLQAEAAKPPSLNIVEAAVHAENLITALVNAYKLQPTPGIQKVGISLFFTIVDYVSDETQRHPPTRQFFTSCIEILGQVFISGIKSECRKVLETILKNSRLCSLLSPFFTPNAAPAEFIQLYEQVVKFLSEDNSDMIFMLLTKFDLKQWLSATKPPLSDRTRLLESIHLALTAWGLEPDEDILMPFNLFCKHWTYLLLYQFPDQYSDILRLLMQSSAEQLLSPECWKATLRALGCCAPSCQQGAASTEGAVLPSSSDALLSDKQVMETIQWLSDFFYKLRLSKMDFKSFGLFSKWSPYMADVKTFLGYLVKRLIDLEMTCLAQDPTASRKTVLKSLHSVIIQLFKPWILVLEDNESSQQRHYPWLESDTVVASSIVQLFTDCIDSLHESFKDKLLPGDAGALWLHLMHYCEACTAPKMPEFILYAFHSTYRKLPWKDLHPDQMLMEAFFKVERGSPKSCFLFLGSVLCEVNWVSVLSDAWNSSPHPETRSMIVCLLFMMILLAKEVQLVDQTDSPLLSLLGQTSSLSWHLVDIVSYQSVLSYFSSHYPPSIILAKESYAELIMKLLKVSAGLSIPTDSQKHLDAVPKCQAFTHQMVQFLSTLEQNGKITLAVLEQEMSKLLDDIIVFNPPDMDSQTRHMALSSLFMEVLMMMNNATIPTAEFLRGSIRTWIGQKMHGLVVLPLLTAACQSLASVRHMAETTEACITAYFKESPLNQNSGWGPILVSLQVPELTMEEFLQECLTLGSYLTLYVYLLQCLNSEQTLRNEMKVLLILSKWLEQVYPSSVEEEAKLFLWWHQVLQLSLIQTEQNDSVLTESVIRILLLVQSRQNLVAEERLSSGILGAIGFGRKSPLSNR

SEQ ID NO: 917640 - protein, 2160 aa, Homo sapiens
MAEAVKPQRRAKAKASRTKTKEKKKYETPQREESSEVSLPKTSREQEIPSLACEFKGDHLKVVTDSQLQDDASGQNESEMFDVPLTSLTISNEESLTCNTEPPKEGGEARPCVGDSAVTPKVHPGDNVGTKVETPKNFTEVEENMSVQGGLSESAPQSNFSYTQPAMENIQVRETQNSKEDKQGLVCSSEVPQNVGLQSSCPAKHGFQTPRVKKLYPQLPAEIAGEAPALVAVKPLLRSERLYPELPSQLELVPFTKEQLKILEPGSWLENVESYLEEFDSMAHQDRHEFYELLLNYSRCRKQLLLAEAELLTLTSDCQNAKSRLWQFKEEQMSVQGICADQVKVFSYHRYQRVEMNENALVELKKLFDAKSEHLHQTLALHSYTSVLSRLQVESYIYALLSSSAVLRSSAIHQQGRASKQTESIPSDLCQLKECISVLFMFTRRVNEDTQFHDDILLWLQKLVSVLQRVGCPGDHLFLLNHILRCPAGVSKWAVPFIQIKVLHNPSGVFHFMQSLALLMSPVKNRAEFMCHMKPSERKPSSSGPGSGTWTLVDEGGEEDEDPETSWILLNEDDLVTILAQFPFHELFQHLLGFKAKGDYLPETTRPQEMMKIFAFANSLVELLAVGLETFNRARYRQFVKRIGYMIRMTLGYVSDHWAQYVSHNQGSGLAQQPYSMEKLQVEFDELFLRAVLHVLKAKRLGIWLFMSEMPFGTLSVQMLWKLFYLMHQVESENLQQLSSSLQPAQCKQQLQDPEHFTNFEKCLSSMNSSEEICLLTTFAQMAQARRTNVDEDFIKIIVLEIYEVSYVTLSTRETFSKVGRELLGTITAVHPEIISVLLDRVQETIDQVGMVSLYLFKELPLYLWQPSASEIAVIRDWLLNYNLTVVKNKLACVILEGLNWGFAKQATLHLDQAVHAEVALMVLEAYQKYLAQKPYAGILSESMKQVSYLASIVRYGETPETSFNQWAWNLILRLKLHKNDYGIQPNCPAVPFSVTVPDMTESPTFHPLLKAVKAGMPIGCYLALSMTAVGHSIEKFCAEGIPLLGILVQSRHLRTVVHVLDKILPLFYPCQYYLLKNEQFLSHLLLFLHLDSGVPQGVTQQVTHKVAQHLTGASHGDNVKLLNSMIQAHISVSTQPNEVGPVAVLEFWVQALISQHLWYREQPILFLMDHLCKAAFQLMQEDCIQKLLYQQHKNALGYHCDRSLLSSLVSWIVAGNITPSFVEGLATPTQVWFAWTVLNMESIFEEDSQLRRVIEGELVINSAFTPDQALKKAQTQLKLPIVPSLQRLLIYRWAHQALVTPSDHPLLPLIWQKFFLLYLHRPGPQYGLPIDGCIGRRFFQSPAHINLLKEMKRRLTEVADFHHAASKALRVPAEGSEGLPESHSGTPGYLTSPELHKELVRLFNVYILWLEDENFQKGDTYIPSLPKHYDIHRLAKVMQNQQDLWMEYLNMERIYHEFQETVGLWTQAKLESHSTPCSLSVQLDFTDPLLAKERVLSNLRKHEAPQPPLALHPTKPPVPVISSAVLLSQKDATQLVCTDLNLLQQQARTAALRESQQVALDGELLDTMPKQYVNREEQTTLHLECRGSSGKKCQGAAVVTVQFEGMHKNEAISQQLHVLRKEVKQLQAEAAKPPSLNIVEAAVHAENLITALVNAYKLQPTPGIQKVGISLFFTIVDYVSDETQRHPPTRQFFTSCIEILGQVFISGIKSECRKVLETILKNSRLCSLLSPFFTPNAAPAEFIQLYEQVVKFLSEDNSDMIFMLLTKFDLKQWLSATKPPLSDRTRLLESIHLALTAWGLEPDEDILMPFNLFCKHWTYLLLYQFPDQYSDILRLLMQSSAEQLLSPECWKATLRALGCCAPSCQQGAASTEGAVLPSSSDALLSDKQVMETIQWLSDFFYKLRLSKMDFKSFGLFSKWSPYMADVKTFLGYLVKRLIDLEMTCLAQDPTASRKTVLKSLHSVIIQLFKPWILVLEDNESSQQRHYPWLESDTVVASSIVQLFTDCIDSLHESFKDKLLPGDAGALWLHLMHYCEACTAPKMPEFILYAFHSTYRKLPWKDLHPDQMLMEAFFKVERGSPKSCFLFLGSVLCEVNWVSVLSDAWNSSPHPETRSMIVCLLFMMILLAKEVQLVDQTVSLGKLMAKIRQGCLDLCFLLGR

SEQ ID NO: 917641 - protein, 1454 aa, Homo sapiens [sequence omitted]

SEQ ID NO: 917642 - protein, 510 aa, Homo sapiens
MATKRPVERGSPKSCFLFLGSVLCEVNWVSVLSDAWNSSPHPETRSMIVCLLFMMILLAKEVQLVDQTDSPLLSLLGQTSSLSWHLVDIVSYQSVLSYFSSHYPPSIILAKESYAELIMKLLKVSAGLSIPTDSQKHLDAVPKCQAFTHQMVQFLSTLEQNGKITLAVLEQEMSKLLDDIIVFNPPDMDSQTRHMALSSLFMEVLMMMNNATIPTAEFLRGSIRTWIGQKMHGLVVLPLLTAACQSLASVRHMAETTEACITAYFKESPLNQNSGWGPILVSLQVPELTMEEFLQECLTLGSYLTLYVYLLQCLNSEQTLRNEMKVLLILSKWLEQVYPSSVEEEAKLFLWWHQVLQLSLIQTEQNDSVLTESVIRILLLVQSRQNLVAEERLSSGILGAIGFGRKSPLSNRFRVVARSMAAFLSVQVPMEDQIRLRPGSELHLTPKAQQALNALESMASSKQYVEYQDQILQATQFIRHPGHCLQDGKSFLALLVNCLYPEVHYLDHIR

SEQ ID NO: 917643 - protein, 1446 aa, Homo sapiens; identical to SEQ ID NO: 917636

SEQ ID NO: 917644 - protein, 202 aa, Homo sapiens
AAVRNTRPIMFPHRGAVRNTRPITFPHRAAVGNIRPITFPHRGAVRNTHPITFPHRAAVRNTHPITFPHRAACRKKHSGSVVPSEEETEAERSPSTCTGPHCQRVTERGFEPKARALKLCVVTWKQHFPPSLGISKLEIQTAQHGIGSNRVRTCHQPQLKRLGRQGRKPTSRSHTSARSLPSSGTYQLCDLSPFYGNLSKMY

SEQ ID NO: 917645 - protein, 191 aa, Homo sapiens
KKKKKKKKKEEEEEEEEEEGQTCNFSVFNIFVKFCPQPPDRPQRVMFPSLFPCVLIVQLPLMSENMRYFIAARQVLPALVCSLLPIKDVLLNPFPVCPKNTCQQHLLLQYLPQDNFATNSRFYYYFLVVFPFTKYNNSRSLKMSNPRKCSIPTRDVNIILEQFLDRDLFNEFDFSEIDDFDDSDASDTRSV

SEQ ID NO: 917646 - protein, 305 aa, Homo sapiens
MLSLLNRRQEERLREQEERLREQEERQREQEDRLHEQEERLREQEERLCEQEERLCEQEERLREHEERLCEQEERLCEQEERLREQEERLHEQEERLREQEERLCEQEERLREHEERLCEQEERLREQEERLCEQEERLREQEERLCEQEERLREQEERLCEQEKLPGQERLLEEVEKLLEQERRQEEQERLLERERLLEEVEKLLEQERQQEEQERLLERERLLEEVEKLLEQERRQEEQERLLERERLLDEVEELLDEELERLRELERLRELERMLELGWEALYEQRAEPRSGFEELKATLEG

SEQ ID NO: 917647 - protein, 129 aa, Homo sapiens [sequence omitted]

SEQ ID NO: 917648 - protein, 127 aa, Homo sapiens
MTMPVNGAHKDADLWSSHDKMLAQPLKDSDVEVYNIIKKESNRQRVGLELIASENFASRAVLEALGSCLNNKYSEGYPGQRYYGGTEFNGLNLENPFVKKPKPLQGPFKLWDPHKLAWGGVKNRSQT

SEQ ID NO: 917649 - protein, 177 aa, Homo sapiens
MPFVSFSCLIILGIEVVLAGILVLFLKVTILVSIVWSRHICFILQVLFGSFSAGSAPAAGLTTTLGLLRDSWVCEPYLVEQAEHTSIHPVSPSSPHLGHHSSCHGGWSQFKWEDRRQVWLEEAAWTCLPDIPQVNPDTGYINYDQLEENARLFHPKLIIAGTSLYSRNLVSPVRDCP

SEQ ID NO: 917650 - protein, 313 aa, Homo sapiens
MTMPVNGAHKDADLWSSHDKMLAQPLKDSDVEVYNIIKKESNRQRVGLELIASENFASRAVLEALGSCLNNKYSEGYPGQRYYGGTEFIDELETLCQKRALQAYKLDPQCWGVNVQPYSGSPANFAVYTALVEPHGRIMGLDLPDGGHLTHGFMTDKKKISATSIFFESMPYKVNPDTGYINYDQLEENARLFHPKLIIAGTSCYSRNLEYARLRKIADENGAYLMADMAHISGLVAAGVVPSPFEHCHVVTTTTHKTLRGCRAGMIFYRKGVAVALKQAMTLEFKVYQHQVVANCRALSEALTELGYKIVTG

SEQ ID NO: 917651 - protein, 356 aa, Homo sapiens
MTMPVNGAHKDADLWSSHDKMLAQPLKDSDVEVYNIIKKESNRQRVGLELIASENFASRAVLEALGSCLNNKYSEGYPGQRYYGGTEFIDELETLCQKRALQAYKLDPQCWGVNVQPYSGSPANFAVYTALVEPHGRIMGLDLPDGGHLTHGFMTDKKKISATSIFFESMPYKVNPDTGYINYDQLEENARLFHPKLIIAGTSCYSRNLEYARLRKIADENGAYLMADMAHISGLVAAGVVPSPFEHCHVVTTTTHKTLRGCRAGMIFYRKGVKSVDPKTGKEILYNLESLINSAVFPGLQGGPHNHAIAGKTSSASAHPVAPNSHPTCPPKSCARTSTLGKKLEGCLCAGDANTE

SEQ ID NO: 917652 - protein, 352 aa, Homo sapiens
MTMPVNGAHKDADLWSSHDKMLAQPLKDSDVEVYNIIKKESNRQRVGLELIASENFASRAVLEALGSCLNNKYSEGYPGQRYYGGTEFIDELETLCQKRALQAYKLDPQCWGVNVQPYSGSPANFAVYTALVEPHGRIMGLDLPDGGHLTHGFMTDKKKISATSIFFESMPYKVNPDTGYINYDQLEENARLFHPKLIIAGTSCYSRNLEYARLRKIADENGAYLMADMAHISGLVAAGVVPSPFEHCHVVTTTTHKTLRGCRAGMIFYRKGVKSVDPKTGKEILYNLESLINSAVFPGLQGGPHNHAIAGVAVALKQAMTLEFKVYQHQVVANCRALSEALTELGYKIVTG

SEQ ID NO: 917653 - protein, 352 aa, Homo sapiens; identical to SEQ ID NO: 917652

SEQ ID NO: 917654 - protein, 818 aa, Homo sapiens
MALSQGRLTFRDVAIEFSQEEWKCLDPAQRALYRDVMLENYRNLVSLGISLSEMSITSMLGQGKEPWTVESEVKITKTSSGWECIKGVNTVVYPFTLPWRYSSNSDKGKVFIMMDNTLSCGFCDLFDVSPTHMIKELPPKENNSTGKVFQAVMLERHEIHDIQDFYFREMQQNIHDFECQCHNDERNYREIPAIKIKNITGRRDQGDGRNAGNKPVENQLELSFWLHLAELQGFQIERKIYECNQIEKSVTRGSSVSLLQTNLPCVNTSISNIYRNDFMHPSLLTQDQKAYIREKPYKCSDCGKAFNQRSNLTTHQRIHTGQKPHKCDICGKGFRRIANLASHHRIHTGEKPYRCNECGKTFNQTFNLTTHQRIHTGQKPYKCDRCGKGFRQIGNLASHHRIHTGEKPYRCNECGKTFNRMFHLTRHQRIHTGQKPYKCDICGKGFRQIANLASHHRIHTGEKPYKCSDCGKTFNYRSHLTRHQRIHTGQKPYKCDTCGKDFSQNSYLENHQRIHTREKSYRCNECGKTFNKMTNLTTHQRIHTGQKTYKCDICGKGFRQIGNLASHHRIHTGEKPYRCNECGKTFNRMFHLTRHQRIHTGQKPYKCDICGKSFSQNSYLENHQRIHTGEKTYKFLVDHQRTHTGEKPYKCNECGKTFIGHSSLTNHQVIHTGEKPYKCNECGKAYVKWSHLRHHESIQTGEKPYKCTKCSKAFRQWADIRIHQKIYAGEKPHKYDECGKTFTQASHLTIHQIIHTGEKPYEYDIYGKVFSQNSHFKSYHRICTEEKPYKCVWQGPQSKFTPCKSSENSYWREILQMS

SEQ ID NO: 917655 - protein, 139 aa, Homo sapiens
MSGQLWNLILAHCSLLFLACDLASPNLHQERVATDTLTPREAARPTLYPPPGFSGVETCALQFWAVGVMSQWDQEDNGERVNSEVWSCGRGSWLVQCGTGSLPKVPSDPPMITNIIKRYMAGYDVPSDGRPQHLLKNQI

SEQ ID NO: 917656 - protein, 190 aa, Homo sapiens
MRKFLSDPQVHTVLVERSTLKGAGPRRAGSPEPGLAECRACQVLRGRRCPRDGRSPAAADDPWMGRARRPQTSRRPGPQGRRRPAEAGAAPGARPRHTHCPARSPQGAPLLVAGRGKGSPSAVTQNNGVALSARASQDGRVGWRQRLPGLRAGEAASLPPVSHELFGFDLCPSQVAFGRDVSGADPRSWG

SEQ ID NO: 917657 - protein, 3558 aa, Homo sapiens
MSEPGGGGGEDGSAGLEVSAVQNVADVSVLQKHLRKLVPLLLEDGGEAPAALEAALEEKSALEQMRKFLSDPQVHTVLVERSTLKEDVGDEGEEEKEFISYNINIDIHYGVKSNSLAFIKRTPVIDADKPVSSQLRVLTLSEDSPYETLHSFISNAVAPFFKSYIRESGKADRDGDKMAPSVEKKIAELEMGLLHLQQNIEIPEISLPIHPMITNVAKQCYERGEKPKVTDFGDKVEDPTFLNQLQSGVNRWIREIQKVTKLDRDPASGTALQEISFWLNLERALYRIQEKRESPEVLLTLDILKHGKRFHATVSFDTDTGLKQALETVNDYNPLMKDFPLNDLLSATELDKIRQALVAIFTHLRKIRNTKYPIQRALRLVEAISRDLSSQLLKVLGTRKLMHVAYEEFEKVMVACFEVFQTWDDEYEKLQVLLRDIVKRKREENLKMVWRINPAHRKLQARLDQMRKFRRQHEQLRAVIVRVLRPQVTAVAQQNQGEVPEPQDMKVAEVLFDAADANAIEEVNLAYENVKEVDGLDVSKEGTEAWEAAMKRYDERIDRVETRITARLRDQLGTAKNANEMFRIFSRFNALFVRPHIRGAIRDYQTQLIQRVKDDIESLHDKFKVQYPQSQACKMSHVRDLPPVSGSIIWAKQIDRQLTAYMKRVEDVLGKGWENHVEGQKLKQDGDSFRMKLNTQEIFDDWARKVQQRNLGVSGRIFTIESTRVRGRTGNVLKLKVNFLPEIITLSKEVRNLKWLGFRVPLAIVNKAHQANQLYPFAISLIESVRTYERTCEKVEERNTISLLVAGLKKEVQALIAEGIALVWESYKLDPYVQRLAETVFNFQEKVDDLLIIEEKIDLEVRSLETCMYDHKTFSEILNRVQKAVDDLNLHSYSNLPIWVNKLDMEIERILGVRLQAGLRAWTQVLLGQAEDKAEVDMDTDAPQVSHKPGGEPKIKNVVHELRITNQVIYLNPPIEECRYKLYQEMFAWKMVVLSLPRIQSQRYQVGVHYELTEEEKFYRNALTRMPDGPVALEESYSAVMGIVSEVEQYVKVWLQYQCLWDMQAENIYNRLGEDLNKWQALLVQIRKARGTFDNAETKKEFGPVVIDYGKVQSKVNLKYDSWHKEVLSKFGQMLGSNMTEFHSQISKSRQELEQHSVDTASTSDAVTFITYVQSLKRKIKQFEKQVELYRNGQRLLEKQRFQFPPSWLYIDNIEGEWGAFNDIMRRKDSAIQQQVANLQMKIVQEDRAVESRTTDLLTDWEKTKPVTGNLRPEEALQALTIYEGKFGRLKDDREKCAKAKEALELTDTGLLSGSEERVQVALEELQDLKGVWSELSKVWEQIDQMKEQPWVSVQPRKLRQNLDALLNQLKSFPARLRQYASYEFVQRLLKGYMKINMLVIELKSEALKDRHWKQLMKRLHVNWVVSELTLGQIWDVDLQKNEAIVKDVLLVAQGEMALEEFLKQIREVWNTYELDLVNYQNKCRLIRGWDDLFNKVKEHINSVSAMKLSPYYKVFEEDALSWEDKLNRIMALFDVWIDVQRRWVYLEGIFTGSADIKHLLPVETQRFQSISTEFLALMKKVSKSPLVMDVLNIQGVQRSLERLADLLGKIQKALGEYLERERSSFPRFYFVGDEDLLEIIGNSKNVAKLQKHFKKMFAGVSSIILNEDNSVVLGISSREGEEVMFKTPVSITEHPKINEWLTLVEKEMRVTLAKLLAESVTEVEIFGKATSIDPNTYITWIDKYQAQLVVLSAQIAWSENVETALSSMGGGGDAAPLHSVLSNVEVTLNVLADSVLMEQPPLRRRKLEHLITELVHQRDVTRSLIKSKIDNAKSFEWLSQMRFYFDPKQTDVLQQLSIQMANAKFNYGFEYLGVQDKLVQTPLTDRCYLTMTQALEARLGGSPFGPAGTGKTESVKALGHQLGRFVLVFNCDETFDFQAMGRIFVGLCQVGAWGCFDEFNRLEERMLSAVSQQVQCIQEALREHSNPNYDKTSAPITCELLNKQVKVSPDMAIFITMNPGYAGRSNLPDNLKKLFRSLAMTKPDRQLIAQVMLYSQGFRTAEVLANKIVPFFKLCDEQLSSQSHYDFGLRALKSVLVSAGNVKRERIQKIKREKEERGEAVDEGEIAENLPEQEILIQSVCETMVPKLVAEDIPLLFSLLSDVFPGVQYHRGEMTALREELKKVCQEMYLTYGDGEEVGGMWVEKVLQLYQITQINHGLMMVGPSGSGKSMAWRVLLKALERLEGVEGVAHIIDPKAISKDHLYGTLDPNTREWTDGLFTHVLRKIIDSVRGELQKRQWIVFDGDVDPEWVENLNSVLDDNKLLTLPNGERLSLPPNVRIMFEVQDLKYATLATVSRCGMVWFSEDVLSTDMIFNNFLARLRSIPLDEGEDEAQRRRKGKEDEGEEAASPMLQIQRDAATIMQPYFTSNGLVTKALEHAFQLEHIMDLTRLRCLGSLFSMLHQACRNVAQYNANHPDFPMQIEQLERYIQVRGHQGLHRAHQLRQTTGLRTSEMLHLWGCALSPRRGRAFVEGLGKVQWVSVMQEDWEPLSLVNFAVSVFLLLLKFYKNQSLIPFLIAISGLCHTLVPAGDSRLKMRAELGEYIRRITTVPLPTAPNIPIIDYEVSISGEWSPWQAKVPQIEVETHKVAAPDVVVPTLDTVRHEALLYTWLAEHKPLVLCGPPGSGKTMTLFSALRALPDMEVVGLNFSSATTPELLLKTFDHYCEYRRTPNGVVLAPVQLGKWLVLFCDEINLPDMDKYGTQRVISFIRQMVEHGGFYRTSDQTWVKLERIQFVGACNPPTDPGRKPLSHRFLRHVPVVYVDYPGPASLTQIYGTFNRAMLRLIPSLRTYAEPLTAAMVEFYTMSQERFTQDTQPHYIYSPREMTRWVRGIFEALRPLETLPVEGLIRIWAHEALRLFQDRLVEDEERRWTDENIDTVALKHFPNIDREKAMSRPILYSNWLSKDYIPVDQEELRDYVKARLKVFYEEELDVPLVLFNEVLDHVLRIDRIFRQPQGHLLLIGVSGAGKTTLSRFVAWMNGLSVYQIKVHRKYTGEDFDEDLRTVLRRSGCKNEKIAFIMDESNVLDSGFLERMNTLLANGEVPGLFEGDEYATLMTQCKEGAQKEGLMLDSHEELYKWFTSQVIRNLHVVFTMNPSSEGLKDRAATSPALFNRCVLNWFGDWSTEALYQVGKEFTSKMDLEKPNYIVPDYMPVVYDKLPQPPSHREAIVNSCVFVHQTLHQANARLAKRGGRTMAITPRHYLDFINHYANLFHEKRSELEEQQMHLNVGLRKIKETVDQVEELRRDLRIKSQELEVKNAAANDKLKKMVKDQQEAEKKKVMSQEIQEQLHKQQEVIADKQMSVKEDLDKVEPAVIEAQNAVKSIKKQHLVEVRSMANPPAAVKLALESICLLLGESTTDWKQIRSIIMRENFIPTIVNFSAEEISDAIREKMKKNYMSNPSYNYEIVNRASLACGPMVKWAIAQLNYADMLKRVEPLRNELQKLEDDAKDNQQKANEVEQMIRDLEASIARYKEEYAVLISEAQASRQTWQLSRQK

SEQ ID NO: 917658 - protein, 3788 aa, Homo sapiens
MSEPGGGGGEDGSAGLEVSAVQNVADVSVLQKHLRKLVPLLLEDGGEAPAALEAALEEKSALEQMRKFLSDPQVHTVLVERSTLKEDVGDEGEEEKEFISYNINIDIHYGVKSNSLAFIKRTPVIDADKPVSSQLRVLTLSEDSPYETLHSFISNAVAPFFKSYIRESGKADRDGDKMAPSVEKKIAELEMGLLHLQQNIEIPEISLPIHPMITNVAKQCYERGEKPKVTDFGDKVEDPTFLNQLQSGVNRWIREIQKVTKLDRDPASGTALQEISFWLNLERALYRIQEKRESPEVLLTLDILKHGKRFHATVSFDTDTGLKQALETVNDYNPLMKDFPLNDLLSATELDKIRQALVAIFTHLRKIRNTKYPIQRALRLVEAISRDLSSQLLKVLGTRKLMHVAYEEFEKVMVACFEVFQTWDDEYEKLQVLLRDIVKRKREENLKMVWRINPAHRKLQARLDQMRKFRRQHEQLRAVIVRVLRPQVTAVAQQNQGEVPEPQDMKVAEVLFDAADANAIEEVNLAYENVKEVDGLDVSKEGTEAWEAAMKRYDERIDRVETRITARLRDQLGTAKNANEMFRIFSRFNALFVRPHIRGAIRDYQTQLIQRVKDDIESLHDKFKVQYPQSQACKMSHVRDLPPVSGSIIWAKQIDRQLTAYMKRVEDVLGKGWENHVEGQKLKQDGDSFRMKLNTQEIFDDWARKVQQRNLGVSGRIFTIESTRVRGRTGNVLKLKVNFLPEIITLSKEVRNLKWLGFRVPLAIVNKAHQANQLYPFAISLIESVRTYERTCEKVEERNTISLLVAGLKKEVQALIAEGIALVWESYKLDPYVQRLAETVFNFQEKVCSHVILRCPGNEGSTVIASSVKTLVLPKKACMVDAAYGHVSCKGGGPFVLTGLFNGAGVLGRPLSNNLSLETGGELKDKESNREQNAVLLLLQLKAEQALGLSHEGLTQSLRLPADQMHTTARLAPQAQEELNRARLLPSPRFTHQRPPLPLSGSKGREAGEAPCIFLSSARTCEWGLVFSPQQLGLATYGRTVPGAFVNVEYLRRMLCENKGTECELGVLNIKYFFLQVDDLLIIEEKIDLEVRSLETCMYDHKTFSEILNRVQKAVDDLNLHSYSNLPIWVNKLDMEIERILGVRLQAGLRAWTQVLLGQAEDKAEVDMDTDAPQVSHKPGGEPKIKNVVHELRITNQVIYLNPPIEECRYKLYQEMFAWKMVVLSLPRIQSQRYQVGVHYELTEEEKFYRNALTRMPDGPVALEESYSAVMGIVSEVEQYVKVWLQYQCLWDMQAENIYNRLGEDLNKWQALLVQIRKARGTFDNAETKKEFGPVVIDYGKVQSKVNLKYDSWHKEVLSKFGQMLGSNMTEFHSQISKSRQELEQHSVDTASTSDAVTFITYVQSLKRKIKQFEKQVELYRNGQRLLEKQRFQFPPSWLYIDNIEGEWGAFNDIMRRKDSAIQQQVANLQMKIVQEDRAVESRTTDLLTDWEKTKPVTGNLRPEEALQALTIYEGKFGRLKDDREKCAKAKEALELTDTGLLSGSEERVQVALEELQDLKGVWSELSKVWEQIDQMKEQPWVSVQPRKLRQNLDALLNQLKSFPARLRQYASYEFVQRLLKGYMKINMLVIELKSEALKDRHWKQLMKRLHVNWVVSELTLGQIWDVDLQKNEAIVKDVLLVAQGEMALEEFLKQIREVWNTYELDLVNYQNKCRLIRGWDDLFNKVKEHINSVSAMKLSPYYKVFEEDALSWEDKLNRIMALFDVWIDVQRRWVYLEGIFTGSADIKHLLPVETQRFQSISTEFLALMKKVSKSPLVMDVLNIQGVQRSLERLADLLGKIQKALGEYLERERSSFPRFYFVGDEDLLEIIGNSKNVAKLQKHFKKMFAGVSSIILNEDNSVVLGISSREGEEVMFKTPVSITEHPKINEWLTLVEKEMRVTLAKLLAESVTEVEIFGKATSIDPNTYITWIDKYQAQLVVLSAQIAWSENVETALSSMGGGGDAAPLHSVLSNVEVTLNVLADSVLMEQPPLRRRKLEHLITELVHQRDVTRSLIKSKIDNAKSFEWLSQMRFYFDPKQTDVLQQLSIQMANAKFNYGFEYLGVQDKLVQTPLTDRCYLTMTQALEARLGGSPFGPAGTGKTESVKALGHQLGRFVLVFNCDETFDFQAMGRIFVGLCQVGAWGCFDEFNRLEERMLSAVSQQVQCIQEALREHSNPNYDKTSAPITCELLNKQVKVSPDMAIFITMNPGYAGRSNLPDNLKKLFRSLAMTKPDRQLIAQVMLYSQGFRTAEVLANKIVPFFKLCDEQLSSQSHYDFGLRALKSVLVSAGNVKRERIQKIKREKEERGEAVDEGEIAENLPEQEILIQSVCETMVPKLVAEDIPLLFSLLSDVFPGVQYHRGEMTALREELKKVCQEMYLTYGDGEEVGGMWVEKVLQLYQITQINHGLMMVGPSGSGKSMAWRVLLKALERLEGVEGVAHIIDPKAISKDHLYGTLDPNTREWTDGLFTHVLRKIIDSVRGELQKRQWIVFDGDVDPEWVENLNSVLDDNKLLTLPNGERLSLPPNVRIMFEVQDLKYATLATVSRCGMVWFSEDVLSTDMIFNNFLARLRSIPLDEGEDEAQRRRKGKEDEGEEAASPMLQIQRDAATIMQPYFTSNGLVTKALEHAFQLEHIMDLTRLRCLGSLFSMLHQACRNVAQYNANHPDFPMQIEQLERYIQVRGHQGLHRAHQLRQTTGLRTSEMLHLWGCALSPRRGRAFVEGLGKVQWVSVMQEDWEPLSLVNFAVSVFLLLLKFYKNQSLIPFLIAISGLCHTLVPAGDSRLKMRAELGEYIRRITTVPLPTAPNIPIIDYEVSISGEWSPWQAKVPQIEVETHKVAAPDVVVPTLDTVRHEALLYTWLAEHKPLVLCGPPGSGKTMTLFSALRALPDMEVVGLNFSSATTPELLLKTFDHYCEYRRTPNGVVLAPVQLGKWLVLFCDEINLPDMDKYGTQRVISFIRQMVEHGGFYRTSDQTWVKLERIQFVGACNPPTDPGRKPLSHRFLRHVPVVYVDYPGPASLTQIYGTFNRAMLRLIPSLRTYAEPLTAAMVEFYTMSQERFTQDTQPHYIYSPREMTRWVRGIFEALRPLETLPVEGLIRIWAHEALRLFQDRLVEDEERRWTDENIDTVALKHFPNIDREKAMSRPILYSNWLSKDYIPVDQEELRDYVKARLKVFYEEELDVPLVLFNEVLDHVLRIDRIFRQPQGHLLLIGVSGAGKTTLSRFVAWMNGLSVYQIKVHRKYTGEDFDEDLRTVLRRSGCKNEKIAFIMDESNVLDSGFLERMNTLLANGEVPGLFEGDEYATLMTQCKEGAQKEGLMLDSHEELYKWFTSQVIRNLHVVFTMNPSSEGLKDRAATSPALFNRCVLNWFGDWSTEALYQVGKEFTSKMDLEKPNYIVPDYMPVVYDKLPQPPSHREAIVNSCVFVHQTLHQANARLAKRGGRTMAITPRHYLDFINHYANLFHEKRSELEEQQMHLNVGLRKIKETVDQVEELRRDLRIKSQELEVKNAAANDKLKKMVKDQQEAEKKKVMSQEIQEQLHKQQEVIADKQMSVKEDLDKVEPAVIEAQNAVKSIKKQHLVEVRSMANPPAAVKLALESICLLLGESTTDWKQIRSIIMRENFIPTIVNFSAEEISDAIREKMKKNYMSNPSYNYEIVNRASLACGPMVKWAIAQLNYADMLKRVEPLRNELQKLEDDAKDNQQKANEVEQMIRDLEASIARYKEEYAVLISEAQASRQTWQLSRQK

SEQ ID NO: 917659 - protein, 3575 aa, Homo sapiens
MSEPGGGGGEDGSAGLEVSAVQNVADVSVLQKHLRKLVPLLLEDGGEAPAALEAALEEKSALEQMRKFLSDPQVHTVLVERSTLKEDVGDEGEEEKEFISYNINIDIHYGVKSNSLAFIKRTPVIDADKPVSSQLRVLTLSEDSPYETLHSFISNAVAPFFKSYIRESGKADRDGDKMAPSVEKKIAELEMGLLHLQQNIEIPEISLPIHPMITNVAKQCYERGEKPKVTDFGDKVEDPTFLNQLQSGVNRWIREIQKVTKLDRDPASGTALQEISFWLNLERALYRIQEKRESPEVLLTLDILKHGKRFHATVSFDTDTGLKQALETVNDYNPLMKDFPLNDLLSATELDKIRQALVAIFTHLRKIRNTKYPIQRALRLVEAISRDLSSQLLKVLGTRKLMHVAYEEFEKVMVACFEVFQTWDDEYEKLQVLLRDIVKRKREENLKMVWRINPAHRKLQARLDQMRKFRRQHEQLRAVIVRVLRPQVTAVAQQNQGEVPEPQDMKVAEVLFDAADANAIEEVNLAYENVKEVDGLDVSKEGTEAWEAAMKRYDERIDRVETRITARLRDQLGTAKNANEMFRIFSRFNALFVRPHIRGAIRDYQTQLIQRVKDDIESLHDKFKVQYPQSQACKMSHVRDLPPVSGSIIWAKQIDRQLTAYMKRVEDVLGKGWENHVEGQKLKQDGDSFRMKLNTQEIFDDWARKVQQRNLGVSGRIFTIESTRVRGRTGNVLKLKVNFLPEIITLSKEVRNLKWLGFRVPLAIVNKAHQANQLYPFAISLIESVRTYERTCEKVEERNTISLLVAGLKKEVQALIAEGIALVWESYKLDPYVQRLAETVFNFQEKVDDLLIIEEKIDLEVRSLETCMYDHKTFSEILNRVQKAVDDLNLHSYSNLPIWVNKLDMEIERILGVRLQAGLRAWTQVLLGQAEDKAEVDMDTDAPQVSHKPGGEPKIKNVVHELRITNQVIYLNPPIEECRYKLYQEMFAWKMVVLSLPRIQSQRYQVGVHYELTEEEKFYRNALTRMPDGPVALEESYSAVMGIVSEVEQYVKVWLQYQCLWDMQAENIYNRLGEDLNKWQALLVQIRKARGTFDNAETKKEFGPVVIDYGKVQSKVNLKYDSWHKEVLSKFGQMLGSNMTEFHSQISKSRQELEQHSVDTASTSDAVTFITYVQSLKRKIKQFEKQVELYRNGQRLLEKQRFQFPPSWLYIDNIEGEWGAFNDIMRRKDSAIQQQVANLQMKIVQEDRAVESRTTDLLTDWEKTKPVTGNLRPEEALQALTIYEGKFGRLKDDREKCAKAKEALELTDTGLLSGSEERVQVALEELQDLKGVWSELSKVWEQIDQMKEQPWVSVQPRKLRQNLDALLNQLKSFPARLRQYASYEFVQRLLKGYMKINMLVIELKSEALKDRHWKQLMKRLHVNWVVSELTLGQIWDVDLQKNEAIVKDVLLVAQGEMALEEFLKQIREVWNTYELDLVNYQNKCRLIRGWDDLFNKVKEHINSVSAMKLSPYYKVFEEDALSWEDKLNRIMALFDVWIDVQRRWVYLEGIFTGSADIKHLLPVETQRFQSISTEFLALMKKVSKSPLVMDVLNIQGVQRSLERLADLLGKIQKALGEYLERERSSFPRFYFVGDEDLLEIIGNSKNVAKLQKHFKKMFAGVSSIILNEDNSVVLGISSREGEEVMFKTPVSITEHPKINEWLTLVEKEMRVTLAKLLAESVTEVEIFGKATSIDPNTYITWIDKYQAQLVVLSAQIAWSENVETALSSMGGGGDAAPLHSVLSNVEVTLNVLADSVLMEQPPLRRRKLEHLITELVHQRDVTRSLIKSKIDNAKSFEWLSQMRFYFDPKQTDVLQQLSIQMANAKFNYGFEYLGVQDKLVQTPLTDRCYLTMTQALEARLGGSPFGPAGTGKTESVKALGHQLGRFVLVFNCDETFDFQAMGRIFVGLCQVGAWGCFDEFNRLEERMLSAVSQQVQCIQEALREHSNPNYDKTSAPITCELLNKQVKVSPDMAIFITMNPGYAGRSNLPDNLKKLFRSLAMTKPDRQLIAQVMLYSQGFRTAEVLANKIVPFFKLCDEQLSSQSHYDFGLRALKSVLVSAGNVKRERIQKIKREKEERGEAVDEGEIAENLPEQEILIQSVCETMVPKLVAEDIPLLFSLLSDVFPGVQYHRGEMTALREELKKVCQEMYLTYGDGEEVGGMWVEKVLQLYQITQINHGLMMVGPSGSGKSMAWRVLLKALERLEGVEGVAHIIDPKAISKDHLYGTLDPNTREWTDGLFTHVLRKIIDSVRGELQKRQWIVFDGDVDPEWVENLNSVLDDNKLLTLPNGERLSLPPNVRIMFEVQDLKYATLATVSRCGMVWFSEDVLSTDMIFNNFLARLRSIPLDEGEDEAQRRRKGKEDEGEEAASPMLQIQRDAATIMQPYFTSNGLVTKALEHAFQLEHIMDLTRLRCLGSLFSMLHQACRNVAQYNANHPDFPMQIEQLERYIQVRGHQGLHRAHQLRQTTGLRTSEMLHLWGCALSPRRGRAFVEGLGKVQWVSVMQEDWEPLSLVNFAVSVFLLLLKFYKNQSLIPFLIAISGLCHTLVPAGDSRLKMRAELGEYIRRITTVPLPTAPNIPIIDYEVSISGEWSPWQAKVPQIEVETHKVAAPDVVVPTLDTVRHEALLYTWLAEHKPLVLCGPPGSGKTMTLFSALRALPDMEVVGLNFSSATTPELLLKTFDHYCEYRRTPNGVVLAPVQLGKWLVLFCDEINLPDMDKYGTQRVISFIRQMVEHGGFYRTSDQTWVKLERIQFVGACNPPTDPGRKPLSHRFLRHVPVVYVDYPGPASLTQIYGTFNRAMLRLIPSLRTYAEPLTAAMVEFYTMSQERFTQDTQPHYIYSPREMTRWVRGIFEALRPLETLPVEGLIRIWAHEALRLFQDRLVEDEERRWTDENIDTVALKHFPNIDREKAMSRPILYSNWLSKDYIPVDQEELRDYVKARLKVFYEEELDVPLVLFNEVLDHVLRIDRIFRQPQGHLLLIGVSGAGKTTLSRFVAWMNGLSVYQIKVHRKYTGEDFDEDLRTVLRRSGCKNEKIAFIMDESNVLDSGFLERMNTLLANGEVPGLFEGDEYATLMTQCKEGAQKEGLMLDSHEELYKWFTSQVIRNLHVVFTMNPSSEGLKDRAATSPALFNRCVLNWFGDWSTEALYQVGKEFTSKMDLEKPNYIVPDYMPVVYDKLPQPPSHREAIVNSCVFVHQTLHQANARLAKRGGRTMAITPRHYLDFINHYANLFHEKRSELEEQQMHLNVGLRKIKETVDQVEELRRDLRIKSQELEVKNAAANDKLKKMVKDQQEAEKKKVMSQEIQEQLHKQQEVIADKQMSVKEDLDKVEPAVIEAQNAVKSIKKQHLVEVRSMANPPAAVKLALESICLLLGESTTDWKQIRSIIMRENFIPTIVNFSAEEISDAIREKMKKNYMSNPSYNYEIVNRASLACGPMVKWAIAQLNYADMLKRVEPLRNELQKLEDDAKDNQQKANEVEQMIRDLEASIARYKEEYAVLISEAQAIKADLAAVEAKVRLSSLILSLSCCGSRD

SEQ ID NO: 917660 - protein, 3558 aa, Homo sapiens; identical to SEQ ID NO: 917657

SEQ ID NO: 917661 - protein, 3521 aa, Homo sapiens
LEDPKRREDSKQEFLVQRENLSAVNLSLGKIVQEDRAVESRTTDLLTDWEKTKPVTGNLRPEEALQALTIYEGKFGRLKDDREKCAKAKEALELTDTGLLSGSEERVQVALEELQDLKGVWSELSKVWEQIDQMKEQPWVSVQPRKLRQNLDALLNQLKSFPARLRQYASYEFVQRLLKGYMKINMLVIELKSEALKDRHWKQLMKRLHVNWVVSELTLGQIWDVDLQKNEAIVKDVLLVAQGEMALEEFLKQIREVWNTYELDLVNYQNKCRLIRGWDDLFNKVKEHINSVSAMKLSPYYKVFEEDALSWEDKLNRIMALFDVWIDVQRRWVYLEGIFTGSADIKHLLPVETQRFQSISTEFLALMKKVSKSPLVMDVLNIQGVQRSLERLADLLGKIQKALGEYLERERSSFPRFYFVGDEDLLEIIGNSKNVAKLQKHFKKMFAGVSSIILNEDNSVVLGISSREGEEVMFKTPVSITEHPKINEWLTLVEKEMRVTLAKLLAESVTEVEIFGKATSIDPNTYITWIDKYQAQLVVLSAQIAWSENVETALSSMGGGGDAAPLHSVLSNVEVTLNVLADSVLMEQPPLRRRKLEHLITELVHQRDVTRSLIKSKIDNAKSFEWLSQMRFYFDPKQTDVLQQLSIQMANAKFNYGFEYLGVQDKLVQTPLTDRCYLTMTQALEARLGGSPFGPAGTGKTESVKALGHQLGRFVLVFNCDETFDFQAMGRIFVGLCQVGAWGCFDEFNRLEERMLSAVSQQVQCIQEALREHSNPNYDKTSAPITCELLNKQVKVSPDMAIFITMNPGYAGRSNLPDNLKKLFRSLAMTKPDRQLIAQVMLYSQGFRTAEVLANKIVPFFKLCDEQLSSQSHYDFGLRALKSVLVSAGNVKRERIQKIKREKEERGEAVDEGEIAENLPEQEILIQSVCETMVPKLVAEDIPLLFSLLSDVFPGVQYHRGEMTALREELKKVCQEMYLTYGDGEEVGGMWVEKVLQLYQITQINHGLMMVGPSGSGKSMAWRVLLKALERLEGVEGVAHIIDPKAISKDHLYGTLDPNTREWTDGLFTHVLRKIIDSVRGELQKRQWIVFDGDVDPEWVENLNSVLDDNKLLTLPNGERLSLPPNVRIMFEVQDLKYATLATVSRCGMVWFSEDVLSTDMIFNNFLARLRSIPLDEGEDEAQRRRKGKEDEGEEAASPMLQIQRDAATIMQPYFTSNGLVTKALEHAFQLEHIMDLTRLRCLGSLFSMLHQACRNVAQYNANHPDFPMQIEQLERYIQVRGHQGLHRAHQLRQTTGLRTSEMLHLWGCALSPRRGRAFVEGLGKVQWVSVMQEDWEPLSLVNFAVSVFLLLLKFYKNQSLIPFLIAISGLCHTLVPAGDSRLKMRAELGEYIRRITTVPLPTAPNIPIIDYEVSISGEWSPWQAKVPQIEVETHKVAAPDVVVPTLDTVRHEALLYTWLAEHKPLVLCGPPGSGKTMTLFSALRALPDMEVVGLNFSSATTPELLLKTFDHYCEYRRTPNGVVLAPVQLGKWLVLFCDEINLPDMDKYGTQRVISFIRQMVEHGGFYRTSDQTWVKLERIQFVGACNPPTDPGRKPLSHRFLRHVPVVYVDYPGPASLTQIYGTFNRAMLRLIPSLRTYAEPLTAAMVEFYTMSQERFTQDTQPHYIYSPREMTRWVRGIFEALRPLETLPVEGLIRIWAHEALRLFQDRLVEDEERRWTDENIDTVALKHFPNIDREKAMSRPILYSNWLSKDYIPVDQEELRDYVKARLKVFYEEELDVPLVLFNEVLDHVLRIDRIFRQPQGHLLLIGVSGAGKTTLSRFVAWMNGLSVYQIKVHRKYTGEDFDEDLRTVLRRSGCKNEKIAFIMDESNVLDSGFLERMNTLLANGEVPGLFEGDEYATLMTQCKEGAQKEGLMLDSHEELYKWFTSQVIRNLHVVFTMNPSSEGLKDRAATSPALFNRCVLNWFGDWSTEALYQVGKEFTSKMDLEKPNYIVPDYMPVVYDKLPQPPSHREAIVNSCVFVHQTLHQANARLAKRGGRTMAITPRHYLDFINHYANLFHEKRSELEEQQMHLNVGLRKIKETVDQVEELRRDLRIKSQELEVKNAAANDKLKKMVKDQQEAEKKKVMSQEIQEQLHKQQEVIADKQMSVKEDLDKVEPAVIEAQNAVKSIKKQHLVEVRSMANPPAAVKLALESICLLLGESTTDWKQIRSIIMRENFIPTIVNFSAEEISDAIREKMKKNYMSNPSYNYEIVNRASLACGPMVKWAIAQLNYADMLKRVEPLRNELQKLEDDAKDNQQKANEVEQMIRDLEASIARYKEEYAVLISEAQAIKADLAAVEAKVNRSTALLKSLSAERERWEKTSETFKNQMSTIAGDCLLSAAFIAYAGYFDQQMRQNLFTTWSHHLQQANIQFRTDIARTEYLSNADERLRWQASSLPADDLCTENAIMLKRFNRYPLIIDPSGQATEFIMNEYKDRKITRTSFLDDAFRKNLESALRFGNPLLVQDVESYDPVLNPVLNREVRRTGGRVLITLGDQDIDLSPSFVIFLSTRDPTVEFPPDLCSRVTFVNFTVTRSSLQSQCLNEVLKAERPDVDEKRSDLLKLQGEFQLRLRQLEKSLLQALNEVKGRILDDDTIITTLENLKREAAEVTRKVEETDIVMQEVETVSQQYLPLSTACSSIYFTMESLKQIHFLYQYSLQFFLDIYHNVLYENPNLKGVTDHTQRLSIITKDLFQVAFNRVARGMLHQDHITFAMLLARIKLKGTVGEPTYDAEFQHFLRGNEIVLSAGSTPRIQGLTVEQAEAVVRLSCLPAFKDLIAKVQADEQFGIWLDSSSPEQTVPYLWSEETPATPIGQAIHRLLLIQAFRPDRLLAMAHMFVSTNLGESFMSIMEQPLDLTHIVGTEVKPNTPVLMCSVPGYDASGHVEDLAAEQNTQITSIAIGSAEGFNQADKAINTAVKSGRWVMLKNVHLAPGWLMQLEKKLHSLQPHACFRLFLTMEINPKVPVNLLRAGRIFVFEPPPGVKANMLRTFSSIPVSRICKSPNERARLYFLLAWFHAIIQERLRYAPLGWSKKYEFGESDLRSACDTVDTWLDDTAKGRQNISPDKIPWSALKTLMAQSIYGGRVDNEFDQRLLNTFLERLFTTRSFDSEFKLACKVDGHKDIQMPDGIRREEFVQWVELLPDTQTPSWLGLPNNAERVLLTTQGVDMISKMLKMQMLEDEDDLAYAETEKKTRTDSTSDGRPAWMRTLHTTASNWLHLIPQTLSHLKRTVENIKDPLFRFFEREVKMGAKLLQDVRQDLADVVQVCEGKKKQTNYLRTLINELVKGILPRSWSHYTVPAGMTVIQWVSDFSERIKQLQNISLAAASGGAKELKNIHVCLGGLFVPEAYITATRQYVAQANSWSLEELCLEVNVTTSQGATLDACSFGVTGLKLQGATCNNNKLSLSNAISTALPLTQLRWVKQTNTEKKASVVTLPVYLNFTRADLIFTVDFEIATKEDPRSFYERGVAVLCTE

SEQ ID NO: 917662 - protein, 3558 aa, Homo sapiens; identical to SEQ ID NO: 917657

SEQ ID NO: 917663 - protein, 3558 aa, Homo sapiens; identical to SEQ ID NO: 917657

SEQ ID NO: 917664 - protein, 3558 aa, Homo sapiens; identical to SEQ ID NO: 917657

SEQ ID NO: 917665 - protein, 4177 aa, Homo sapiens
MSEPGGGGGEDGSAGLEVSAVQNVADVSVLQKHLRKLVPLLLEDGGEAPAALEAALEEKSALEQMRKFLSDPQVHTVLVERSTLKEDVGDEGEEEKEFISYNINIDIHYGVKSNSLAFIKRTPVIDADKPVSSQLRVLTLSEDSPYETLHSFISNAVAPFFKSYIRESGKADRDGDKMAPSVEKKIAELEMGLLHLQQNIEIPEISLPIHPMITNVAKQCYERGEKPKVTDFGDKVEDPTFLNQLQSGVNRWIREIQKVTKLDRDPASGTALQEISFWLNLERALYRIQEKRESPEVLLTLDILKHGKRFHATVSFDTDTGLKQALETVNDYNPLMKDFPLNDLLSATELDKIRQALVAIFTHLRKIRNTKYPIQRALRLVEAISRDLSSQLLKVLGTRKLMHVAYEEFEKVMVACFEVFQTWDDEYEKLQVLLRDIVKRKREENLKMVWRINPAHRKLQARLDQMRKFRRQHEQLRAVIVRVLRPQVTAVAQQNQGEVPEPQDMKVAEVLFDAADANAIEEVNLAYENVKEVDGLDVSKEGTEAWEAAMKRYDERIDRVETRITARLRDQLGTAKNANEMFRIFSRFNALFVRPHIRGAIRDYQTQLIQRVKDDIESLHDKFKVQYPQSQACKMSHVRDLPPVSGSIIWAKQIDRQLTAYMKRVEDVLGKGWENHVEGQKLKQDGDSFRMKLNTQEIFDDWARKVQQRNLGVSGRIFTIESTRVRGRTGNVLKLKVNFLPEIITLSKEVRNLKWLGFRVPLAIVNKAHQANQLYPFAISLIESVRTYERTCEKVEERNTISLLVAGLKKEVQALIAEGIALVWESYKLDPYVQRLAETVFNFQEKVDDLLIIEEKIDLEVRSLETCMYDHKTFSEILNRVQKAVDDLNLHSYSNLPIWVNKLDMEIERILGVRLQAGLRAWTQVLLGQAEDKAEVDMDTDAPQVSHKPGGEPKIKNVVHELRITNQVIYLNPPIEECRYKLYQEMFAWKMVVLSLPRIQSQRYQVGVHYELTEEEKFYRNALTRMPDGPVALEESYSAVMGIVSEVEQYVKVWLQYQCLWDMQAENIYNRLGEDLNKWQALLVQIRKARGTFDNAETKKEFGPVVIDYGKVQSKVNLKYDSWHKEVLSKFGQMLGSNMTEFHSQISKSRQELEQHSVDTASTSDAVTFITYVQSLKRKIKQFEKQVELYRNGQRLLEKQRFQFPPSWLYIDNIEGEWGAFNDIMRRKDSAIQQQVANLQMKIVQEDRAVESRTTDLLTDWEKTKPVTGNLRPEEALQALTIYEGKFGRLKDDREKCAKAKEALELTDTGLLSGSEERVQVALEELQDLKGVWSELSKVWEQIDQMKEQPWVSVQPRKLRQNLDALLNQLKSFPARLRQYASYEFVQRLLKGYMKINMLVIELKSEALKDRHWKQLMKRLHVNWVVSELTLGQIWDVDLQKNEAIVKDVLLVAQGEMALEEFLKQIREVWNTYELDLVNYQNKCRLIRGWDDLFNKVKEHINSVSAMKLSPYYKVFEEDALSWEDKLNRIMALFDVWIDVQRRWVYLEGIFTGSADIKHLLPVETQRFQSISTEFLALMKKVSKSPLVMDVLNIQGVQRSLERLADLLGKIQKALGEYLERERSSFPRFYFVGDEDLLEIIGNSKNVAKLQKHFKKMFAGVSSIILNEDNSVVLGISSREGEEVMFKTPVSITEHPKINEWLTLVEKEMRVTLAKLLAESVTEVEIFGKATSIDPNTYITWIDKYQAQLVVLSAQIAWSENVETALSSMGGGGDAAPLHSVLSNVEVTLNVLADSVLMEQPPLRRRKLEHLITELVHQRDVTRSLIKSKIDNAKSFEWLSQMRFYFDPKQTDVLQQLSIQMANAKFNYGFEYLGVQDKLVQTPLTDRCYLTMTQALEARLGGSPFGPAGTGKTESVKALGHQLGRFVLVFNCDETFDFQAMGRIFVGLCQVGAWGCFDEFNRLEERMLSAVSQQVQCIQEALREHSNPNYDKTSAPITCELLNKQVKVSPDMAIFITMNPGYAGRSNLPDNLKKLFRSLAMTKPDRQLIAQVMLYSQGFRTAEVLANKIVPFFKLCDEQLSSQSHYDFGLRALKSVLVSAGNVKRERIQKIKREKEERGEAVDEGEIAENLPEQEILIQSVCETMVPKLVAEDIPLLFSLLSDVFPGVQYHRGEMTALREELKKVCQEMYLTYGDGEEVGGMWVEKVLQLYQITQINHGLMMVGPSGSGKSMAWRVLLKALERLEGVEGVAHIIDPKAISKDHLYGTLDPNTREWTDGLFTHVLRKIIDSVRGELQKRQWIVFDGDVDPEWVENLNSVLDDNKLLTLPNGERLSLPPNVRIMFEVQDLKYATLATVSRCGMVWFSEDVLSTDMIFNNFLARLRSIPLDEGEDEAQRRRKGKEDEGEEAASPMLQIQRDAATIMQPYFTSNGLVTKALEHAFQLEHIMDLTRLRCLGSLFSMLHQACRNVAQYNANHPDFPMQIEQLERYIQVRGHQGLHRAHQLRQTTGLRTSEMLHLWGCALSPRRGRAFVEGLGKVQWVSVMQEDWEPLSLVNFAVSVFLLLLKFYKNQSLIPFLIAISGLCHTLVPAGDSRLKMRAELGEYIRRITTVPLPTAPNIPIIDYEVSISGEWSPWQAKVPQIEVETHKVAAPDVVVPTLDTVRHEALLYTWLAEHKPLVLCGPPGSGKTMTLFSALRALPDMEVVGLNFSSATTPELLLKTFDHYCEYRRTPNGVVLAPVQLGKWLVLFCDEINLPDMDKYGTQRVISFIRQMVEHGGFYRTSDQTWVKLERIQFVGACNPPTDPGRKPLSHRFLRHVPVVYVDYPGPASLTQIYGTFNRAMLRLIPSLRTYAEPLTAAMVEFYTMSQERFTQDTQPHYIYSPREMTRWVRGIFEALRPLETLPVEGLIRIWAHEALRLFQDRLVEDEERRWTDENIDTVALKHFPNIDREKAMSRPILYSNWLSKDYIPVDQEELRDYVKARLKVFYEEELDVPLVLFNEVLDHVLRIDRIFRQPQGHLLLIGVSGAGKTTLSRFVAWMNGLSVYQIKVHRKYTGEDFDEDLRTVLRRSGCKNEKIAFIMDESNVLDSGFLERMNTLLANGEVPGLFEGDEYATLMTQCKEGAQKEGLMLDSHEELYKWFTSQVIRNLHVVFTMNPSSEGLKDRAATSPALFNRCVLNWFGDWSTEALYQVGKEFTSKMDLEKPNYIVPDYMPVVYDKLPQPPSHREAIVNSCVFVHQTLHQANARLAKRGGRTMAITPRHYLDFINHYANLFHEKRSELEEQQMHLNVGLRKIKETVDQVEELRRDLRIKSQELEVKNAAANDKLKKMVKDQQEAEKKKVMSQEIQEQLHKQQEVIADKQMSVKEDLDKVEPAVIEAQNAVKSIKKQHLVEVRSMANPPAAVKLALESICLLLGESTTDWKQIRSIIMRENFIPTIVNFSAEEISDAIREKMKKNYMSNPSYNYEIVNRASLACGPMVKWAIAQLNYADMLKRVEPLRNELQKLEDDAKDNQQKANEVEQMIRDLEASIARYKEEYAVLISEAQAIKADLAAVEAKVNRSTALLKSLSAERERWEKTSETFKNQMSTIAGDCLLSAAFIAYAGYFDQQMRQNLFTTWSHHLQQANIQFRTDIARTEYLSNADERLRWQASSLPADDLCTENAIMLKRFNRYPLIIDPSGQATEFIMNEYKDRKITRTSFLDDAFRKNLESALRFGNPLLVQVGVGLGILETLHSRVNSFLGAAFSFQLCKTSFCIRRIKLCGGSDKIPWSALKTLMAQSIYGGRVDNEFDQRLLNTFLERLFTTRSFDSEFKLACKVDGHKDIQMPDGIRREEFVQWVELLPDTQTPSWLGLPNNAERVLLTTQGVDMISKMLKMQMLEDEDDLAYAETEKKTRTDSTSDGRPAWMRTLHTTASNWLHLIPQTLSHLKRTVENIKDPLFRFFEREVKMGAKLLQDVRQDLADVVQVCEGKKKQTNYLRTLINELVKGILPRSWSHYTVPAGMTVIQWVSDFSERIKQLQNISLAAASGGAKELKNIHVCLGGLFVPEAYITATRQYVAQANSWSLEELCLEVNVTTSQGATLDACSFGVTGLKLQGATCNNNKLSLSNAISTALPLTQLRWVKQTNTEKKASVVTLPVYLNFTRADLIFTVDFEIATKEDPRSFYERGVAVLCTE

SEQ ID NO: 917666 - protein, 1667 aa, Homo sapiens
TDAAGYLEDPVSFIMDESNVLDSGFLERMNTLLANGEVPGLFEGDEYATLMTQCKEGAQKEGLMLDSHEELYKWFTSQVIRNLHVVFTMNPSSEGLKDRAATSPALFNRCVLNWFGDWSTEALYQVGKEFTSKMDLEKPNYIVPDYMPVVYDKLPQPPSHREAIVNSCVFVHQTLHQANARLAKRGGRTMAITPRHYLDFINHYANLFHEKRSELEEQQMHLNVGLRKIKETVDQVEELRRDLRIKSQELEVKNAAANDKLKKMVKDQQEAEKKKVMSQEIQEQLHKQQEVIADKQMSVKEDLDKVEPAVIEAQNAVKSIKKQHLVEVRSMANPPAAVKLALESICLLLGESTTDWKQIRSIIMRENFIPTIVNFSAEEISDAIREKMKKNYMSNPSYNYEIVNRASLACGPMVKWAIAQLNYADMLKRVEPLRNELQKLEDDAKDNQQKANEVEQMIRDLEASIARYKEEYAVLISEAQAIKADLAAVEAKVNRSTALLKSLSAERERWEKTSETFKNQMSTIAGDCLLSAAFIAYAGYFDQQMRQNLFTTWSHHLQQANIQFRTDIARTEYLSNADERLRWQASSLPADDLCTENAIMLKRFNRYPLIIDPSGQATEFIMNEYKDRKITRTSFLDDAFRKNLESALRFGNPLLVQDVESYDPVLNPVLNREVRRTGGRVLITLGDQDIDLSPSFVIFLSTRDPTVEFPPDLCSRVTFVNFTVTRSSLQSQCLNEVLKAERPDVDEKRSDLLKLQGEFQLRLRQLEKSLLQALNEVKGRILDDDTIITTLENLKREAAEVTRKVEETDIVMQEVETVSQQYLPLSTACSSIYFTMESLKQIHFLYQYSLQFFLDIYHNVLYENPNLKGVTDHTQRLSIITKDLFQVAFNRVARGMLHQDHITFAMLLARIKLKGTVGEPTYDAEFQHFLRGNEIVLSAGSTPRIQGLTVEQAEAVVRLSCLPAFKDLIAKVQADEQFGIWLDSSSPEQTVPYLWSEETPATPIGQAIHRLLLIQAFRPDRLLAMAHMFVSTNLGESFMSIMEQPLDLTHIVGTEVKPNTPVLMCSVPGYDASGHVEDLAAEQNTQITSIAIGSAEGFNQADKAINTAVKSGRWVMLKNVHLAPGWLMQLEKKLHSLQPHACFRLFLTMEINPKVPVNLLRAGRIFVFEPPPGVKANMLRTFSSIPVSRICKSPNERARLYFLLAWFHAIIQERLRYAPLGWSKKYEFGESDLRSACDTVDTWLDDTAKGRQNISPDKIPWSALKTLMAQSIYGGRVDNEFDQRLLNTFLERLFTTRSFDSEFKLACKVDGHKDIQMPDGIRREEFVQWVELLPDTQTPSWLGLPNNAERVLLTTQGVDMISKMLKMQMLEDEDDLAYAETEKKTRTDSTSDGRPAWMRTLHTTASNWLHLIPQTLSHLKRTVENIKDPLFRFFEREVKMGAKLLQDVRQDLADVVQVCEGKKKQTNYLRTLINELVKGILPRSWSHYTVPAGMTVIQWVSDFSERIKQLQNISLAAASGGAKELKNIHVCLGGLFVPEAYITATRQYVAQANSWSLEELCLEVNVTTSQGATLDACSFGVTGLKLQGATCNNNKLSLSNAISTALPLTQLRWVKQTNTEKKASVVTLPVYLNFTRADLIFTVDFEIATKEDPRSFYERGVAVLCTE

SEQ ID NO: 917667 - protein, 1012 aa, Homo sapiens
MQDVESYDPVLNPVLNREVRRTGGRVLITLGDQDIDLSPSFVIFLSTRDPTVEFPPDLCSRVTFVNFTVTRSSLQSQCLNEVLKAERPDVDEKRSDLLKLQGEFQLRLRQLEKSLLQALNEVKGRILDDDTIITTLENLKREAAEVTRKVEETDIVMQEVETVSQQYLPLSTACSSIYFTMESLKQIHFLYQYSLQFFLDIYHNVLYENPNLKGVTDHTQRLSIITKDLFQVAFNRVARGMLHQDHITFAMLLARIKLKGTVGEPTYDAEFQHFLRGNEIVLSAGSTPRIQGLTVEQAEAVVRLSCLPAFKDLIAKVQADEQFGIWLDSSSPEQTVPYLWSEETPATPIGQAIHRLLLIQAFRPDRLLAMAHMFVSTNLGESFMSIMEQPLDLTHIVGTEVKPNTPVLMCSVPGYDASGHVEDLAAEQNTQITSIAIGSAEGFNQADKAINTAVKSGRWVMLKNVHLAPGWLMQLEKKLHSLQPHACFRLFLTMEINPKVPVNLLRAGRIFVFEPPPGVKANMLRTFSSIPVSRICKSPNERARLYFLLAWFHAIIQERLRYAPLGWSKKYEFGESDLRSACDTVDTWLDDTAKGRQNISPDKIPWSALKTLMAQSIYGGRVDNEFDQRLLNTFLERLFTTRSFDSEFKLACKVDGHKDIQMPDGIRREEFVQWVELLPDTQTPSWLGLPNNAERVLLTTQGVDMISKMLKMQMLEDEDDLAYAETEKKTRTDSTSDGRPAWMRTLHTTASNWLHLIPQTLSHLKRTVENIKDPLFRFFEREVKMGAKLLQDVRQDLADVVQVCEGKKKQTNYLRTLINELVKGILPRSWSHYTVPAGMTVIQWVSDFSERIKQLQNISLAAASGGAKELKNIHVCLGGLFVPEAYITATRQYVAQANSWSLEELCLEVNVTTSQGATLDACSFGVTGLKLQGATCNNNKLSLSNAISTALPLTQLRWVKQTNTEKKASVVTLPVYLNFTRADLIFTVDFEIATKEDPRSFYERGVAVLCTE

SEQ ID NO: 917668 - protein, 3558 aa, Homo sapiens; identical to SEQ ID NO: 917657

SEQ ID NO: 917669 - protein, 4350 aa, Homo sapiens
MSEPGGGGGEDGSAGLEVSAVQNVADVSVLQKHLRKLVPLLLEDGGEAPAALEAALEEKSALEQMRKFLSDPQVHTVLVERSTLKEDVGDEGEEEKEFISYNINIDIHYGVKSNSLAFIKRTPVIDADKPVSSQLRVLTLSEDSPYETLHSFISNAVAPFFKSYIRESGKADRDGDKMAPSVEKKIAELEMGLLHLQQNIEIPEISLPIHPMITNVAKQCYERGEKPKVTDFGDKVEDPTFLNQLQSGVNRWIREIQKVTKLDRDPASGTALQEISFWLNLERALYRIQEKRESPEVLLTLDILKHGKRFHATVSFDTDTGLKQALETVNDYNPLMKDFPLNDLLSATELDKIRQALVAIFTHLRKIRNTKYPIQRALRLVEAISRDLSSQLLKVLGTRKLMHVAYEEFEKVMVACFEVFQTWDDEYEKLQVLLRDIVKRKREENLKMVWRINPAHRKLQARLDQMRKFRRQHEQLRAVIVRVLRPQVTAVAQQNQGEVPEPQDMKVAEVLFDAADANAIEEVNLAYENVKEVDGLDVSKEGTEAWEAAMKRYDERIDRVETRITARLRDQLGTAKNANEMFRIFSRFNALFVRPHIRGAIRDYQTQLIQRVKDDIESLHDKFKVQYPQSQACKMSHVRDLPPVSGSIIWAKQIDRQLTAYMKRVEDVLGKGWENHVEGQKLKQDGDSFRMKLNTQEIFDDWARKVQQRNLGVSGRIFTIESTRVRGRTGNVLKLKVNFLPEIITLSKEVRNLKWLGFRVPLAIVNKAHQANQLYPFAISLIESVRTYERTCEKVEERNTISLLVAGLKKEVQALIAEGIALVWESYKLDPYVQRLAETVFNFQEKVDDLLIIEEKIDLEVRSLETCMYDHKTFSEILNRVQKAVDDLNLHSYSNLPIWVNKLDMEIERILGVRLQAGLRAWTQVLLGQAEDKAEVDMDTDAPQVSHKPGGEPKIKNVVHELRITNQVIYLNPPIEECRYKLYQEMFAWKMVVLSLPRIQSQRYQVGVHYELTEEEKFYRNALTRMPDGPVALEESYSAVMGIVSEVEQYVKVWLQYQCLWDMQAENIYNRLGEDLNKWQALLVQIRKARGTFDNAETKKEFGPVVIDYGKVQSKVNLKYDSWHKEVLSKFGQMLGSNMTEFHSQISKSRQELEQHSVDTASTSDAVTFITYVQSLKRKIKQFEKQVELYRNGQRLLEKQRFQFPPSWLYIDNIEGEWGAFNDIMRRKDSAIQQQVANLQMKIVQEDRAVESRTTDLLTDWEKTKPVTGNLRPEEALQALTIYEGKFGRLKDDREKCAKAKEALELTDTGLLSGSEERVQVALEELQDLKGVWSELSKVWEQIDQMKEQPWVSVQPRKLRQNLDALLNQLKSFPARLRQYASYEFVQRLLKGYMKINMLVIELKSEALKDRHWKQLMKRLHVNWVVSELTLGQIWDVDLQKNEAIVKDVLLVAQGEMALEEFLKQIREVWNTYELDLVNYQNKCRLIRGWDDLFNKVKEHINSVSAMKLSPYYKVFEEDALSWEDKLNRIMALFDVWIDVQRRWVYLEGIFTGSADIKHLLPVETQRFQSISTEFLALMKKVSKSPLVMDVLNIQGVQRSLERLADLLGKIQKALGEYLERERSSFPRFYFVGDEDLLEIIGNSKNVAKLQKHFKKMFAGVSSIILNEDNSVVLGISSREGEEVMFKTPVSITEHPKINEWLTLVEKEMRVTLAKLLAESVTEVEIFGKATSIDPNTYITWIDKYQAQLVVLSAQIAWSENVETALSSMGGGGDAAPLHSVLSNVEVTLNVLADSVLMEQPPLRRRKLEHLITELVHQRDVTRSLIKSKIDNAKSFEWLSQMRFYFDPKQTDVLQQLSIQMANAKFNYGFEYLGVQDKLVQTPLTDRCYLTMTQALEARLGGSPFGPAGTGKTESVKALGHQLGRFVLVFNCDETFDFQAMGRIFVGLCQVGAWGCFDEFNRLEERMLSAVSQQVQCIQEALREHSNPNYDKTSAPITCELLNKQVKVSPDMAIFITMNPGYAGRSNLPDNLKKLFRSLAMTKPDRQLIAQVMLYSQGFRTAEVLANKIVPFFKLCDEQLSSQSHYDFGLRALKSVLVSAGNVKRERIQKIKREKEERGEAVDEGEIAENLPEQEILIQSVCETMVPKLVAEDIPLLFSLLSDVFPGVQYHRGEMTALREELKKVCQEMYLTYGDGEEVGGMWVEKVLQLYQITQINHGLMMVGPSGSGKSMAWRVLLKALERLEGVEGVAHIIDPKAISKDHLYGTLDPNTREWTDGLFTHVLRKIIDSVRGELQKRQWIVFDGDVDPEWVENLNSVLDDNKLLTLPNGERLSLPPNVRIMFEVQDLKYATLATVSRCGMVWFSEDVLSTDMIFNNFLARLRSIPLDEGEDEAQRRRKGKEDEGEEAASPMLQIQRDAATIMQPYFTSNGLVTKALEHAFQLEHIMDLTRLRCLGSLFSMLHQACRNVAQYNANHPDFPMQIEQLERYIQVRGHQGLHRAHQLRQTTGLRTSEMLHLWGCALSPRRGRAFVEGLGKVQWVSVMQEDWEPLSLVNFAVSVFLLLLKFYKNQSLIPFLIAISGLCHTLVPAGDSRLKMRAELGEYIRRITTVPLPTAPNIPIIDYEVSISGEWSPWQAKVPQIEVETHKVAAPDVVVPTLDTVRHEALLYTWLAEHKPLVLCGPPGSGKTMTLFSALRALPDMEVVGLNFSSATTPELLLKTFDHYCEYRRTPNGVVLAPVQLGKWLVLFCDEINLPDMDKYGTQRVISFIRQMVEHGGFYRTSDQTWVKLERIQFVGACNPPTDPGRKPLSHRFLRHVPVVYVDYPGPASLTQIYGTFNRAMLRLIPSLRTYAEPLTAAMVEFYTMSQERFTQDTQPHYIYSPREMTRWVRGIFEALRPLETLPVEGLIRIWAHEALRLFQDRLVEDEERRWTDENIDTVALKHFPNIDREKAMSRPILYSNWLSKDYIPVDQEELRDYVKARLKVFYEEELDVPLVLFNEVLDHVLRIDRIFRQPQGHLLLIGVSGAGKTTLSRFVAWMNGLSVYQIKVHRKYTGEDFDEDLRTVLRRSGCKNEKIAFIMDESNVLDSGFLERMNTLLANGEVPGLFEGDEYATLMTQCKEGAQKEGLMLDSHEELYKWFTSQVIRNLHVVFTMNPSSEGLKDRAATSPALFNRCVLNWFGDWSTEALYQVGKEFTSKMDLEKPNYIVPDYMPVVYDKLPQPPSHREAIVNSCVFVHQTLHQANARLAKRGGRTMAITPRHYLDFINHYANLFHEKRSELEEQQMHLNVGLRKIKETVDQVEELRRDLRIKSQELEVKNAAANDKLKKMVKDQQEAEKKKVMSQEIQEQLHKQQEVIADKQMSVKEDLDKVEPAVIEAQNAVKSIKKQHLVEVRSMANPPAAVKLALESICLLLGESTTDWKQIRSIIMRENFIPTIVNFSAEEISDAIREKMKKNYMSNPSYNYEIVNRASLACGPMVKWAIAQLNYADMLKRVEPLRNELQKLEDDAKDNQQKANEVEQMIRDLEASIARYKEEYAVLISEAQAIKADLAAVEAKVNRSTALLKSLSAERERWEKTSETFKNQMSTIAGDCLLSAAFIAYAGYFDQQMRQNLFTTWSHHLQQANIQFRTDIARTEYLSNADERLRWQASSLPADDLCTENAIMLKRFNRYPLIIDPSGQATEFIMNEYKDRKITRTSFLDDAFRKNLESALRFGNPLLVQDVESYDPVLNPVLNREVRRTGGRVLITLGDQDIDLSPSFVIFLSTRDPTVEFPPDLCSRVTFVNFTVTRSSLQSQCLNEVLKAERPDVDEKRSDLLKLQGEFQLRLRQLEKSLLQALNEVKGRILDDDTIITTLENLKREAAEVTRKVEETDIVMQEVETVSQQYLPLSTACSSIYFTMESLKQIHFLYQYSLQFFLDIYHNVLYENPNLKGVTDHTQRLSIITKDLFQVAFNRVARGMLHQDHITFAMLLARIKLKGTVGEPTYDAEFQHFLRGNEIVLSAGSTPRIQGLTVEQAEAVVRLSCLPAFKDLIAKVQADEQFGIWLDSSSPEQTVPYLWSEETPATPIGQAIHRLLLIQAFRPDRLLAMAHMFVSTNLGESFMSIMEQPLDLTHIVGTEVKPNTPVLMCSVPGYDASGHVEDLAAEQNTQITSIAIGSAEGFNQADKAINTAVKSGRWVMLKNVHLAPGWLMQLEKKLHSLQPHACFRLFLTMEINPKVPVNLLRAGRIFVFEPPPGVKANMLRTFSSIPVSRICKVSTLSSWYAFPIEAKAQSHHQMQKWVPGPPEVPCGELHSCFCFSAVGKISFHGRAPWLTLVILALWKVEVGGSLEPRSSRLSGQARSGGSRL

SEQ ID NO: 917670 - protein, 545 aa, Homo sapiens
MSEPDRSVNDCVHWPSSHTGLRVFLTMEINPKVPVNLLRAGRIFVFEPPPGVKANMLRTFSSIPVSRICKSPNERARLYFLLAWFHAIIQERLRYAPLGWSKKYEFGESDLRSACDTVDTWLDDTAKGRQNISPDKIPWSALKTLMAQSIYGGRVDNEFDQRLLNTFLERLFTTRSFDSEFKLACKVDGHKDIQMPDGIRREEFVQWVELLPDTQTPSWLGLPNNAERVLLTTQGVDMISKMLKMQMLEDEDDLAYAETEKKTRTDSTSDGRPAWMRTLHTTASNWLHLIPQTLSHLKRTVENIKDPLFRFFEREVKMGAKLLQDVRQDLADVVQVCEGKKKQTNYLRTLINELVKGILPRSWSHYTVPAGMTVIQWVSDFSERIKQLQNISLAAASGGAKELKNIHVCLGGLFVPEAYITATRQYVAQANSWSLEELCLEVNVTTSQGATLDACSFGVTGLKLQGATCNNNKLSLSNAISTALPLTQLRWVKQTNTEKKASVVTLPVYLNFTRADLIFTVDFEIATKEDPRSFYERGVAVLCTE

SEQ ID NO: 917671 - protein, 400 aa, Homo sapiens [sequence omitted]

SEQ ID NO: 917672 - protein, 3687 aa, Homo sapiens
MSEPGGGGGEDGSAGLEVSAVQNVADVSVLQKHLRKLVPLLLEDGGEAPAALEAALEEKSALEQMRKFLSDPQVHTVLVERSTLKEDVGDEGEEEKEFISYNINIDIHYGVKSNSLAFIKRTPVIDADKPVSSQLRVLTLSEDSPYETLHSFISNAVAPFFKSYIRESGKADRDGDKMAPSVEKKIAELEMGLLHLQQNIEIPEISLPIHPMITNVAKQCYERGEKPKVTDFGDKVEDPTFLNQLQSGVNRWIREIQKVTKLDRDPASGTALQEISFWLNLERALYRIQEKRESPEVLLTLDILKHGKRFHATVSFDTDTGLKQALETVNDYNPLMKDFPLNDLLSATELDKIRQALVAIFTHLRKIRNTKYPIQRALRLVEAISRDLSSQLLKVLGTRKLMHVAYEEFEKVMVACFEVFQTWDDEYEKLQVLLRDIVKRKREENLKMVWRINPAHRKLQARLDQMRKFRRQHEQLRAVIVRVLRPQVTAVAQQNQGEVPEPQDMKVAEVLFDAADANAIEEVNLAYENVKEVDGLDVSKEGTEAWEAAMKRYDERIDRVETRITARLRDQLGTAKNANEMFRIFSRFNALFVRPHIRGAIRDYQTQLIQRVKDDIESLHDKFKVQYPQSQACKMSHVRDLPPVSGSIIWAKQIDRQLTAYMKRVEDVLGKGWENHVEGQKLKQDGDSFRMKLNTQEIFDDWARKVQQRNLGVSGRIFTIESTRVRGRTGNVLKLKVNFLPEIITLSKEVRNLKWLGFRVPLAIVNKAHQANQLYPFAISLIESVRTYERTCEKVEERNTISLLVAGLKKEVQALIAEGIALVWESYKLDPYVQRLAETVFNFQEKVDDLLIIEEKIDLEVRSLETCMYDHKTFSEILNRVQKAVDDLNLHSYSNLPIWVNKLDMEIERILGVRLQAGLRAWTQVLLGQAEDKAEVDMDTDAPQVSHKPGGEPKIKNVVHELRITNQVIYLNPPIEECRYKLYQEMFAWKMVVLSLPRIQSQRYQVGVHYELTEEEKFYRNALTRMPDGPVALEESYSAVMGIVSEVEQYVKVWLQYQCLWDMQAENIYNRLGEDLNKWQALLVQIRKARGTFDNAETKKEFGPVVIDYGKVQSKVNLKYDSWHKEVLSKFGQMLGSNMTEFHSQISKSRQELEQHSVDTASTSDAVTFITYVQSLKRKIKQFEKQVELYRNGQRLLEKQRFQFPPSWLYIDNIEGEWGAFNDIMRRKDSAIQQQVANLQMKIVQEDRAVESRTTDLLTDWEKTKPVTGNLRPEEALQALTIYEGKFGRLKDDREKCAKAKEALELTDTGLLSGSEERVQVALEELQDLKGVWSELSKVWEQIDQMKEQPWVSVQPRKLRQNLDALLNQLKSFPARLRQYASYEFVQRLLKGYMKINMLVIELKSEALKDRHWKQLMKRLHVNWVVSELTLGQIWDVDLQKNEAIVKDVLLVAQGEMALEEFLKQIREVWNTYELDLVNYQNKCRLIRGWDDLFNKVKEHINSVSAMKLSPYYKVFEEDALSWEDKLNRIMALFDVWIDVQRRWVYLEGIFTGSADIKHLLPVETQRFQSISTEFLALMKKVSKSPLVMDVLNIQGVQRSLERLADLLGKIQKALGEYLERERSSFPRFYFVGDEDLLEIIGNSKNVAKLQKHFKKMFAGVSSIILNEDNSVVLGISSREGEEVMFKTPVSITEHPKINEWLTLVEKEMRVTLAKLLAESVTEVEIFGKATSIDPNTYITWIDKYQAQLVVLSAQIAWSENVETALSSMGGGGDAAPLHSVLSNVEVTLNVLADSVLMEQPPLRRRKLEHLITELVHQRDVTRSLIKSKIDNAKSFEWLSQMRFYFDPKQTDVLQQLSIQMANAKFNYGFEYLGVQDKLVQTPLTDRCYLTMTQALEARLGGSPFGPAGTGKTESVKALGHQLGRFVLVFNCDETFDFQAMGRIFVGLCQVGAWGCFDEFNRLEERMLSAVSQQVQCIQEALREHSNPNYDKTSAPITCELLNKQVKVSPDMAIFITMNPGYAGRSNLPDNLKKLFRSLAMTKPDRQLIAQVMLYSQGFRTAEVLANKIVPFFKLCDEQLSSQSHYDFGLRALKSVLVSAGNVKRERIQKIKREKEERGEAVDEGEIAENLPEQEILIQSVCETMVPKLVAEDIPLLFSLLSDVFPGVQYHRGEMTALREELKKVCQEMYLTYGDGEEVGGMWVEKVLQLYQITQINHGLMMVGPSGSGKSMAWRVLLKALERLEGVEGVAHIIDPKAISKDHLYGTLDPNTREWTDGLFTHVLRKIIDSVRGELQKRQWIVFDGDVDPEWVENLNSVLDDNKLLTLPNGERLSLPPNVRIMFEVQDLKYATLATVSRCGMVWFSEDVLSTDMIFNNFLARLRSIPLDEGEDEAQRRRKGKEDEGEEAASPMLQIQRDAATIMQPYFTSNGLVTKALEHAFQLEHIMDLTRLRCLGSLFSMLHQACRNVAQYNANHPDFPMQIEQLERYIQVRGHQGLHRAHQLRQTTGLRTSEMLHLWGCALSPRRGRAFVEGLGKVQWVSVMQEDWEPLSLVNFAVSVFLLLLKFYKNQSLIPFLIAISGLCHTLVPAGDSRLKMRAELGEYIRRITTVPLPTAPNIPIIDYEVSISGEWSPWQAKVPQIEVETHKVAAPDVVVPTLDTVRHEALLYTWLAEHKPLVLCGPPGSGKTMTLFSALRALPDMEVVGLNFSSATTPELLLKTFDHYCEYRRTPNGVVLAPVQLGKWLVLFCDEINLPDMDKYGTQRVISFIRQMVEHGGFYRTSDQTWVKLERIQFVGACNPPTDPGRKPLSHRFLRHVPVVYVDYPGPASLTQIYGTFNRAMLRLIPSLRTYAEPLTAAMVEFYTMSQERFTQDTQPHYIYSPREMTRWVRGIFEALRPLETLPVEGLIRIWAHEALRLFQDRLVEDEERRWTDENIDTVALKHFPNIDREKAMSRPILYSNWLSKDYIPVDQEELRDYVKARLKVFYEEELDVPLVLFNEVLDHVLRIDRIFRQPQGHLLLIGVSGAGKTTLSRFVAWMNGLSVYQIKVHRKYTGEDFDEDLRTVLRRSGCKNEKIAFIMDESNVLDSGFLERMNTLLANGEVPGLFEGDEYATLMTQCKEGAQKEGLMLDSHEELYKWFTSQVIRNLHVVFTMNPSSEGLKDRAATSPALFNRCVLNWFGDWSTEALYQVGKEFTSKMDLEKPNYIVPDYMPVVYDKLPQPPSHREAIVNSCVFVHQTLHQANARLAKRGGRTMAITPRHYLDFINHYANLFHEKRSELEEQQMHLNVGLRKIKETVDQVEELRRDLRIKSQELEVKNAAANDKLKKMVKDQQEAEKKKVMSQEIQEQLHKQQEVIADKQMSVKEDLDKVEPAVIEAQNAVKSIKKQHLVEVRSMANPPAAVKLALESICLLLGESTTDWKQIRSIIMRENFIPTIVNFSAEEISDAIREKMKKNYMSNPSYNYEIVNRASLACGPMVKWAIAQLNYADMLKRVEPLRNELQKLEDDAKDNQQKANEVEQMIRDLEASIARYKEEYAVLISEAQAIKADLAAVEAKVNRSTALLKSLSAERERWEKTSETFKNQMSTIAGDCLLSAAFIAYAGYFDQQMRQNLFTTWSHHLQQANIQFRTDIARTEYLSNADERLRWQASSLPADDLCTENAIMLKRFNRYELGCQGEAWEECGW

SEQ ID NO: 917673 - protein, 2983 aa, Homo sapiens
MSEPGGGGGEDGSAGLEVSAVQNVADVSVLQKHLRKLVPLLLEDGGEAPAALEAALEEKSALEQMRKFLSDPQVHTVLVERSTLKEDVGDEGEEEKEFISYNINIDIHYGVKSNSLAFIKRTPVIDADKPVSSQLRVLTLSEDSPYETLHSFISNAVAPFFKSYIRESGKADRDGDKMAPSVEKKIAELEMGLLHLQQNIEIPEISLPIHPMITNVAKQCYERGEKPKVTDFGDKVEDPTFLNQLQSGVNRWIREIQKVTKLDRDPASGTALQEISFWLNLERALYRIQEKRESPEVLLTLDILKHGKRFHATVSFDTDTGLKQALETVNDYNPLMKDFPLNDLLSATELDKIRQALVAIFTHLRKIRNTKYPIQRALRLVEAISRDLSSQLLKVLGTRKLMHVAYEEFEKVMVACFEVFQTWDDEYEKLQVLLRDIVKRKREENLKMVWRINPAHRKLQARLDQMRKFRRQHEQLRAVIVRVLRPQVTAVAQQNQGEVPEPQDMKVAEVLFDAADANAIEEVNLAYENVKEVDGLDVSKEGTEAWEAAMKRYDERIDRVETRITARLRDQLGTAKNANEMFRIFSRFNALFVRPHIRGAIRDYQTQLIQRVKDDIESLHDKFKVQYPQSQACKMSHVRDLPPVSGSIIWAKQIDRQLTAYMKRVEDVLGKGWENHVEGQKLKQDGDSFRMKLNTQEIFDDWARKVQQRNLGVSGRIFTIESTRVRGRTGNVLKLKVNFLPEIITLSKEVRNLKWLGFRVPLAIVNKAHQANQLYPFAISLIESVRTYERTCEKVEERNTISLLVAGLKKEVQALIAEGIALVWESYKLDPYVQRLAETVFNFQEKVDDLLIIEEKIDLEVRSLETCMYDHKTFSEILNRVQKAVDDLNLHSYSNLPIWVNKLDMEIERILGVRLQAGLRAWTQVLLGQAEDKAEVDMDTDAPQVSHKPGGEPKIKNVVHELRITNQVIYLNPPIEECRYKLYQEMFAWKMVVLSLPRIQSQRYQVGVHYELTEEEKFYRNALTRMPDGPVALEESYSAVMGIVSEVEQYVKVWLQYQCLWDMQAENIYNRLGEDLNKWQALLVQIRKARGTFDNAETKKEFGPVVIDYGKVQSKVNLKYDSWHKEVLSKFGQMLGSNMTEFHSQISKSRQELEQHSVDTASTSDAVTFITYVQSLKRKIKQFEKQVELYRNGQRLLEKQRFQFPPSWLYIDNIEGEWGAFNDIMRRKDSAIQQQVANLQMKIVQEDRAVESRTTDLLTDWEKTKPVTGNLRPEEALQALTIYEGKFGRLKDDREKCAKAKEALELTDTGLLSGSEERVQVALEELQDLKGVWSELSKVWEQIDQMKEQPWVSVQPRKLRQNLDALLNQLKSFPARLRQYASYEFVQRLLKGYMKINMLVIELKSEALKDRHWKQLMKRLHVNWVVSELTLGQIWDVDLQKNEAIVKDVLLVAQGEMALEEFLKQIREVWNTYELDLVNYQNKCRLIRGWDDLFNKVKEHINSVSAMKLSPYYKVFEEDALSWEDKLNRIMALFDVWIDVQRRWVYLEGIFTGSADIKHLLPVETQRFQSISTEFLALMKKVSKSPLVMDVLNIQGVQRSLERLADLLGKIQKALGEYLERERSSFPRFYFVGDEDLLEIIGNSKNVAKLQKHFKKMFAGVSSIILNEDNSVVLGISSREGEEVMFKTPVSITEHPKINEWLTLVEKEMRVTLAKLLAESVTEVEIFGKATSIDPNTYITWIDKYQAQLVVLSAQIAWSENVETALSSMGGGGDAAPLHSVLSNVEVTLNVLADSVLMEQPPLRRRKLEHLITELVHQRDVTRSLIKSKIDNAKSFEWLSQMRFYFDPKQTDVLQQLSIQMANAKFNYGFEYLGVQDKLVQTPLTDRCYLTMTQALEARLGGSPFGPAGTGKTESVKALGHQLGRFVLVFNCDETFDFQAMGRIFVGLCQVGAWGCFDEFNRLEERMLSAVSQQVQCIQEALREHSNPNYDKTSAPITCELLNKQVKVSPDMAIFITMNPGYAGRSNLPDNLKKLFRSLAMTKPDRQLIAQVMLYSQGFRTAEVLANKIVPFFKLCDEQLSSQSHYDFGLRALKSVLVSAGNVKRERIQKIKREKEERGEAVDEGEIAENLPEQEILIQSVCETMVPKLVAEDIPLLFSLLSDVFPGVQYHRGEMTALREELKKVCQEMYLTYGDGEEVGGMWVEKVLQLYQITQINHGLMMVGPSGSGKSMAWRVLLKALERLEGVEGVAHIIDPKAISKDHLYGTLDPNTREWTDGLFTHVLRKIIDSVRGELQKRQWIVFDGDVDPEWVENLNSVLDDNKLLTLPNGERLSLPPNVRIMFEVQDLKYATLATVSRCGMVWFSEDVLSTDMIFNNFLARLRSIPLDEGEDEAQRRRKGKEDEGEEAASPMLQIQRDAATIMQPYFTSNGLVTKALEHAFQLEHIMDLTRLRCLGSLFSMLHQACRNVAQYNANHPDFPMQIEQLERYIQVRGHQGLHRAHQLRQTTGLRTSEMLHLWGCALSPRRGRAFVEGLGKVQWVSVMQEDWEPLSLVNFAVSVFLLLLKFYKNQSLIPFLIAISGLCHTLVPAGDSRLKMRAELGEYIRRITTVPLPTAPNIPIIDYEVSISGEWSPWQAKVPQIEVETHKVAAPDVVVPTLDTVRHEALLYTWLAEHKPLVLCGPPGSGKTMTLFSALRALPDMEVVGLNFSSATTPELLLKTFDHYCEYRRTPNGVVLAPVQLGKWLVLFCDEINLPDMDKYGTQRVISFIRQMVEHGGFYRTSDQTWVKLERIQFVGACNPPTDPGRKPLSHRFLRHVPVVYVDYPGPASLTQIYGTFNRAMLRLIPSLRTYAEPLTAAMVEFYTMSQERFTQDTQPHYIYSPREMTRWVRGIFEALRPLETLPVEGLIRIWAHEALRLFQDRLVEDEERRWTDENIDTVALKHFPNIDREKAMSRPILYSNWLSKVANSHHFRHTSFSAIPF

SEQ ID NO: 917674 - protein, 318 aa, Homo sapiens
RLWDCGPGVDMISKMLKMQMLEDEDDLAYAETEKKTRTDSTSDGRPAWMRTLHTTASNWLHLIPQTLSHLKRTVENIKDPLFRFFEREVKMGAKLLQDVRQDLADVVQVCEGKKKQTNYLRTLINELVKGILPRSWSHYTVPAGMTVIQWVSDFSERIKQLQNISLAAASGGAKELKNIHVCLGGLFVPEAYITATRQYVAQANSWSLEELCLEVNVTTSQGATLDACSFGVTGLKLQGATCNNNKLSLSNAISTALPLTQLRWVKQTNTEKKASVVTLPVYLNFTRADLIFTVDFEIATKEDPRSFYERGVAVLCTE

SEQ ID NO: 917675 - protein, 247 aa, Homo sapiens
HPFERFKDPLFRFFEREVKMGAKLLQDVRQDLADVVQVCEGKKKQTNYLRTLINELVKGILPRSWSHYTVPAGMTVIQWVSDFSERIKQLQNISLAAASGGAKELKNIHVCLGGLFVPEAYITATRQYVAQANSWSLEELCLEVNVTTSQGATLDACSFGVTGLKLQGATCNNNKLSLSNAISTALPLTQLRWVKQTNTEKKASVVTLPVYLNFTRADLIFTVDFEIATKEDPRSFYERGVAVLCTE

SEQ ID NO: 917676 - protein, 2851 aa, Homo sapiens
MSEPGGGGGEDGSAGLEVSAVQNVADVSVLQKHLRKLVPLLLEDGGEAPAALEAALEEKSALEQMRKFLSDPQVHTVLVERSTLKEDVGDEGEEEKEFISYNINIDIHYGVKSNSLAFIKRTPVIDADKPVSSQLRVLTLSEDSPYETLHSFISNAVAPFFKSYIRESGKADRDGDKMAPSVEKKIAELEMGLLHLQQNIEIPEISLPIHPMITNVAKQCYERGEKPKVTDFGDKVEDPTFLNQLQSGVNRWIREIQKVTKLDRDPASGTALQEISFWLNLERALYRIQEKRESPEVLLTLDILKHGKRFHATVSFDTDTGLKQALETVNDYNPLMKDFPLNDLLSATELDKIRQALVAIFTHLRKIRNTKYPIQRALRLVEAISRDLSSQLLKVLGTRKLMHVAYEEFEKVMVACFEVFQTWDDEYEKLQVLLRDIVKRKREENLKMVWRINPAHRKLQARLDQMRKFRRQHEQLRAVIVRVLRPQVTAVAQQNQGEVPEPQDMKVAEVLFDAADANAIEEVNLAYENVKEVDGLDVSKEGTEAWEAAMKRYDERIDRVETRITARLRDQLGTAKNANEMFRIFSRFNALFVRPHIRGAIRDYQTQLIQRVKDDIESLHDKFKVQYPQSQACKMSHVRDLPPVSGSIIWAKQIDRQLTAYMKRVEDVLGKGWENHVEGQKLKQDGDSFRMKLNTQEIFDDWARKVQQRNLGVSGRIFTIESTRVRGRTGNVLKLKVNFLPEIITLSKEVRNLKWLGFRVPLAIVNKAHQANQLYPFAISLIESVRTYERTCEKVEERNTISLLVAGLKKEVQALIAEGIALVWESYKLDPYVQRLAETVFNFQEKVDDLLIIEEKIDLEVRSLETCMYDHKTFSEILNRVQKAVDDLNLHSYSNLPIWVNKLDMEIERILGVRLQAGLRAWTQVLLGQAEDKAEVDMDTDAPQVSHKPGGEPKIKNVVHELRITNQVIYLNPPIEECRYKLYQEMFAWKMVVLSLPRIQSQRYQVGVHYELTEEEKFYRNALTRMPDGPVALEESYSAVMGIVSEVEQYVKVWLQYQCLWDMQAENIYNRLGEDLNKWQALLVQIRKARGTFDNAETKKEFGPVVIDYGKVQSKVNLKYDSWHKEVLSKFGQMLGSNMTEFHSQISKSRQELEQHSVDTASTSDAVTFITYVQSLKRKIKQFEKQVELYRNGQRLLEKQRFQFPPSWLYIDNIEGEWGAFNDIMRRKDSAIQQQVANLQMKIVQEDRAVESRTTDLLTDWEKTKPVTGNLRPEEALQALTIYEGKFGRLKDDREKCAKAKEALELTDTGLLSGSEERVQVALEELQDLKGVWSELSKVWEQIDQMKEQPWVSVQPRKLRQNLDALLNQLKSFPARLRQYASYEFVQRLLKGYMKINMLVIELKSEALKDRHWKQLMKRLHVNWVVSELTLGQIWDVDLQKNEAIVKDVLLVAQGEMALEEFLKQIREVWNTYELDLVNYQNKCRLIRGWDDLFNKVKEHINSVSAMKLSPYYKVFEEDALSWEDKLNRIMALFDVWIDVQRRWVYLEGIFTGSADIKHLLPVETQRFQSISTEFLALMKKVSKSPLVMDVLNIQGVQRSLERLADLLGKIQKALGEYLERERSSFPRFYFVGDEDLLEIIGNSKNVAKLQKHFKKMFAGVSSIILNEDNSVVLGISSREGEEVMFKTPVSITEHPKINEWLTLVEKEMRVTLAKLLAESVTEVEIFGKATSIDPNTYITWIDKYQAQLVVLSAQIAWSENVETALSSMGGGGDAAPLHSVLSNVEVTLNVLADSVLMEQPPLRRRKLEHLITELVHQRDVTRSLIKSKIDNAKSFEWLSQMRFYFDPKQTDVLQQLSIQMANAKFNYGFEYLGVQDKLVQTPLTDRCYLTMTQALEARLGGSPFGPAGTGKTESVKALGHQLGRFVLVFNCDETFDFQAMGRIFVGLCQVGAWGCFDEFNRLEERMLSAVSQQVQCIQEALREHSNPNYDKTSAPITCELLNKQVKVSPDMAIFITMNPGYAGRSNLPDNLKKLFRSLAMTKPDRQLIAQVMLYSQGFRTAEVLANKIVPFFKLCDEQLSSQSHYDFGLRALKSVLVSAGNVKRERIQKIKREKEERGEAVDEGEIAENLPEQEILIQSVCETMVPKLVAEDIPLLFSLLSDVFPGVQYHRGEMTALREELKKVCQEMYLTYGDGEEVGGMWVEKVLQLYQITQINHGLMMVGPSGSGKSMAWRVLLKALERLEGVEGVAHIIDPKAISKDHLYGTLDPNTREWTDGLFTHVLRKIIDSVRGELQKRQWIVFDGDVDPEWVENLNSVLDDNKLLTLPNGERLSLPPNVRIMFEVQDLKYATLATVSRCGMVWFSEDVLSTDMIFNNFLARLRSIPLDEGEDEAQRRRKGKEDEGEEAASPMLQIQRDAATIMQPYFTSNGLVTKALEHAFQLEHIMDLTRLRCLGSLFSMLHQACRNVAQYNANHPDFPMQIEQLERYIQVRGHQGLHRAHQLRQTTGLRTSEMLHLWGCALSPRRGRAFVEGLGKVQWVSVMQEDWEPLSLVNFAVSVFLLLLKFYKNQSLIPFLIAISGLCHTLVPAGDSRLKMRAELGEYIRRITTVPLPTAPNIPIIDYEVSISGEWSPWQAKVPQIEVETHKVAAPDVVVPTLDTVRHEALLYTWLAEHKPLVLCGPPGSGKTMTLFSALRALPDMEVVGLNFSSATTPELLLKTFDHYCEYRRTPNGVVLAPVQLGKWLVLFCDEINLPDMDKYGTQRVISFIRQMVEHGGFYRTSDQTWVKLERIQFVGACNPPTDPGRKPLSHRFLRHVPVVYVDYPGPASLTQIYGTFNRAMLRLIPSLRK

SEQ ID NO: 917677 - protein, 2822 aa, Homo sapiens
MSEPGGGGGEDGSAGLEVSAVQNVADVSVLQKHLRKLVPLLLEDGGEAPAALEAALEEKSALEQMRKFLSDPQVHTVLVERSTLKEDVGDEGEEEKEFISYNINIDIHYGVKSNSLAFIKRTPVIDADKPVSSQLRVLTLSEDSPYETLHSFISNAVAPFFKSYIRESGKADRDGDKMAPSVEKKIAELEMGLLHLQQNIEIPEISLPIHPMITNVAKQCYERGEKPKVTDFGDKVEDPTFLNQLQSGVNRWIREIQKVTKLDRDPASGTALQEISFWLNLERALYRIQEKRESPEVLLTLDILKHGKRFHATVSFDTDTGLKQALETVNDYNPLMKDFPLNDLLSATELDKIRQALVAIFTHLRKIRNTKYPIQRALRLVEAISRDLSSQLLKVLGTRKLMHVAYEEFEKVMVACFEVFQTWDDEYEKLQVLLRDIVKRKREENLKMVWRINPAHRKLQARLDQMRKFRRQHEQLRAVIVRVLRPQVTAVAQQNQGEVPEPQDMKVAEVLFDAADANAIEEVNLAYENVKEVDGLDVSKEGTEAWEAAMKRYDERIDRVETRITARLRDQLGTAKNANEMFRIFSRFNALFVRPHIRGAIRDYQTQLIQRVKDDIESLHDKFKVQYPQSQACKMSHVRDLPPVSGSIIWAKQIDRQLTAYMKRVEDVLGKGWENHVEGQKLKQDGDSFRMKLNTQEIFDDWARKVQQRNLGVSGRIFTIESTRVRGRTGNVLKLKVNFLPEIITLSKEVRNLKWLGFRVPLAIVNKAHQANQLYPFAISLIESVRTYERTCEKVEERNTISLLVAGLKKEVQALIAEGIALVWESYKLDPYVQRLAETVFNFQEKVDDLLIIEEKIDLEVRSLETCMYDHKTFSEILNRVQKAVDDLNLHSYSNLPIWVNKLDMEIERILGVRLQAGLRAWTQVLLGQAEDKAEVDMDTDAPQVSHKPGGEPKIKNVVHELRITNQVIYLNPPIEECRYKLYQEMFAWKMVVLSLPRIQSQRYQVGVHYELTEEEKFYRNALTRMPDGPVALEESYSAVMGIVSEVEQYVKVWLQYQCLWDMQAENIYNRLGEDLNKWQALLVQIRKARGTFDNAETKKEFGPVVIDYGKVQSKVNLKYDSWHKEVLSKFGQMLGSNMTEFHSQISKSRQELEQHSVDTASTSDAVTFITYVQSLKRKIKQFEKQVELYRNGQRLLEKQRFQFPPSWLYIDNIEGEWGAFNDIMRRKDSAIQQQVANLQMKIVQEDRAVESRTTDLLTDWEKTKPVTGNLRPEEALQALTIYEGKFGRLKDDREKCAKAKEALELTDTGLLSGSEERVQVALEELQDLKGVWSELSKVWEQIDQMKEQPWVSVQPRKLRQNLDALLNQLKSFPARLRQYASYEFVQRLLKGYMKINMLVIELKSEALKDRHWKQLMKRLHVNWVVSELTLGQIWDVDLQKNEAIVKDVLLVAQGEMALEEFLKQIREVWNTYELDLVNYQNKCRLIRGWDDLFNKVKEHINSVSAMKLSPYYKVFEEDALSWEDKLNRIMALFDVWIDVQRRWVYLEGIFTGSADIKHLLPVETQRFQSISTEFLALMKKVSKSPLVMDVLNIQGVQRSLERLADLLGKIQKALGEYLERERSSFPRFYFVGDEDLLEIIGNSKNVAKLQKHFKKMFAGVSSIILNEDNSVVLGISSREGEEVMFKTPVSITEHPKINEWLTLVEKEMRVTLAKLLAESVTEVEIFGKATSIDPNTYITWIDKYQAQLVVLSAQIAWSENVETALSSMGGGGDAAPLHSVLSNVEVTLNVLADSVLMEQPPLRRRKLEHLITELVHQRDVTRSLIKSKIDNAKSFEWLSQMRFYFDPKQTDVLQQLSIQMANAKFNYGFEYLGVQDKLVQTPLTDRCYLTMTQALEARLGGSPFGPAGTGKTESVKALGHQLGRFVLVFNCDETFDFQAMGRIFVGLCQVGAWGCFDEFNRLEERMLSAVSQQVQCIQEALREHSNPNYDKTSAPITCELLNKQVKVSPDMAIFITMNPGYAGRSNLPDNLKKLFRSLAMTKPDRQLIAQVMLYSQGFRTAEVLANKIVPFFKLCDEQLSSQSHYDFGLRALKSVLVSAGNVKRERIQKIKREKEERGEAVDEGEIAENLPEQEILIQSVCETMVPKLVAEDIPLLFSLLSDVFPGVQYHRGEMTALREELKKVCQEMYLTYGDGEEVGGMWVEKVLQLYQITQINHGLMMVGPSGSGKSMAWRVLLKALERLEGVEGVAHIIDPKAISKDHLYGTLDPNTREWTDGLFTHVLRKIIDSVRGELQKRQWIVFDGDVDPEWVENLNSVLDDNKLLTLPNGERLSLPPNVRIMFEVQDLKYATLATVSRCGMVWFSEDVLSTDMIFNNFLARLRSIPLDEGEDEAQRRRKGKEDEGEEAASPMLQIQRDAATIMQPYFTSNGLVTKALEHAFQLEHIMDLTRLRCLGSLFSMLHQACRNVAQYNANHPDFPMQIEQLERYIQVRGHQGLHRAHQLRQTTGLRTSEMLHLWGCALSPRRGRAFVEGLGKVQWVSVMQEDWEPLSLVNFAVSVFLLLLKFYKNQSLIPFLIAISGLCHTLVPAGDSRLKMRAELGEYIRRITTVPLPTAPNIPIIDYEVSISGEWSPWQAKVPQIEVETHKVAAPDVVVPTLDTVRHEALLYTWLAEHKPLVLCGPPGSGKTMTLFSALRALPDMEVVGLNFSSATTPELLLKTFDHYCEYRRTPNGVVLAPVQLGKWLVLFCDEINLPDMDKYGTQRVISFIRQMVEHGGFYRTSDQTWVKLERIQFVGACNPPTDPGRKPLSHRSTAPANAPC

SEQ ID NO: 917678 - protein, 2509 aa, Homo sapiens
MSEPGGGGGEDGSAGLEVSAVQNVADVSVLQKHLRKLVPLLLEDGGEAPAALEAALEEKSALEQMRKFLSDPQVHTVLVERSTLKEDVGDEGEEEKEFISYNINIDIHYGVKSNSLAFIKRTPVIDADKPVSSQLRVLTLSEDSPYETLHSFISNAVAPFFKSYIRESGKADRDGDKMAPSVEKKIAELEMGLLHLQQNIEIPEISLPIHPMITNVAKQCYERGEKPKVTDFGDKVEDPTFLNQLQSGVNRWIREIQKVTKLDRDPASGTALQEISFWLNLERALYRIQEKRESPEVLLTLDILKHGKRFHATVSFDTDTGLKQALETVNDYNPLMKDFPLNDLLSATELDKIRQALVAIFTHLRKIRNTKYPIQRALRLVEAISRDLSSQLLKVLGTRKLMHVAYEEFEKVMVACFEVFQTWDDEYEKLQVLLRDIVKRKREENLKMVWRINPAHRKLQARLDQMRKFRRQHEQLRAVIVRVLRPQVTAVAQQNQGEVPEPQDMKVAEVLFDAADANAIEEVNLAYENVKEVDGLDVSKEGTEAWEAAMKRYDERIDRVETRITARLRDQLGTAKNANEMFRIFSRFNALFVRPHIRGAIRDYQTQLIQRVKDDIESLHDKFKVQYPQSQACKMSHVRDLPPVSGSIIWAKQIDRQLTAYMKRVEDVLGKGWENHVEGQKLKQDGDSFRMKLNTQEIFDDWARKVQQRNLGVSGRIFTIESTRVRGRTGNVLKLKVNFLPEIITLSKEVRNLKWLGFRVPLAIVNKAHQANQLYPFAISLIESVRTYERTCEKVEERNTISLLVAGLKKEVQALIAEGIALVWESYKLDPYVQRLAETVFNFQEKVDDLLIIEEKIDLEVRSLETCMYDHKTFSEILNRVQKAVDDLNLHSYSNLPIWVNKLDMEIERILGVRLQAGLRAWTQVLLGQAEDKAEVDMDTDAPQVSHKPGGEPKIKNVVHELRITNQVIYLNPPIEECRYKLYQEMFAWKMVVLSLPRIQSQRYQVGVHYELTEEEKFYRNALTRMPDGPVALEESYSAVMGIVSEVEQYVKVWLQYQCLWDMQAENIYNRLGEDLNKWQALLVQIRKARGTFDNAETKKEFGPVVIDYGKVQSKVNLKYDSWHKEVLSKFGQMLGSNMTEFHSQISKSRQELEQHSVDTASTSDAVTFITYVQSLKRKIKQFEKQVELYRNGQRLLEKQRFQFPPSWLYIDNIEGEWGAFNDIMRRKDSAIQQQVANLQMKIVQEDRAVESRTTDLLTDWEKTKPVTGNLRPEEALQALTIYEGKFGRLKDDREKCAKAKEALELTDTGLLSGSEERVQVALEELQDLKGVWSELSKVWEQIDQMKEQPWVSVQPRKLRQNLDALLNQLKSFPARLRQYASYEFVQRLLKGYMKINMLVIELKSEALKDRHWKQLMKRLHVNWVVSELTLGQIWDVDLQKNEAIVKDVLLVAQGEMALEEFLKQIREVWNTYELDLVNYQNKCRLIRGWDDLFNKVKEHINSVSAMKLSPYYKVFEEDALSWEDKLNRIMALFDVWIDVQRRWVYLEGIFTGSADIKHLLPVETQRFQSISTEFLALMKKVSKSPLVMDVLNIQGVQRSLERLADLLGKIQKALGEYLERERSSFPRFYFVGDEDLLEIIGNSKNVAKLQKHFKKMFAGVSSIILNEDNSVVLGISSREGEEVMFKTPVSITEHPKINEWLTLVEKEMRVTLAKLLAESVTEVEIFGKATSIDPNTYITWIDKYQAQLVVLSAQIAWSENVETALSSMGGGGDAAPLHSVLSNVEVTLNVLADSVLMEQPPLRRRKLEHLITELVHQRDVTRSLIKSKIDNAKSFEWLSQMRFYFDPKQTDVLQQLSIQMANAKFNYGFEYLGVQDKLVQTPLTDRCYLTMTQALEARLGGSPFGPAGTGKTESVKALGHQLGRFVLVFNCDETFDFQAMGRIFVGLCQVGAWGCFDEFNRLEERMLSAVSQQVQCIQEALREHSNPNYDKTSAPITCELLNKQVKVSPDMAIFITMNPGYAGRSNLPDNLKKLFRSLAMTKPDRQLIAQVMLYSQGFRTAEVLANKIVPFFKLCDEQLSSQSHYDFGLRALKSVLVSAGNVKRERIQKIKREKEERGEAVDEGEIAENLPEQEILIQSVCETMVPKLVAEDIPLLFSLLSDVFPGVQYHRGEMTALREELKKVCQEMYLTYGDGEEVGGMWVEKVLQLYQITQINHGLMMVGPSGSGKSMAWRVLLKALERLEGVEGVAHIIDPKAISKDHLYGTLDPNTREWTDGLFTHVLRKIIDSVRGELQKRQWIVFDGDVDPEWVENLNSVLDDNKLLTLPNGERLSLPPNVRIMFEVQDLKYATLATVSRCGMVWFSEDVLSTDMIFNNFLARLRSIPLDEGEDEAQRRRKGKEDEGEEAASPMLQIQRDAATIMQPYFTSNGLVTKALEHAFQLEHIMDLTRLRCLGSLFSMLHQACRNVAQYNANHPDFPMQIEQLERYIQVRGHQGLHRAHHCARPQV

SEQ ID NO: 917679 - protein, 2117 aa, Homo sapiens
MSEPGGGGGEDGSAGLEVSAVQNVADVSVLQKHLRKLVPLLLEDGGEAPAALEAALEEKSALEQMRKFLSDPQVHTVLVERSTLKEDVGDEGEEEKEFISYNINIDIHYGVKSNSLAFIKRTPVIDADKPVSSQLRVLTLSEDSPYETLHSFISNAVAPFFKSYIRESGKADRDGDKMAPSVEKKIAELEMGLLHLQQNIEIPEISLPIHPMITNVAKQCYERGEKPKVTDFGDKVEDPTFLNQLQSGVNRWIREIQKVTKLDRDPASGTALQEISFWLNLERALYRIQEKRESPEVLLTLDILKHGKRFHATVSFDTDTGLKQALETVNDYNPLMKDFPLNDLLSATELDKIRQALVAIFTHLRKIRNTKYPIQRALRLVEAISRDLSSQLLKVLGTRKLMHVAYEEFEKVMVACFEVFQTWDDEYEKLQVLLRDIVKRKREENLKMVWRINPAHRKLQARLDQMRKFRRQHEQLRAVIVRVLRPQVTAVAQQNQGEVPEPQDMKVAEVLFDAADANAIEEVNLAYENVKEVDGLDVSKEGTEAWEAAMKRYDERIDRVETRITARLRDQLGTAKNANEMFRIFSRFNALFVRPHIRGAIRDYQTQLIQRVKDDIESLHDKFKVQYPQSQACKMSHVRDLPPVSGSIIWAKQIDRQLTAYMKRVEDVLGKGWENHVEGQKLKQDGDSFRMKLNTQEIFDDWARKVQQRNLGVSGRIFTIESTRVRGRTGNVLKLKVNFLPEIITLSKEVRNLKWLGFRVPLAIVNKAHQANQLYPFAISLIESVRTYERTCEKVEERNTISLLVAGLKKEVQALIAEGIALVWESYKLDPYVQRLAETVFNFQEKVDDLLIIEEKIDLEVRSLETCMYDHKTFSEILNRVQKAVDDLNLHSYSNLPIWVNKLDMEIERILGVRLQAGLRAWTQVLLGQAEDKAEVDMDTDAPQVSHKPGGEPKIKNVVHELRITNQVIYLNPPIEECRYKLYQEMFAWKMVVLSLPRIQSQRYQVGVHYELTEEEKFYRNALTRMPDGPVALEESYSAVMGIVSEVEQYVKVWLQYQCLWDMQAENIYNRLGEDLNKWQALLVQIRKARGTFDNAETKKEFGPVVIDYGKVQSKVNLKYDSWHKEVLSKFGQMLGSNMTEFHSQISKSRQELEQHSVDTASTSDAVTFITYVQSLKRKIKQFEKQVELYRNGQRLLEKQRFQFPPSWLYIDNIEGEWGAFNDIMRRKDSAIQQQVANLQMKIVQEDRAVESRTTDLLTDWEKTKPVTGNLRPEEALQALTIYEGKFGRLKDDREKCAKAKEALELTDTGLLSGSEERVQVALEELQDLKGVWSELSKVWEQIDQMKEQPWVSVQPRKLRQNLDALLNQLKSFPARLRQYASYEFVQRLLKGYMKINMLVIELKSEALKDRHWKQLMKRLHVNWVVSELTLGQIWDVDLQKNEAIVKDVLLVAQGEMALEEFLKQIREVWNTYELDLVNYQNKCRLIRGWDDLFNKVKEHINSVSAMKLSPYYKVFEEDALSWEDKLNRIMALFDVWIDVQRRWVYLEGIFTGSADIKHLLPVETQRFQSISTEFLALMKKVSKSPLVMDVLNIQGVQRSLERLADLLGKIQKALGEYLERERSSFPRFYFVGDEDLLEIIGNSKNVAKLQKHFKKMFAGVSSIILNEDNSVVLGISSREGEEVMFKTPVSITEHPKINEWLTLVEKEMRVTLAKLLAESVTEVEIFGKATSIDPNTYITWIDKYQAQLVVLSAQIAWSENVETALSSMGGGGDAAPLHSVLSNVEVTLNVLADSVLMEQPPLRRRKLEHLITELVHQRDVTRSLIKSKIDNAKSFEWLSQMRFYFDPKQTDVLQQLSIQMANAKFNYGFEYLGVQDKLVQTPLTDRCYLTMTQALEARLGGSPFGPAGTGKTESVKALGHQLGRFVLVFNCDETFDFQAMGRIFVGLCQVGAWGCFDEFNRLEERMLSAVSQQVQCIQEALREHSNPNYDKTSAPITCELLNKQVKVSPDMAIFITMNPGYAGRSNLPDNLKKLFRSLAMTKPDRQLIAQVMLYSQGFRTAEVLANKIVPFFKLCDEQLSSQSHYDFGLRALKSVLVSAGNVKRERIQKIKREKEE

SEQ ID NO: 917680 - protein, 71 aa, Homo sapiens
YSATAATGAQLEFPVRWVKQTNTEKKASVVTLPVYLNFTRADLIFTVDFEIATKEDPRSFYERGVAVLCTE

SEQ ID NO: 917681 - protein, 254 aa, Homo sapiens
MSEPGGGGGEDGSAGLEVSAVQNVADVSVLQKHLRKLVPLLLEDGGEAPAALEAALEEKSALEQMRKFLSDPQVHTVLVERSTLKGAGPRRAGSPEPGLAECRACQVLRGRRCPRDGRSPAAADDPWMGRARRPQTSRRPGPQGRRRPAEAGAAPGARPRHTHCPARSPQGAPLLVAGRGKGSPSAVTQNNGVALSARASQDGRVGWRQRLPGLRAGEAASLPPVSHELFGFDLCPSQVAFGRDVSGADPRSWG

SEQ ID NO: 917682 - protein, 74 aa, Homo sapiens
MLPHSTHPSVPVSAPIGQAIHRLLLIQAFRPDRLLAMAHMFVSTNLGESFMSIMEQPLDLTHIVGTEVMSWYSP

SEQ ID NO: 917683 - protein, 66 aa, Homo sapiens
MAITPRHYLDFINHYANLFHEKRSELEEQQMHLNVGLRKIKETVDQVRHRHKFLTGVSCSEDPFPY

SEQ ID NO: 917684 - protein, 859 aa, Homo sapiens
MSEPGGGGGEDGSAGLEVSAVQNVADVSVLQKHLRKLVPLLLEDGGEAPAALEAALEEKSALEQMRKFLSDPQVHTVLVERSTLKEDVGDEGEEEKEFISYNINIDIHYGVKSNSLAFIKRTPVIDADKPVSSQLRVLTLSEDSPYETLHSFISNAVAPFFKSYIRESGKADRDGDKMAPSVEKKIAELEMGLLHLQQNIEIPEISLPIHPMITNVAKQCYERGEKPKVTDFGDKVEDPTFLNQLQSGVNRWIREIQKVTKLDRDPASGTALQEISFWLNLERALYRIQEKRESPEVLLTLDILKHGKRFHATVSFDTDTGLKQALETVNDYNPLMKDFPLNDLLSATELDKIRQALVAIFTHLRKIRNTKYPIQRALRLVEAISRDLSSQLLKVLGTRKLMHVAYEEFEKVMVACFEVFQTWDDEYEKLQVLLRDIVKRKREENLKMVWRINPAHRKLQARLDQMRKFRRQHEQLRAVIVRVLRPQVTAVAQQNQGEVPEPQDMKVAEVLFDAADANAIEEVNLAYENVKEVDGLDVSKEGTEAWEAAMKRYDERIDRVETRITARLRDQLGTAKNANEMFRIFSRFNALFVRPHIRGAIRDYQTQLIQRVKDDIESLHDKFKVQYPQSQACKMSHVRDLPPVSGSIIWAKQIDRQLTAYMKRVEDVLGKGWENHVEGQKLKQDGDSFRMKLNTQEIFDDWARKVQQRNLGVSGRIFTIESTRVRGRTGNVLKLKVNFLPEIITLSKEVRNLKWLGFRVPLAIVNKAHQANQLYPFAISLIESVRTYERTCEKVEERNTISLLVAGLKKEVQALIAEGIALVWESYKLDPYVQRLAETVFNFQEKVCSHVILRCPGNE

SEQ ID NO: 917685 - protein, 137 aa, Homo sapiens
MSKIESEFNFKFAQQNPLNPLVNLTVSPKRNSSLDTRKKPCRYRRVHFCKSALFYIYECIFEALRPLETLPVEGLIRIWAHEALRLFQDRLVEDEERRWTDENIDTVALKHFPNIDREKAMSRPILYSNWLSKDYNQ

SEQ ID NO: 917686 - protein, 3471 aa, Homo sapiens
MSEPGGGGGEDGSAGLEVSAVQNVADVSVLQKHLRKLVPLLLEDGGEAPAALEAALEEKSALEQMRKFLSDPQVHTVLVERSTLKEDVGDEGEEEKEFISYNINIDIHYGVKSNSLAFIKRTPVIDADKPVSSQLRVLTLSEDSPYETLHSFISNAVAPFFKSYIRESGKADRDGDKMAPSVEKKIAELEMGLLHLQQNIEIPEISLPIHPMITNVAKQCYERGEKPKVTDFGDKVEDPTFLNQLQSGVNRWIREIQKVTKLDRDPASGTALQEISFWLNLERALYRIQEKRESPEVLLTLDILKHGKRFHATVSFDTDTGLKQALETVNDYNPLMKDFPLNDLLSATELDKIRQALVAIFTHLRKIRNTKYPIQRALRLVEAISRDLSSQLLKVLGTRKLMHVAYEEFEKVMVACFEVFQTWDDEYEKLQVLLRDIVKRKREENLKMVWRINPAHRKLQARLDQMRKFRRQHEQLRAVIVRVLRPQVTAVAQQNQGEVPEPQDMKVAEVLFDAADANAIEEVNLAYENVKEVDGLDVSKEGTEAWEAAMKRYDERIDRVETRITARLRDQLGTAKNANEMFRIFSRFNALFVRPHIRGAIRDYQTQLIQRVKDDIESLHDKFKVQYPQSQACKMSHVRDLPPVSGSIIWAKQIDRQLTAYMKRVEDVLGKGWENHVEGQKLKQDGDSFRMKLNTQEIFDDWARKVQQRNLGVSGRIFTIESTRVRGRTGNVLKLKVNFLPEIITLSKEVRNLKWLGFRVPLAIVNKAHQANQLYPFAISLIESVRTYERTCEKVEERNTISLLVAGLKKEVQALIAEGIALVWESYKLDPYVQRLAETVFNFQEKVDDLLIIEEKIDLEVRSLETCMYDHKTFSEILNRVQKAVDDLNLHSYSNLPIWVNKLDMEIERILGVRLQAGLRAWTQVLLGQAEDKAEVDMDTDAPQVSHKPGGEPKIKNVVHELRITNQVIYLNPPIEECRYKLYQEMFAWKMVVLSLPRIQSQRYQVGVHYELTEEEKFYRNALTRMPDGPVALEESYSAVMGIVSEVEQYVKVWLQYQCLWDMQAENIYNRLGEDLNKWQALLVQIRKARGTFDNAETKKEFGPVVIDYGKVQSKVNLKYDSWHKEVLSKFGQMLGSNMTEFHSQISKSRQELEQHSVDTASTSDAVTFITYVQSLKRKIKQFEKQVELYRNGQRLLEKQRFQFPPSWLYIDNIEGEWGAFNDIMRRKDSAIQQQVANLQMKIVQEDRAVESRTTDLLTDWEKTKPVTGNLRPEEALQALTIYEGKFGRLKDDREKCAKAKEALELTDTGLLSGSEERVQVALEELQDLKGVWSELSKVWEQIDQMKEQPWVSVQPRKLRQNLDALLNQLKSFPARLRQYASYEFVQRLLKGYMKINMLVIELKSEALKDRHWKQLMKRLHVNWVVSELTLGQIWDVDLQKNEAIVKDVLLVAQGEMALEEFLKQIREVWNTYELDLVNYQNKCRLIRGWDDLFNKVKEHINSVSAMKLSPYYKVFEEDALSWEDKLNRIMALFDVWIDVQRRWVYLEGIFTGSADIKHLLPVETQRFQSISTEFLALMKKVSKSPLVMDVLNIQGVQRSLERLADLLGKIQKALGEYLERERSSFPRFYFVGDEDLLEIIGNSKNVAKLQKHFKKMFAGVSSIILNEDNSVVLGISSREGEEVMFKTPVSITEHPKINEWLTLVEKEMRVTLAKLLAESVTEVEIFGKATSIDPNTYITWIDKYQAQLVVLSAQIAWSENVETALSSMGGGGDAAPLHSVLSNVEVTLNVLADSVLMEQPPLRRRKLEHLITELVHQRDVTRSLIKSKIDNAKSFEWLSQMRFYFDPKQTDVLQQLSIQMANAKFNYGFEYLGVQDKLVQTPLTDRCYLTMTQALEARLGGSPFGPAGTGKTESVKALGHQLGRFVLVFNCDETFDFQAMGRIFVGLCQVGAWGCFDEFNRLEERMLSAVSQQVQCIQEALREHSNPNYDKTSAPITCELLNKQVKVSPDMAIFITMNPGYAGRSNLPDNLKKLFRSLAMTKPDRQLIAQVMLYSQGFRTAEVLANKIVPFFKLCDEQLSSQSHYDFGLRALKSVLVSAGNVKRERIQKIKREKEERGEAVDEGEIAENLPEQEILIQSVCETMVPKLVAEDIPLLFSLLSDVFPGVQYHRGEMTALREELKKVCQEMYLTYGDGEEVGGMWVEKVLQLYQITQINHGLMMVGPSGSGKSMAWRVLLKALERLEGVEGVAHIIDPKAISKDHLYGTLDPNTREWTDGLFTHVLRKIIDSVRGELQKRQWIVFDGDVDPEWVENLNSVLDDNKLLTLPNGERLSLPPNVRIMFEVQDLKYATLATVSRCGMVWFSEDVLSTDMIFNNFLARLRSIPLDEGEDEAQRRRKGKEDEGEEAASPMLQIQRDAATIMQPYFTSNGLVTKALEHAFQLEHIMDLTRLRCLGSLFSMLHQACRNVAQYNANHPDFPMQIEQLERYIQRYLVYAILWSLSGDSRLKMRAELGEYIRRITTVPLPTAPNIPIIDYEVSISGEWSPWQAKVPQIEVETHKVAAPDVVVPTLDTVRHEALLYTWLAEHKPLVLCGPPGSGKTMTLFSALRALPDMEVVGLNFSSATTPELLLKTFDHYCEYRRTPNGVVLAPVQLGKWLVLFCDEINLPDMDKYGTQRVISFIRQMVEHGGFYRTSDQTWVKLERIQFVGACNPPTDPGRKPLSHRFLRHVPVVYVDYPGPASLTQIYGTFNRAMLRLIPSLRTYAEPLTAAMVEFYTMSQERFTQDTQPHYIYSPREMTRWVRGIFEALRPLETLPVEGLIRIWAHEALRLFQDRLVEDEERRWTDENIDTVALKHFPNIDREKAMSRPILYSNWLSKDYIPVDQEELRDYVKARLKVFYEEELDVPLVLFNEVLDHVLRIDRIFRQPQGHLLLIGVSGAGKTTLSRFVAWMNGLSVYQIKVHRKYTGEDFDEDLRTVLRRSGCKNEKIAFIMDESNVLDSGFLERMNTLLANGEVPGLFEGDEYATLMTQCKEGAQKEGLMLDSHEELYKWFTSQVIRNLHVVFTMNPSSEGLKDRAATSPALFNRCVLNWFGDWSTEALYQVGKEFTSKMDLEKPNYIVPDYMPVVYDKLPQPPSHREAIVNSCVFVHQTLHQANARLAKRGGRTMAITPRHYLDFINHYANLFHEKRSELEEQQMHLNVGLRKIKETVDQVEELRRDLRIKSQELEVKNAAANDKLKKMVKDQQEAEKKKVMSQEIQEQLHKQQEVIADKQMSVKEDLDKVEPAVIEAQNAVKSIKKQHLVEVRSMANPPAAVKLALESICLLLGESTTDWKQIRSIIMRENFIPTIVNFSAEEISDAIREKMKKNYMSNPSYNYEIVNRASLACGPMVKWAIAQLNYADMLKRVEPLRNELQKLEDDAKDNQQKANEVEQMIRDLEASIARYKEEYAVLISEAQASRQTWQLSRQK

SEQ ID NO: 917687 - protein, 3558 aa, Homo sapiens; identical to SEQ ID NO: 917657

SEQ ID NO: 917688 - protein, 3526 aa, Homo sapiens
GPRKYTAEGEWGAFNDIMRRKDSAIQQQVANLQMKIVQEDRAVESRTTDLLTDWEKTKPVTGNLRPEEALQALTIYEGKFGRLKDDREKCAKAKEALELTDTGLLSGSEERVQVALEELQDLKGVWSELSKVWEQIDQMKEQPWVSVQPRKLRQNLDALLNQLKSFPARLRQYASYEFVQRLLKGYMKINMLVIELKSEALKDRHWKQLMKRLHVNWVVSELTLGQIWDVDLQKNEAIVKDVLLVAQGEMALEEFLKQIREVWNTYELDLVNYQNKCRLIRGWDDLFNKVKEHINSVSAMKLSPYYKVFEEDALSWEDKLNRIMALFDVWIDVQRRWVYLEGIFTGSADIKHLLPVETQRFQSISTEFLALMKKVSKSPLVMDVLNIQGVQRSLERLADLLGKIQKALGEYLERERSSFPRFYFVGDEDLLEIIGNSKNVAKLQKHFKKMFAGVSSIILNEDNSVVLGISSREGEEVMFKTPVSITEHPKINEWLTLVEKEMRVTLAKLLAESVTEVEIFGKATSIDPNTYITWIDKYQAQLVVLSAQIAWSENVETALSSMGGGGDAAPLHSVLSNVEVTLNVLADSVLMEQPPLRRRKLEHLITELVHQRDVTRSLIKSKIDNAKSFEWLSQMRFYFDPKQTDVLQQLSIQMANAKFNYGFEYLGVQDKLVQTPLTDRCYLTMTQALEARLGGSPFGPAGTGKTESVKALGHQLGRFVLVFNCDETFDFQAMGRIFVGLCQVGAWGCFDEFNRLEERMLSAVSQQVQCIQEALREHSNPNYDKTSAPITCELLNKQVKVSPDMAIFITMNPGYAGRSNLPDNLKKLFRSLAMTKPDRQLIAQVMLYSQGFRTAEVLANKIVPFFKLCDEQLSSQSHYDFGLRALKSVLVSAGNVKRERIQKIKREKEERGEAVDEGEIAENLPEQEILIQSVCETMVPKLVAEDIPLLFSLLSDVFPGVQYHRGEMTALREELKKVCQEMYLTYGDGEEVGGMWVEKVLQLYQITQINHGLMMVGPSGSGKSMAWRVLLKALERLEGVEGVAHIIDPKAISKDHLYGTLDPNTREWTDGLFTHVLRKIIDSVRGELQKRQWIVFDGDVDPEWVENLNSVLDDNKLLTLPNGERLSLPPNVRIMFEVQDLKYATLATVSRCGMVWFSEDVLSTDMIFNNFLARLRSIPLDEGEDEAQRRRKGKEDEGEEAASPMLQIQRDAATIMQPYFTSNGLVTKALEHAFQLEHIMDLTRLRCLGSLFSMLHQACRNVAQYNANHPDFPMQIEQLERYIQVRGHQGLHRAHQLRQTTGLRTSEMLHLWGCALSPRRGRAFVEGLGKVQWVSVMQEDWEPLSLVNFAVSVFLLLLKFYKNQSLIPFLIAISGLCHTLVPAGDSRLKMRAELGEYIRRITTVPLPTAPNIPIIDYEVSISGEWSPWQAKVPQIEVETHKVAAPDVVVPTLDTVRHEALLYTWLAEHKPLVLCGPPGSGKTMTLFSALRALPDMEVVGLNFSSATTPELLLKTFDHYCEYRRTPNGVVLAPVQLGKWLVLFCDEINLPDMDKYGTQRVISFIRQMVEHGGFYRTSDQTWVKLERIQFVGACNPPTDPGRKPLSHRFLRHVPVVYVDYPGPASLTQIYGTFNRAMLRLIPSLRTYAEPLTAAMVEFYTMSQERFTQDTQPHYIYSPREMTRWVRGIFEALRPLETLPVEGLIRIWAHEALRLFQDRLVEDEERRWTDENIDTVALKHFPNIDREKAMSRPILYSNWLSKDYIPVDQEELRDYVKARLKVFYEEELDVPLVLFNEVLDHVLRIDRIFRQPQGHLLLIGVSGAGKTTLSRFVAWMNGLSVYQIKVHRKYTGEDFDEDLRTVLRRSGCKNEKIAFIMDESNVLDSGFLERMNTLLANGEVPGLFEGDEYATLMTQCKEGAQKEGLMLDSHEELYKWFTSQVIRNLHVVFTMNPSSEGLKDRAATSPALFNRCVLNWFGDWSTEALYQVGKEFTSKMDLEKPNYIVPDYMPVVYDKLPQPPSHREAIVNSCVFVHQTLHQANARLAKRGGRTMAITPRHYLDFINHYANLFHEKRSELEEQQMHLNVGLRKIKETVDQVEELRRDLRIKSQELEVKNAAANDKLKKMVKDQQEAEKKKVMSQEIQEQLHKQQEVIADKQMSVKEDLDKVEPAVIEAQNAVKSIKKQHLVEVRSMANPPAAVKLALESICLLLGESTTDWKQIRSIIMRENFIPTIVNFSAEEISDAIREKMKKNYMSNPSYNYEIVNRASLACGPMVKWAIAQLNYADMLKRVEPLRNELQKLEDDAKDNQQKANEVEQMIRDLEASIARYKEEYAVLISEAQAIKADLAAVEAKVNRSTALLKSLSAERERWEKTSETFKNQMSTIAGDCLLSAAFIAYAGYFDQQMRQNLFTTWSHHLQQANIQFRTDIARTEYLSNADERLRWQASSLPADDLCTENAIMLKRFNRYPLIIDPSGQATEFIMNEYKDRKITRTSFLDDAFRKNLESALRFGNPLLVQDVESYDPVLNPVLNREVRRTGGRVLITLGDQDIDLSPSFVIFLSTRDPTVEFPPDLCSRVTFVNFTVTRSSLQSQCLNEVLKAERPDVDEKRSDLLKLQGEFQLRLRQLEKSLLQALNEVKGRILDDDTIITTLENLKREAAEVTRKVEETDIVMQEVETVSQQYLPLSTACSSIYFTMESLKQIHFLYQYSLQFFLDIYHNVLYENPNLKGVTDHTQRLSIITKDLFQVAFNRVARGMLHQDHITFAMLLARIKLKGTVGEPTYDAEFQHFLRGNEIVLSAGSTPRIQGLTVEQAEAVVRLSCLPAFKDLIAKVQADEQFGIWLDSSSPEQTVPYLWSEETPATPIGQAIHRLLLIQAFRPDRLLAMAHMFVSTNLGESFMSIMEQPLDLTHIVGTEVKPNTPVLMCSVPGYDASGHVEDLAAEQNTQITSIAIGSAEGFNQADKAINTAVKSGRWVMLKNVHLAPGWLMQLEKKLHSLQPHACFRLFLTMEINPKVPVNLLRAGRIFVFEPPPGVKANMLRTFSSIPVSRICKSPNERARLYFLLAWFHAIIQERLRYAPLGWSKKYEFGESDLRSACDTVDTWLDDTAKGRQNISPDKIPWSALKTLMAQSIYGGRVDNEFDQRLLNTFLERLFTTRSFDSEFKLACKVDGHKDIQMPDGIRREEFVQWVELLPDTQTPSWLGLPNNAERVLLTTQGVDMISKMLKMQMLEDEDDLAYAETEKKTRTDSTSDGRPAWMRTLHTTASNWLHLIPQTLSHLKRTVENIKDPLFRFFEREVKMGAKLLQDVRQDLADVVQVCEGKKKQTNYLRTLINELVKGILPRSWSHYTVPAGMTVIQWVSDFSERIKQLQNISLAAASGGAKELKNIHVCLGGLFVPEAYITATRQYVAQANSWSLEELCLEVNVTTSQGATLDACSFGVTGLKLQGATCNNNKLSLSNAISTALPLTQLRWVKQTNTEKKASVVTLPVYLNFTRADLIFTVDFEIATKEDPRSFYERGVAVLCTE

SEQ ID NO: 917689 - protein, 3558 aa, Homo sapiens; identical to SEQ ID NO: 917657

SEQ ID NO: 917690 - protein, 3558 aa, Homo sapiens; identical to SEQ ID NO: 917657

SEQ ID NO: 917691 - protein, 3558 aa, Homo sapiens; identical to SEQ ID NO: 917657

SEQ ID NO: 917692 - protein, 1779 aa, Homo sapiens
TCCSPHRLVEDEERRWTDENIDTVALKHFPNIDREKAMSRPILYSNWLSKDYIPVDQEELRDYVKARLKVFYEEELDVPLVLFNEVLDHVLRIDRSIGSTQEEDFDEDLRTVLRRSGCKNEKIAFIMDESNVLDSGFLERMNTLLANGEVPGLFEGDEYATLMTQCKEGAQKEGLMLDSHEELYKWFTSQVIRNLHVVFTMNPSSEGLKDRAATSPALFNRCVLNWFGDWSTEALYQVGKEFTSKMDLEKPNYIVPDYMPVVYDKLPQPPSHREAIVNSCVFVHQTLHQANARLAKRGGRTMAITPRHYLDFINHYANLFHEKRSELEEQQMHLNVGLRKIKETVDQVEELRRDLRIKSQELEVKNAAANDKLKKMVKDQQEAEKKKVMSQEIQEQLHKQQEVIADKQMSVKEDLDKVEPAVIEAQNAVKSIKKQHLVEVRSMANPPAAVKLALESICLLLGESTTDWKQIRSIIMRENFIPTIVNFSAEEISDAIREKMKKNYMSNPSYNYEIVNRASLACGPMVKWAIAQLNYADMLKRVEPLRNELQKLEDDAKDNQQKANEVEQMIRDLEASIARYKEEYAVLISEAQAIKADLAAVEAKVNRSTALLKSLSAERERWEKTSETFKNQMSTIAGDCLLSAAFIAYAGYFDQQMRQNLFTTWSHHLQQANIQFRTDIARTEYLSNADERLRWQASSLPADDLCTENAIMLKRFNRYPLIIDPSGQATEFIMNEYKDRKITRTSFLDDAFRKNLESALRFGNPLLVQDVESYDPVLNPVLNREVRRTGGRVLITLGDQDIDLSPSFVIFLSTRDPTVEFPPDLCSRVTFVNFTVTRSSLQSQCLNEVLKAERPDVDEKRSDLLKLQGEFQLRLRQLEKSLLQALNEVKGRILDDDTIITTLENLKREAAEVTRKVEETDIVMQEVETVSQQYLPLSTACSSIYFTMESLKQIHFLYQYSLQFFLDIYHNVLYENPNLKGVTDHTQRLSIITKDLFQVAFNRVARGMLHQDHITFAMLLARIKLKGTVGEPTYDAEFQHFLRGNEIVLSAGSTPRIQGLTVEQAEAVVRLSCLPAFKDLIAKVQADEQFGIWLDSSSPEQTVPYLWSEETPATPIGQAIHRLLLIQAFRPDRLLAMAHMFVSTNLGESFMSIMEQPLDLTHIVGTEVKPNTPVLMCSVPGYDASGHVEDLAAEQNTQITSIAIGSAEGFNQADKAINTAVKSGRWVMLKNVHLAPGWLMQLEKKLHSLQPHACFRLFLTMEINPKVPVNLLRAGRIFVFEPPPGVKANMLRTFSSIPVSRICKSPNERARLYFLLAWFHAIIQERLRYAPLGWSKKYEFGESDLRSACDTVDTWLDDTAKGRQNISPDKIPWSALKTLMAQSIYGGRVDNEFDQRLLNTFLERLFTTRSFDSEFKLACKVDGHKDIQMPDGIRREEFVQWVELLPDTQTPSWLGLPNNAERVLLTTQGVDMISKMLKMQMLEDEDDLAYAETEKKTRTDSTSDGRPAWMRTLHTTASNWLHLIPQTLSHLKRTVENIKDPLFRFFEREVKMGAKLLQDVRQDLADVVQVCEGKKKQTNYLRTLINELVKGILPRSWSHYTVPAGMTVIQWVSDFSERIKQLQNISLAAASGGAKELKNIHVCLGGLFVPEAYITATRQYVAQANSWSLEELCLEVNVTTSQGATLDACSFGVTGLKLQGATCNNNKLSLSNAISTALPLTQLRWVKQTNTEKKASVVTLPVYLNFTRADLIFTVDFEIATKEDPRSFYERGVAVLCTE

SEQ ID NO: 917693 - protein, 1001 aa, Homo sapiens
KKITARYEAGVWGRVLITLGDQDIDLSPSFVIFLSTRDPTVEFPPDLCSRVTFVNFTVTRSSLQSQCLNEVLKAERPDVDEKRSDLLKLQGEFQLRLRQLEKSLLQALNEVKGRILDDDTIITTLENLKREAAEVTRKVEETDIVMQEVETVSQQYLPLSTACSSIYFTMESLKQIHFLYQYSLQFFLDIYHNVLYENPNLKGVTDHTQRLSIITKDLFQVAFNRVARGMLHQDHITFAMLLARIKLKGTVGEPTYDAEFQHFLRGNEIVLSAGSTPRIQGLTVEQAEAVVRLSCLPAFKDLIAKVQADEQFGIWLDSSSPEQTVPYLWSEETPATPIGQAIHRLLLIQAFRPDRLLAMAHMFVSTNLGESFMSIMEQPLDLTHIVGTEVKPNTPVLMCSVPGYDASGHVEDLAAEQNTQITSIAIGSAEGFNQADKAINTAVKSGRWVMLKNVHLAPGWLMQLEKKLHSLQPHACFRLFLTMEINPKVPVNLLRAGRIFVFEPPPGVKANMLRTFSSIPVSRICKSPNERARLYFLLAWFHAIIQERLRYAPLGWSKKYEFGESDLRSACDTVDTWLDDTAKGRQNISPDKIPWSALKTLMAQSIYGGRVDNEFDQRLLNTFLERLFTTRSFDSEFKLACKVDGHKDIQMPDGIRREEFVQWVELLPDTQTPSWLGLPNNAERVLLTTQGVDMISKMLKMQMLEDEDDLAYAETEKKTRTDSTSDGRPAWMRTLHTTASNWLHLIPQTLSHLKRTVENIKDPLFRFFEREVKMGAKLLQDVRQDLADVVQVCEGKKKQTNYLRTLINELVKGILPRSWSHYTVPAGMTVIQWVSDFSERIKQLQNISLAAASGGAKELKNIHVCLGGLFVPEAYITATRQYVAQANSWSLEELCLEVNVTTSQGATLDACSFGVTGLKLQGATCNNNKLSLSNAISTALPLTQLRWVKQTNTEKKASVVTLPVYLNFTRADLIFTVDFEIATKEDPRSFYERGVAVLCTE

SEQ ID NO: 917694 - protein, 4360 aa, Homo sapiens
MSEPGGGGGEDGSAGLEVSAVQNVADVSVLQKHLRKLVPLLLEDGGEAPAALEAALEEKSALEQMRKFLSDPQVHTVLVERSTLKEDVGDEGEEEKEFISYNINIDIHYGVKSNSLAFIKRTPVIDADKPVSSQLRVLTLSEDSPYETLHSFISNAVAPFFKSYIRESGKADRDGDKMAPSVEKKIAELEMGLLHLQQNIEIPEISLPIHPMITNVAKQCYERGEKPKVTDFGDKVEDPTFLNQLQSGVNRWIREIQKVTKLDRDPASGTALQEISFWLNLERALYRIQEKRESPEVLLTLDILKHGKRFHATVSFDTDTGLKQALETVNDYNPLMKDFPLNDLLSATELDKIRQALVAIFTHLRKIRNTKYPIQRALRLVEAISRDLSSQLLKVLGTRKLMHVAYEEFEKVMVACFEVFQTWDDEYEKLQVLLRDIVKRKREENLKMVWRINPAHRKLQARLDQMRKFRRQHEQLRAVIVRVLRPQVTAVAQQNQGEVPEPQDMKVAEVLFDAADANAIEEVNLAYENVKEVDGLDVSKEGTEAWEAAMKRYDERIDRVETRITARLRDQLGTAKNANEMFRIFSRFNALFVRPHIRGAIRDYQTQLIQRVKDDIESLHDKFKVQYPQSQACKMSHVRDLPPVSGSIIWAKQIDRQLTAYMKRVEDVLGKGWENHVEGQKLKQDGDSFRMKLNTQEIFDDWARKVQQRNLGVSGRIFTIESTRVRGRTGNVLKLKVNFLPEIITLSKEVRNLKWLGFRVPLAIVNKAHQANQLYPFAISLIESVRTYERTCEKVEERNTISLLVAGLKKEVQALIAEGIALVWESYKLDPYVQRLAETVFNFQEKVDDLLIIEEKIDLEVRSLETCMYDHKTFSEILNRVQKAVDDLNLHSYSNLPIWVNKLDMEIERILGVRLQAGLRAWTQVLLGQAEDKAEVDMDTDAPQVSHKPGGEPKIKNVVHELRITNQVIYLNPPIEECRYKLYQEMFAWKMVVLSLPRIQSQRYQVGVHYELTEEEKFYRNALTRMPDGPVALEESYSAVMGIVSEVEQYVKVWLQYQCLWDMQAENIYNRLGEDLNKWQALLVQIRKARGTFDNAETKKEFGPVVIDYGKVQSKVNLKYDSWHKEVLSKFGQMLGSNMTEFHSQISKSRQELEQHSVDTASTSDAVTFITYVQSLKRKIKQFEKQVELYRNGQRLLEKQRFQFPPSWLYIDNIEGEWGAFNDIMRRKDSAIQQQVANLQMKIVQEDRAVESRTTDLLTDWEKTKPVTGNLRPEEALQALTIYEGKFGRLKDDREKCAKAKEALELTDTGLLSGSEERVQVALEELQDLKGVWSELSKVWEQIDQMKEQPWVSVQPRKLRQNLDALLNQLKSFPARLRQYASYEFVQRLLKGYMKINMLVIELKSEALKDRHWKQLMKRLHVNWVVSELTLGQIWDVDLQKNEAIVKDVLLVAQGEMALEEFLKQIREVWNTYELDLVNYQNKCRLIRGWDDLFNKVKEHINSVSAMKLSPYYKVFEEDALSWEDKLNRIMALFDVWIDVQRRWVYLEGIFTGSADIKHLLPVETQRFQSISTEFLALMKKVSKSPLVMDVLNIQGVQRSLERLADLLGKIQKALGEYLERERSSFPRFYFVGDEDLLEIIGNSKNVAKLQKHFKKMFAGVSSIILNEDNSVVLGISSREGEEVMFKTPVSITEHPKINEWLTLVEKEMRVTLAKLLAESVTEVEIFGKATSIDPNTYITWIDKYQAQLVVLSAQIAWSENVETALSSMGGGGDAAPLHSVLSNVEVTLNVLADSVLMEQPPLRRRKLEHLITELVHQRDVTRSLIKSKIDNAKSFEWLSQMRFYFDPKQTDVLQQLSIQMANAKFNYGFEYLGVQDKLVQTPLTDRCYLTMTQALEARLGGSPFGPAGTGKTESVKALGHQLGRFVLVFNCDETFDFQAMGRIFVGLCQVGAWGCFDEFNRLEERMLSAVSQQVQCIQEALREHSNPNYDKTSAPITCELLNKQVKVSPDMAIFITMNPGYAGRSNLPDNLKKLFRSLAMTKPDRQLIAQVMLYSQGFRTAEVLANKIVPFFKLCDEQLSSQSHYDFGLRALKSVLVSAGNVKRERIQKIKREKEERGEAVDEGEIAENLPEQEILIQSVCETMVPKLVAEDIPLLFSLLSDVFPGVQYHRGEMTALREELKKVCQEMYLTYGDGEEVGGMWVEKVLQLYQITQINHGLMMVGPSGSGKSMAWRVLLKALERLEGVEGVAHIIDPKAISKDHLYGTLDPNTREWTDGLFTHVLRKIIDSVRGELQKRQWIVFDGDVDPEWVENLNSVLDDNKLLTLPNGERLSLPPNVRIMFEVQDLKYATLATVSRCGMVWFSEDVLSTDMIFNNFLARLRSIPLDEGEDEAQRRRKGKEDEGEEAASPMLQIQRDAATIMQPYFTSNGLVTKALEHAFQLEHIMDLTRLRCLGSLFSMLHQACRNVAQYNANHPDFPMQIEQLERYIQVRGHQGLHRAHQLRQTTGLRTSEMLHLWGCALSPRRGRAFVEGLGKVQWVSVMQEDWEPLSLVNFAVSVFLLLLKFYKNQSLIPFLIAISGLCHTLVPAGDSRLKMRAELGEYIRRITTVPLPTAPNIPIIDYEVSISGEWSPWQAKVPQIEVETHKVAAPDVVVPTLDTVRHEALLYTWLAEHKPLVLCGPPGSGKTMTLFSALRALPDMEVVGLNFSSATTPELLLKTFDHYCEYRRTPNGVVLAPVQLGKWLVLFCDEINLPDMDKYGTQRVISFIRQMVEHGGFYRTSDQTWVKLERIQFVGACNPPTDPGRKPLSHRFLRHVPVVYVDYPGPASLTQIYGTFNRAMLRLIPSLRTYAEPLTAAMVEFYTMSQERFTQDTQPHYIYSPREMTRWVRGIFEALRPLETLPVEGLIRIWAHEALRLFQDRLVEDEERRWTDENIDTVALKHFPNIDREKAMSRPILYSNWLSKDYIPVDQEELRDYVKARLKVFYEEELDVPLVLFNEVLDHVLRIDRIFRQPQGHLLLIGVSGAGKTTLSRFVAWMNGLSVYQIKVHRKYTGEDFDEDLRTVLRRSGCKNEKIAFIMDESNVLDSGFLERMNTLLANGEVPGLFEGDEYATLMTQCKEGAQKEGLMLDSHEELYKWFTSQVIRNLHVVFTMNPSSEGLKDRAATSPALFNRCVLNWFGDWSTEALYQVGKEFTSKMDLEKPNYIVPDYMPVVYDKLPQPPSHREAIVNSCVFVHQTLHQANARLAKRGGRTMAITPRHYLDFINHYANLFHEKRSELEEQQMHLNVGLRKIKETVDQVEELRRDLRIKSQELEVKNAAANDKLKKMVKDQQEAEKKKVMSQEIQEQLHKQQEVIADKQMSVKEDLDKVEPAVIEAQNAVKSIKKQHLVEVRSMANPPAAVKLALESICLLLGESTTDWKQIRSIIMRENFIPTIVNFSAEEISDAIREKMKKNYMSNPSYNYEIVNRASLACGPMVKWAIAQLNYADMLKRVEPLRNELQKLEDDAKDNQQKANEVEQMIRDLEASIARYKEEYAVLISEAQAIKADLAAVEAKVNRSTALLKSLSAERERWEKTSETFKNQMSTIAGDCLLSAAFIAYAGYFDQQMRQNLFTTWSHHLQQANIQFRTDIARTEYLSNADERLRWQASSLPADDLCTENAIMLKRFNRYPLIIDPSGQATEFIMNEYKDRKITRTSFLDDAFRKNLESALRFGNPLLVQDVESYDPVLNPVLNREVRRTGGRVLITLGDQDIDLSPSFVIFLSTRDPTVEFPPDLCSRVTFVNFTVTRSSLQSQCLNEVLKAERPDVDEKRSDLLKLQGEFQLRLRQLEKSLLQALNEVKGRILDDDTIITTLENLKREAAEVTRKVEETDIVMQEVETVSQQYLPLSTACSSIYFTMESLKQIHFLYQYSLQFFLDIYHNVLYENPNLKGVTDHTQRLSIITKDLFQVAFNRVARGMLHQDHITFAMLLARIKLKGTVGEPTYDAEFQHFLRGNEIVLSAGSTPRIQGLTVEQAEAVVRLSCLPAFKDLIAKVQADEQFGIWLDSSSPEQTVPYLWSEETPATPIGQAIHRLLLIQAFRPDRLLAMAHMFVSTNLGESFMSIMEQPLDLTHIVGTEVKPNTPVLMCSVPGYDASGHVEDLAAEQNTQITSIAIGSAEGFNQADKAINTAVKSGRWVMLKNVHLAPGWLMQLEKKLHSLQPHACFRLFLTMEINPKVPVNLLRAGRIFVFEPPPGVKANMLRTFSSIPVSRICKSPNERARLYFLLAWFHAIIQERLRYAPLGWSKKYEFGESDLRSACDTVDTWLDDTAKGRQNISPDKIPWSALKTLMAQSIYGGRVDNEFDQRLLNTFPTRST

SEQ ID NO: 917695 - protein, 583 aa, Homo sapiens
MQITSIAIGSAEGFNQADKAINTAVKSGRWVMLKNVHLAPGWLMQLEKKLHSLQPHACFRLFLTMEINPKVPVNLLRAGRIFVFEPPPGVKANMLRTFSSIPVSRICKSPNERARLYFLLAWFHAIIQERLRYAPLGWSKKYEFGESDLRSACDTVDTWLDDTAKGRQNISPDKIPWSALKTLMAQSIYGGRVDNEFDQRLLNTFLERLFTTRSFDSEFKLACKVDGHKDIQMPDGIRREEFVQWVELLPDTQTPSWLGLPNNAERVLLTTQGVDMISKMLKMQMLEDEDDLAYAETEKKTRTDSTSDGRPAWMRTLHTTASNWLHLIPQTLSHLKRTVENIKDPLFRFFEREVKMGAKLLQDVRQDLADVVQVCEGKKKQTNYLRTLINELVKGILPRSWSHYTVPAGMTVIQWVSDFSERIKQLQNISLAAASGGAKELKNIHVCLGGLFVPEAYITATRQYVAQANSWSLEELCLEVNVTTSQGATLDACSFGVTGLKLQGATCNNNKLSLSNAISTALPLTQLRWVKQTNTEKKASVVTLPVYLNFTRADLIFTVDFEIATKEDPRSFYERGVAVLCTE

SEQ ID NO: 917696 - protein, 3792 aa, Homo sapiens
MSEPGGGGGEDGSAGLEVSAVQNVADVSVLQKHLRKLVPLLLEDGGEAPAALEAALEEKSALEQMRKFLSDPQVHTVLVERSTLKEDVGDEGEEEKEFISYNINIDIHYGVKSNSLAFIKRTPVIDADKPVSSQLRVLTLSEDSPYETLHSFISNAVAPFFKSYIRESGKADRDGDKMAPSVEKKIAELEMGLLHLQQNIEIPEISLPIHPMITNVAKQCYERGEKPKVTDFGDKVEDPTFLNQLQSGVNRWIREIQKVTKLDRDPASGTALQEISFWLNLERALYRIQEKRESPEVLLTLDILKHGKRFHATVSFDTDTGLKQALETVNDYNPLMKDFPLNDLLSATELDKIRQALVAIFTHLRKIRNTKYPIQRALRLVEAISRDLSSQLLKVLGTRKLMHVAYEEFEKVMVACFEVFQTWDDEYEKLQVLLRDIVKRKREENLKMVWRINPAHRKLQARLDQMRKFRRQHEQLRAVIVRVLRPQVTAVAQQNQGEVPEPQDMKVAEVLFDAADANAIEEVNLAYENVKEVDGLDVSKEGTEAWEAAMKRYDERIDRVETRITARLRDQLGTAKNANEMFRIFSRFNALFVRPHIRGAIRDYQTQLIQRVKDDIESLHDKFKVQYPQSQACKMSHVRDLPPVSGSIIWAKQIDRQLTAYMKRVEDVLGKGWENHVEGQKLKQDGDSFRMKLNTQEIFDDWARKVQQRNLGVSGRIFTIESTRVRGRTGNVLKLKVNFLPEIITLSKEVRNLKWLGFRVPLAIVNKAHQANQLYPFAISLIESVRTYERTCEKVEERNTISLLVAGLKKEVQALIAEGIALVWESYKLDPYVQRLAETVFNFQEKVDDLLIIEEKIDLEVRSLETCMYDHKTFSEILNRVQKAVDDLNLHSYSNLPIWVNKLDMEIERILGVRLQAGLRAWTQVLLGQAEDKAEVDMDTDAPQVSHKPGGEPKIKNVVHELRITNQVIYLNPPIEECRYKLYQEMFAWKMVVLSLPRIQSQRYQVGVHYELTEEEKFYRNALTRMPDGPVALEESYSAVMGIVSEVEQYVKVWLQYQCLWDMQAENIYNRLGEDLNKWQALLVQIRKARGTFDNAETKKEFGPVVIDYGKVQSKVNLKYDSWHKEVLSKFGQMLGSNMTEFHSQISKSRQELEQHSVDTASTSDAVTFITYVQSLKRKIKQFEKQVELYRNGQRLLEKQRFQFPPSWLYIDNIEGEWGAFNDIMRRKDSAIQQQVANLQMKIVQEDRAVESRTTDLLTDWEKTKPVTGNLRPEEALQALTIYEGKFGRLKDDREKCAKAKEALELTDTGLLSGSEERVQVALEELQDLKGVWSELSKVWEQIDQMKEQPWVSVQPRKLRQNLDALLNQLKSFPARLRQYASYEFVQRLLKGYMKINMLVIELKSEALKDRHWKQLMKRLHVNWVVSELTLGQIWDVDLQKNEAIVKDVLLVAQGEMALEEFLKQIREVWNTYELDLVNYQNKCRLIRGWDDLFNKVKEHINSVSAMKLSPYYKVFEEDALSWEDKLNRIMALFDVWIDVQRRWVYLEGIFTGSADIKHLLPVETQRFQSISTEFLALMKKVSKSPLVMDVLNIQGVQRSLERLADLLGKIQKALGEYLERERSSFPRFYFVGDEDLLEIIGNSKNVAKLQKHFKKMFAGVSSIILNEDNSVVLGISSREGEEVMFKTPVSITEHPKINEWLTLVEKEMRVTLAKLLAESVTEVEIFGKATSIDPNTYITWIDKYQAQLVVLSAQIAWSENVETALSSMGGGGDAAPLHSVLSNVEVTLNVLADSVLMEQPPLRRRKLEHLITELVHQRDVTRSLIKSKIDNAKSFEWLSQMRFYFDPKQTDVLQQLSIQMANAKFNYGFEYLGVQDKLVQTPLTDRCYLTMTQALEARLGGSPFGPAGTGKTESVKALGHQLGRFVLVFNCDETFDFQAMGRIFVGLCQVGAWGCFDEFNRLEERMLSAVSQQVQCIQEALREHSNPNYDKTSAPITCELLNKQVKVSPDMAIFITMNPGYAGRSNLPDNLKKLFRSLAMTKPDRQLIAQVMLYSQGFRTAEVLANKIVPFFKLCDEQLSSQSHYDFGLRALKSVLVSAGNVKRERIQKIKREKEERGEAVDEGEIAENLPEQEILIQSVCETMVPKLVAEDIPLLFSLLSDVFPGVQYHRGEMTALREELKKVCQEMYLTYGDGEEVGGMWVEKVLQLYQITQINHGLMMVGPSGSGKSMAWRVLLKALERLEGVEGVAHIIDPKAISKDHLYGTLDPNTREWTDGLFTHVLRKIIDSVRGELQKRQWIVFDGDVDPEWVENLNSVLDDNKLLTLPNGERLSLPPNVRIMFEVQDLKYATLATVSRCGMVWFSEDVLSTDMIFNNFLARLRSIPLDEGEDEAQRRRKGKEDEGEEAASPMLQIQRDAATIMQPYFTSNGLVTKALEHAFQLEHIMDLTRLRCLGSLFSMLHQACRNVAQYNANHPDFPMQIEQLERYIQVRGHQGLHRAHQLRQTTGLRTSEMLHLWGCALSPRRGRAFVEGLGKVQWVSVMQEDWEPLSLVNFAVSVFLLLLKFYKNQSLIPFLIAISGLCHTLVPAGDSRLKMRAELGEYIRRITTVPLPTAPNIPIIDYEVSISGEWSPWQAKVPQIEVETHKVAAPDVVVPTLDTVRHEALLYTWLAEHKPLVLCGPPGSGKTMTLFSALRALPDMEVVGLNFSSATTPELLLKTFDHYCEYRRTPNGVVLAPVQLGKWLVLFCDEINLPDMDKYGTQRVISFIRQMVEHGGFYRTSDQTWVKLERIQFVGACNPPTDPGRKPLSHRFLRHVPVVYVDYPGPASLTQIYGTFNRAMLRLIPSLRTYAEPLTAAMVEFYTMSQERFTQDTQPHYIYSPREMTRWVRGIFEALRPLETLPVEGLIRIWAHEALRLFQDRLVEDEERRWTDENIDTVALKHFPNIDREKAMSRPILYSNWLSKDYIPVDQEELRDYVKARLKVFYEEELDVPLVLFNEVLDHVLRIDRIFRQPQGHLLLIGVSGAGKTTLSRFVAWMNGLSVYQIKVHRKYTGEDFDEDLRTVLRRSGCKNEKIAFIMDESNVLDSGFLERMNTLLANGEVPGLFEGDEYATLMTQCKEGAQKEGLMLDSHEELYKWFTSQVIRNLHVVFTMNPSSEGLKDRAATSPALFNRCVLNWFGDWSTEALYQVGKEFTSKMDLEKPNYIVPDYMPVVYDKLPQPPSHREAIVNSCVFVHQTLHQANARLAKRGGRTMAITPRHYLDFINHYANLFHEKRSELEEQQMHLNVGLRKIKETVDQVEELRRDLRIKSQELEVKNAAANDKLKKMVKDQQEAEKKKVMSQEIQEQLHKQQEVIADKQMSVKEDLDKVEPAVIEAQNAVKSIKKQHLVEVRSMANPPAAVKLALESICLLLGESTTDWKQIRSIIMRENFIPTIVNFSAEEISDAIREKMKKNYMSNPSYNYEIVNRASLACGPMVKWAIAQLNYADMLKRVEPLRNELQKLEDDAKDNQQKANEVEQMIRDLEASIARYKEEYAVLISEAQAIKADLAAVEAKVNRSTALLKSLSAERERWEKTSETFKNQMSTIAGDCLLSAAFIAYAGYFDQQMRQNLFTTWSHHLQQANIQFRTDIARTEYLSNADERLRWQASSLPADDLCTENAIMLKRFNRYPLIIDPSGQATEFIMNEYKDRKITRTSFLDDAFRKNLESALRFGNPLLVQDVESYDPVLNPVLNREVRRTGGRVLITLGDQDIDLSPSFVIFLSTRDPTLEFPTTILCSSGHCYNFTMR

SEQ ID NO: 917697 - protein, 3675 aa, Homo sapiens
MSEPGGGGGEDGSAGLEVSAVQNVADVSVLQKHLRKLVPLLLEDGGEAPAALEAALEEKSALEQMRKFLSDPQVHTVLVERSTLKEDVGDEGEEEKEFISYNINIDIHYGVKSNSLAFIKRTPVIDADKPVSSQLRVLTLSEDSPYETLHSFISNAVAPFFKSYIRESGKADRDGDKMAPSVEKKIAELEMGLLHLQQNIEIPEISLPIHPMITNVAKQCYERGEKPKVTDFGDKVEDPTFLNQLQSGVNRWIREIQKVTKLDRDPASGTALQEISFWLNLERALYRIQEKRESPEVLLTLDILKHGKRFHATVSFDTDTGLKQALETVNDYNPLMKDFPLNDLLSATELDKIRQALVAIFTHLRKIRNTKYPIQRALRLVEAISRDLSSQLLKVLGTRKLMHVAYEEFEKVMVACFEVFQTWDDEYEKLQVLLRDIVKRKREENLKMVWRINPAHRKLQARLDQMRKFRRQHEQLRAVIVRVLRPQVTAVAQQNQGEVPEPQDMKVAEVLFDAADANAIEEVNLAYENVKEVDGLDVSKEGTEAWEAAMKRYDERIDRVETRITARLRDQLGTAKNANEMFRIFSRFNALFVRPHIRGAIRDYQTQLIQRVKDDIESLHDKFKVQYPQSQACKMSHVRDLPPVSGSIIWAKQIDRQLTAYMKRVEDVLGKGWENHVEGQKLKQDGDSFRMKLNTQEIFDDWARKVQQRNLGVSGRIFTIESTRVRGRTGNVLKLKVNFLPEIITLSKEVRNLKWLGFRVPLAIVNKAHQANQLYPFAISLIESVRTYERTCEKVEERNTISLLVAGLKKEVQALIAEGIALVWESYKLDPYVQRLAETVFNFQEKVDDLLIIEEKIDLEVRSLETCMYDHKTFSEILNRVQKAVDDLNLHSYSNLPIWVNKLDMEIERILGVRLQAGLRAWTQVLLGQAEDKAEVDMDTDAPQVSHKPGGEPKIKNVVHELRITNQVIYLNPPIEECRYKLYQEMFAWKMVVLSLPRIQSQRYQVGVHYELTEEEKFYRNALTRMPDGPVALEESYSAVMGIVSEVEQYVKVWLQYQCLWDMQAENIYNRLGEDLNKWQALLVQIRKARGTFDNAETKKEFGPVVIDYGKVQSKVNLKYDSWHKEVLSKFGQMLGSNMTEFHSQISKSRQELEQHSVDTASTSDAVTFITYVQSLKRKIKQFEKQVELYRNGQRLLEKQRFQFPPSWLYIDNIEGEWGAFNDIMRRKDSAIQQQVANLQMKIVQEDRAVESRTTDLLTDWEKTKPVTGNLRPEEALQALTIYEGKFGRLKDDREKCAKAKEALELTDTGLLSGSEERVQVALEELQDLKGVWSELSKVWEQIDQMKEQPWVSVQPRKLRQNLDALLNQLKSFPARLRQYASYEFVQRLLKGYMKINMLVIELKSEALKDRHWKQLMKRLHVNWVVSELTLGQIWDVDLQKNEAIVKDVLLVAQGEMALEEFLKQIREVWNTYELDLVNYQNKCRLIRGWDDLFNKVKEHINSVSAMKLSPYYKVFEEDALSWEDKLNRIMALFDVWIDVQRRWVYLEGIFTGSADIKHLLPVETQRFQSISTEFLALMKKVSKSPLVMDVLNIQGVQRSLERLADLLGKIQKALGEYLERERSSFPRFYFVGDEDLLEIIGNSKNVAKLQKHFKKMFAGVSSIILNEDNSVVLGISSREGEEVMFKTPVSITEHPKINEWLTLVEKEMRVTLAKLLAESVTEVEIFGKATSIDPNTYITWIDKYQAQLVVLSAQIAWSENVETALSSMGGGGDAAPLHSVLSNVEVTLNVLADSVLMEQPPLRRRKLEHLITELVHQRDVTRSLIKSKIDNAKSFEWLSQMRFYFDPKQTDVLQQLSIQMANAKFNYGFEYLGVQDKLVQTPLTDRCYLTMTQALEARLGGSPFGPAGTGKTESVKALGHQLGRFVLVFNCDETFDFQAMGRIFVGLCQVGAWGCFDEFNRLEERMLSAVSQQVQCIQEALREHSNPNYDKTSAPITCELLNKQVKVSPDMAIFITMNPGYAGRSNLPDNLKKLFRSLAMTKPDRQLIAQVMLYSQGFRTAEVLANKIVPFFKLCDEQLSSQSHYDFGLRALKSVLVSAGNVKRERIQKIKREKEERGEAVDEGEIAENLPEQEILIQSVCETMVPKLVAEDIPLLFSLLSDVFPGVQYHRGEMTALREELKKVCQEMYLTYGDGEEVGGMWVEKVLQLYQITQINHGLMMVGPSGSGKSMAWRVLLKALERLEGVEGVAHIIDPKAISKDHLYGTLDPNTREWTDGLFTHVLRKIIDSVRGELQKRQWIVFDGDVDPEWVENLNSVLDDNKLLTLPNGERLSLPPNVRIMFEVQDLKYATLATVSRCGMVWFSEDVLSTDMIFNNFLARLRSIPLDEGEDEAQRRRKGKEDEGEEAASPMLQIQRDAATIMQPYFTSNGLVTKALEHAFQLEHIMDLTRLRCLGSLFSMLHQACRNVAQYNANHPDFPMQIEQLERYIQVRGHQGLHRAHQLRQTTGLRTSEMLHLWGCALSPRRGRAFVEGLGKVQWVSVMQEDWEPLSLVNFAVSVFLLLLKFYKNQSLIPFLIAISGLCHTLVPAGDSRLKMRAELGEYIRRITTVPLPTAPNIPIIDYEVSISGEWSPWQAKVPQIEVETHKVAAPDVVVPTLDTVRHEALLYTWLAEHKPLVLCGPPGSGKTMTLFSALRALPDMEVVGLNFSSATTPELLLKTFDHYCEYRRTPNGVVLAPVQLGKWLVLFCDEINLPDMDKYGTQRVISFIRQMVEHGGFYRTSDQTWVKLERIQFVGACNPPTDPGRKPLSHRFLRHVPVVYVDYPGPASLTQIYGTFNRAMLRLIPSLRTYAEPLTAAMVEFYTMSQERFTQDTQPHYIYSPREMTRWVRGIFEALRPLETLPVEGLIRIWAHEALRLFQDRLVEDEERRWTDENIDTVALKHFPNIDREKAMSRPILYSNWLSKDYIPVDQEELRDYVKARLKVFYEEELDVPLVLFNEVLDHVLRIDRIFRQPQGHLLLIGVSGAGKTTLSRFVAWMNGLSVYQIKVHRKYTGEDFDEDLRTVLRRSGCKNEKIAFIMDESNVLDSGFLERMNTLLANGEVPGLFEGDEYATLMTQCKEGAQKEGLMLDSHEELYKWFTSQVIRNLHVVFTMNPSSEGLKDRAATSPALFNRCVLNWFGDWSTEALYQVGKEFTSKMDLEKPNYIVPDYMPVVYDKLPQPPSHREAIVNSCVFVHQTLHQANARLAKRGGRTMAITPRHYLDFINHYANLFHEKRSELEEQQMHLNVGLRKIKETVDQVEELRRDLRIKSQELEVKNAAANDKLKKMVKDQQEAEKKKVMSQEIQEQLHKQQEVIADKQMSVKEDLDKVEPAVIEAQNAVKSIKKQHLVEVRSMANPPAAVKLALESICLLLGESTTDWKQIRSIIMRENFIPTIVNFSAEEISDAIREKMKKNYMSNPSYNYEIVNRASLACGPMVKWAIAQLNYADMLKRVEPLRNELQKLEDDAKDNQQKANEVEQMIRDLEASIARYKEEYAVLISEAQAIKADLAAVEAKVNRSTALLKSLSAERERWEKTSETFKNQMSTIAGDCLLSAAFIAYAGYFDQQMRQNLFTTWSHHLQQANIQFRTDIARTEYLSNADERLRWQASSLPADDLCTENAIMLKRFNRYRI

SEQ ID NO: 917698 - protein, 340 aa, Homo sapiens
PPPSVGRLDQEPSWLGLPNNAERVLLTTQGVDMISKMLKMQMLEDEDDLAYAETEKKTRTDSTSDGRPAWMRTLHTTASNWLHLIPQTLSHLKRTVENIKDPLFRFFEREVKMGAKLLQDVRQDLADVVQVCEGKKKQTNYLRTLINELVKGILPRSWSHYTVPAGMTVIQWVSDFSERIKQLQNISLAAASGGAKELKNIHVCLGGLFVPEAYITATRQYVAQANSWSLEELCLEVNVTTSQGATLDACSFGVTGLKLQGATCNNNKLSLSNAISTALPLTQLRWVKQTNTEKKASVVTLPVYLNFTRADLIFTVDFEIATKEDPRSFYERGVAVLCTE

SEQ ID NO: 917699 - protein, 2880 aa, Homo sapiens
MSEPGGGGGEDGSAGLEVSAVQNVADVSVLQKHLRKLVPLLLEDGGEAPAALEAALEEKSALEQMRKFLSDPQVHTVLVERSTLKEDVGDEGEEEKEFISYNINIDIHYGVKSNSLAFIKRTPVIDADKPVSSQLRVLTLSEDSPYETLHSFISNAVAPFFKSYIRESGKADRDGDKMAPSVEKKIAELEMGLLHLQQNIEIPEISLPIHPMITNVAKQCYERGEKPKVTDFGDKVEDPTFLNQLQSGVNRWIREIQKVTKLDRDPASGTALQEISFWLNLERALYRIQEKRESPEVLLTLDILKHGKRFHATVSFDTDTGLKQALETVNDYNPLMKDFPLNDLLSATELDKIRQALVAIFTHLRKIRNTKYPIQRALRLVEAISRDLSSQLLKVLGTRKLMHVAYEEFEKVMVACFEVFQTWDDEYEKLQVLLRDIVKRKREENLKMVWRINPAHRKLQARLDQMRKFRRQHEQLRAVIVRVLRPQVTAVAQQNQGEVPEPQDMKVAEVLFDAADANAIEEVNLAYENVKEVDGLDVSKEGTEAWEAAMKRYDERIDRVETRITARLRDQLGTAKNANEMFRIFSRFNALFVRPHIRGAIRDYQTQLIQRVKDDIESLHDKFKVQYPQSQACKMSHVRDLPPVSGSIIWAKQIDRQLTAYMKRVEDVLGKGWENHVEGQKLKQDGDSFRMKLNTQEIFDDWARKVQQRNLGVSGRIFTIESTRVRGRTGNVLKLKVNFLPEIITLSKEVRNLKWLGFRVPLAIVNKAHQANQLYPFAISLIESVRTYERTCEKVEERNTISLLVAGLKKEVQALIAEGIALVWESYKLDPYVQRLAETVFNFQEKVDDLLIIEEKIDLEVRSLETCMYDHKTFSEILNRVQKAVDDLNLHSYSNLPIWVNKLDMEIERILGVRLQAGLRAWTQVLLGQAEDKAEVDMDTDAPQVSHKPGGEPKIKNVVHELRITNQVIYLNPPIEECRYKLYQEMFAWKMVVLSLPRIQSQRYQVGVHYELTEEEKFYRNALTRMPDGPVALEESYSAVMGIVSEVEQYVKVWLQYQCLWDMQAENIYNRLGEDLNKWQALLVQIRKARGTFDNAETKKEFGPVVIDYGKVQSKVNLKYDSWHKEVLSKFGQMLGSNMTEFHSQISKSRQELEQHSVDTASTSDAVTFITYVQSLKRKIKQFEKQVELYRNGQRLLEKQRFQFPPSWLYIDNIEGEWGAFNDIMRRKDSAIQQQVANLQMKIVQEDRAVESRTTDLLTDWEKTKPVTGNLRPEEALQALTIYEGKFGRLKDDREKCAKAKEALELTDTGLLSGSEERVQVALEELQDLKGVWSELSKVWEQIDQMKEQPWVSVQPRKLRQNLDALLNQLKSFPARLRQYASYEFVQRLLKGYMKINMLVIELKSEALKDRHWKQLMKRLHVNWVVSELTLGQIWDVDLQKNEAIVKDVLLVAQGEMALEEFLKQIREVWNTYELDLVNYQNKCRLIRGWDDLFNKVKEHINSVSAMKLSPYYKVFEEDALSWEDKLNRIMALFDVWIDVQRRWVYLEGIFTGSADIKHLLPVETQRFQSISTEFLALMKKVSKSPLVMDVLNIQGVQRSLERLADLLGKIQKALGEYLERERSSFPRFYFVGDEDLLEIIGNSKNVAKLQKHFKKMFAGVSSIILNEDNSVVLGISSREGEEVMFKTPVSITEHPKINEWLTLVEKEMRVTLAKLLAESVTEVEIFGKATSIDPNTYITWIDKYQAQLVVLSAQIAWSENVETALSSMGGGGDAAPLHSVLSNVEVTLNVLADSVLMEQPPLRRRKLEHLITELVHQRDVTRSLIKSKIDNAKSFEWLSQMRFYFDPKQTDVLQQLSIQMANAKFNYGFEYLGVQDKLVQTPLTDRCYLTMTQALEARLGGSPFGPAGTGKTESVKALGHQLGRFVLVFNCDETFDFQAMGRIFVGLCQVGAWGCFDEFNRLEERMLSAVSQQVQCIQEALREHSNPNYDKTSAPITCELLNKQVKVSPDMAIFITMNPGYAGRSNLPDNLKKLFRSLAMTKPDRQLIAQVMLYSQGFRTAEVLANKIVPFFKLCDEQLSSQSHYDFGLRALKSVLVSAGNVKRERIQKIKREKEERGEAVDEGEIAENLPEQEILIQSVCETMVPKLVAEDIPLLFSLLSDVFPGVQYHRGEMTALREELKKVCQEMYLTYGDGEEVGGMWVEKVLQLYQITQINHGLMMVGPSGSGKSMAWRVLLKALERLEGVEGVAHIIDPKAISKDHLYGTLDPNTREWTDGLFTHVLRKIIDSVRGELQKRQWIVFDGDVDPEWVENLNSVLDDNKLLTLPNGERLSLPPNVRIMFEVQDLKYATLATVSRCGMVWFSEDVLSTDMIFNNFLARLRSIPLDEGEDEAQRRRKGKEDEGEEAASPMLQIQRDAATIMQPYFTSNGLVTKALEHAFQLEHIMDLTRLRCLGSLFSMLHQACRNVAQYNANHPDFPMQIEQLERYIQVRGHQGLHRAHQLRQTTGLRTSEMLHLWGCALSPRRGRAFVEGLGKVQWVSVMQEDWEPLSLVNFAVSVFLLLLKFYKNQSLIPFLIAISGLCHTLVPAGDSRLKMRAELGEYIRRITTVPLPTAPNIPIIDYEVSISGEWSPWQAKVPQIEVETHKVAAPDVVVPTLDTVRHEALLYTWLAEHKPLVLCGPPGSGKTMTLFSALRALPDMEVVGLNFSSATTPELLLKTFDHYCEYRRTPNGVVLAPVQLGKWLVLFCDEINLPDMDKYGTQRVISFIRQMVEHGGFYRTSDQTWVKLERIQFVGACNPPTDPGRKPLSHRFLRHVPVVYVDYPGPASLTQIYGTFNRAMLRLIPSLRTYAEPLTAAMVEFYTMSQQVDEFTPVYNRL

SEQ ID NO: 917700 - protein, 2826 aa, Homo sapiens
MSEPGGGGGEDGSAGLEVSAVQNVADVSVLQKHLRKLVPLLLEDGGEAPAALEAALEEKSALEQMRKFLSDPQVHTVLVERSTLKEDVGDEGEEEKEFISYNINIDIHYGVKSNSLAFIKRTPVIDADKPVSSQLRVLTLSEDSPYETLHSFISNAVAPFFKSYIRESGKADRDGDKMAPSVEKKIAELEMGLLHLQQNIEIPEISLPIHPMITNVAKQCYERGEKPKVTDFGDKVEDPTFLNQLQSGVNRWIREIQKVTKLDRDPASGTALQEISFWLNLERALYRIQEKRESPEVLLTLDILKHGKRFHATVSFDTDTGLKQALETVNDYNPLMKDFPLNDLLSATELDKIRQALVAIFTHLRKIRNTKYPIQRALRLVEAISRDLSSQLLKVLGTRKLMHVAYEEFEKVMVACFEVFQTWDDEYEKLQVLLRDIVKRKREENLKMVWRINPAHRKLQARLDQMRKFRRQHEQLRAVIVRVLRPQVTAVAQQNQGEVPEPQDMKVAEVLFDAADANAIEEVNLAYENVKEVDGLDVSKEGTEAWEAAMKRYDERIDRVETRITARLRDQLGTAKNANEMFRIFSRFNALFVRPHIRGAIRDYQTQLIQRVKDDIESLHDKFKVQYPQSQACKMSHVRDLPPVSGSIIWAKQIDRQLTAYMKRVEDVLGKGWENHVEGQKLKQDGDSFRMKLNTQEIFDDWARKVQQRNLGVSGRIFTIESTRVRGRTGNVLKLKVNFLPEIITLSKEVRNLKWLGFRVPLAIVNKAHQANQLYPFAISLIESVRTYERTCEKVEERNTISLLVAGLKKEVQALIAEGIALVWESYKLDPYVQRLAETVFNFQEKVDDLLIIEEKIDLEVRSLETCMYDHKTFSEILNRVQKAVDDLNLHSYSNLPIWVNKLDMEIERILGVRLQAGLRAWTQVLLGQAEDKAEVDMDTDAPQVSHKPGGEPKIKNVVHELRITNQVIYLNPPIEECRYKLYQEMFAWKMVVLSLPRIQSQRYQVGVHYELTEEEKFYRNALTRMPDGPVALEESYSAVMGIVSEVEQYVKVWLQYQCLWDMQAENIYNRLGEDLNKWQALLVQIRKARGTFDNAETKKEFGPVVIDYGKVQSKVNLKYDSWHKEVLSKFGQMLGSNMTEFHSQISKSRQELEQHSVDTASTSDAVTFITYVQSLKRKIKQFEKQVELYRNGQRLLEKQRFQFPPSWLYIDNIEGEWGAFNDIMRRKDSAIQQQVANLQMKIVQEDRAVESRTTDLLTDWEKTKPVTGNLRPEEALQALTIYEGKFGRLKDDREKCAKAKEALELTDTGLLSGSEERVQVALEELQDLKGVWSELSKVWEQIDQMKEQPWVSVQPRKLRQNLDALLNQLKSFPARLRQYASYEFVQRLLKGYMKINMLVIELKSEALKDRHWKQLMKRLHVNWVVSELTLGQIWDVDLQKNEAIVKDVLLVAQGEMALEEFLKQIREVWNTYELDLVNYQNKCRLIRGWDDLFNKVKEHINSVSAMKLSPYYKVFEEDALSWEDKLNRIMALFDVWIDVQRRWVYLEGIFTGSADIKHLLPVETQRFQSISTEFLALMKKVSKSPLVMDVLNIQGVQRSLERLADLLGKIQKALGEYLERERSSFPRFYFVGDEDLLEIIGNSKNVAKLQKHFKKMFAGVSSIILNEDNSVVLGISSREGEEVMFKTPVSITEHPKINEWLTLVEKEMRVTLAKLLAESVTEVEIFGKATSIDPNTYITWIDKYQAQLVVLSAQIAWSENVETALSSMGGGGDAAPLHSVLSNVEVTLNVLADSVLMEQPPLRRRKLEHLITELVHQRDVTRSLIKSKIDNAKSFEWLSQMRFYFDPKQTDVLQQLSIQMANAKFNYGFEYLGVQDKLVQTPLTDRCYLTMTQALEARLGGSPFGPAGTGKTESVKALGHQLGRFVLVFNCDETFDFQAMGRIFVGLCQVGAWGCFDEFNRLEERMLSAVSQQVQCIQEALREHSNPNYDKTSAPITCELLNKQVKVSPDMAIFITMNPGYAGRSNLPDNLKKLFRSLAMTKPDRQLIAQVMLYSQGFRTAEVLANKIVPFFKLCDEQLSSQSHYDFGLRALKSVLVSAGNVKRERIQKIKREKEERGEAVDEGEIAENLPEQEILIQSVCETMVPKLVAEDIPLLFSLLSDVFPGVQYHRGEMTALREELKKVCQEMYLTYGDGEEVGGMWVEKVLQLYQITQINHGLMMVGPSGSGKSMAWRVLLKALERLEGVEGVAHIIDPKAISKDHLYGTLDPNTREWTDGLFTHVLRKIIDSVRGELQKRQWIVFDGDVDPEWVENLNSVLDDNKLLTLPNGERLSLPPNVRIMFEVQDLKYATLATVSRCGMVWFSEDVLSTDMIFNNFLARLRSIPLDEGEDEAQRRRKGKEDEGEEAASPMLQIQRDAATIMQPYFTSNGLVTKALEHAFQLEHIMDLTRLRCLGSLFSMLHQACRNVAQYNANHPDFPMQIEQLERYIQVRGHQGLHRAHQLRQTTGLRTSEMLHLWGCALSPRRGRAFVEGLGKVQWVSVMQEDWEPLSLVNFAVSVFLLLLKFYKNQSLIPFLIAISGLCHTLVPAGDSRLKMRAELGEYIRRITTVPLPTAPNIPIIDYEVSISGEWSPWQAKVPQIEVETHKVAAPDVVVPTLDTVRHEALLYTWLAEHKPLVLCGPPGSGKTMTLFSALRALPDMEVVGLNFSSATTPELLLKTFDHYCEYRRTPNGVVLAPVQLGKWLVLFCDEINLPDMDKYGTQRVISFIRQMVEHGGFYRTSDQTWVKLERIQFVGACNPPTDPGRKPLSHRSCARGSLSRLQHQ

SEQ ID NO: 917701 - protein, 2509 aa, Homo sapiens; identical to SEQ ID NO: 917678

SEQ ID NO: 917702 - protein, 364 aa, Homo sapiens
MSEPGGGGGEDGSAGLEVSAVQNVADVSVLQKHLRKLVPLLLEDGGEAPAALEAALEEKSALEQMRKFLSDPQVHTVLVERSTLKEDVGDEGEEEKEFISYNINIDIHYGVKSNSLAFIKRTPVIDADKPVSSQLRVLTLSEDSPYETLHSFISNAVAPFFKSYIRESGKADRDGDKMAPSVEKKIAELEMGLLHLQQNIEIPEISLPIHPMITNVAKQCYERGEKPKVTDFGDKVEDPTFLNQLQSGVNRWIREIQKVTKLDRDPASGTALQEISFWLNLERALYRIQEKRESPEVLLTLDILKHGKRFHATVSFDTDTGLKQALETVNDYNPLMKDFPLNDLLSATELDSKSFRGKSFPHAE

SEQ ID NO: 917703 - protein, 71 aa, Homo sapiens
VTLRSTRNASFTPSLTQLLVADTRERQCVVTLPVYLNFTRADLIFTVDFEIATKEDPRSFYERGVAVLCTE

SEQ ID NO: 917704 - protein, 129 aa, Homo sapiens
MQDVESYDPVLNPVLNREVRRTGGRVLITLGDQDIDLSPSFVIFLSTRDPTVRNGTLPQGNLAGCGFETGLRQTVLLPILEVEFPPDLCSRVTFVNFTVTRSSLQSQCLNEVLKAERPDVDEKRSDLLK

SEQ ID NO: 917705 - protein, 318 aa, Homo sapiens
MGTSGTHSRPQPHTQTHIQRIPLKEHTCKSPHRGTHKWGHQEHRATATHTDPHTEDPTQGAHVRKSPTEGHTNGDIRNTGPQPHTQTHIQRIPLKEHTCESPHRGAHKWGHQEHRATATHTDPHTEDPTQGAHVRKSPQRGTQMGTSGTQGHSHTHRPTYRGSHSRSTSAKVPTEGHTNGDIRNTLGATATHTDPHTEDPTQGAHVQKSPQRGTQVGTSGTQGHSHTHRPTYRGSHSRNTRVKVPTEVHTGSTQEQAHHRQDPKWKSRQTPRRQVDRAQSQTTLRDRGEQWNQNSGYGHGDSRKGNSSMDADRTNPKL

SEQ ID NO: 917706 - protein, 533 aa, Homo sapiens
METLTSRHEKRALHSQASAISQDREEKIMSQEPLSFKDVAVVFTEEELELLDSTQRQLYQDVMQENFRNLLSVGERNPLGDKNGKDTEYIQDEELRFFSHKELSSCKIWEEVAGELPGSQDCRVNLQGKDFQFSEDAAPHQGWEGASTPCFPIENSLDSLQGDGLIGLENQQFPAWRAIRPIPIQGSWAKAFVNQLGDVQERCKNLDTEDTVYKCNWDDDSFCWISCHVDHRFPEIDKPCGCNKCRKDCIKNSVLHRINPGENGLKSNEYRNGFRDDADLPPHPRVPLKEKLCQYDEFSEGLRHSAHLNRHQRVPTGEKSVKSLERGRGVRQNTHIRNHPRAPVGDMPYRCDVCGKGFRYKSVLLIHQGVHTGRRPYKCEECGKAFGRSSNLLVHQRVHTGEKPYKCSECGKGFSYSSVLQVHQRLHTGEKPYTCSECGKGFCAKSALHKHQHIHPGEKPYSCGECGKGFSCSSHLSSHQKTHTGERPYQCDKCGKGFSHNSYLQAHQRVHMGQHLYKCNVCGKSFSYSSGLL

SEQ ID NO: 917707 - protein, 430 aa, Homo sapiens
SLLTMSLEYLTLYPLVILGYISTQAMPPLFSLGYHQCRWNYEDEQDVKAVDAGFDEHDIPYDAMWLDIEHTEGKRYFTWDKNRFPNPKRMQELLRSKKRKLVVISDPHIKIDPDYSVYVKAKDQGFFVKNQEGEDFEGVCWPGLSSYLDFTNPKVREWYSSLFAFPVYQGSTDILFLWNDMNEPSVFRGPEQTMQKNAIHHGNWEHRELHNIYGFYHQMATAEGLIKRSKGKERPFVLTRSFFAGSQKYGAVWTGDNTAEWSNLKISIPMLLTLSITGISFCGADIGGFIGNPETELLVRWYQAGAYQPFFRGHATMNTKRREPWLFGEEHTRLIREAIRERYGLLPYWYSLFYHAHVASQPVMRPLWVEFPDELKTFDMEDEYMLGSALLVHPVTEPKATTVDVFLPGSNEVPLPSRNLRKRLNATTAE

SEQ ID NO: 917708 - protein, 554 aa, Homo sapiens
SLLTMSLEYLTLYPLVILGYISTQAMPPLFSLGYHQCRWNYEDEQDVKAVDAGFDEHDIPYDAMWLDIEHTEGKRYFTWDKNRFPNPKRMQELLRSKKRKLVVISDPHIKIDPDYSVYVKAKDQGFFVKNQEGEDFEGVCWPGLSSYLDFTNPKVREWYSSLFAFPVYQGSTDILFLWNDMNEPSVFRGPEQTMQKNAIHHGNWEHRELHNIYGFYHQMATAEGLIKRSKGKERPFVLTRSFFAGSQKYGAVWTGDNTAEWSNLKISIPMLLTLSITGISFCGADIGGFIGNPETELLVRWYQAGAYQPFFRGHATMNTKRREPWLFGEEHTRLIREAIRERYGLLPYWYSLFYHAHVASQPVMRPLWVEFPDELKTFDMEDEYMLGSALLVHPVTEPKATTVDVFLPGSNEVWYDYKTFAHWEGGCTVKIPVALDTIPVFQRGGSVIPIKTTVGKSTGWMTESSYGLRVALSTKGSSVGELYLDDGHSFQYLHQKQFLHRKFSFCSSVLINSFADQRGHYPSKCVVEKILVLGFRKEPSSVTTHSSGEKAVHS

SEQ ID NO: 917709 - protein, 202 aa, Homo sapiens
MHTALCARQFLLNSVAQKFAVSLWSLGRTRVASLGPSWFLLMQTVTRPNTARPGTPRLRRSRSSGKPLSAPQKPALGKGGAGVQTAGAAASGKGGAGVQTAGAAARGKEGVLQQQTAGAAAWGRGLCWGADGGGCTWGAGRAGVQTAGAAVSCPSLRVSGAASLRFPPAALALRSLWPGEDPSCIGGHSKSAVWSLHCLFRV

SEQ ID NO: 917710 - protein, 741 aa, Homo sapiens
AGKIMNQCLEGDPVACEDVAVNFTQEEWALLDISQRKLYREVMLETFRNLTSIGKKWKDQNIEYEYQNPRRNFRSLIEGNVNEIKEDSHCGETFTQVPDDRLNFQEKKASPEAKSCDNFVCGEVGIGNSSFNMNIRGDIGHKAYEYQDYAPKPYKCQQPKKAFRYHPSFRTQERNHTGEKPYACKECGKTFISHSGIRRRMVMHSGDGPYKYYILSMKELTLERNRMNVNNVLNPLVILLPIEYMKELTLEKSLMNVSNVGKHSIVPVLFKHIKEPTLGESHMNVNNVANPSVGVIPFKYMKELTLGRSPVNVANVIKHSVVTDPILDIKGVTRERSLINVRNVEKHSRIPVPFVDMKGPTLRKNLMNVSSVGKHYLISFQTHLRMRSGERPYKFPFNIMKGLTLERNPMSVSNVGKPSDVPHTFEGMVGLTGEKPYECKECGKAFRSASHLQIHERTQTHIRIHSGERPYKCKTCGKGFYSPKSFQRHEKTHTAEKPYECKQCGKAFSSSSSFPYHERTHTGEKPYECKQCGKAFRSASILQMHAGTHPEEKPYECKQCGKAFRSAPHLRIHGRTHTGEKPYECKECGKAFRSAKNLRIHERTQTHVRMHSVERPYKCKICGKGFYSAKSFQIHEKSYTGGKPYECKQCGLQLPRTAAESVDSEKLQGPGKQETHVQLLSLYCLRRVLDCSREFCRRRRNIWKLKNACALCLLPWHLGGLLPTTLCLKIQKSAAHGGGYQ

SEQ ID NO: 917711 - protein, 164 aa, Homo sapiens
KETIVYTGSVERAPGECSGMTLLSRCPEANIAHPVATVPKSACREESSSPGAEAECKSAGPALQHAGSLPVHPICCFLGVVATSSKGGWICSPVHSPYPRGTCGALATSSQGAAEEVGSLLIPVPSENWRLPSPNHTCNKVFCLLLTAPENLLRENKTFDCCSS

SEQ ID NO: 917712 - protein, 259 aa, Homo sapiens
ATPGPAAPPVQWFSTVVVLSMAGVAVNVYVPWLTTLAMHPGVPEGPGVSEPGPRELCAFVSGAAAHMLRALQPRRTRPPKRRPNHRRFLHNQICRQFTKIEAATQRLALSILSQEAPPQRPSLQKPPPPPPSPFLGVACAVAPTEAPHASASLSLAALDTSTLDLFDNIALTPECASMPWDPSSGSDAPLPAPGLSHRDLGQLDLRQVPHFCGPLPLPQHALGEEADLVAPDWGWVDCWEVPRAWDSQGIPEGWGTSSP

SEQ ID NO: 917713 - protein, 170 aa, Homo sapiens
AAREPLQRTREMKMGRRIHLELRNRTPSDVKELVLDNKNLKSLDLFNCEVTNLNDYRENVFKLLLQLTYLDGYDRDDKEAPNLDAEGYVEGLDEEEEDEDEEEYDEDAQVVEDEEEEEGEEEDVSGEEEEDEKGYNDGEVDDEEDEEELREEERGQKRKGEPEDEGEDDD

SEQ ID NO: 917714 - protein, 170 aa, Homo sapiens; identical to SEQ ID NO: 917713

SEQ ID NO: 917715 - protein, 522 aa, Homo sapiens
AVTPQRLAQCPAHSWCSINICQMVEEQRPLCPQEVNVMNTPHPLHKQEKAPAHKNPVCFLRSPAAHSRTTRKPSPTFPLFSSVTWFLSQYQIQALGTKRVRRLPQEACPATFLNVGAEISITLEPAQPSEGDNVTLVVHGLSGELLAYSWYAGPTLSVSYLVASYIVSTGDETPGPAHTGREAVRPDGSLDIQGILPRHSGTYILQTFNRQLQTEVGYGHVQVHEILAQPTVLANSTALVERRDTLRLMCSSPSPTAEVRWFFNGGALPVALRLGLSPDGRVLARHGIRREEAGAYQCEVWNPVSVSRSEPINLTVYFGPERVAILQDSTTRTGCTIKVDFNTSLTLWCVSRSCPEPEYVWTFNGQALKNGQDHLNISSMTAAQEGTYTCIAKNTKTLLSGSASVVVKLSAAAVATMIVPVPTKPTEGQDVTLTVQGYPKDLLVYAWYRGPASEPNRLLSQLPSGTWIAGPAHTGREVGFPNCSLLVQKLNLTDTGRYTLKTVTVQGKTETLEVELQVAPLG

SEQ ID NO: 917716 - protein, 179 aa, Homo sapiens
MCGHNNFKVRNDYTDEKLEGTKEEGGRTQKASLLRSDPGTTCFSSHCPGHHFPLRVGKSVVLVTTSWRFSPSGKVQTPHPPNLDGPRRANRNTFLWTCHVGIPDLPALPAPASFLGTQLTLKKASDGPRTEKVTQDLAQPFWTTGRQLRFVLHLSLQQKDLSKCWRGAEVVLGPTRLFL

SEQ ID NO: 917717 - protein, 180 aa, Homo sapiens
MVPREHRRSDRPQHQLLMAHTSWGCKACPWLWQRDDRAVAPAGVAVAAARVARAMDEGQDMESRGRNEPRGHRAQLSGSHGEAQRETHSQVAVDLGDSSLVHLSSHNVPGPMRLARGRETQNDSRHGTLLGEVSQPRNGGLGMLNAMAQAASVLMKPPYQCVFFINSGGGGVVVGIRTCV

SEQ ID NO: 917718 - protein, 366 aa, Homo sapiens
MLIILLEPAVQGVGVSPGKSILQVLNLISANMLTKLLLIPHYSSHTCSCTFFFNISVGFTSKGLSPKENNKEELYHLVILERKESHGINNFDLKEVWENMPKFDSLWDYDVKNYKGMPLTCNKNLTHRKDQQHNKSSIHFSLKQSVSIRDSAHQYFIHDKPFIRNLLKLKNNIRYAGNKYVKCFENKIGLSLQAQLAELQRFQTGEKMYECNPVEKSINSSSVSPLPPCVKNICNKYRKILKYPLLHTQYGRTHIREKSYKCNDCGKAFSKSSNLTNHQRIHSGQRPYKCNECGKAFNQCSNLTRHQRVHTGEKPYQCNICGKVCSQNSNLASHQRMHTGEKPYKCNECGLGSMIHELLPWSRTIL

SEQ ID NO: 917719 - protein, 78 aa, Homo sapiens
EADLAGLLALSGESPSFGFKPAPRGPQVPTLRCRVLGSPCRLKPRTCSFLSRRGPKTFPVPSLREGLEICVHFGLKSF

SEQ ID NO: 917720 - protein, 369 aa, Homo sapiens
MALSQGLFTFKDVAIEFSQEEWECLDPAQRALYRDVMLENYRNLLSLDEDNIPPEDDISVGFTSKGLSPKENNKEELYHLVILERKESHGINNFDLKEVWENMPKFDSLWDYDVKNYKGMPLTCNKNLTHRKDQQHNKSSIHFSLKQSVSIRDSAHQYFIHDKPFIRNLLKLKNNIRYAGNKYVKCFENKIGLSLQAQLAELQRFQTGEKMYECNPVEKSINSSSVSPLPPCVKNICNKYRKILKYPLLHTQYGRTHIREKSYKCNDCGKAFSKSSNLTNHQRIHSGQRPYKCNECGKAFNQCSNLTRHQRVHTGEKPYQCNICGKVCSQNSNLASHQRMHTGEKPYKCNECGLGSMIHELLPWSRTIL

SEQ ID NO: 917721 - protein, 78 aa, Homo sapiens; identical to SEQ ID NO: 917719

SEQ ID NO: 917722 - protein, 78 aa, Homo sapiens; identical to SEQ ID NO: 917719

SEQ ID NO: 917723 - protein, 217 aa, Homo sapiens
MALSQGLFTFKDVAIEFSQEEWECLDPAQRALYRDVMLENYRNLLSLDEDNIPPEDDISVGFTSKGLSPKENNKEELYHLVILERKESHGINNFDLKEVWENMPKFDSLWDYDVKNYKGMPLTCNKNLTHRKDQQHNKSSIHFSLTKKKKNERKTMQQGERTENTQDKREHDTKKTTQKKQSRDNNSTNTNEGGETNNTAGGPLRNTTSSKERHAKR

SEQ ID NO: 917724 - protein, 333 aa, Homo sapiens
MRITSLQKMVTTLVHLYIFPYISVGFTSKGLSPKENNKEELYHLVILERKESHGINNFDLKEVWENMPKFDSLWDYDVKNYKGMPLTCNKNLTHRKDQQHNKSSIHFSLKQSVSIRDSAHQYFIHDKPFIRNLLKLKNNIRYAGNKYVKCFENKIGLSLQAQLAELQRFQTGEKMYECNPVEKSINSSSVSPLPPCVKNICNKYRKILKYPLLHTQYGRTHIREKSYKCNDCGKAFSKSSNLTNHQRIHSGQRPYKCNECGKAFNQCSNLTRHQRVHTGEKPYQCNICGKVCSQNSNLASHQRMHTGEKPYKCNECGLGSMIHELLPWSRTIL

SEQ ID NO: 917725 - protein, 531 aa, Homo sapiens
MQASADQVERDILETQKRLQQDRLNSEQSQALQHQQETGSSLKEAEVLLKDLFLDVDKARRLKHPQAEETEKDIEQLHERVTQECAEYCALYEKMVLPPRRGIQGRLGTRAGAETEAGLRRPVWAGHGGAGGTDRGAQHRAEGDQRPRRAAAEPGGAGGTEGGVVARAEPGQPVHALQGCTWQLSALAEQQRRILQQDWSDLMADPAGVRREYEVGWQRAILVLTAAPHPTRPQHFKQHELLSQEQSVNQLEEDGKRMVELRHPAVGPIQAHQEALKMEWQNFLNLCICQETQLQHVEDYSRVSPRAAAGRQGGRAGALAARAEREELPVPAMEPQPTAWGSPHPEAVLQLEVAPESSGPCTDTAKDQQSDKLPDLMPPAVATGLSPGAESIAGDRRGREEVASMAPASSSHAAPSPGHGASLGVRDQGVQSELLYLTKERPLLFTRATALLPQDLFILPVLGLSICKLEVLRAGKGGCEEGFGQLLLLSEVASSSRHGGLSTTGLLGYLPLICSLVRALLNRQARGAGTR

SEQ ID NO: 917726 - protein, 119 aa, Homo sapiens
MKPESCLICQATQQHQEKEQPWWPQTVVTGSQTSTPLRVPSLTPPLPTPEWSFQMTNLVRSLPCQEPLHGFFVNQGSSPDLSVFIYKNDTGTRKSEMRKAVCGHPLVNIEKSEAEQPRT

SEQ ID NO: 917727 - protein, 119 aa, Homo sapiens; identical to SEQ ID NO: 917726

SEQ ID NO: 917728 - protein, 533 aa, Homo sapiens
MAQPSAPAASMLLPCPECPSGPRFMTCCLSVSTFCSPSLRRPPGFVQCLLLKLCSKFNASCDLPYTTWGPSPPQPFSCVPASCRRHHDHHHPPVHLLQLHQGLLRPGSGSSRTSCRLSGGLGAGSCRLGSAGGLGSALRGSSYSSCYCFGSGGGYGSSFGGVDGLLAGGEKATMQNLNDRLASYLDKMRALEEANTELEVKIRDWYQRQAPGPARDYSQYYRTIEELQNKILTATLNNANILLQIDNAHLAAADFCTKFETEQALRLSVEAAINGLRRVLDGLTLARADLEMQIENLKEELAYLKKNHEEEINALRGQVGGEINVEMDAAPGMDLSRILNEMREYTDSKATARCLGGAHSSASCVDHRVTRCINRPGAELKLGSGGWVGRLTPPCPVSCLQTEELKREVATNSELVQSGKSKISELWRTMQALEIELQSQLSMKASLEGNLAETESRYCMQLSQIQGLIGSVEEQLAQLRCETEQQNQQYKILLDVKTRLEQEIATYHRLLEGEDAQLLCPGSVGLYFSFLLP

SEQ ID NO: 917729 - protein, 553 aa, Homo sapiens
MSDFDEFERQLNENKQERDKENRHRKRSHSRSRSRDRKRRSRSRDRRNRDQRSASRDRRRRSKPLTRGAKEEHGGLMCASLPAPSSLMSTPFTFLTPVHPVPPISSPGPSTGKSPLTLKPAPLSQALPQTLSFPGESGAYLVAGRVKGCLGGGSQAHCCRSPRHEKKKKVRKYWDVPPPGFEHITPMQYKAMQDSSHCSSPHHDPDGLAVTPTPVPVVGSQMTRQARRLYVGNIPFGITENPEIKELFPFLFKVKYCGAEIPRSNKKFATIEAMMDFFNAQMRLGGLTQAPGNPVLAVQINQDKNFAFLEFRSVDETTQAMAFDGIIFQGQSLKIRRPHDYQPLPGMSENPSVYVPGIGAVLSALHGRQFYDTGIGAVLSALHARQFYDTGIGAVLSALHGRQFYDTGIGAVLSALHGRQFYDTGIGAVLSALHGRQFYDTGIGAVLSALHARQTVQVLGDNLVLELKSSSSLPIGVVSTVVPDSAHKLFIGGLPNYLNDDQVKELLTSFGPLKAFNLVKDSATGLSKGYAFCEYVDINVTDQGTGREAANLR

SEQ ID NO: 917730 - protein, 222 aa, Homo sapiens
MGAQPGEPQNTCSRIQTLFRRVKTLLIKAPPPPQPPPPPPSWNPGCTHVYGYAFGHMHDNNLEHLPSQQVLDTGEQLMVPVEVLEVDNKEALWKFLLSGAMAGAVSRTGTAPLDRAKVYMQVYSSKTNFTNLLGGLQSMVQEGGFRSLWRGNGINVLKIAPEYAIKFSVFEQCKNYFCGIQGSPPFQERLLAGSLAVAISQTLINPMENFFLFSTLSLILSA

SEQ ID NO: 917731 - protein, 171 aa, Homo sapiens
PVYEGDVRKKDRTLRFREAKELPEVIQRIMTAAKGPDACLHSGPSKAWGRAGRADFQNSQVVSGPCCGERDLRAARTSDAVRLPSDRLAPVLWCPVATKDKRKGRTQKQSLYDMKGLAKPPARSVSRLLLLFTHKRVCHIHTPTPTTTDLTHSPQTYTLPMNQDLPGRLCH

SEQ ID NO: 917732 - protein, 190 aa, Homo sapiens
CCGGQGLLVGTDLQSLSPGSRLSKIYSQSTLSLSTVANEAHNNLGVKRPTSRRLPGSRERDWENGSNASSPASVPEYTGPRLYKEPSAKSNKFIIHNALSHCCLAGKVNEPQKNRILEEIEKSKANHFLILFRDSSCQFRALYTLSGETEDCRGWQGMGPGPSRPPWWKASTSTTRTASASPRSPPRPCP

SEQ ID NO: 917733 - protein, 283 aa, Homo sapiens
MLHTGYRWMMPTWLPMTSAPSEAGSLELPQGLDKLTLPGANLEMQPENLKEDLVYLKKNHEEKVLGPRDSNPRIEIQGPAGAVRRSYMPCPVASFSAELCAALSWGSLLPEKQDTRKVDKDVSVKMDTVPGVNLSCILNEMRDQDKKLVEKSCKDAQGWFFSVEQPLSCAPLVKVSINPCGPLCLPERGAELQGGHQHRGPAERQDGDVELYISVQNLSRPSSARTQLAQLQGLIRSMEQQLCELCCDAEHQDHEHQVLLDVKTRLEQEIATYSRLLEVEDAH

SEQ ID NO: 917734 - protein, 283 aa, Homo sapiens; identical to SEQ ID NO: 917733

SEQ ID NO: 917735 - protein, 283 aa, Homo sapiens; identical to SEQ ID NO: 917733

SEQ ID NO: 917736 - protein, 47 aa, Homo sapiens
MGRWAVSEDRVICPVALVGLVKSVFKLSPALSRGSGALEGKYGYTFR

SEQ ID NO: 917737 - protein, 148 aa, Homo sapiens
RWALTVNMTFLSQVLSFPMSAGRVSVVVFSLCSCSSGVPKRCLRGSLGNSNERRWLAQQVELRDTHCCLSSTSCSYKLGRGIRGLGTYTHPHTRAHAHFNNPDWARTKSSQSVSLAGVLTGHGPAALLFSSWKPPALGGQPFCSLANG

SEQ ID NO: 917738 - protein, 148 aa, Homo sapiens; identical to SEQ ID NO: 917737

SEQ ID NO: 917739 - protein, 148 aa, Homo sapiens; identical to SEQ ID NO: 917737

SEQ ID NO: 917740 - protein, 148 aa, Homo sapiens; identical to SEQ ID NO: 917737

SEQ ID NO: 917741 - protein, 490 aa, Homo sapiens
QKSLQFSRLQGKSRRPRNHPPVQPSPAALRPPSPATGPVCPAGACDEGPVELRTRPKATGLPGAALPLRKRPLRRPSPEPAAPRGRCGPCRPPGPSARRLRPAGGPRAPPRPGPPEALYYPGALLPLYPTRAMGSPFPLVNLPTPLYPMMCPMEHPLSADIAMATRADEDGDTPLHIAVVQGNLPAVHRLVNLFQQGGRELDIYNNLRQTPLHLAVITTLPSVVRLLVTAGASPMALDRHGQTAAHLACEHRSPTCLRALLDSAAPGTLDLEARNYDGLTALHVAVNTECQETVQLLLERGADIDAVDIKSGRSPLIHAVENNSLSMVQLLLQHGANVNAQMYSGSSALHSASGRRLLPLVRTLVRSGADSSLKNCHNDTPLMVARSRRVIDILRGKATRPASTSQPDPSPDRSANTSPESSSRLSSNGLLSASPSSSPSQSPPRDPPGFPMAPPNFFLPSPSPPAFLPFAGVLRGPGRPVPPSPAPGGS

SEQ ID NO: 917742 - protein, 490 aa, Homo sapiens; identical to SEQ ID NO: 917741

SEQ ID NO: 917743 - protein, 486 aa, Homo sapiens
QKSLQFSRLQGKSRRPRNHPPVQPSPAALRPPSPATGPVCPAGACDEGPVELRTRPKATGLPGAALPLRKRPLRRPSPEPAAPRGRCGPCRPPGPSARRLRPAGGPRAPPRPGPPEALYYPGALLPLYPTRAMGSPFPLVNLPTPLYPMMCPMEHPLSADIAMATRADEDGDTPLHIAVVQGNLPAVHRLVNLFQQGGRELDIYNNLRQTPLHLAVITTLPSVVRLLVTAGASPMALDRHGQTAAHLACEHRSPTCLRALLDSAAPGTLDLEARNYDGLTALHVAVNTECQETVQLLLERGADIDAVDIKSGRSPLIHAVENNSLSMVQLLLQHGANVNAQMYSGSSALHSASGRRLLPLVRTLVRSGADSSLKNCHNDTPLMVARSRRVIDILRGKATRPASTSQPDPSPDRSANTSPESSSRLSSNGLLSASQCHTAPVMSLTLFAVTPTHCSHPFSHVGLASHSLNVPGMLHLMPLHLQFSLT

SEQ ID NO: 917744 - protein, 482 aa, Homo sapiens
MIYFWEAQRGNLTERVKTLFLAENSVKLKNLTGYTAYMVSVAAFNAAGDGPRSTPTQGQTQQAAPSAPSSVKFSELTTTSVNVSWEAPQFPNGILEGYRLVYEPCSPVDGVSKIVTVDVKGNSPLWLKVKDLAEGVTYRFRIRAKTFTYGPEIEANVTTGPGEGAPGPPGVPIIVRYSSAIAIHWSSGDPGKGPITRYVIEARPSDEGLWDILIKDIPKEVSSYTFSMDILKPGVSYDFRVIAVNDYGFGTPSSPSQSVPAQKANPFYEEWWFLVVIALVGLIFILLLVFVLIIRGQSKKYAKKTDSGNSAKSGALGHSEMMSLDESSFPALELNNRRLSVKNSFCRKNGLYTRSPPRPSPGSLHYSDEDVTKYNDLIPAESSSLTEKPSEISDSQGSDSEYEVDSNHQKAHSFVNHYISDPTYYNSWRRQQKGISRAQAYSYTESDSGEPDHTTVTNSTSTQQGSLFRPKASRNSNAPEPP

SEQ ID NO: 917745 - protein, 482 aa, Homo sapiens; identical to SEQ ID NO: 917744

SEQ ID NO: 917746 - protein, 599 aa, Homo sapiens
MGWAWGDPEKRKGFGWARWLTPVIPALWEAKAGRSPEDIPPLLGDTEKGWFQLELGGAIEGGGRRRGKENRFLYLPFTLSHCCFPTRCLYFWPELCLPQPCVFLTVSFSLLEPPPCSSVPSLFPYHPRSSFLRLLPPQQKRDLAGSAQPVSPEDTGQVFQVSHSFPHPLYDMSLLKNRFLRPGDDSSHDLMLLRLSEPAELTDAVKVMDLPTQEPALGTTCYASGWGSIEPEEWGPAHNSVFAWPVVLTPKKLQCVDLHVISNDVCAQVHPQKVTKFMLCAGRWTGGKSTCSGDSGGPLVCNGVLQGITSWGSEPCALPERPSLYTKVVHYRKWIKDTIHLHYAGEAGAMTSCSCDYPCSAPLPSRPNHGAVDVRPLVDVACVVPGRGLVCQQGKGGVLENEGFIGLLREAPQPQTHHLAVDTCVSMWDLVLSIALSVGCTGAVPLIQSRIVGGWECEKHSQPWQVAVYSHGWAHCGGVLVHPQWVLTAAHCLKKNSQVWLGRHNLFEPEDTGQRVPVSHSFPHPLYNMSLLKHQSLRPDEDSSHDLMLLRLSEPAKITDVVKVLGLPPRSQHWGPPATPQAGAASNQRSSCAPGVFSV

SEQ ID NO: 917747 - protein, 599 aa, Homo sapiens; identical to SEQ ID NO: 917746

SEQ ID NO: 917748 - protein, 136 aa, Homo sapiens
AKTGALFPLLDSLPIFLWEWVLETFLSVPESWELLSVICLRGSERWSCLGSYWGQSFSLCLSSFTLRVILGVHLSVMVCFKVSHHGALSHVPCLKSLLCTPRWCITGSGSRTPSQPTPECPCPTPTSSKFKSTSRS

SEQ ID NO: 917749 - protein, 475 aa, Homo sapiens
MGWAWGDPEKRKGFGWARWLTPVIPALWEAKAGRSPEDIPPLLGDTEKGWFQLELGGAIEGGGRRRGKENRFLYLPFTLSHCCFPTRCLYFWPELCLPQPCVFLTVSFSLLEPPPCSSVPSLFPYHPRSSFLRLLPPQQKRDLAGSAQPVSPEDTGQVFQVSHSFPHPLYDMSLLKNRFLRPGDDSSHDLMLLRLSEPAELTDAVKVMDLPTQEPALGTTCYASGWGSIEPEEWGPAHNSVFAWPVVLTPKKLQCVDLHVISNDVCAQVHPQKVTKFMLCAGRWTGGKSTCSGDSGGPLVCNGVLQGITSWGSEPCALPERPSLYTKVVHYRKWIKDTIHLHYAGEAGAMTSCSCDYPCSAPLPSRPNHGAVDVRPLVDVACVVPGRGLVCQQGKGGVLENEGFIGLLREAPQPQTHHLAVDTCVSMWDLVLSIALSVGCTGIARSGWVGTTCLSLKTQARGSLSATASHTRSTI

SEQ ID NO: 917750 - protein, 284 aa, Homo sapiens
CCDNTALVPRSLSAGSMMKSGSQSAPMPAPYVLRRPEGQASVPHLQGPGSMENSLSGCLETAARALSGPRKAGLRSSRMPEVQLERELLSRVGRGRHGVRGSLGDGASGALIAMVTTLPLLGVPLLLVHDAEDVTQHGGPQVDVGHGILDKQGRVRREPSMSRCSRSPLVTDCDRLLPRNFLDRRLRLEDEEEGCSSKDSPSGSPALLLRKEVSPKASPARPTCMVWRKSPSGALIISAVRSARERRLECTELDTSCLRIGILLDGRGGIQSRGVILQIWLEFQ

SEQ ID NO: 917751 - protein, 284 aa, Homo sapiens; identical to SEQ ID NO: 917750

SEQ ID NO: 917752 - protein, 824 aa, Homo sapiens
YRSYLRPITQAPSETATDAASLFALQAFLRSRDRSHQKFYNMMTKTQMFIRFIEECSFVSDKDASLAFFDDCVDKVDMDKSGEVRLIELDESFKSEHTVFVTPPEIPHLPNGEEPPLQYSYNGFPVLRNNLFERPEGFLQAKKNKLPSKSSMSHCALPQLLFKMHYFILDFMYMVTSVFRYNFELVFQVCYRILMQLCGQYDQPVLAVRVLFEMQKAGIDPNAITYGYYNKAVLESTWPSRSRSGYFLWTKVRNVVLGVTQFKRALKKHAHLSQTTLSGGQSDLGYNSLSKDEVRRGDTSTEDIQEEKDKKGSDCSSLSESESTKGSADCLPKLSYQNSSSIVRLTGTSNNSAGKISGESMESTPELLLISSLEDTNETRNIQSRCFRKRHKSDNETNLQQQVVWGNRNRNLSGGVLMGFMLNRINQEATPGDIVEKLGADAKILSNVISKSTRPNTLDIGKPPLRSKRDSLEKESSDDDTPFDGSNYLADKVDSPVIFDLEDLDSETDVSKAGCVATQNPKRIQRMNSSFSVKPFEKTDVATGFDPLSLLVAETEQQQKEEEEEDEDDSKSISTPSARRDLAEEIVMYMNNMSSPLTSRTPSIDLQRACDDKLNKKSPPLVKACRRSSLPPNSPKPVRLTKSKSYTKSEEKPRDRLWSSPAFSPTCPFREESQDTLTHSSPSFNLDTLLVPKLDVLRNSMFTAGKGVAEKASKWYSRFTMYTTSSKDQSSDRTSLSSVGAQDSESTSLTDEDVCHELEGPISSQETSATSGTKRIDLSRISLESSASLEGYFAFPLPVYENTYFPTALSTNYVGTLGFLPSDR

SEQ ID NO: 917753 - protein, 248 aa, Homo sapiens
LSQTVSGMDLRQTSADVQQRGLTVRTKTNTERNSININKKDVHTKTLSEGHQHRRAKENQEDLGLWEEKFGKFVDIKANETKLSILVSTGPSSIGLDFSLHGFEHLYGIPQHAESHQLKNTGDGDAYRLYNLDVYGYQIYDKMGIYGSVPYLLAHKLGRTIGIFWLNASETLVEINTEPAVEYTLTQMGPVAAKQKVRSRTHVHWMSESGIIDVFLLTGPTPSDVFKQYSHLTEKGCSKHCSCCCSPA

SEQ ID NO: 917754 - protein, 235 aa, Homo sapiens
MTTSIRQFTSSSSIKGSSGLGGGSSRTSCRLSGGLGAGSCRLGSAGGLGSTLGGSSYSSCYSFGSGGGYGSSFGGVDGLLAGGEKATMQNLNDRLASYLDKVRALEEANTELEVKIRDWYQRQAPGPARDYSQYYRTIEELQNKIPHSTHVEQRPTYTATDKTNDPNRLLDDYRTQVMRQKQSPDSQNVEADIDGLTQGDWTEHEPGQRRPGECRKRTVNGGAGHNRRRTTQRRR

SEQ ID NO: 917755 - protein, 470 aa, Homo sapiens
MTTSIRQFTSSSSIKGSSGLGGGSSRTSCRLSGGLGAGSCRLGSAGGLGSTLGGSSYSSCYSFGSGGGYGSSFGGVDGLLAGGEKATMQNLNDRLASYLDKVRALEEANTELEVKIRDWYQRQAPGPARDYSQYYRTIEELQNKEDLFRTLVWAQPPPSDDLTTLPSPLILTATVDNANILLQIDNARLAADDFRTKFETEQALRLSVEADINGLRRVLDELTLARADLEMHIENLKEELAYLKKNHEVRWLGQKVKDAEEWVAEPWGWAMAEAVRESTAGALGLVTLEGFPVCGALILGEMNAPRGQVGGEINVEMGAAPGVDLSRILNEMREQYEKMAEKNRKDAEDWFFSKTEELNREVATNSELVQSGKSEISELRCTMQALEIELQSQLSMKASLEGNLAETENRYCMQLSQIQGLIGSVEERLAQLLCEMEQQNQEYKILLDMKMRLELEITTYHRLLEGEDAQ

SEQ ID NO: 917756 - protein, 498 aa, Homo sapiens
FEDLIRHAVCRPLLSSPSPVCLPPAAATMTTSIRQFTSSSSIKGSSGLGGGSSRTSCRLSGGLGAGSCRLGSAGGLGSTLGGSSYSSCYSFGSGGGYGSSFGGVDGLLAGGEKATMQNLNDRLASYLDKVRALEEANTELEVKIRDWYQRQAPGPARDYSQYYRTIEELQNKEDLFRTLVWAQPPPSDDLTTLPSPLILTATVDNANILLQIDNARLAADDFRTKFETEQALRLSVEADINGLRRVLDELTLARADLEMHIENLKEELAYLKKNHEVRWLGQKVKDAEEWVAEPWGWAMAEAVRESTAGALGLVTLEGFPVCGALILGEMNAPRGQVGGEINVEMGAAPGVDLSRILNEMREQYEKMAEKNRKDAEDWFFSKTEELNREVATNSELVQSGKSEISELRCTMQALEIELQSQLSMKASLEGNLAETENRYCMQLSQIQGLIGSVEERLAQLLCEMEQQNQEYKILLDMKMRLELEITTYHRLLEGEDAQ

SEQ ID NO: 917757 - protein, 445 aa, Homo sapiens
MTTSIRQFTSSSSIKGSSGLGGGSSRTSCRLSGGLGAGSCRLGSAGGLGSTLGGSSYSSCYSFGSGGGYGSSFGGVDGLLAGGEKATMQNLNDRLASYLDKVRALEEANTELEVKIRDWYQRQAPGPARDYSQYYRTIEELQNKILTATVDNANILLQIDNARLAADDFRTKFETEQALRLSVEADINGLRRVLDELTLARADLEMHIENLKEELAYLKKNHEVRWLGQKVKDAEEWVAEPWGWAMAEAVRESTAGALGLVTLEGFPVCGALILGEMNAPRGQVGGEINVEMGAAPGVDLSRILNEMREQYEKMAEKNRKDAEDWFFSKTEELNREVATNSELVQSGKSEISELRCTMQALEIELQSQLSMKASLEGNLAETENRYCMQLSQIQGLIGSVEERLAQLLCEMEQQNQEYKILLDMKMRLELEITTYHRLLEGEDAQ

SEQ ID NO: 917758 - protein, 263 aa, Homo sapiens
RLVGGVIGEALLSSPSPVCLPPAAATMTTSIRQFTSSSSIKGSSGLGGGSSRTSCRLSGGLGAGSCRLGSAGGLGSTLGGSSYSSCYSFGSGGGYGSSFGGVDGLLAGGEKATMQNLNDRLASYLDKVRALEEANTELEVKIRDWYQRQAPGPARDYSQYYRTIEELQNKILTATVDNANILLQIDNARLAADDFRTKFETEQALRLSVEADINGLRRVLDELTLARADLEMHIENLKGKEPGPNLERKPRREGKIETPAKGP

SEQ ID NO: 917759 - protein, 470 aa, Homo sapiens; identical to SEQ ID NO: 917755

SEQ ID NO: 917760 - protein, 117 aa, Homo sapiens
MVFRVETLQSHTSRCHIQTPHVAGHTRVCICPMPLPVPSTRMPFPRCHGHHSGLSDNPLSEFQWLLPPLAQRPRKEREDQPRGGWSPKAMNFQENVTLAMALFTILTSIYFFNKAQQ

SEQ ID NO: 917761 - protein, 149 aa, Homo sapiens
MDLELRGHNGPPPHPTPANPTTLPPGRQPSLICPLNTICLGMGLEGGRFGGLGERQKELEGGTDRVHSHRGKKAPNQGAGRSLDSGSSIFSLLSGAGLCRVLTQGVVAEHRATTGSPAVAVFKNRPGTCKLLIPVTRAQIGTQSQPVGG

SEQ ID NO: 917762 - protein, 144 aa, Homo sapiens
MGQRLLHSQRMPACGCCRVAVAAPRAHSKGRAPCQLTHPGGLTTACNTILLHPGFTDEETEAYEEIRSALWPLQASTWDRGAKAQPSHAQGFSAVAKPLDSPVRRFCRLLEKARETMGSHSSHLSSGKNYNSVLLHSQNHHGLM

SEQ ID NO: 917763 - protein, 143 aa, Homo sapiens
IAVEETVMGWGLGLPPLPGRPGASVALCEVLLCRSLTQTTAPDVLATHPDLAVLPFWLNKRQTAPLHLAVCGLTNAYEDRINNSHHSRGGELNKSLLGSGKNPFRTPCDMCSHLARISLGGKRRLQERGRRLGWMAAFESVLR

SEQ ID NO: 917764 - protein, 171 aa, Homo sapiens
MDIRVSIVLSFWIVEVCWAVVERSLLGSSEPLARASPHFLAVYHAVASLATPPGIWMMSATDLFYGDPFAFPGGPFGKDLDRPQWALPGDTNLLLWLTLRLRWSQPHPLQQETAHLSGSLAFLDLLGVCIYKEKGPLVCEQHRGTEVPCLLVSPPSPSDIFLSSCCLVSWY

SEQ ID NO: 917765 - protein, 171 aa, Homo sapiens; identical to SEQ ID NO: 917764

SEQ ID NO: 917766 - protein, 155 aa, Homo sapiens
VTSHAANMLQVPTGPCTPLLQNVPHKSSLPEGIRPGTVLRIRGLVPPNASRFHVNLLCGEEQGSDAALHFNPRLDTSEVVFNSKEQGSWGREERGPGVPFQRGQPFEVLIIASDDGFKAVVGDAQYHHFRHRLPLARVRLVEVGGDVQLDSVRIF

SEQ ID NO: 917767 - protein, 176 aa, Homo sapiens
VTSHAANMLQVPTGPCTPLLQNVPHKSSLPEGIRPGTVLRIRGLVPPNASRFHVNLLCGEEQGSDAALHFNPRLDTSEVVFNSKEQGSWGREERGPGVPFQRGQPFEVLIIASDDGFKVRLCDRGHGPPESSPPTLPCTAVVGDAQYHHFRHRLPLARVRLVEVGGDVQLDSVRIF

SEQ ID NO: 917768 - protein, 254 aa, Homo sapiens
SSKQVMKMNKILHKLGSQICVLKVEWQFIQQTRKEIPGLGDSMYKDIDVRRTSFLKSVAAFENCSGHFCSSDPWQSTLTTTYIWTHVCKGCIQDVISKVQQISLSSQGTLNIHYQTNSLDTGSSLATERGHLYFPDHLGSIETPDGSSTDYSKTHWNEITGPRIFFWAKGNNSEMGSPKLVALLPPWKEGRAQTLVLSAIPDMWLPSLGPRQLSQLLSFPEGALGYDGERAMQSSEYNLLASLEEAVLWKQFQW

SEQ ID NO: 917769 - protein, 189 aa, Homo sapiens
MCSTGRAELGKGEPSPCTGRPERRGRRKTSPAPPAPTPDAGPQTSDDLEPPPHGCQEADRGSSWGATAPRPFRQNLSDLGRCSALPLKKNLCPGGSSLGAPPPRTPQRRVTLAVQRWLSHPRRRAVGLVGTWDADVDIRDYIGKRASQHVSQSITEEIETLMGVLDKDDGESTASSGGGDPEQPLEEKE

SEQ ID NO: 917770 - protein, 879 aa, Homo sapiens
MFQDPVAFKDVAVNFTQEEWALLDISQRKLYREVMLETFRNLTSLGKRWKDQNIEYEHQNPRRNFRSLIEEKVNEIKDDSHCGETFTPVPDDRLNFQEKKASPEVKSCESFVCGEVGLGNSSFNMNIRGDIGHKAYEYQEYGPKPCKCQQPKKAFRYRPSFRTQERDHTGEKPNACKVCGKTFISHSSVRRHMVMHSGDGPYKYYILSMKEFTLERNHVNVNSVVNPLVILLPIEYIKELTLEKSLMNIRSVGKHFIVPDPIVDMKGFTWEKRLINVRNVEKHSRVPVMKNLYECKQCGKALSSLTSFQTHVRLHSGERPYECKICGKDFCSVNSFQRHEKIHSGEKPYKCKQCGKAFPHSSSLRYHERTHTGEKPYECKQCGKAFRSASHLRVHGRTHTGEKPYECKECGKAFRYVNNLQSHERTQTHIRIHSGERRYKCKICGKGFYCPKSFQRHEKTHTGEKLYECKQRSVVPSVVPVPFDIMKGLTLERSPINASNVGKPSELCQSFECMVGLTLKRNPMSVSNDGKPSDLPHTFEYVVGHHNGEKPYACKECGKPFGSAQNLRIHERTQTHIMHSVERPYKCKICGRGFYSAKSFQIHEKSYTGEKPYECKQCGKAFVSFTSFRYHERTHTGENPYECKQFGKAFRSVKNLRFHKRTHTGEKPCECKKCRKAFHNFSSLQIHERMHRGEKLCECKHVGKHSYLPRSFEYMQEHTMERNPMNVKNAEKHSACLLPFIDMKRLTLEGNTMNASNVAKLSLLPVLFNIMKEHTREKPYQCKQCAKAFISSTSFQYHERTHMGEKPYECMPSGKAFISSSSLQYHERTHTGEKPYEYKQCGKAFRSASHLQMHGRTHTGEKPYECKQYGKAFRPDKIL

SEQ ID NO: 917771 - protein, 879 aa, Homo sapiens; identical to SEQ ID NO: 917770

SEQ ID NO: 917772 - protein, 879 aa, Homo sapiens; identical to SEQ ID NO: 917770

SEQ ID NO: 917773 - protein, 576 aa, Homo sapiens
MFQDPVAFKDVAVNFTQEEWALLDISQRKLYREVMLETFRNLTSLGKRWKDQNIEYEHQNPRRNFRSLIEEKVNEIKDDSHCGETFTPVPDDRLNFQEKKASPEVKSCESFVCGEVGLGNSSFNMNIRGDIGHKAYEYQEYGPKPCKCQQPKKAFRYRPSFRTQERDHTGEKPNACKVCGKTFISHSSVRRHMVMHSGDGPYKYYILSMKEFTLERNHVNVNSVVNPLVILLPIEYIKELTLEKSLMNIRSVGKHFIVPDPIVDMKGFTWEKRLINVRNVEKHSRVPVMKNLYECKQCGKALSSLTSFQTHVRLHSGERPYECKICGKDFCSVNSFQRHEKIHSGEKPYKCKQCGKAFPHSSSLRYHERTHTGEKPYECKQCGKAFRSASHLRVHGRTHTGEKPYECKECGKAFRYVNNLQSHERTQTHIRIHSGERRYKCKICGKGFYCPKSFQRHEKTHTGEKLYECKQRSVVPSVVPVPFDIMKGLTLERSPINASNVGKPSELCQSFECMVGLTLKRNPMSVSNDGKPSDLPHTFEYVVGHTMERSPMHVRNVGNPSDLPRTFEFMKGHKHT

SEQ ID NO: 917774 - protein, 174 aa, Homo sapiens
MITAHCTLYLQGSSNPPTSASQVAGITALACMNSSHPPNQPRRYQRSKVGYHQHKSPKGHPTDDRPGGARGRSTPFASRNAAVRLGAVRSLCRQRSPRAVTSCGLGEPAARGEPGLEVLGSSGSLGCTQGSALGRRGHKTPGLHSAQGLVDIEPPGNLCHQRRVLMPAARNTTK

SEQ ID NO: 917775 - protein, 705 aa, Homo sapiens
GVWGSGAGLCLIGLHGSALHSYTSLPPAMSDFHVHPQATVGEEGGVARFQCQIHGLPKPLITWEKNRVPIDTDNERYTLLPKGVLQITGLRAEDGGIFHCVASNIASIRISHGARLTVSGSGSGAYKEPAILVGPENLTLTVHQTAVLECVATGNPRPIVSWSRLDGRPIGVEGIQVLGTGNLIISDVTVQHSGVYVCAANRPGTRVRRTAQGRLVVQAPAEFVQHPQSISRPAGTTAMFTCQAQGEPPPHVTWLKNGQVLGPGGHVRLKNNNSTLTISGIGPEDEAIYQCVAENSAGSSQASARLTVLWAEGLPGPPRNVRAVSVSSTEVRVSWSEPLANTKEIIGYVLHIRKAADPPELEYQEAVSKSTFQHLVSDLEPSTAYSFYIKAYTPRGASSASVPTLASTLGEAPAPPPLSVRVLGSSSLQLLWEPWPRLAQHEGGFKLFYRPASKTSFTGPILLPGTVSSYNLSQLDPTAVYEVKLLAYNQHGDGNATVRFVSLRGASERTALSPPCDCRKEEAANQTSTTGIVIGIHIGVTCIIFCVLFLLFGQRGRVLLCKDVENQLSPPQGPRSQRDPGILALNGARRGQRGQLGRDEKRVDMKELEQLFPPASAAGQPDPRPTQDPAAPAPCEETQLSVLPLQGCGLMEGKTTEAKTTEATAPCAGLAAAPPPPDGGPGLLSEGQASRPAAARVTQPAHSEQ

SEQ ID NO: 917776 - protein, 807 aa, Homo sapiens
GVWGSGAGLCLIGLHGSALHSYTSLPPAMSDFHVHPQATVGEEGGVARFQCQIHGLPKPLITWEKNRVPIDTDNERYTLLPKGVLQITGLRAEDGGIFHCVASNIASIRISHGARLTVSGSGSGAYKEPAILVGPENLTLTVHQTAVLECVATGNPRPIVSWSRLDGRPIGVEGIQVLGTGNLIISDVTVQHSGVYVCAANRPGTRVRRTAQGRLVVQAPAEFVQHPQSISRPAGTTAMFTCQAQGEPPPHVTWLKNGQVLGPGGHVRLKNNNSTLTISGIGPEDEAIYQCVAENSAGSSQASARLTVLWAEGLPGPPRNVRAVSVSSTEVRVSWSEPLANTKEIIGYVLHIRKAADPPELEYQEAVSKSTFQHLVSDLEPSTAYSFYIKAYTPRGASSASVPTLASTLGEGEAWVWSTKPQALTQGIRAEPPCTLVLVVRCAGCPALRLSGLSLLGGKGFFFYFLGRCCFHKHMPLARGRGLSGFWGLGSQVEGRKIELPLGPHIVASSLPAAPAPPPLSVRVLGSSSLQLLWEPWPRLAQHEGGFKLFYRPASKTSFTGPILLPGTVSSYNLSQLDPTAVYEVKLLAYNQHGDGNATVRFVSLRGASERTALSPPCDCRKEEAANQTSTTGIVIGIHIGVTCIIFCVLFLLFGQRGRVLLCKDVENQLSPPQGPRSQRDPGILALNGARRGQRGQLGRDEKRVDMKELEQLFPPASAAGQPDPRPTQDPAAPAPCEETQLSVLPLQGCGLMEGKTTEAKTTEATAPCAGLAAAPPPPDGGPGLLSEGQASRPAAARVTQPAHSEQ

SEQ ID NO: 917777 - protein, 561 aa, Homo sapiens
GNVESCLFSVGVHSIPVTWEEDGRPIGVEGIQVLGTGNLIISDVTVQHSGVYVCAANRPGTRVRRTAQGRLVVQAPAEFVQHPQSISRPAGTTAMFTCQAQGEPPPHVTWLKNGQVLGPGGHVRLKNNNSTLTISGIGPEDEAIYQCVAENSAGSSQASARLTVLWAEGLPGPPRNVRAVSVSSTEVRVSWSEPLANTKEIIGYVLHIRKAADPPELEYQEAVSKSTFQHLVSDLEPSTAYSFYIKAYTPRGASSASVPTLASTLGEAPAPPPLSVRVLGSSSLQLLWEPWPRLAQHEGGFKLFYRPASKTSFTGPILLPGTVSSYNLSQLDPTAVYEVKLLAYNQHGDGNATVRFVSLRGASERTALSPPCDCRKEEAANQTSTTGIVIGIHIGVTCIIFCVLFLLFGQRGRVLLCKDVENQLSPPQGPRSQRDPGILALNGARRGQRGQLGRDEKRVDMKELEQLFPPASAAGQPDPRPTQDPAAPAPCEETQLSVLPLQGCGLMEGKTTEAKTTEATAPCAGLAAAPPPPDGGPGLLSEGQASRPAAARVTQPAHSEQ

SEQ ID NO: 917778 - protein, 144 aa, Homo sapiens
MTCIVVSAILQTLITVKRSTGTWAMRNILPNHVTAETSLSHPPGQRPNSLTAGTSLPYPAGQQALPPRSLPPSPMITPACEWQLVLALSWFPPPQGFAGNKDVAVEATNLMAASSPSVTVGEASMERSASRESKGNMIKGKEEQ

SEQ ID NO: 917779 - protein, 154 aa, Homo sapiens
SPRLESRRGVEPLMSCQPYKVELVIDGQALLPPFFNGISSMYTSLKSTFVAFADGRGTTESMPSPPLANSNHESPVNQLGNMQNMRLGPSFILTGIFLGNGRTEASPFFTDEFALSKIFPEYKRNLFGKFQTNMAFSLELDPPSLLLSVVLFMF

SEQ ID NO: 917780 - protein, 272 aa, Homo sapiens
VFDMPEMVLGLGACIAMDTTRYSKWGGSSEEVPGASTERAALLDGHDLLRTNASKQTAALGALKEEVGDCHSCCSGTQAQLQTTRAELGEAQAKLMEQESALRELRERVTQGLAEAGRGREDVRTELFRALEAVRLQNNSCEPCPTSWLSFEGSCYFFSVPKTTWAAAQDHCADASAHLVIVGGLDEQGFLTRNTRGRGYWLGLRAVRHLGKVQGYQWVDGVSLSFSHWNQGEPNDAWGRENCVMMLHTGLWNDAPCDSEKDGWICEKRHNC

SEQ ID NO: 917781 - protein, 529 aa, Homo sapiens
MVSADDTHGLSLWEHLKGVRLQILVHLGRTQEGREVQTYVWPWGTCHPLEPVWSLPAHPQLEFWAFSPAHRWDLVNFSQVALVSITLLSHSFCKGLPGGVKGSGGHRGGGEMAFSGCQAPYLSPAVPFSGTIQGGLQDGFQITVNGAVLSCSGTRFAVDFQTGFSGNDIAFHFNPRFEDGGYVVCNTRQKGTWGPEERKMHMPFQKGMPFDLCFLVQSSDFKEHGWSWKPLQEQKTKHRKFSLISEELNDENTWTQAGKQHTLGPGRGRRASGRLANGAGLDTKVMVNGSLFVQYFHRVPFHRVDTISVNGSVQLSYISFQNPRAVPVQPAFSTVPFSQPVCFPPRPRGRRQKPPSVRPANPAPITQTVIHTVQSASGQMFSQTPAIPPMMYPHPAYPMPFITTIPGGLYPSKSIILSGTVLPSAQRFHINLCSGSHIAFHMNPRFDENAVVRNTQINNSWGSEERSLPRKMPFVRGQSFSVWILCEAHCLKVAVDGQHVFEYYHRLRNLPTINKLEVGGDIQLTHVQT

SEQ ID NO: 917782 - protein, 467 aa, Homo sapiens
MVSADDTHGLSLWEHLKGVRLQILVHLGRTQEGREVQTYVWPWGTCHPLEPVWSLPAHPQLEFWAFSPAHRWDLVNFSQVALVSITLLSHSFCKGLPGGVKGSGGHRGGGEMAFSGCQAPYLSPAVPFSGTIQGGLQDGFQITVNGAVLSCSGTRFAVDFQTGFSGNDIAFHFNPRFEDGGYVVCNTRQKGTWGPEERKMHMPFQKGMPFDLCFLVQSSDFKVMVNGSLFVQYFHRVPFHRVDTISVNGSVQLSYISFQNPRAVPVQPAFSTVPFSQPVCFPPRPRGRRQKPPSVRPANPAPITQTVIHTVQSASGQMFSQTPAIPPMMYPHPAYPMPFITTIPGGLYPSKSIILSGTVLPSAQRFHINLCSGSHIAFHMNPRFDENAVVRNTQINNSWGSEERSLPRKMPFVRGQSFSVWILCEAHCLKVAVDGQHVFEYYHRLRNLPTINKLEVGGDIQLTHVQT

SEQ ID NO: 917783 - protein, 98 aa, Homo sapiens
AFPGPRFAVDFQTGFSGNDIAFHFNPRFEDGGYVVCNTRQKGTWGPEERKMHMPFQKGMPFDLCFLVQSSDFKEHGWSWKPLQEQKTKHRKFSLISRS

SEQ ID NO: 917784 - protein, 160 aa, Homo sapiens
MTNTKGKRRGTRYMFSRPFRKHGVVPLATYMRIYKKVDIVDVKGMGTVQKGMPHKCYHGKTGRVYSVTQHAVGIVVNKQVKGKILAKRINVRIKHIKHSKSQDSFLKRVKENDQKKKEAKEKGTWVQLKRQPAPPREAHFVRTSGKEPELLEPIPCEFMA

SEQ ID NO: 917785 - protein, 140 aa, Homo sapiens
MAAPMLALFPHLTMKRLNSMFSKIFSSSEVPQFVGAECTYTNLKVTFEKCPQRIIENFGIHVVLAISEVQRRNHCSTALHPLIEHTLIQYMPDPSANIPTHNNPARYTNYWEMTTQHTYTHTNTPQTSPAHTNITQFLHS

SEQ ID NO: 917786 - protein, 160 aa, Homo sapiens
FACYQVLPIHTLPTNKEMRVVLCCTSPLQGCLPGTRQCDWDEPFIIREDTGYLGSHGVECLQHSAQKPLNLGRKLLPHQIGASANSINFQFLRQQKAQLERETSALSHPPSFILGATLCSVEFAQDSQSELINLPGLSHPVCHLSGSSPRKSIPKFKKSS

SEQ ID NO: 917787 - protein, 160 aa, Homo sapiens; identical to SEQ ID NO: 917786

SEQ ID NO: 917788 - protein, 160 aa, Homo sapiens; identical to SEQ ID NO: 917786

SEQ ID NO: 917789 - protein, 160 aa, Homo sapiens; identical to SEQ ID NO: 917786

SEQ ID NO: 917790 - protein, 160 aa, Homo sapiens; identical to SEQ ID NO: 917786

SEQ ID NO: 917791 - protein, 160 aa, Homo sapiens; identical to SEQ ID NO: 917786

SEQ ID NO: 917792 - protein, 140 aa, Homo sapiens
MLYHTVLPTTACSFIVAVNAPFLSFSPLKIREHAGLSCARHSIPHMVDEGGCGSDGSTAVHPGGWTCVPGYQSLRLTSPHVHAALPLAVSTFWVSLKDFTGADFTKAKLFLKEVDMKDLKSGLLKKSKHRLMTYLHPTRF

SEQ ID NO: 917793 - protein, 593 aa, Homo sapiens
MSANPRWDISRALGVAKLFHLVCGVREACVTPFLTLYLRQLGLAAPWVGTLMGTKHLIAAFWAPVCAFLAKSYRKRRALLIGSLLGSVGASLLMVLVPPVDKNRVHFPCNGSSGLTSTDALPGVTLPVNITSAQESASSHPAKRTAEVEMPGFRNPPGESDRETFRDLHVYLAPSVEGARTTSQALLHPVTSGLKDHPWEVTFEVVKTALPLLPGGKGPGNPANLSGTKGKAWAFDLSLEALRRTFILSLGSVAFWELLTAPLEQVADDSLYEFLDFVDATDRYRSLWVWRLLGMSAGVCGITALVGQLDCFLMTSGPRGVVHFYGYSVVSTLALLVSIAFPIPICQQWEPSYKRVKALSIVGGDPHLILLASTTVLVGAIVSTVQNFLFWHMKDHGSGELVMGFSVALSLLGEILLHPFKATLLRKLSRTGLVGLGLSCLAGQLLYYSFLWSWWSVLPIQILSAISNRALWWAVGASVEDLATPRMERALSALFRGHFYGSGCSLGSFVGGFVVMRFSLAVLYQACCVALLLWLALLLSIQRRLPRERKIKYSKLLSMEVLLNSAMAEAIKSNCQCQEDHGDLQDSVGREGS

SEQ ID NO: 917794 - protein, 1358 aa, Homo sapiens
MIEPSEDSFETMMEHKNPSSKQMESSEGSSNTTEATSGSGVRGEAGPASGPAQEKKEPPSGPLQEMEELPTDLLQDMEEPSSGPRKEIEDPPNDLLQDLEESCNGSHQARGDPLSGASDRMKEASVNPSGAREEQEAHTDLKESGREETPQEQNQTEHSTAELMAMVRSIISLYFRMQDLKEQQRVAEEILIKGINAGQLPAPKHFSGDRREFHEFIVLCQLTLQSYPRMFYNDRLRVGYVINHLSGLALEWAKALLQENSPLIGDFPAFLEAMSEVFEYRQALRVAEEAMFTIRQGGRSATEYIDEFQSLVPILGWPDEVLQAHLCQGLNEEIRHYLFRVPQPDSLDSLIVLILQIEEKLAERRAMLRLPPEARPRNLTWIDSPAPERWMVSSWLPSEVHPDINRAHLFLLLMVRVNPYHSVAVQALVDSGADGNFMDEKFAQEHYVELYEKPYPQPVQSVDGSLIGNEPVWLYTEPLVCIHQNHQESIEFDIVPSPNFSVVLGIRWLRVHAPEVDWIKGRCTFHSPYCLKNCFRPPPPCIALERHGMSLLPGLPHPYSDLADVFNPKEADDETSDQPSSDGSDDLSESEPSELQQAGDSDHSETFYECPSTAPWEPVGARMQERARLQEEYWDLQDMLTNRQDYIQMIPELFDQLHGAEWFTKLELRGTIVEESVNGHRTEDVWKAAFGLELEEMKSYQPFALSPDPIIPQNVIHFILKDMLGFFVLSYGQEVLIYSMSQEEHLHHVRQVLVRFRHHNVYCSLDKSQFHRQTVEFLGFVVTPKGVKLNKNVMTIITGYPTPGSKLSLRNFIEFVFPYRHFVERFSIIAEPLVRQLLSSYQFYWGVEEQEAFECLKRAFRKAPLLHHPKPQNPFYLETGVTGTALHASLIQIDDQTGKRACCAFYSRNISPIEVEYSQAEMKILPIRAAFMVWCRYLENTEEPIMILLNTEDLASLNNDRLTVLLPGHWVFFFSHFNFDVMELPEQDGGRALPPVRNLRWRRAFQRNTAARQTLLLASRGFPRDPSTESGEEENEEQDELNEQILRQELLAMIPIDQILNSFLAHFSMAQIRAVILHFFRGLLYWKNTLALAAILVLLRVRQCLSLRPAPAMRVARPQPQRSLRLILDSSLIAGSSITTAITQLLTQMPALVGANTIPAQELAELFLGPGRWQRNALHSQAHRGLQFTPGFWLTLCEFFGVRVTPQEGHLPALRQNRYLELHVVGDEDVVLREALQDDLQRYRQCGLHDGLQDTSQDKQDNDVQEAPPSHTAATHPPRPRHLMDPQVLEFLGSRLLHIHSADGQLHLLSREQAARALSQFLTLIYRRALPIPAWESQPREQARLEELPDEDEDANLD

SEQ ID NO: 917795 - protein, 119 aa, Homo sapiens
MTPGVGYMVPCTTASAAHGSTTEDPKTKCPALCGRVQGGRMTPVFECRSPNEDHIYQEEMLEMARKGVLPAVPTAYSCLPGKPKSQKHFHDDIFGAVFPYEAKKDRAAVQPSSLEMSAL

SEQ ID NO: 917796 - protein, 245 aa, Homo sapiens
MVCVSDSEHLFEAALITQASVNPTKRPPNPAALPLDPRNPAVPSEPPALLTARLALLSFKKPPNPADPPLKSRPHPRREHPPTSVPAPLSRPSRRPLTTARGAAAPGSRERPALEGTPPSGSRPLPRLRGGIALRCSPRAASRFRLPAASYCGSGGAGRRHRRRLREWQRSWRRAACGRSGRGEERRGHLGPSLCSSFRSARGRTRDGMEPTTIPSTVVFQASRENPHTPEQTALPGRERLGAKP

SEQ ID NO: 917797 - protein, 121 aa, Homo sapiens
MGTRTIIGCKVLPNRTHLYCVRQTRVLYFYFYFFEMESHSPRLECNGMILAHCNLCVLSLRDSPASASPVTGIIGARHYAQLIFYIFSRHEVSPCQSGWSQTPDLRQSARLSLPKCLGLQA

SEQ ID NO: 917798 - protein, 793 aa, Homo sapiens
MAKDTLGRNGDVELDLQRSVQAVLRELSTQAPALQSNQGMWRWSLHKKVERDPGKSPVLVRILLRELEKAESQDLRHVIIPLLHTVMYVLTKATGITEELYQRIYAFCTRLLTLPTPYCTVALDCAIRLKTEMAVPGTLYQRMVIAEQNLTNELYPYQERVFLFVDPELVSASVCSALLLEIEAAQAQQTPETCMRHVVSHALQAALGEACHAGALHRKLQASPRRTLEHYFHAVVAALEQMASEASPSREGHVERLEEIYCSLLGPAAGRCGGDLVQERPPSIPLPSPYITFHLWTGKELVLFLRPRSQLRLSADLEVLDLQGLRPDRELARVSVLSTDSGIERDLPTGADELPAPGSPEMERAGLQRKGGIKKRAWPLDFLMPGSWDGPPGLHRRTGRPSGDGEMLPGVSRLHTARVLVLGDDRMLGRLAQAYHRLRKRETQKFCLTPRLSLQLYYIPVLAPEKPAASRQPELGELATFLGRVDPWYQSNVNTLCPAIHKLAEMVGEGSYFGPDHRGKDEVKYSFPPSLDTSRTVDPFILDVITYYIRMGTQPIYFQIYTVKIFFSDLSQDPTEDIFLIELKVKIQDSKFPKATQKVRNGECRAKKERRDEKGNAGERAEWQEKGEPSQSRNWSQDQDLVTAFKLLAPYSRPYQNQSDDASTLVSGSSHCPLPAAPVTDHTCLNVNVTEVVKSSNLAGKSFSTVTNTFRTNNIQIQSRDQRLLTLSLDKDDQRTFRDVVRFEVAPCPEPCSGAQKSKAPWLNLHGQQEVEAIKAKPKPLLMPINTFSGIVQ

SEQ ID NO: 917799 - protein, 793 aa, Homo sapiens; identical to SEQ ID NO: 917798

SEQ ID NO: 917800 - protein, 716 aa, Homo sapiens
MSSLGQHVCTKHVLLNRKPKVPVNQEGNTLERRRKGSETVLVSFVIRTVEMRLLDPSSILEGQLRAKTERERGGFHSRTCVGRRILQCPQQDTCVEMDSPVSTAGRVWQKGFSSVHGGTCVEMDSPVSMAGRVRREGFSSIHSRTCVSRRILQCPRQDVCGEKDSPVSTVGSVWREGFSSVHGGTCVARRILQYPRRDVLSTAGRVWQGFSSIHGGTCVSRRILQCPRKDMCGEKDSPVSTVGSVWREGFSSIHSGMCDVYGEKDSPVSTAGRVWQEGFSSVHGGTCVEMDSPVSTAGHVWREGFSGVHGGTCVARRILQCPRRDVCGEKDSPVSTAGDMCGEDSPVSTAGRVWGEGFSSVHGGMCVGRRILQCPQWDTCGKKDSPVSTAGRVWGKGFSSVHSGTRVARRILQCPQQDVCGEKDSPVSTVDVCGEKDSPVSTVGHVCQEGFSSVHGGTCVWKRILQCPRRDVCGEKDSPVSMAGDVCGEDSQCPRRDVCGEKDSPVSTAGHVCGQKDSPVSTVGRVCGKGFSSVHGRTCVWRRILQCPRQDVCVEKDSPVSTEGRVWREGFSSVHGRTCVGRRILQCPQQDVYGEKDSPVSMARHVWRRILQCPRQDLCGQKDSPVSTAGRVWREGFSSVHGGTCVGRRILQCPQWDTCGKRDSPVSTAGRVWEEGFSGVVFAGSSLPANKVFLPIVALAFRSQPSFLPKGRAFLT

SEQ ID NO: 917801 - protein, 147 aa, Homo sapiens
LQKCLQEGMKGHRGERVSEYEKIVDSPGAARVLWCAASTLPLIAAASVGLAPPTIVLDLFPFPRTIAWMMKHIAEYCFITIQELYPFKFLYGGFQHTAKQPKVISVFLNPAQEWIGRKGAGPNPMTMLAGGALQKATAPQASSLRSL

SEQ ID NO: 917802 - protein, 307 aa, Homo sapiens
GSGLSPSSDLSLKSLASQSCLPPGKGLSHSLQGKKPAAPCLPKAEAAQFSAPAAPGTPEMLCGPSQPGACPGPSDCPSRIATLPPTPAPVMFTASLGKGLPHFLEEESTSSFPQVSESFSFFPQPYQHTYVPARTTAPETLSVGSLETWLWSQQDLSTDRWGPESLRLTTNLCCSLEPLVWVVGSHENRGNEKRPGPALHSNPKVSALSPHHRAASTKEFGRGDSCTRKREGGDLKSTVKTTDTRGGSPKTSASLGLGTSLRTVGSWLKDLGSPEAATEPSPLTSVFSSIQEVTPTLSHTNNREQQL

SEQ ID NO: 917803 - protein, 363 aa, Homo sapiens
MGERLFESAEGSQCGETFTQVPEDMLNKKTLPGVKSCESGTCGEIFMGYSSFNRNIRTDTGHQPHKCQKFLEKPYKHKQRRKALSHSHCFRTHERPHTREKPFDCKECEKSFISPASIRRYMVTHSGDGPYKCKFCGKALDCLSLYLTHERTHTGEKRYECKQCGKAFSWHSSVRIHERTHTGEKPYECKECGKSFNFSSSFRRHERTHTGEKPYKCKECGKAFNCPSSFHRHERTHTGEKPYECKLYGKALSRLISFRRHMRMHTGERPHKCKICGKAFYSPSSFQRHERSHTGEKPYKCKQCGKAFTCSTSFQYHERTHTGEKPDGCKQCGKAFRSAKYIRIHGRTHTESKPGTTGQSSNE

SEQ ID NO: 917804 - protein, 113 aa, Homo sapiens
KVPGLASRYVEEGLGGTNRILLWRDPGLRSGDPGDWDPRPPWRGLALGPLGRQVGLGPQLGPRASCPVPTRRLRPRPRSPLWAAPRPQPGVFPDCAGATGGSWGVGCVPPFFC

SEQ ID NO: 917805 - protein, 619 aa, Homo sapiens
GFAVAAWLGSGRLAWRGSDRLAWHFWLSGPPFADWKPRAILLGGCGRGSSSLLMVSWGGEKRGGAEGSPKPAVYATRKTGSVRSQEDQWYLGYPGDQWSSGFSYSWWKNSVGSESKHGEGALDQPQHDVRLEDLGELHRAARSGDVPGVEHVLVPGDTGVDKRDRKKSIQQLVPEYKEKQTPESLPQNNNPDWHPTNLTLSDETCQRSKNLKVDDKCPSVSPSMPENQSATKELGQMNLTEREKMDTGVVLLSGNDTLHDLCQSQLPENKESKEEKTPKKQNKQINLPLLHLQKTSQEPEMAKDCDREDIPIYPVLPHVQKSEEMRIEQGKLEWKNQLKLVINELKQRFGEIYEKYKIPACPEEEPLLDNSTRGTDVKDIPFNLTNNIPGCEEEDASEISVSVVFETFPEQKEPSLKNIIHSYYHPYSGSQEHVCQSSSKLHLHENKLDCDNDNKPGIGHIFSTDKNFHNDASTKKARNPEVVTVEMKEDQEFDLQMTKNMNQNSDSGSTNNYKSLKPKLENLSSLPPDSDRTSEVYLHEELQQDMQKFKNEVNTLEEEFLALKKENVQLHKEVEEEMEKHRSNSTELSGTLTDGTTVGNDDDGLNQQIPRKENGEHDR

SEQ ID NO: 917806 - protein, 158 aa, Homo sapiens [sequence omitted]

SEQ ID NO: 917807 - protein, 158 aa, Homo sapiens [sequence omitted]

SEQ ID NO: 917808 - protein, 169 aa, Homo sapiens
MSQKEEHPWTPDSLQCSGLWALTALHGDPAEATPGPPGGPRQQAPSPTSRVSSRGPLVLLPCQLCHGAMCVPALFHGSPREGRGRQMQSMLATALGSRDRGTLMISGNFREVEPLQCYLHSLPTFLLVLPLFSSLQVSPLPLPSGSLPSLPHYHQAPPNTTEIVHGQRT

SEQ ID NO: 917809 - protein, 126 aa, Homo sapiens
MSKNAGSSQLYQMPAANTTLVPLSLPGEWGATMGVRDHGQDNRNSLLGLIPFGQPQAVTTRMTATLWKELAASGPSAWASVRSMGRKKGTNVLSKQCSVYLLPGPVLNPPVASSVPPADPLNSPRP

SEQ ID NO: 917810 - protein, 148 aa, Homo sapiens
MAAEALAAEAVASRLERQEEDIRWLWSEVERLRDEQLNAPYSCQAEGPCLTREVAQLRAENCDLRHRLCSLRLCLAEERSRQATLESAELEAAQEAGAQPPPSQSQDKDMKKKKMKESEADSECKGKSGKQRLTKWLLKLVRNWLKAR

SEQ ID NO: 917811 - protein, 582 aa, Homo sapiens
MGSQSGKASPLPGGFSFTVDLGFVLAPLNLPLTCDEAPCAFVLLGALEEQLETVVGPGSGRPLCHYRLRAPGCGHQRPPGPPHTAGAADSPLPARDLGMSRAVETADAGRAVLQSFGSPNKKHVGVILQRGALVLLLCCLPCWALFLNTQHILLLFRQDPDVSSGVVGNCVNGVANYALVSVLNLGVRGSAYANIISQFAQTVFLLLYIVLKKLHLETWAGWSSQCLQDWGPFFSLAVPSMLMICVEWWAYEIGSFLMGLLSVVDLSAQAVIYEVATVTYMDPPRASRAHQVQTLLSLRQDSHTGAHNLTTKGDISLTDIPLGLSIGVCVRVGMALGAADTVQAKRSAVSGVLSIVGISLVLGTLISILKNQLGHIFTNDEDVIALVSQVLPVYSVFHVFEAICCVYGGVLRGTGKQAFGAAVNAITYYIIGLPLGILLTFVVRMRIMGLWLGMLACVFLATAAFVAYTARLDWKLAAEEAKKHSGRQQQQRAESTATRPGPEKAVLSSVATGSSPGITLTTYSRSECHVDFFRTPEEAHALSAPTSRLSVKQLVIRRGAALGAASATLMVGLTVRILATRH

SEQ ID NO: 917812 - protein, 566 aa, Homo sapiens
MDSLQDTVALDHGGCCPALSRLVPRGFGTEMWTLFALSGPLFLFQVLTFMIYIVSTVFCGHLGKVELASVTLAVAFVNVCGVSVGVGLSSACDTLMSQSFGSPNKKHVGVILQRGALVLLLCCLPCWALFLNTQHILLLFRQDPDVSRLTQDYVMIFIPGLPVIFLYNLLAKYLQNQKITWPQVLSGVVGNCVNGVANYALVSVLNLGVRGSAYANIISQFAQTVFLLLYIVLKKLHLETWAGWSSQCLQDWGPFFSLAVPSMLMICVEWWAYEIGSFLMGLLSVVDLSAQAVIYEVATVTYMIPLGLSIGVCVRVGMALGAADTVQAKRSAVSGVLSIVGISLVLGTLISILKNQLGHIFTNDEDVIALVSQVLPVYSVFHVFEAICCVYGGVLRGTGKQAFGAAVNAITYYIIGLPLGILLTFVVRMRIMGLWLGMLACVFLATAAFVAYTARLDWKLAAEEAKKHSGRQQQQRAESTATRPGPEKAVLSSVATGSSPGITLTTYSRSECHVDFFRTPEEAHALSAPTSRLSVKQLVIRRGAALGAASATLMVGLTVRILATRH

SEQ ID NO: 917813 - protein, 145 aa, Homo sapiens
MEYHGFRICVLLVGAPALGLCTPDVPTLGLCTPDVPTLGLCTLMYPHLASVPQMYPHSASVPQMYPPSASVPQMYPHSASVPRCTHTRPLYPDVPTLGLRTPDAPTLSPYNPDVPTLSPPTPQIHPHSASVPQVYSHSALIPQDF

SEQ ID NO: 917814 - protein, 104 aa, Homo sapiens
MSTPCLERPPERNTPCQRLPAAEPATLPPTSWPLHRPSLPLSTLPSRSRSPCVHQQPLPVCPAPHAAPGQHGETPSLLKIQKLAGRVAGTFNLSYLGGRGRRIT

SEQ ID NO: 917815 - protein, 192 aa, Homo sapiens
TRKSYTMVNPSSITLRCIFPIHQECLSQERQETVSPELRVSTWHCSSSSSSICGHWPGVTNHQVLANVGFHHVKLVLSCKTKSCIYFSLPPCQWIESLCTVLPRTGGEKVGAVSWLPRLMLIWVTSKSHAARTNTALGALVAQADMACLPVGFTRGLRPLWKASSGVSWNTRPWFGAEGFCLALGLPWETCE

SEQ ID NO: 917816 - protein, 147 aa, Homo sapiens
MFFFRCWRSMTEERWRNEDSGKSGAQHPLGLSKGSLQPFQLFRHPFAILSGAPTLEHETIGAAEVQPGDPLGALASVRFLSRWVLSPLLAPGLSELMALFRLFSRHGLGNAHSCDPATDGFFANNRNMQRLLRAVLVGSEVGGCGAP

SEQ ID NO: 917817 - protein, 417 aa, Homo sapiens
AVAYTLSNTMNLLAHLGFLVPEPLTFYLLGITPQPLTFYLLGITPQPLTFYLLGITPPPLTFYLLEITPPPLTFYLLGITPQPLTFYLLGITPPPLTFYLLGITPPPLTFYLLGITPQPLTFYLLGISPQPLTFYLLGITPQPLTFYLLGITPPPLTFYLLGITPQPLTFYLLGITPQPLTFYLLGITPQPLTFYLLGITPPPLTFYLLGITPPPLTFYLLGITPQPLTFYLLGITPPPLTFYLLGITPQPLTFYLLGITPPPLTFYLLGITPQPLTFYLLGITPQPLTFYLLGITPQPLTFYLLGITPQPLTFYLLGITPQPLTFYLLGITPPPLTFYLLGITPPPLTFYLLGITPQTLVPAALLSVSMGLSALEMSWQWNHTGMQVAFCTCLLPLSKRFQRCLDAIIDVAPSCHL

SEQ ID NO: 917818 - protein, 144 aa, Homo sapiens
GTSSLWRMELGLGIPSGLGTTVLLHHQICSLHSPNYLLTCWCKSGVPLRSEGATSHLHTCACSVELSGAHRSSRVCQTKAMALGKRGKIATQIQLLAGSPVCSPDSVPSIPKDFNFWGAKGLLHLVRKPRGKKNSGIDEESGIQ

SEQ ID NO: 917819 - protein, 396 aa, Homo sapiens; identical to SEQ ID NO: 915433

SEQ ID NO: 917820 - protein, 178 aa, Homo sapiens
LIFRCASCSFDVYCSGGLSGNGLRMQEKYGGLSTGRFHRMIPACIKHIVYPRCCAQSCGDPERPGRFHLQGVCKFMCTALWEKAISGSLAQPLSQTPPRHCHGWVPHPQTPWCWADLLLLLRSRANGPLLTKRAYKRKAAPVPGLLRFKTAPTAAETKNLLPRGHTFHSDIRKRIVVA

SEQ ID NO: 917821 - protein, 964 aa, Homo sapiens
NNTLDQEGHIILHSMHRYLPRLHLVPAEKAVEVIQLNGPGVHTFTFPQTEFFAVTAYQNIQITQLKIDYNPFAKGFRDDGLNNNPQRDGKQKNSSDQEGNNISSSSGHRVRLTEGQGSEIQPGDLDPLSRGHETSGKGLEKTSLNIKRDFLGFMDTDSALSEVPQLKQEISECLIASSFEDDSRVASPLDQNGSFNVVIKEEPLDDYDYELGECPEGVTVKQEETDEETDVYSNSDDDPILEKQLKRHNKVDNPEADHLSSKWLPSSPSGVAKAKMFKLDTGKMPVVYLEPCAVTRSTVKISELPDNMLSTSRKDKSSMLAELEYLPTYIENSNETAFCLGKESENGLRKHSPDLRVVQKYPLLKEPQWKYPDISDSISTERILDDSKDSVGDSLSGKEDLGRKRTTMLKIATAAKVVNANQNASPNVPGKRGRPRKLKLCKAGRPPKNTGKSLISTKNTPVSPGSTFPDVKPDLEDVDGVLFVSFESKEALDIHAVDGTTEESSSLQASTTNDSGYRARISQLEKELIEDLKTLRHKQVIHPGLQEVGLKLNSVDPTMSIDLKYLGVQLPLAPATSFPFWNLTGTNPASPDAGFPFVSRTGKTNDFTKIKGWRGKFHSASASRNEGGNSESSLKNRSAFCSDKLDEYLENEGKLMETSMGFSSNAPTSPVVYQLPTKSTSYVRTLDSVLKKQSTISPSTSYSLKPHSVPPVSRKAKSQNRQATFSGRTKSSYKSILPYPVSPKQKYSHVILGDKVTKNSSGIISENQANNFVVPTLDENIFPKQISLRQAQQQQQQQQGSRPPGLSKSQVKLMDLEDCALWEGKPRTYITEERADVSLTTLLTAQASLKTKPIHTIIRKRAPPCNNDFCRLGCVCSSLALEKRQPAHCRRPDCMFGCTCLKRKVVLVKGGSKTKHFQRKAAHRDPVFYDTLGEEAREEEEGIREEEEQLKEKKKRKKLEYSEY

SEQ ID NO: 917822 - protein, 2887 aa, Homo sapiens
NNTLDQEGHIILHSMHRYLPRLHLVPAEKAVEVIQLNGPGVHTFTFPQTEFFAVTAYQNIQITQLKIDYNPFAKGFRDDGLNNNPQRDGKQKNSSDQEGNNISSSSGHRVRLTEGQGSEIQPGDLDPLSRGHETSGKGLEKTSLNIKRDFLGFMDTDSALSEVPQLKQEISECLIASSFEDDSRVASPLDQNGSFNVVIKEEPLDDYDYELGECPEGVTVKQEETDEETDVYSNSDDDPILEKQLKRHNKVDNPEADHLSSKWLPSSPSGVAKAKMFKLDTGKMPVVYLEPCAVTRSTVKISELPDNMLSTSRKDKSSMLAELEYLPTYIENSNETAFCLGKESENGLRKHSPDLRVVQKYPLLKEPQWKYPDISDSISTERILDDSKDSVGDSLSGKEDLGRKRTTMLKIATAAKVVNANQNASPNVPGKRGRPRKLKLCKAGRPPKNTGKSLISTKNTPVSPGSTFPDVKPDLEDVDGVLFVSFESKEALDIHAVDGTTEESSSLQASTTNDSGYRARISQLEKELIEDLKTLRHKQVIHPGLQEVGLKLNSVDPTMSIDLKYLGVQLPLAPATSFPFWNLTGTNPASPDAGFPFVSRTGKTNDFTKIKGWRGKFHSASASRNEGGNSESSLKNRSAFCSDKLDEYLENEGKLMETSMGFSSNAPTSPVVYQLPTKSTSYVRTLDSVLKKQSTISPSTSYSLKPHSVPPVSRKAKSQNRQATFSGRTKSSYKSILPYPVSPKQKYSHVILGDKVTKNSSGIISENQANNFVVPTLDENIFPKQISLRQAQQQQQQQQGSRPPGLSKSQVKLMDLEDCALWEGKPRTYITEERADVSLTTLLTAQASLKTKPIHTIIRKRAPPCNNDFCRLGCVCSSLALEKRQPAHCRRPDCMFGCTCLKRKVVLVKGGSKTKHFQRKAAHRDPVFYDTLGEEAREEEEGIREEEEQLKEKKKRKKLEYTICETEPEQPVRHYPLWVKVEGEVDPEPVYIPTPSVIEPMKPLLLPQPEVLSPTVKGKLLTGIKSPRSYTPKPNPVIREEDKDPVYLYFESMMTCARVRVYERKKEDQRQPSSSSSPSPSFQQQTSCHSSPENHNNAKLMAGGSTFACTATSTSVVTPRKTTKEKSWKSSCNEGESSSTSYMHQRSPGGPTKLIEIISDCNWEEDRNKILSILSQHINSNMPQSLKVGSFIIELASQRKSRGEKNPPVYSSRVKISMPSCQDQDDMAEKSGSETPDGPLSPGKMEDISPVQTDALDSVRERLHGGKGLPFYAGLSPAGKLVAYKRKPSSSTSGLIQVNGKSYPQAKLLLGQMGALHPANRLAAYITGRLRPSVLDLSTLSTVISKVASNAKVAASRKPRTLLPSTSNSKMASSSGTATNRPGKNLKAFVPAKRPIVMVVTPVVSSEPVQVCSPVTAAVTTTTPQVFLENTTAVTPMTAISDVETKETTYSSGATTTGVVEVSETNTSTSVTSTQSTATVNLTKTTGITTPVASVAFPKSLVASPSTITLPVASTASTSLVVVTAAASSSMVTTPTSSLGSVPIILSGINGSPPVSQRPENAAQIPVATPQVSPNTVKRAGPRLLLIPVQQGSPTLRPVSNTQLQGHRMVLQPVRSPSGMNLFRHPNGQIVQLLPLHQLRGSNTQPNLQPVMFRNPGSVMGIRLPAPSKPSETPPSSTSSSAFSVMNPVIQAVGSSSAVNVITQAPSLLSSGASFVSQAGTLTLRISPPEPQSFASKTGSETKITYSSGGQPVGTASLIPLQSGSFALLQLPGQKPVPSSILQHVASLQMKRESQNPDQKDETNSIKREQETKKVLQSEGEAVDPEANVIKQNSGAATSEETLNDSLEDRGDHLDEECLPEEGCATVKPSEHSCITGSHTDQDYKDVNEEYGARNRKSSKEKVAVLEVRTISEKASNKTVQNLSKVQHQKLGDVKVEQQKGFDNPEENSSEFPVTFKEESKFELSGSKVMEQQSNLQPEAKEKECGDSLEKDRERWRKHLKGPLTRKCVGASQECKKEADEQLIKETKTCQENSDVFQQEQGISDLLGKSGITEDARVLKTECDSWSRISNPSAFSIVPRRAAKSSRGNGHFQGHLLLPGEQIQPKQEKKGGRSSADFTVLDLEEDDEDDNEKTDDSIDEIVDVVSDYQSEEVDDVEKNNCVEYIEDDEEHVDIETVEELSEEINVAHLKTTAAHTQSFKQPSCTHISADEKAAERSRKAPPIPLKLKPDYWSDKLQKEAEAFAYYRRTHTANERRRRGEMRDLFEKLKITLGLLHSSKVSKSLILTRAFSEIQGLTDQADKLIGQKNLLTRKRNILIRKVSSLSGKTEEVVLKKLEYIYAKQQALEAQKRKKKMGSDEFDISPRISKQQEGSSASSVDLGQMFINNRRGKPLILSRKKDQATENTSPLNTPHTSANLVMTPQGQLLTLKGPLFSGPVVAVSPDLLESDLKPQVAGSAVALPENDDLFMMPRIVNVTSLATEGGLVDMGGSKYPHEVPDSKPSDHLKDTVRNEDNSLEDKGRISSRGNRDGRVTLGPTQVFLANKDSGYPQIVDVSNMQKAQEFLPKKISGDMRGIQYKWKESESRGERVKSKDSSFHKLKMKDLKDSSIEMELRKVTSAIEEAALDSSELLTNMEDEDDTDETLTSLLNEIAFLNQQLNDDSVGLAELPSSMDTEFPGDARRAFISKVPPGSRATFQVEHLGTGLKELPDVQGESDSISPLLLHLEDDDFSENEKQLAEPASEPDVLKIVIDSEIKDSLLSNKKAIDGGKNTSGLPAEPESVSSPPTLHMKTGLENSNSTDTLWRPMPKLAPLGLKVANPSSDADGQSLKVMPCLAPIAAKVGSVGHKMNLTGNDQEGRESKVMPTLAPVVAKLGNSGASPSSAGK

SEQ ID NO: 917823 - protein, 684 aa, Homo sapiens
MLVLSILLYTCEMFQDSVAFEDVAVTFTQEEWALLDPSQKNLCRDVMQETFRNLASIGKKWKPQNIYVEYENLRRNLRIVGERLFESKEGHQHGEILTQVPDDMLKKTTTGVKSCESSVYGEVGSAHSSLNRHIRDDTGHKAYEYQEYGQKPYKCKYCKKPFNCLSSVQTHERAHSGRKLYVCEECGKTFISHSNLQRHRIMHRGDGPYKCKFCGKALMFLSLYLIHKRTHTGEKPYQCKQCGKAFSHSSSLRIHERTHTGEKPYKCNECGKAFHSSTCLHAHKRTHTGEKPYECKQCGKAFSSSHSFQIHERTHTGEKPYECKECGKAFKCPSSVRRHERTHSRKKPYECKHCGKVLSYLTSFQNHLGMHTGEISHKCKICGKAFYSPSSLQTHEKTHTGEKPYKCNQCGKAFNSSSSFRYHERTHTGEKPYECKQCGKAFRSASLLQTHGRTHTGEKPYACKECGKPFSNFSFFQIHERMHREEKPYECKGYGKTFSLPSLFHRHERTHTGGKTYECKQCGRSFNCSSSFRYHGRTHTGEKPYECKQCGKAFRSASQLQIHGRTHTGEKPYECKQCGKAFGSASHLQMHGRTHTGEKPYECKQCGKSFGCASRLQMHGRTHTGEKPYKCKQCGKAFGCPSNLRRHGRTHTGEKPYKCNQCGKVFRCSSQLQVHGRAHCIDTP

SEQ ID NO: 917824 - protein, 638 aa, Homo sapiens
MQETFRNLASIGKKWKPQNIYVEYENLRRNLRIVGERLFESKEGHQHGEILTQVPDDMLKKTTTGVKSCESSVYGEVGSAHSSLNRHIRDDTGHKAYEYQEYGQKPYKCKYCKKPFNCLSSVQTHERAHSGRKLYVCEECGKTFISHSNLQRHRIMHRGDGPYKCKFCGKALMFLSLYLIHKRTHTGEKPYQCKQCGKAFSHSSSLRIHERTHTGEKPYKCNECGKAFHSSTCLHAHKRTHTGEKPYECKQCGKAFSSSHSFQIHERTHTGEKPYECKECGKAFKCPSSVRRHERTHSRKKPYECKHCGKVLSYLTSFQNHLGMHTGEISHKCKICGKAFYSPSSLQTHEKTHTGEKPYKCNQCGKAFNSSSSFRYHERTHTGEKPYECKQCGKAFRSASLLQTHGRTHTGEKPYACKECGKPFSNFSFFQIHERMHREEKPYECKGYGKTFSLPSLFHRHERTHTGGKTYECKQCGRSFNCSSSFRYHGRTHTGEKPYECKQCGKAFRSASQLQIHGRTHTGEKPYECKQCGKAFGSASHLQMHGRTHTGEKPYECKQCGKSFGCASRLQMHGRTHTGEKPYKCKQCGKAFGCPSNLRRHGRTHTGEKPYKCNQCGKVFRCSSQLQVHGRAHCIDTP

SEQ ID NO: 917825 - protein, 638 aa, Homo sapiens; identical to SEQ ID NO: 917824

SEQ ID NO: 917826 - protein, 241 aa, Homo sapiens
MGGGVQRRPWEKLFYNPTMEQRLQTAPMRVRPQFLIWCGRVRLWRGLGNDQAWHSPGHKYASSGPGDTKKGLKPHRPLLCSFLHSRGHEVPLEVCQDILVPVPHTSTRHEKQPFSFQASGGPLPAAALVSCWALGLAPAPATGSPHLEAQPRPFHSTHLDQRTLPPSETASPSGFPLLLVRPPSYESSFPQPPHPFYQVLREPPVTPRWLRQMCPLVPSEPTLRSQSWHFYFNFFIFLLHH

SEQ ID NO: 917827 - protein, 117 aa, Homo sapiens
MEHMLLANHTDKATFTGTQRQRSCSGASVSQPRPLRGKLVGYWDPHSRLLSRGRALGSVSAPSTPRGRGWKATFDGCILHDDLLTKVHGFQSLIGLQQHLACGDSGSLMKNCHDISA

SEQ ID NO: 917828 - protein, 154 aa, Homo sapiens
MRRLPLPGVWCQPPAWQRNSSPCSPKLLQAFCFPDSEWARCPVGTRLVSPPTGDDVKIQLSLVSPGDDILRLVFLQENRDRSPPTGLFHRPILFSPPVSFGSVFSLIQTRKSPLAQPRLLSWRRARGWSQPRWPRLLGKGRACKFEMKARKPRN

SEQ ID NO: 917829 - protein, 117 aa, Homo sapiens; identical to SEQ ID NO: 917827

SEQ ID NO: 917830 - protein, 184 aa, Homo sapiens
MPVHGNSTLALSFLGVCYGLLAGLPVSRLWPPVACLSSRVHREVVVALTGLPPSLCAPPPGAGSPRGPARSYPLLGHLLDPRSSRPAPRPVPPQPLGPPGPPQGVGTGGSLGGSRPLSSFPGRSSFAAPLTERRLPGPVSQGSAQPSNLWERALPRLNENSPVETVEKWLEGRRPKCLFLCDPM

SEQ ID NO: 917831 - protein, 121 aa, Homo sapiens
MRRLPLPGVWCQPPAWQRNSSPCSPKLLQAFCFPDSEWARCPVGTRLVSPPTGDDVKIQLSLVSPGDDILRLVFLQENRDRSPPTDGVSLCRPGWSVVAQSWLTATSDSQVQEILLHQPPK

SEQ ID NO: 917832 - protein, 218 aa, Homo sapiens
RKRISQAPSVSCRFGAMASQGRRRRPLRRPETVVPGEATETDSERSASSSEEEELYLGPSGPTRGRPTGLRVAGEAAETDSEPEPEPEPTAAPRDLPPLVVQRESAEEAWGTEEAPAPAPARSLLQLRLAESQARLDHDVAAAVSGVYRRAGRDVAALASRLAAAQAAGLAAAHSVRLARGDLCALAERLDIVAGCRLLPDIRGVPGTEPEKDPGPRA

SEQ ID NO: 917833 - protein, 1046 aa, Homo sapiens
QGARAAGGSGAGGGVAAAAVPLILEQLMALQQQQIHQLQLIEQIRSQVALMQRPPPRPSLSPAAAPSAPGPAPSQLPGLAALPLSAGAPAAAIAGSGPAAPAAFEGAQPLSRPESGASTPGGPAEPSAPAAPSAAPAPAAPAPAPAPQSAASSQPQSASTPPALAPGSLLGAAPGLPSPLLPQTSASGVIFPNPLVSIAATANALDPLSALMKHRKGKPPNVSVFEPKASAEDPFFKHKCRFCAKVFGSDSALQIHLRSHTGERPFKCNICGNRFSTKGNLKVHFQRHKEKYPHIQMNPYPVPEYLDNVPTCSGIPYGMSLPPEKPVTTWLDSKPVLPTVPTSVGLQLPPTVPGAHGYADSPSATPASRSPQRPSPASSECASLSPGLNHVESGVSATAESPQSLLGGPPLTKAEPVSLPCTNARAGDAPVGAQASAAPTSVDGAPTSLGSPGLPAVSEQFKAQFPFGGLLDSMQTSETSKLQQLVENIDKKMTDPNQCVICHRVLSCQSALKMHYRTHTGERPFKCKICGRAFTTKGNLKTHFGVHRAKPPLRVQHSCPICQKKFTNAVVLQQHIRMHMGGQIPNTPLPEGFQDAMDSELAYDDKNAETLSSYDDDMDENSMEDDAELKDAATDPAKPLLSYAGSCPPSPPSVISSIAALENQMKMIDSVMSCQQLTGLKSVENGSGESDRLSNDSSSAVGDLESRSAGSPALSESSSSQALSPAPSNGESFRSKSPGLGAPEEPQEIPLKTERPDSPAAAPGSGGAPGRAGIKEEAPFSLLFLSRERGPSQSTPSLISSAAPTMIKMEVNGHGKAMALGEGPPLPAGVQVPAGPQTVMGPGLAPMLAPPPRRTPKQHNCQSCGKTFSSASALQIHERTHTGEKPFGCTICGRAFTTKGNLKVHMGTHMWNNAPARRGRRLSVENPMALLGGDALKFSEMFQKDLAARAMNVDPSFWNQYAAAITNGLAMKNNEISVIQNGGIPQLPVSLGGSALPPLGSMASGMDKARTGSSPPIVSLDKASSETAASRPFTRFIEDNKEIGIN

SEQ ID NO: 917834 - protein, 107 aa, Homo sapiens
AGRWPWDVLELMFLCLRESKRRGAQSESPSSRRCKVGDSRGQKGARAWASEGARPGPFELQNILCVAMWVLHLRRKLLESLSTERPHSLIYICWFCLLYSIKQDVCM

SEQ ID NO: 917835 - protein, 866 aa, Homo sapiens
MYIKLIIATPEIQDFVKVLRSPHWTNGRKSKKASKTRESPKEAVREESTDLASCLQYSQQFTGELERTLFALSTQQKNMDSVSPTASLIPWQPSFPDGGVEAGYEALDANQQLQQAMEERAQLEVHLGQVMGSLKQLQMEKDQHAENLKGESALWWQRMREMSEQVHALREETVHSMSRVQELETILAELRNQMVSNRYLCGGLWIIRYPEGSGSKRPWAMTQYQEVTVALDSSYITISRRNKTIESLIPMLQPLPHMSWGCGFSGKHWPDWLSGAPYFHSDSGPNLLFDSGQATSPPWACVSRGGKARKPAKPGSPKEAITEEAEDLASHLLYSWQHVGELEQEQRKADRSQPGAVSAAVGELGGAVGSEHWMQSSEAKCLPCPYLAVALVNNSNKELKQENSALAEQLQVVLIDKAGMQCDLEELKKKLELTELTLQQLSSWCEAPDANQQLQQPTDERAQLEAHLGQVMEWLKYLQMEREQYAEYLHGESAMWWQRMREMSEQVHTLREERVHSMSRVQELETILAELRNQVAEPLPPEPPAGPSEVEQKLQAEAEHLWKELENLAGQLQAQVEENEGLSHLNQEQEEVAQVVGARGEVAGARGEVAGARGEVAGARGEATGAAGEPARAEAEGRFLSQLNPYPEPPAGPSEVEALRHTVRNDRTTIRRALSQKHELKKYLGELKEMERLEAEPVATGPVESHGSPWGSAEEEQAQLHGQLKEQRVHCQRLSYPVALAQKEPEAAASAPGTGGDSVWGNPPDLAGDHGEAAGEKVRHIIPEPEVSAEDVDRENEYISRLAQDKEEMKVKLLELVLQLVGDCNKWHGRFLAAAQNPADEPAPWDPAPQEIGAANKQGDLPQCGA

SEQ ID NO: 917836 - protein, 151 aa, Homo sapiens
MVKRMWFFRWEIREDLSGKETFESKSEEGGSESSESVKNFLSKASSKHEGSQEGVCLVSSKNKQASVAGKYYINQELWDAGLSQPKEGESGFFRPIMKIFYSCQSRTYELSSLEQVTGPFRTSVSLLWNGDNNTCFTRQLRGSSEICENIV

SEQ ID NO: 917837 - protein, 775 aa, Homo sapiens
MSPQPILYGFLVLGFRAAWGHPKMPTAAKSLVVSKDKCEPSVMPGQGHQGAPWSSSDASVWEDARCQAVRGLAVAKSVKEHPLLSRPGKGVSFSPGEFREDCSSTSCGGPDISQDSVAFEDVAINFTCEEWALLGPSQKSLYRDVMQETIRNLDCIGMIWQNHDIEEDQYKDLRRNLRCHMVERACEIKDNSQCGGPFTQTQDSIVNEKIPGVDPWESSECTDVLMGRSSLNCYVRVDSEHKPCEYQEYGEKPYTHTQCGTAFSYQPCFQIHERPQHGKKLYDCKECASFSSLENLQRHMAAHHGDGPRICKLCGNAFIWPSLFHMLRRTHTEEKPYEYEQCSTAFPAYSSTLRHERTHSGEKPYQCKQCGKAFSCSCYTQLYERTHTGEQSYECKQCGKAFYHLGSFQRHMIVHTGDGPHKCKICGKGFLSPSSVRRHKRTHTGEKPYECKYCGKAFSDCTGFRRHMITHTGDGPHKCKVCGKAFDSPSLCRRHETTHTGEKPYKCECGKAFSDFYYFRNHETTHTGEKPYKCKQCGKAFISFRSSNYIRVHEKTHTGEKPYECKQCGKALSHLKSFQRHMIMHTGDGPHKCKICGKSFDSPSSFRRHERIHTGERPYKCKLCGKGFRSSSYIQLHERTHTGEKPYGCQQCGKALSDLSSFRRHMITHTGNGPHKCKICGKGFDYPSSVQRHERTHTGEKPYECKECGKAFSHSSYLRIHERVHTGEKPYKCKECGKPFHCPSAFHKHERTHIRVHVSNNVRICGVCEYKIFKC

SEQ ID NO: 917838 - protein, 240 aa, Homo sapiens
MSGELAVWRVTEGAGCMSGELAVCRVTEGAGCMSGELAVCRVTEGAGCMSGELAVCRVTEGAGCMSGELAVCRVTEGAGCMSGELAVCTVTEGASCMSGEPAVCRVTEGARCMSGEPAVWRVTEGAGCMSGELAVWRVTEGAGCMSGELAVWRVTEGAGCMSGELAVCTVTEGAGCMSGELAVCRVTEGPCCVSGELAVCRVTEGPCCISGECIRSVLICLIPDHVSTQDTCVCVKGVRS

SEQ ID NO: 917839 - protein, 167 aa, Homo sapiens
GVLQCSASCGKGVWKRTVACTNSQGKCDASTRPRAEEACEDYSGCYEWKTGDWSTCSSTCGKGLQSRVVQCMHKVTGRHGSECPALSKPAPYRQCYQEVCNDRINANTITSPRLAALTYKCTRDQWTVYCRVIREKNLCQDMRWYQRCCQTCRDFYANKMRQPPPSS

SEQ ID NO: 917840 - protein, 187 aa, Homo sapiens
FPSPCWAKKRILIMMARKMAMISWYAVVVAVNAVGTLPPCIILAVTISAHINLTASNHEHLCLFERFLYLSKNIRGVLDKISAWETRETQNRDMNKSTLERPYANSLSPTHHLMLVDVLMGSVSYITESTVYSMAAQYERGVLMEQVFVWGPHFSSVTGVPSSTHKSTDTITELNLGLPAQCRKAKH

SEQ ID NO: 917841 - protein, 144 aa, Homo sapiens
MPRQKFAVGGTAEGKYGVRAPTQCPYWAPPSGAVKRQPTSSSPQNGRSTDSLHCEPGKASNTQHQPVKAAGREAVACKATGLELPKTMETLLFHQRDLDKEIINGSAENAGVDILNQAGNILRARKRRGLKNLTTNLLESEPAT

SEQ ID NO: 917842 - protein, 144 aa, Homo sapiens
MAWPIQPADLIPSSPLLQAPPLPATVLGLQLPQLNRGLSPAALKAFRGWLSFVRLGICPSVLLKGPPRIRGWIWQKSWRGSAARSRDDTSLLGGESTSAEKGEATCLDPSRRAPVPCKAACHPPPSLPPLPSSPGLPPPSDLKK

SEQ ID NO: 917843 - protein, 622 aa, Homo sapiens
MGSLTFRDVAIQFSLEEWQCLDTAQQNLYRNVMLENYRNLVFLGIAAPKPDLIIFLEQGKEPWNMKRHELVKEPPVICSHFAQDLWPEQGREDSFQKVILRRYEKCGHENLQLKIGCTNVDECKVHKKGYNKLNQSLTTTQSKVFQCGKYANIFHKCSNSKRHKIRHTGKKLLKCKEYVRSFCMLSHLSQHKRIYTRENSYKSEEHGKAFNWSSALTYKRIHTGEKPCKCEECGKAFSKFSILTKHKVIHTGEKHYKCEECGKAFTRSSSLIEHKRSHAGEKPYKCEECGKAFSKASTLTAHKTIHAGEKPYKCEECGKAFNRSSNLMEHKRIHTGEKPCKCEECGKAFGNFSTLTKHKVIHTGEKPYKCEECGKAFSWPSSLTEHKRIHAGDKPYKCEECGKTFKWSSTLTKHKIIHTGEKPYKCEECGKAFTTFSSLTKHKVIHTGEKHYKCEECGKVFSWSSSLTTHKAIHAGEKLYKCEECGKAFKWSSNLMEHKRIHTGEKPYKCEECGKAFSKVANLTKHKVIHTGEKQYKCEECGKAFIWSSRLSEHKRIHTGEKPYKCEECGKAFSWVSVLNKHKKIHAGKKFYKCEECGKDFNQSSHLTTHKRIHTGGKTLQM

SEQ ID NO: 917844 - protein, 470 aa, Homo sapiens
MEPLRAPALRRLLPPLLLLLLSLPPRARAKYVRGNLSSKEVSMPSPPLRPAGPRGTQGRRGERVPPRPLPPLLADSGSLGGVGPRAMGDWARVEAKGSRRVAARPGGCRRDVEDWVFLTRFCFLSDYGRLDFRFRYPEAKCCQNILLYFDDPSQWPAVYKAGDKDCLAKESVIRPENNQVINLTTQYAWSGCQVVSEEGTRYLSCSSGRSFRSVRERWWYIALSKCGGDGLQLEYEMVLTNGKSFWTRHFSADEFGILETDVTFLLIFILIFFLSCYFGFLSLLFFCIYWGQYATDGIGNESVKILAKLLFSSSFLIFLLMLILLGKGFTVTRGRISHAGSVKLSVYMTLYTLTHVVLLIYEAEFFDPGQVLYTYESPAGYGLIGLQVAAYVWFCYAVLVSLRHFPEKQPFYVPFFAAYTLWFFAVPVMALIANFGIPKWAREKIVNGIQLGIHLYAHGVFLVLLPQPPE

SEQ ID NO: 917845 - protein, 170 aa, Homo sapiens
MPRVYIGRLSYNVQEKAIQRFFSGYGRLLEVDLKNGYGFVEFEDSRDTDDALYELNSEELCGERVIVEHARGPRRNRDSYSYGSRRGGGGYSSRRHLAETNTDHLSRSKGRSRSRSKGRKSRSKSKSKPKSDRGSHSHSRSRSKDEYEKYRSRSRSRSKSRSRSRSSSRD

SEQ ID NO: 917846 - protein, 152 aa, Homo sapiens
LNKESDKMHSKQGRNKQQKQRFIENESTFYKVGAGLSSGSRAPVTESSGVQLPPRGFPLATGVHPMQMKWWPSINLIGCRKQPSEANMKLQSYTPMQPSDWFWKAANQRLRPWKGKRDLRDPKPGNMRNVNGQDQFLPTKTLLHGRRPCSMA

SEQ ID NO: 917847 - protein, 487 aa, Homo sapiens
MAREGLRTLVVAKKALTEEQYQDFEPMQSSSVESTHSTYTCAHRRLPLCPQSRYTQAKLSMHDRSLKVAAVVESLEREMELLCLTGVEDQLQADVRPTLEMLRNAGIKIWMLTGDKLETATCIAKSSHLVSRTQDIHIFRQVTSRGEAHLELNAFRRKHDCALVISGDSLEVCLKYYEHEFVELACQCPAVVCCRCSPTQKARIVTLLQQHTGRRTCAIGDGGNDVSMIQAADCGIGIEGKRTLGQQTLSTCLVNTHQHVLSAQSAHTRYTLGRRTSAHAQRTAHTRHTVITRQLVPSAQSAHTQHTVSAHQHVLSAQSAHSTHSVSARQHVLSAQSAHTAHTCLVHISTCSAHTWHTRLAHYTCSAHGRAHTQITRESFNRAGPDSAALLTPVTPMEGKQASLAADFSITQFRHIGRLLMVHGRNSYKRSAALGQFVMHRGLIISTMQVLVELTVVFVCGLSLQAVFSSVFYFASVPLYQGFLMVG

SEQ ID NO: 917848 - protein, 750 aa, Homo sapiens
MDPVACEDVAVNFTQEEWALLDISQRKLYREVMLETFRNLTSIGKKWKDQNIEYEYQNPRRNFRSLIEGNVNEIKEDSHCGETFTQVPDDRLNFQEKKASPEAKSCDNFVCGEVGIGNSSFNMNIRGDIGHKAYEYQDYAPKPYKCQQPKKAFRYHPSFRTQERNHTGEKPYACKECGKTFISHSGIRRRMVMHSGDGPYKYYILSMKELTLERNRMNVNNVLNPLVILLPIEYMKELTLEKSLMNVSNVGKHSIVPVLFKHIKEPTLGESHMNVNNVANPSVGVIPFKYMKELTLGRSPVNVANVIKHSVVTDPILDIKGVTRERSLINVRNVEKHSRIPVPFVDMKGPTLRKNLMNVSSVGKHYLISFQTHLRMRSGERPYKFPFSIMKGLTLERNPMSVSNVGKPSDVPHTFEGMVGLTGEKPYECKECGKAFRSASHLQIHERTQTHIRIHSGERPYKCKTCGKGFYSPTSFQRHEKTHTAEKPYECKQCGKAFSSSSSFWYHERTHTGEKPYECKQCGKAFRSASILQMHAGTHPEEKPYECKQCGKAFRSAPHLRIHGRTHTGEKPYECKECGKAFRSAKNLRIHERTQTHVRMHSVERPYKCKICGKGFYSAKSFQIPEKSYTGEKPYECKQCGLQLPRTAAESVDSEKLQGPGKQETHVQDALSNRGAGAGPCQLFNPPEGGRSIAGLLIAWLLEETRSRDSFFPALRGTRSLLRSFCLSIACAVSWTAHGSSAGDAGISGS

SEQ ID NO: 917849 - protein, 750 aa, Homo sapiens; identical to SEQ ID NO: 917848

SEQ ID NO: 917850 - protein, 750 aa, Homo sapiens; identical to SEQ ID NO: 917848

SEQ ID NO: 917851 - protein, 952 aa, Homo sapiens
LSLFRAESPTTASPALGGPAPGCSRRTPPPPMAPLALVGVTLLLAAPPCSGAATPTPSLPPPPANDSDTSTGGCQGSYRCQPGVLLPVWEPDDPSLGDKAARAVVYFVAMVYMFLGVSIIADRFMAAIEVITSKEKEITITKANGETSVGTVRIWNETVSNLTLMALGSSAPEILLSVIEVCGHNFQAGELGPGTIVGSAAFNMFVVIAVCIYVIPAGESRKIKHLRVFFVTASWSIFAYVWLYLILAVFSPGVVQVWEALLTLVFFPVCVVFAWMADKRLLFYKYVYKRYRTDPRSGIIIGAEGDPPKSIELDGTFVGAEAPGELGGLGPGPAEARELDASRREVIQILKDLKQKHPDKDLEQLVGIANYYALLHQQKSRAFYRIQATRLMTGAGNVLRRHAADASRRAAPAEGAGEDEDDGASRIFFEPSLYHCLENCGSVLLSVTCQGGEGNSTFYVDYRTEDGSAKAGSDYEYSEGTLVFKPGETQKELRIGIIDDDIFEEDEHFFVRLLNLRVGDAQGMFEPDGGGRPKGRLVAPLLATVTILDDDHAGIFSFQDRLLHVSECMGTVDVRVVRSSGARGTVRLPYRTVDGTARGGGVHYEDACGELEFGDDETMKTLQVKIVDDEEYEKKDNFFIELGQPQWLKRGISALLLNQGDGDRKLTAEEEEARRIAEMGKPVLGENCRLEVIIEESYDFKNTVDKLIKKTNLALVIGTHSWREQFLEAITVSAGDEEEEEDGSREERLPSCFDYVMHFLTVFWKVLFACVPPTEYCHGWACFGVSILVIGLLTALIGDLASHFGCTVGLKDSVNAVVFVALGTSIPDTFASKVAALQDQCADASIGNVTGSNAVNVFLGLGVAWSVAAVYWAVQGRPFEVRTGTLAFSVTLFTVFAFVGIAVLLYRRRPHIGGELGGPRGPKLATTALFLGLWLLYILFASLEAYCHIRGF

SEQ ID NO: 917852 - protein, 545 aa, Homo sapiens
ITCLMPVDPHTWEFFYGTYVSSGKHVQTPPVQHTADDRPSPRSSPSPPRRSEGTLVFKPGETQKELRIGIIDDDIFEEDEHFFVRLLNLRVGDAQGMFEPDGGGRPKGRLVAPLLATVTILDDDHAGIFSFQDRLLHVSECMGTVDVRVVRSSGARGTVRLPYRTVDGTARGGGVHYEDACGELEFGDDETMKTLQVKIVDDEEYEKKDNFFIELGQPQWLKRGISGDGDRKLTAEEEEARRIAEMGKPVLGENCRLEVIIEESYDFKNTVDKLIKKTNLALVIGTHSWREQFLEAITVSAGDEEEEEDGSREERLPSCFDYVMHFLTVFWKVLFACVPPTEYCHGWACFGVSILVIGLLTALIGDLASHFGCTVGLKDSVNAVVFVALGTSIPGNTLGDFGGVGSQMSQAGATQDPAKMNTFASKVAALQDQCADASIGNVTGSNAVNVFLGLGVAWSVAAVYWAVQGRPFEVRTGTLAFSVTLFTVFAFVGIAVLLYRRRPHIGGELGGPRGPKLATTALFLGLWLLYILFASLEAYCHIRGF

SEQ ID NO: 917853 - protein, 365 aa, Homo sapiens
VGAAEIGRGRKRIAEMGKPVLGENCRLEVIIEESYDFKNTVDKLIKKTNLALVIGTHSWREQFLEAITVSAGDEEEEEDGSREERLPSCFDYVMHFLTVFWKVLFACVPPTEYCHGWACFGVSILVIGLLTALIGDLASHFGCTVGLKDSVNAVVFVALGTSIPGNTLGDFGGVGSQMSQAGATQDPAKMRHVRQQGGGAAGPVRRRVHRQRDRLQRGERVPWPGRRLVCGRRVLGGAGPPLRGAHWHAGLLRHALHRLRLRGHCRAAVPAPAAHRRRAGRPARTQARHHRALPGPLAPVHPLRQPGGVLPHPGLLGPRAETRPHRPPGARDSAAPALGPWSPFPPRLGLLSWDSASLLRPLPWL

SEQ ID NO: 917854 - protein, 1028 aa, Homo sapiens
LSLFRAESPTTASPALGGPAPGCSRRTPPPPMAPLALVGVTLLLAAPPCSGAATPTPSLPPPPANDSDTSTGGCQGSYRCQPGVLLPVWEPDDPSLGDKAARAVVYFVAMVYMFLGVSIIADRFMAAIEVITSKEKEITITKANGETSVGTVRIWNETVSNLTLMALGSSAPEILLSVIEVCGHNFQAGELGPGTIVGSAAFNMFVVIAVCIYVIPAGESRKIKHLRVFFVTASWSIFAYVWLYLILAVFSPGVVQVWEALLTLVFFPVCVVFAWMADKRLLFYKYVYKRYRTDPRSGIIIGAEGDPPKSIELDGTFVGAEAPGELGGLGPGPAEARELDASRREVIQILKDLKQKHPDKDLEQLVGIANYYALLHQQKSRAFYRIQATRLMTGAGNVLRRHAADASRRAAPAEGAGEDEDDGASRIFFEPSLYHCLENCGSVLLSVTCQGGEGNSTFYVDYRTEDGSAKAGSDYEYSEGTLVFKPGETQKELRIGIIDDDIFEEDEHFFVRLLNLRVGDAQGMFEPDGGGRPKGRLVAPLLATVTILDDDHAGIFSFQDRLLHVSECMGTVDVRVVRSSGARGTVRLPYRTVDGTARGGGVHYEDACGELEFGDDETMKTLQVKIVDDEEYEKKDNFFIELGQPQWLKRGISALLLNQGDGDRKLTAEEEEARRIAEMGKPVLGENCRLEVIIEESYDFKNTVDKLIKKTNLALVIGTHSWREQFLEAITVSAGDEEEEEDGSREERLPSCFDYVMHFLTVFWKVLFACVPPTEYCHGWACFGVSILVIGLLTALIGDLASHFGCTVGLKDSVNAVVFVALGTSIPGNTLGDFGGVGSQMSQAGATQDPAKMRHVRQQGGGAAGPVRRRVHRQRDRLQRGERVPWPGRRLVCGRRVLGGAGPPLRGAHWHAGLLRHALHRLRLRGHCRAAVPAPAAHRRRAGRPARTQARHHRALPGPLAPVHPLRQPGGVLPHPGLLGPRAETRPHRPPGARDSAAPALGPWSPFPPRLGLLSWDSASLLRPLPWL

SEQ ID NO: 917855 - protein, 227 aa, Homo sapiens
MPQLGRVPTGDEEEEEDGSREERLPSCFDYVMHFLTVFWKVLFACVPPTEYCHGWACFGVSILVIGLLTALIGDLASHFGCTVGLKDSVNAVVFVALGTSIPDTFASKVAALQDQCADASIGNVTGSNAVNVFLGLGVAWSVAAVYWAVQGRPFEVRTGTLAFSVTLFTVFAFVGIAVLLYRRRPHIGGELGGPRGPKLATTALFLGLWLLYILFASLEAYCHIRGF

SEQ ID NO: 917856 - protein, 241 aa, Homo sapiens
MSIKTTCRKTQCKSATKIFLIQINLTSLANPVLRSKKPRKIPENNKGWQECEETGNFVRCWWALNPKQVFLQETQRRQQCEGGGREGSDAATTTRSWKGERVKSPLESLDGHGPADTLISDFWPPNHERICFGAHQAKGRRDQGKWPGPLPSSTAADLSQEHSCGQPRTLLPEINLLSPPALKPLWVMKEMLTLSTTRMRLEDSTKRNKLGTRGQIPHEATYVRDQEYLIIQSTQIHRDRG

SEQ ID NO: 917857 - protein, 260 aa, Homo sapiens
MLSVVENGLDPQAAIPVIKKKLVGSVKALQKQYVSLDTVVTSEDGDANTMCSALEAVFIHGLHAKHIRAEAGGKRKKSAHQKPLPQPVFWPLLKAVTHKHIISELEHLTFVNMDVGRCRAWLRLALNNGLMECYLKLLLQEQARLQLQRKESLDSISHSSGSEDIEVHHSGHKIRRNQKPTASSLSLDTASSSQLSCSLNSDSCLLQENGSKSPDHCEEPMSYDSDLGTANAEDSDQSLQEKTRAGSQRMTSTGLPGSNP

SEQ ID NO: 917858 - protein, 232 aa, Homo sapiens
MASGAGAPLPVVSGRETASSARRLRGCRGRERPSPRSSLRLVSCDSLREQLREWRCFQWWRMDWTPRLPSRHIISELEHLTFVNMDVGRCRAWLRLALNNGLMECYLKLLLQEQARLQLQRKESLDSISHSSGSEDIEVHHSGHKIRRNQKPTASSLSLDTASSSQLSCSLNSDSCLLQENGSKSPDHCEEPMSYDSDLGTANAEDSDQSLQEKTRAGSQRMTSTGLPGSNP

SEQ ID NO: 917859 - protein, 183 aa, Homo sapiens
MLSVVENGLDPQAAIPVIKKKLVGSVKALQKQHIISELEHLTFVNMDVGRCRAWLRLALNNGLMECYLKLLLQEQARLQLQRKESLDSISHSSGSEDIEVHHSGHKIRRNQKPTASSLSLDTASSSQLSCSLNSDSCLLQENGSKSPDHCEEPMSYDSDLGTANAEDSDQSLQESRIPRRPAP

SEQ ID NO: 917860 - protein, 293 aa, Homo sapiens
MDTILVFSLIIASYDANKKDLRDSSCRLEQLPGIFPKDVRSIRELQMQETHTETKRTTFIQNRTIATLQCLGSDSKVKVNLVYLERRPKVKHILKNLRIIAAPRRNSSASSSCHLIPTSKFQTGSLLKGKAFLPGISQCKVLGASSETFPTSAPSITPGNKEGEKTTSTDTDENLEKRQKWSIVVKILIAVTLLLSGVAIIVFVIFEVPCPYQCLGARKLCQCQWLWRWQKKGGQPPGTAESKPDSQPQKESVLCVVYVICLKKCNYRLTKRQNEVHLELHGVLYLASPFLGT

SEQ ID NO: 917861 - protein, 165 aa, Homo sapiens
PGRGPFTCTQLHGRMAAEFHPESRHRNTGIVAAALASAPTLTYSLGENESFSPSIPTTCLHGEGEKADELLMNCGGDFDGTFFSTKSQQRLGVGQKYSECSFDKSFIGYAFTWEDGSLRERPCGHSFSIGPLVAEGDLHSGTFLYRHRADGPRPSPTFSLRTINQ

SEQ ID NO: 917862 - protein, 402 aa, Homo sapiens
AGPGASGGGGGGGTMGRARRFQWPLLLLWAAAAGPGAGQEVQTENVTVAEGGVAEITCRLHQYDGSIVVIQNPARQTLFFNGTRALKDERFQLEEFSPRRVRIRLSDARLEDEGGYFCQLYTEDTHHQIATLTVLVAPENPVVEVREQAVEGGEVELSCLVPRSRPAATLRWYRDRKELKGVSSSQENGKVWSVASTVRFRVDRKDDGGIIICEAQNQALPSGHSKQTQYVLDVQYSPTARIHASQAVVREGDTLVLTCAVTGNPRPNQIRWNRGNESLPERAEAVGETLTLPGLVSADNGTYTCEASNKHGHARALYVLVVYDPGAVVEAQTSVPYAIVGGILALLVFLIICVLVGMVWCSVRQKGSYLTHEASGLDEQGEAREAFLNGSDGHKRKEEFFI

SEQ ID NO: 917863 - protein, 402 aa, Homo sapiens; identical to SEQ ID NO: 917862

SEQ ID NO: 917864 - protein, 402 aa, Homo sapiens; identical to SEQ ID NO: 917862

SEQ ID NO: 917865 - protein, 344 aa, Homo sapiens
AGPGASGGGGGGGTMGRARRFQWPLLLLWAAAAGPGAGQEVQTENVTVAEGGVAEITCRLHQYDGSIVVIQNPARQTLFFNGTRALKDERFQLEEFSPRRVRIRLSDARLEDEGGYFCQLYTEDTHHQIATLTVLVAPENPVVEVREQAVEGGEVELSCLVPRSRPAATLRWYRDRKELKGVSSSQENGKVWSVASTVRFRVDRKDDGGIIICEAQNQALPSGHSKQTQYVLDVQYSPTARIHASQAVVREGDTLVLTCAVTGNPRPNQIRWNRGNESLPERAEAVGETLTLPGLVSADNGTYTCEASNKHGHARALYVLVVYGESRLRPTEGGGGAPGGGGGA

SEQ ID NO: 917866 - protein, 319 aa, Homo sapiens
CHLGPWFPMVAGNRQLDRFEPTFVPSLTPYFPSPCGSGPRESCGGGPGAGGRGRRGGAQLPRSAVPSGCHPALVPGPQGAERTTVVSSSVRRRTRRCPPDTASRRSTCWMCSVSDRRARTQGIPTPATRTREGPPCLRDGLETTLSSYFCLTDSPTARIHASQAVVREGDTLVLTCAVTGNPRPNQIRWNRGNESLPERAEAVGETLTLPGLVSADNGTYTCEASNKHGHARALYVLVVYDPGAVVEAQTSVPYAIVGGILALLVFLIICVLVGMVWCSVRQKGSYLTHEASGLDEQGEAREAFLNGSDGHKRKEEFFI

SEQ ID NO: 917867 - protein, 371 aa, Homo sapiens
WHHSHFIDGATEAPKGAGQEVQTENVTVAEGGVAEITCRLHQYDGSIVVIQNPARQTLFFNGTRALKDERFQLEEFSPRRVRIRLSDARLEDEGGYFCQLYTEDTHHQIATLTVLVAPENPVVEVREQAVEGGEVELSCLVPRSRPAATLRWYRDRKELKGVSSSQENGKVWSVASTVRFRVDRKDDGGIIICEAQNQALPSGHSKQTQYVLDVQYSPTARIHASQAVVREGDTLVLTCAVTGNPRPNQIRWNRGNESLPERAEAVGETLTLPGLVSADNGTYTCEASNKHGHARALYVLVVYDPGAVVEAQTSVPYAIVGGILALLVFLIICVLVGMVWCSVRQKGPEVRAQRSGSPRGQGPKVQTPQVQ

SEQ ID NO: 917868 - protein, 344 aa, Homo sapiens; identical to SEQ ID NO: 917865

SEQ ID NO: 917869 - protein, 347 aa, Homo sapiens
AGPGASGGGGGGGTMGRARRFQWPLLLLWAAAAGPGAGQEVQTENVTVAEGGVAEITCRLHQYDGSIVVIQNPARQTLFFNGTRALKDERFQLEEFSPRRVRIRLSDARLEDEGGYFCQLYTEDTHHQIATLTVLVAPENPVVEVREQAVEGGEVELSCLVPRSRPAATLRWYRDRKELKGVSSSQENGKVWSVASTVRFRVDRKDDGGIIICEAQNQALPSGHSKQTQYVLDVQYSPTARIHASQAVVREGDTLVLTCAVTGNPRPNQIRWNRGNESLPERAEAVGETLTLPGLVSADNGTYTCEASNKHGHARALYVLVVYGNRTCLRLSLPISKVEINNSTYIT

SEQ ID NO: 917870 - protein, 151 aa, Homo sapiens
MSLQDSTLSREGKPEGEIMAAVFFSVGRLSPEVTQPDEDLHLQAEETQLVKESVTFKDVAIDFTLEEWRLMDPTQRNLHKDVMLENYRNLVSLGLAVSKPDMISHLENGKGPWVTVREISRIPYPGSHSITQAGMQWCDHSSLQSQTPGLK

SEQ ID NO: 917871 - protein, 146 aa, Homo sapiens
IKEFGEVAELQRKGRGLRLLLRRETTQNDRWRARALGRRCPSFYDLVNCVSFLFLFFSLPLLLLLLLFFFNRYTLERRSRHRFPRRLTLRSKSRASWTRSLWPGGTNSSLGHFERAVPTFSVACGRGEDLLSPSNEGKCETLALYL

SEQ ID NO: 917872 - protein, 126 aa, Homo sapiens
PSGRQDVPPAPSSPRPRPSPQYVFFRFLNFLFLSLQVVLSGVNRQHRWPPGASPSRSLGEAGGERPARALRRPRAPGRAGGGGPPGGGIPACSIGPGLARLAALGGLPSILESSRLLPSPRSSACL

SEQ ID NO: 917873 - protein, 358 aa, Homo sapiens
MRGPLGWPQPEDGPGRNPTADFRTASLAKGVPRGLSGAQTRGLLDGPAPRRSPRSSLGLRGGDCGRGARAGSSWREKCRVHVSARGPSASETNPRGEPRALAVCAPDAGTPPAALFLAVELPGPAQRVQRSFRKRHNFDATVSIVLGFLMITNVICLGSKLCKSAGLNSAGGCVCGEALTTRSLTAEQGTKRAECGGGGGSRSRSGMGVFSVTDCTELLAHRSHSGCPGRTLMYAVGWCSPGHSSQFHGVVDKCGERGPFSGNASTSGTVTAEQFCRPGHRLAIGLTPGRGGPWITRRLGSRLRRVWEGTLTCFQRDLVLVGSAAKRDRVENKIQGVGTPSRGASPAQPISLSCHGVE

SEQ ID NO: 917874 - protein, 126 aa, Homo sapiens; identical to SEQ ID NO: 917872

SEQ ID NO: 917875 - protein, 520 aa, Homo sapiens
MDVVEVAGSWWAQEREDIIMKYEKALATLYLGPLTKAPSGLQGHQAGLPEDKGPKPFRSYNNNVDHLGIVHETELPPLTAREAKQIRREISRKSKWVDMLGDWEKYKSSRKLIDRAYKGMPMNIRGPMWSVLLNIEEMKLKNPGRYQIMKEKGKRSSEHIQRIDRDISGTLRKHMFFRDRYGTKQRELLHILLAYEEYNPEVGYCRDLSHIAALFLLYLPEEDAFWALVQLLASERHSLQGFHSPNGGTVQGLQDQQEHVVATSQPKTMGHQDKKDLCGQCSPLGCLIRILIDGISLGLTLRLWDVYLVEGEQALMPITRIAFKVQQKRLTKTSRCGPWARFCNRFVDTWARDEDTVLKHLRASMKKLTRKQGDLPPPAKPEQGSSASRPVPASRGGKTLCKGDRQAPPGPPARFPRPIWSASPPRAPRSSTPCPGGAVREDTYPVGTQGVPSPALAQGGPQGSWRFLQWNSMPRLPTDLDVEGPWFRHYDFRQSCWVRAISQEDQLAPCWQAEHPAERV

SEQ ID NO: 917876 - protein, 163 aa, Homo sapiens
MRFGLEDSEYNALERRWNPCEAQDNLPVWLVLIPSEYQRSRRLQMLSSGIQTKDLILAEAATAASAGGTPLGSLSDLVSSTWSKYAEGTQKSRQFPRATHDCQPSRPAVLTVHGPGPWESLMWVSHESAWTQSRHWRNRSDSHDSGMRMFCPRSTAEKIMLKP

SEQ ID NO: 917877 - protein, 476 aa, Homo sapiens
CCRSHRMAAVVLPPTAGAQRSSVSDRAALGTWDLGIWVSVDVTCVVNVLELLNSPFSSFCEPDKNTREGHTEGGELVNELLKSWLKGLVTFEDVAVEFTQEEWALLDPAQRTLYRDVMLENCRNLASLGNQVDKPRLISQLEQEDKVMTEERGILSGTCPDVENPFKAKGLTPKLHVFRKEQSRNMKMERNHLGATLNECNQCFKVFSTKSSLTRHRKIHTGERPYGCSECGKSYSSRSYLAVHKRIHNGEKPYECNDCGKTFSSRSYLTVHKRIHNGEKPYECSDCGKTFSNSSYLRPHLRIHTGEKPYKCNQCFREFRTQSIFTRHKRVHTGEGHYVCNQCGKAFGTRSSLSSHYSIHTGEYPYECHDCGRTFRRRSNLTQHIRTHTGEKPYTCNECGKSFTNSFSLTIHRRIHNGEKSYECSDCGKSFNVLSSVKKHMRTHTGKKPYECNYCGKSFTSNSYLSVHTRMHNRQM

SEQ ID NO: 917878 - protein, 167 aa, Homo sapiens
TWILQVPVQDLHAVMVLFDEILQSRCFHPQWQRPLGPFSSYGSSVFTQLNLATAHSSSPCLNRLELSFHSLPTTADRCHRRPVLTSTPQGSVGCPLASDPARRCPLLLPIGLEARHCSWVAKCLELQDSPLFWHCCPPAEDQADIFRRHMEVMVNFATVKTKVNWVH

SEQ ID NO: 917879 - protein, 512 aa, Homo sapiens
RIPSSVTRRWLWVGAAGTAEATARLNVFAKPEATEVSPNKGTLSVMEDSAQEIATCNSRNGNPAPKITWYRNGQRLEVPVEMNPEGYMTSRTVREASGLLSLTSTLYLRLRKDDRDASFHCAAHYSLPEGRHGRLDSPTFHLTLHYPTEHVQFWVGSPSTPAGWVREGDTVQLLCRGDGSPSPEYTLFRLQDEQEEVLNVNLEGNLTLEGVTRGQSGTYGCRVEDYDAADDVQLSKTLELRVAYLDPLELSEGKVLSLPLNSSAVVNCSVHGLPTPALRWTKDSTPLGDGPMLSLSSITFDSNGTYVCEASLPTVPVLSRTQNFTLLVQGSPELKTAEIEPKADGSWREGDEVTLICSARGHPDPKLSWSQLGGSPAEPIPGRQGWVSSSLTLKVTSALSRDGISCEASNPHGNKRHVFHFGTVSPQTSQAGVAVMAVAVSVGLLLLVVAVFYCVRRKGGPCCRQRREKGAPPPGEPGLSHSGSEQPEQTGLLMGGASGGARGGSGGFGDEC

SEQ ID NO: 917880 - protein, 564 aa, Homo sapiens
APRPQTDRSGARPRLASAEMQGSELQVTMHDTRGRSPPYQLDSQGRLVLAEPGGDERDYVCVVRVGAAGTAEATARLNVFAKPEATEVSPNKGTLSVMEDSAQEIATCNSRNGNPAPKITWYRNGQRLEVPVEMNPEGYMTSRTVREASGLLSLTSTLYLRLRKDDRDASFHCAAHYSLPEGRHGRLDSPTFHLTLHYPTEHVQFWVGSPSTPAGWVREGDTVQLLCRGDGSPSPEYTLFRLQDEQEEVLNVNLEGNLTLEGVTRGQSGTYGCRVEDYDAADDVQLSKTLELRVAYLDPLELSEGKVLSLPLNSSAVVNCSVHGLPTPALRWTKDSTPLGDGPMLSLSSITFDSNGTYVCEASLPTVPVLSRTQNFTLLVQGSPELKTAEIEPKADGSWREGDEVTLICSARGHPDPKLSWSQLGGSPAEPIPGRQGWVSSSLTLKVTSALSRDGISCEASNPHGNKRHVFHFGTVSPQTSQAGVAVMAVAVSVGLLLLVVAVFYCVRRKGGPCCRQRREKGAPPPGEPGLSHSGSEQPEQTGLLMGGASGGARGGSGGFGDEC

SEQ ID NO: 917881 - protein, 610 aa, Homo sapiens
EIEPMLSSQATEQDSISKKKRKENERQSGEGETKRRRDGTGMRWRKGDRKNQELIGNGGRRRWGGTEGEDSCVLGRRELGDPESLVPGGWCWRPGLFSLSRGLGIWTPGSWESREFRSPAHESEWGELLREEPRLQSPSSKPRPCPCLPQIATCNSRNGNPAPKITWYRNGQRLEVPVEMNPEGYMTSRTVREASGLLSLTSTLYLRLRKDDRDASFHCAAHYSLPEGRHGRLDSPTFHLTLHYPTEHVQFWVGSPSTPAGWVREGDTVQLLCRGDGSPSPEYTLFRLQDEQEEVLNVNLEGNLTLEGVTRGQSGTYGCRVEDYDAADDVQLSKTLELRVAYLDPLELSEGKVLSLPLNSSAVVNCSVHGLPTPALRWTKDSTPLGDGPMLSLSSITFDSNGTYVCEASLPTVPVLSRTQNFTLLVQGSPELKTAEIEPKADGSWREGDEVTLICSARGHPDPKLSWSQLGGSPAEPIPGRQGWVSSSLTLKVTSALSRDGISCEASNPHGNKRHVFHFGTVSPQTSQAGVAVMAVAVSVGLLLLVVAVFYCVRRKGGPCCRQRREKGAPPPGEPGLSHSGSEQPEQTGLLMGGASGGARGGSGGFGDEC

SEQ ID NO: 917882 - protein, 512 aa, Homo sapiens; identical to SEQ ID NO: 917879

SEQ ID NO: 917883 - protein, 512 aa, Homo sapiens; identical to SEQ ID NO: 917879

SEQ ID NO: 917884 - protein, 523 aa, Homo sapiens
RIPSSVTRRWLWVGAAGTAEATARLNVFAKPEATEVSPNKGTLSVMEDSAQEIATCNSRNGNPAPKITWYRNGQRLEVPVEMNPEGYMTSRTVREASGLLSLTSTLYLRLRKDDRDASFHCAAHYSLPEGRHGRLDSPTFHLTLHYPTEHVQFWVGSPSTPAGWVREGDTVQLLCRGDGSPSPEYTLFRLQDEQEEVLNVNLEGNLTLEGVTRGQSGTYGCRVEDYDAADDVQLSKTLELRVAYLDPLELSEGKVLSLPLNSSAVVNCSVHGLPTPALRWTKDSTPLGDGPMLSLSSITFDSNGTYVCEASLPTVPVLSRTQNFTLLVQGSPELKTAEIEPKADGSWREGDEVTLICSARGHPDPKLSWSQLGGSPAEPIPGRQGWVSSSLTLKVTSALSRDGISCEASNPHGNKRHVFHFGTVSPQTSQAGVAVMAVAVSVGLLLLVVAVFYCVRRKGGPCCRQRREKGAPPPGEPGLSHSGSEQPEQTGLLMGGASGGARGGSGGFGDECWSPHLTSCCRV

SEQ ID NO: 917885 - protein, 406 aa, Homo sapiens
CQSVVPDDRDASFHCAAHYSLPEGRHGRLDSPTFHLTLHYPTEHVQFWVGSPSTPAGWVREGDTVQLLCRGDGSPSPEYTLFRLQDEQEEVLNVNLEGNLTLEGVTRGQSGTYGCRVEDYDAADDVQLSKTLELRVAYLDPLELSEGKVLSLPLNSSAVVNCSVHGLPTPALRWTKDSTPLGDGPMLSLSSITFDSNGTYVCEASLPTVPVLSRTQNFTLLVQGSPELKTAEIEPKADGSWREGDEVTLICSARGHPDPKLSWSQLGGSPAEPIPGRQGWVSSSLTLKVTSALSRDGISCEASNPHGNKRHVFHFGTVSPQTSQAGVAVMAVAVSVGLLLLVVAVFYCVRRKGGPCCRQRREKGAPPPGEPGLSHSGSEQPEQTGLLMGGASGGARGGSGGFGDEC

SEQ ID NO: 917886 - protein, 442 aa, Homo sapiens
RIPSSVTRRWLWVGAAGTAEATARLNVFAKPEATEVSPNKGTLSVMEDSAQEIATCNSRNGNPAPKITWYRNGQRLEVPVEMNPEGYMTSRTVREASGLLSLTSTLYLRLRKDDRDASFHCAAHYSLPEGRHGRLDSPTFHLTLHYPTEHVQFWVGSPSTPAGWVREGDTVQLLCRGDGSPSPEYTLFRLQDEQEEVLNVNLEGNLTLEGVTRGQSGTYGCRVEDYDAADDVQLSKTLELRVAYLDPLELSEGKVLSLPLNSSAVVNCSVHGLPTPALRWTKDSTPLGDGPMLSLSSITFDSNGTYVCEASLPTVPVLSRTQNFTLLVQGSPELKTAEIEPKADGSWREGDEVTLICSARGHPDPKLSWSQLGGSPAEPIPGRQGWVSSSLTLKVTSALSRDGISCEASNPHGNKRHVFHFGTVSPHRESVDALSVGYLTAQ

SEQ ID NO: 917887 - protein, 355 aa, Homo sapiens
RIPSSVTRRWLWVGAAGTAEATARLNVFAKPEATEVSPNKGTLSVMEDSAQEIATCNSRNGNPAPKITWYRNGQRLEVPVEMNPEGYMTSRTVREASGLLSLTSTLYLRLRKDDRDASFHCAAHYSLPEGRHGRLDSPTFHLTLHYPTEHVQFWVGSPSTPAGWVREGDTVQLLCRGDGSPSPEYTLFRLQDEQEEVLNVNLEGNLTLEGVTRGQSGTYGCRVEDYDAADDVQLSKTLELRVAYLDPLELSEGKVLSLPLNSSAVVNCSVHGLPTPALRWTKDSTPLGDGPMLSLSSITFDSNGTYVCEASLPTVPVLSRTQNFTLLVQGSGGREGVGLDGDSVGCGTWTNRTSS

SEQ ID NO: 917888 - protein, 313 aa, Homo sapiens
MARYEAGVNRQRVEGQSGTYGCRVEDYDAADDVQLSKTLELRVAYLDPLELSEGKVLSLPLNSSAVVNCSVHGLPTPALRWTKDSTPLGDGPMLSLSSITFDSNGTYVCEASLPTVPVLSRTQNFTLLVQGSPELKTAEIEPKADGSWREGDEVTLICSARGHPDPKLSWSQLGGSPAEPIPGRQGWVSSSLTLKVTSALSRDGISCEASNPHGNKRHVFHFGTVSPQTSQAGVAVMAVAVSVGLLLLVVAVFYCVRRKGGPCCRQRREKGAPPPGEPGLSHSGSEQPEQTGLLMGGASGGARGGSGGFGDEC

SEQ ID NO: 917889 - protein, 345 aa, Homo sapiens
ALKGERLCKLPVKLRKRYVLYDSYERYVLSFPSYLVLTPPRVKLFECEPYFFPVLLKAALNDTGLEGIVNSPVLLEHLDPLELSEGKVLSLPLNSSAVVNCSVHGLPTPALRWTKDSTPLGDGPMLSLSSITFDSNGTYVCEASLPTVPVLSRTQNFTLLVQGSPELKTAEIEPKADGSWREGDEVTLICSARGHPDPKLSWSQLGGSPAEPIPGRQGWVSSSLTLKVTSALSRDGISCEASNPHGNKRHVFHFGTVSPQTSQAGVAVMAVAVSVGLLLLVVAVFYCVRRKGGPCCRQRREKGAPPPGEPGLSHSGSEQPEQTGLLMGGASGGARGGSGGFGDEC

SEQ ID NO: 917890 - protein, 67 aa, Homo sapiens
LSLLVVIFYRLKQRGALLPPTAGKGGSPPGEPGLSHSGSEQPEQTGLLMGGASGGARGGSGGFGDEC

SEQ ID NO: 917891 - protein, 252 aa, Homo sapiens
EIEPMLSSQATEQDSISKKKRKENERQSGEGETKRRRDGTGMRWRKGDRKNQELIGNGGRRRWGGTEGEDSCVLGRRELGDPESLVPGGWCWRPGLFSLSRGLGIWTPGSWESREFRSPAHESEWGELLREEPRLQSPSSKPRPCPCLPQIATCNSRNGNPAPKITWYRNGQRLEVPVEMNPEGYMTSRTVREASGLLSLTSTLYLRLRKDDRDASFHCAAHYSLPEGRHGRLDSPTFHLTLHCESVLAFDL

SEQ ID NO: 917892 - protein, 181 aa, Homo sapiens [sequence omitted]

SEQ ID NO: 917893 - protein, 499 aa, Homo sapiens
GVVGAERCEHWRSRVAKPEATEVSPNKGTLSVMEDSAQEIATCNSRNGNPAPKITWYRNGQRLEVPVEMNPEGYMTSRTVREASGLLSLTSTLYLRLRKDDRDASFHCAAHYSLPEGRHGRLDSPTFHLTLHYPTEHVQFWVGSPSTPAGWVREGDTVQLLCRGDGSPSPEYTLFRLQDEQEEVLNVNLEGNLTLEGVTRGQSGTYGCRVEDYDAADDVQLSKTLELRVAYLDPLELSEGKVLSLPLNSSAVVNCSVHGLPTPALRWTKDSTPLGDGPMLSLSSITFDSNGTYVCEASLPTVPVLSRTQNFTLLVQGSPELKTAEIEPKADGSWREGDEVTLICSARGHPDPKLSWSQLGGSPAEPIPGRQGWVSSSLTLKVTSALSRDGISCEASNPHGNKRHVFHFGTVSPQTSQAGVAVMAVAVSVGLLLLVVAVFYCVRRKGGPCCRQRREKGAPPPGEPGLSHSGSEQPEQTGLLMGGASGGARGGSGGFGDEC

SEQ ID NO: 917894 - protein, 477 aa, Homo sapiens
PDSVGRTVSVMEDSAQEIATCNSRNGNPAPKITWYRNGQRLEVPVEMNPEGYMTSRTVREASGLLSLTSTLYLRLRKDDRDASFHCAAHYSLPEGRHGRLDSPTFHLTLHYPTEHVQFWVGSPSTPAGWVREGDTVQLLCRGDGSPSPEYTLFRLQDEQEEVLNVNLEGNLTLEGVTRGQSGTYGCRVEDYDAADDVQLSKTLELRVAYLDPLELSEGKVLSLPLNSSAVVNCSVHGLPTPALRWTKDSTPLGDGPMLSLSSITFDSNGTYVCEASLPTVPVLSRTQNFTLLVQGSPELKTAEIEPKADGSWREGDEVTLICSARGHPDPKLSWSQLGGSPAEPIPGRQGWVSSSLTLKVTSALSRDGISCEASNPHGNKRHVFHFGTVSPQTSQAGVAVMAVAVSVGLLLLVVAVFYCVRRKGGPCCRQRREKGAPPPGEPGLSHSGSEQPEQTGLLMGGASGGARGGSGGFGDEC

SEQ ID NO: 917895 - protein, 512 aa, Homo sapiens; identical to SEQ ID NO: 917879

SEQ ID NO: 917896 - protein, 472 aa, Homo sapiens
RIPSSVTRRWLWVGAAGTAEATARLNVFAKPEATEVSPNKGTLSVMEDSAQEIATCNSRNGNPAPKITWYRNGQRLEVPVEMNPEGYMTSRTVREASGLLSLTSTLYLRLRKDDRDASFHCAAHYSLPEGRHGRLDSPTFHLTLHYPTEHVQFWVGSPSTPAGWVREGDTVQLLCRGDGSPSPEYTLFRLQDEQEEVLNVNLEGNLTLEGVTRGQSGTYGCRVEDYDAADDVQLSKTLELRVAYLDPLELSEGKVLSLPLNSSAVVNCSVHGLPTPALRWTKDSTPLGDGPMLSLSSITFDSNGTYVCEASLPTVPVLSRTQNFTLLVQGSPELKTAEIEPKADGSWREGDEVTLICSARGHPDPKLSWSQLGGSPAEPIPGRQGWVSSSLTLKVTSALSRDGISCEASNPHGNKRHVFHFGTVSPQTSQAGVAVMAVAVSVGLLLLVVAVFYCVRRKGGPCCRQRREKGAP

SEQ ID NO: 917897 - protein, 354 aa, Homo sapiens
MTETPASTAPPTTACPRAATAAWTAPPSTSPCTDEQEEVLNVNLEGNLTLEGVTRGQSGTYGCRVEDYDAADDVQLSKTLELRVAYLDPLELSEGKVLSLPLNSSAVVNCSVHGLPTPALRWTKDSTPLGDGPMLSLSSITFDSNGTYVCEASLPTVPVLSRTQNFTLLVQGSPELKTAEIEPKADGSWREGDEVTLICSARGHPDPKLSWSQLGGSPAEPIPGRQGWVSSSLTLKVTSALSRDGISCEASNPHGNKRHVFHFGTVSPQTSQAGVAVMAVAVSVGLLLLVVAVFYCVRRKGGPCCRQRREKGAPPPGEPGLSHSGSEQPEQTGLLMGGASGGARGGSGGFGDEC

SEQ ID NO: 917898 - protein, 503 aa, Homo sapiens
PDSVGRTVSVMEDSAQEIATCNSRNGNPAPKITWYRNGQRLEVPVEMNPEGYMTSRTVREASGLLSLTSTLYLRLRKDDRDASFHCAAHYMCMPRGAGLRDQTETSHTCIHDLTAVTYPSGSHVAVRGLCGMTSSIPEQSWDTRRCAHCSRLAAARWGTGDDPSPESQYRYFARITGLMQGMDEQEEVLNVNLEGNLTLEGVTRGQSGTYGCRVEDYDAADDVQLSKTLELRVAYLDPLELSEGKVLSLPLNSSAVVNCSVHGLPTPALRWTKDSTPLGDGPMLSLSSITFDSNGTYVCEASLPTVPVLSRTQNFTLLVQGSPELKTAEIEPKADGSWREGDEVTLICSARGHPDPKLSWSQLGGSPAEPIPGRQGWVSSSLTLKVTSALSRDGISCEASNPHGNKRHVFHFGTVSPQTSQAGVAVMAVAVSVGLLLLVVAVFYCVRRKGGPCCRQRREKGAPPPGEPGLSHSGSEQPEQTGLLMGGASGGARGGSGGFGDEC

SEQ ID NO: 917899 - protein, 308 aa, Homo sapiens
MDPLSIVGLGQSGTYGCRVEDYDAADDVQLSKTLELRVAYLDPLELSEGKVLSLPLNSSAVVNCSVHGLPTPALRWTKDSTPLGDGPMLSLSSITFDSNGTYVCEASLPTVPVLSRTQNFTLLVQGSPELKTAEIEPKADGSWREGDEVTLICSARGHPDPKLSWSQLGGSPAEPIPGRQGWVSSSLTLKVTSALSRDGISCEASNPHGNKRHVFHFGTVSPQTSQAGVAVMAVAVSVGLLLLVVAVFYCVRRKGGPCCRQRREKGAPPPGEPGLSHSGSEQPEQTGLLMGGASGGARGGSGGFGDEC

SEQ ID NO: 917900 - protein, 239 aa, Homo sapiens
AGTGLGVRDDSTPLGDGPMLSLSSITFDSNGTYVCEASLPTVPVLSRTQNFTLLVQGSPELKTAEIEPKADGSWREGDEVTLICSARGHPDPKLSWSQLGGSPAEPIPGRQGWVSSSLTLKVTSALSRDGISCEASNPHGNKRHVFHFGTVSPQTSQAGVAVMAVAVSVGLLLLVVAVFYCVRRKGGPCCRQRREKGAPPPGEPGLSHSGSEQPEQTGLLMGGASGGARGGSGGFGDEC

SEQ ID NO: 917901 - protein, 162 aa, Homo sapiens
RIPSSVTRRWLWVGAAGTAEATARLNVFAKPEATEVSPNKGTLSVMEDSAQEIATCNSRNGNPAPKITWYRNGQRLEVPVEMNPEGYMTSRTVREASGLLSLTSTLYLRLRKDDRDASFHCAAHYSLPEGRHGRLDSPTFHLTLHYLTEQLQIYDCAVEHVH

SEQ ID NO: 917902 - protein, 288 aa, Homo sapiens
RGLEHGTARLKEQEGEGGLGPRKEKGRARGRERRRKMQLTRCCFVFLVQGSLYLVICGQDDGPPGSEDPERDDHEGQPRPRVPRKRGHISPKSRPMANSTLLGLLAPPGEAWGILGQPPNRPNHSPPPSAKVKKIFGWGDFYSNIKTVALNLLVTGKIVDHGNGTFSVHFQHNATGQGNISISLVPPSKAVEFHQEQQIFIEAKASKIFNCRMEWEKVERGRRTSLCTHDPAKICSRDHAQSSATWSCSQPFKVVCVYIAFYSTDYRLVQKVCPDYNYHSDTPYYPSG

SEQ ID NO: 917903 - protein, 288 aa, Homo sapiens; identical to SEQ ID NO: 917902

SEQ ID NO: 917904 - protein, 288 aa, Homo sapiens; identical to SEQ ID NO: 917902

SEQ ID NO: 917905 - protein, 288 aa, Homo sapiens; identical to SEQ ID NO: 917902

SEQ ID NO: 917906 - protein, 124 aa, Homo sapiens
MIVNLQKRISSLADSKHSLNVNGRVQILPKPVKFKAKQKVGHRSYEESQARQFGSRKKWSQDFSKPPYPFLFHKGYLNPREQDKVGGCIHNLALASWKQSTLPQFNKLVLSSGIRTVLGNSCAV

SEQ ID NO: 917907 - protein, 124 aa, Homo sapiens; identical to SEQ ID NO: 917906

SEQ ID NO: 917908 - protein, 124 aa, Homo sapiens; identical to SEQ ID NO: 917906

SEQ ID NO: 917909 - protein, 971 aa, Homo sapiens
MIWLRNRRCLEPLQGTPKWVPVLGELQKTLQKGEYLPLRPLPMFESNFVQVTHQGGPVFVNHRTNRLAMGVAASLPGLVLPDILLIGQPAEDRDCSGLVLTRMIPWTSSTSAVHDLSAWRLKLRLVSGRQYYLALDAPDNEVGFLFHCWVRLINLLQEPAPTWTPRTTRTAPLDMPLAEAPASTWHLQDQPISRHAVRVAERNFPHKTVAAQRQRKAKALKRSFKSQAVGDSVPLIWSQLEHADVRKKPAEKKSHSDPRPDRTHTQIRLPGQGHVVESPSHCVSADSPDGFFLGSCSSLDPCLWHQDTEDLMDSGGSTFCTCFIVETPTWIGSSPEGPSCVSSSPEGPSCTCSIPEGPSRTCSIPEGPSHTCSIPEGLSCMALSPPASRGKLPGDFDVLPTGIPGRAVLERSQSGGKPEPVVTVRTQETDVVEMTTQAKSPESPFTVTKKESKDILISQTKEVTLEAFRGQGKLEDWAHWAKLEERSPDLPGVRSKELEQRKRWVKAKELAVEGPSQEHSRPFSVEALTLTKLMITANSKEQPSKSALVSLPSWLLATPQASATSMMASVPSRPGQLSLLEGKPVVVREQPESHTWVKEGKRPWGEMKEQPWGEMKEPPWDPKGPPKVPFRSKPTSASLKREGISQAPIPLTASPWEDLRPSPLSETLISKMEATARASQQPKRVSQEPMRMPAQHPLATVGKRNVESRLGGFAPSGRYQNYGYAFIYWGAGGGGGEPVEPPNFQRLKLEPETQRVAPRCLCARAGPRGGVGGARGGVGAPLPAPRCTTAPIGWGSGVLANPAAGCVSPDPGGTAPRGLRSERHPGTIPQQIQWPPTSGWSCLLRGCWMWKPRSPPRGNGRRRPSTRASPARTRSVTATRTSWTTTAASRPGPAAGRARSPASTISACTTRCAPSAGWRAGTSRSRTGFSPAKSDCPSAASSEDAVILHLFVSRSPGSRLSTPTSQCLSHE

SEQ ID NO: 917910 - protein, 971 aa, Homo sapiens; identical to SEQ ID NO: 917909

SEQ ID NO: 917911 - protein, 255 aa, Homo sapiens
MVIVIFIMTGFTVSRVPPTPMMVIVIIFIMMGFTVSRACTTPTMVIIIIMTSSTVSRACTTPTMVIVIIIITMMGSTVSRTSTTPTMVIIIITMLGLHSLQGPHHSHDVSRAYTTPTMVIVIIVTGSTVSRASTTPTMVIIIITMLGLHSLQGPHHTHDGHCHHNDGLHSIQGLYHPHDGHHHHHDAGASQSPGSPPPPRWVLTTPTMVIIIIMMVFTVSRACTYPHDGHHYCLRCGGALQCFDGGHLIAITISS

SEQ ID NO: 917912 - protein, 1260 aa, Homo sapiens
QDGGARSRDPVIAAVEGPPTEREVGGSLEVRPRCVHRAGGRGACVHRQARSGAELICLWGEAWGTAGGCRRRVRMTGPSCSRSASWSRRAPFPALSRYSCLFQFPPVGTANGIFPRPRIHRQAEIDYSSPTSVPDSEDRNKMKEWKSKMEISEEKKSARAASEKLQRQITQECELVETSNSEDRLLKHWVSPLKDAMRHLPSQESGIREMHIIPQKAIVGEIGHGCNEGEKILSAGESSHRYEVSGQNFKQKSGLTEHQKIHNINKTYECKECEKTFNRSSNLIIHQRIHTGNKPYVCNECGKDSNQSSNLIIHQRIHTGKKPYICHECGKDFNQSSNLVRHKQIHSGGNPYECKECGKAFKGSSNLVLHQRIHSRGKPYLCNKCGKAFSQSTDLIIHHRIHTGEKPYECYDCGQMFSQSSHLVPHQRIHTGEKPLKCNECEKAFRQHSHLTEHQRLHSGEKPYECHRCGKTFSGRTAFLKHQRLHAGEKIEECEKTFSKDEELREEQRIHQEEKAYWCNQCGRNFQGTSDLIRHQVTHTGEKPYECKECGKTFNQSSDLLRHHRIHSGEKPCVCSKCGKSFRGSSDLIRHHRVHTGEKPYECSECGKAFSQRSHLVTHQKIHTGEKPYQCTECGKAFRRRSLLIQHRRIHSGEKPYECKECGKLFIWRTAFLKHQSLHTGEKLECEKTFSQDEELRGEQKIHQEAKAYWCNQCGRAFQGSSDLIRHQVTHTREKPYECKECGKTFNQSSDLLRHHRIHSGEKPYVCNKCGKSFRGSSDLIKHHRIHTGEKPYECSECGKAFSQRSHLATHQKIHTGEKPYQCSECGNAFRRRSLLIQHRRLHSGEKPYECKECGKLFMWHTAFLKHQRLHAGEKLEECEKTFSKDEELRKEQRTHQEKKVYWCNQCSRTFQGSSDLIRHQVTHTREKPYEVKNVGKLNQSSDLLRHHRIHSGEKPYVCNKCGESFRSSSDLIKHHRVHTGEKPHECSECGKVFSQRSHLVTHQKIHTGEKPYQCTECEKAFRRRSLLIQRRRIHSGEKPYECKECGKLFMWHTAFLKHQRLHAGEKLEEREKTFSKDEELRGEQKIHQEEKAYWCNQCGRAFQGSSDLIGHQVTHTGEKPYECKECGKTFNQSSDLLRHHRIHSGEKPYVCNKCGKSFRGSSDLIRHHRVHTGEKPYECPECWKAFSQNSHLVSHQRIHTREKPFECSNCGKAFSGWTAFLKHQKLHIGKEFEDCKSLQTGPILIGSRNLMNAVKLGKV

SEQ ID NO: 917913 - protein, 399 aa, Homo sapiens
MLLPPGSLSRPRTFSSQPLQTKLMTHNGLFRPIPYVTAASADEATASQQPPQAQLHRYNGLFRPSSCLPAFSPGPELSQVDLTRPSSCILVAPPGPASASRQPLQSQRLPHSRFFTPSIYLTVDPPSQAPNLSAASTHPAPACQWPLQAHGAHFLTTAFPGPVFPFRRPLRAQNLLKSASPDPLAPSGRSLRAQLFFLVGSPGPIPASQQPLWTQCLPISWRPWSAHSFLKPSSPGPGQASRWPLQDELLPSDGISRPQMVSGRWAPPRQGWASRRLPQAQVVLKSGSPGPASQQVSKLFWLNSCPAPNRLCRPRTFSSQALRAHLLPPGGLYSSSTGWRTASAGPALPPRGLSRPSSCTHGGLPGQVPACLPAARVRPAPPSRWPVDANSCLWTLHRA

SEQ ID NO: 917914 - protein, 383 aa, Homo sapiens
MAYLGPYPTSRQPPQMRLLPHNSLHRHSSIVTMASLDPAPASQPSLQALNFLKSTSPGPAHASLQPLQAQLMHLGGPSRPSLCLPSASTVPTSASQQILHAQHLPHCGPPKPSSQPFSSFYTPSSRLPVASSGPWGSFLTTAFPGPVFPFRRPLRAQNLLKSASPDPLAPSGRSLRAQLFFLVGSPGPIPASQQPLWTQCLPISWRPWSAHSFLKPSSPGPGQASRWPLQDELLPSDGISRPQMVSGRWAPPRQGWASRRLPQAQVVLKSGSPGPASQQVSKLFWLNSCPAPNRLCRPRTFSSQALRAHLLPPGGLYSSSTGWRTASAGPALPPRGLSRPSSCTHGGLPGQVPACLPAARVRPAPPSRWPVDANSCLWTLHRA

SEQ ID NO: 917915 - protein, 399 aa, Homo sapiens; identical to SEQ ID NO: 917913

SEQ ID NO: 917916 - protein, 399 aa, Homo sapiens; identical to SEQ ID NO: 917913

SEQ ID NO: 917917 - protein, 399 aa, Homo sapiens; identical to SEQ ID NO: 917913

SEQ ID NO: 917918 - protein, 34 aa, Homo sapiens
MFKVQDPPGDRLISDSLMQTLDRNILLQLSRLLI

SEQ ID NO: 917919 - protein, 652 aa, Homo sapiens
SSAGGQEAVGEEEDLEEMEDLRELGWGAGSAGQLASLRLPNVPRMTATPESLFPTGDELDSSQLQMESDEVDTLKEGEDPADRMHPFLAIYELQSLKVHPLVGTCTLYSVRLTHGDFSWTTKKKYRHFQELHRDLLRHKVLMSLLPLARNQSTQPPSSYLTFIHPFHRFAVAYSPARDAGNREMPSLPRAGPEGSTRHAASKQKYLENYLNRLLTMSFYRNYHAMTEFLEVSQLSFIPDLGRKGLEGMIRKRSGGHRVPGLTCCGRDQVCYRWSKRWLVVKDSFLLYMCLETGAISFVQLFDPGFEVQVGKRSTEARHGVRIDTSHRSLILKCSSYRQARWWAQEITELAQGPGRDFLQLHRHDSYAPPRPGTLARWFVNGAGYFAAVADAILRAQEEIFITDWWLSPEVYLKRPAHSDDWRLDIMLKRKAEEGVRVSILLFKEVELALGINSGYSKRALMLLHPNIKVMRHPDQVTLWAHHEKLLVVDQVVAFLGGLDLAYGRWDDLHYRLTDLGDSSESAASQPPTPRPDSPATPDLSHNQFFWLGKDYSNLITKDWVQLDRPFEDFIDRETTPRMPWRDVGVVVHGLPARDLARHFIQRWNFTKTTKAKYKTPTYPYLLPKSTSTANQLPFTLPGGQCTTVQEEDVVVS

SEQ ID NO: 917920 - protein, 543 aa, Homo sapiens
WVVEKIPRPLALPRKCSELLYVFQTQLALKLLQCLKVTDAPHFYGLPSLERTLRGMANLTAFPGWSSHSPLTKPLDICVKYLSGLLEVITSFYVERGGNAMSFMGKGVTKSTILCLLHLSHEMMAQAGSLEWMSLWFLPLGSHSEEHIPTQQGLAWLIPLWVDRDPEVRFTSLGLGSALTTLETGCVALANSCQNISGGLWGTVVNILLDQSECSMVRREAAFILQNLLVIPMPTEIIKDYTWQGPCVHDEDSGLSLIGKPALQALLYHCHFYEHLNQMVKHCYLGRCMFDLNFSAFDRNSESNDLNGRKKQASPANKASQLSQEDFLFLIVTALQMLPSYRHVSRNSEPCCLHHLQLNTLRLMPLENTTVQQMVFMLLSNLALSHDCKGVIQKSNFLQNFLSLALPKGGNKHLSNLTILWLKLLLNISSGEDGQQMILRLDGCLDLLTEMSKYKHKSSPLLPLLIFHNVCFSPANKPKILANEKVITVLAACLESENQNAQRIGAAALWALIYNYQKAKTALKSPSVKRRVDEAYSLAKKTP

SEQ ID NO: 917921 - protein, 619 aa, Homo sapiens
FVTPSLLSAMCSLLDNLLTIAPRDTAKAFRQAHLIELLCSIADATLIQTCVQELRALLPSSPPAEHTQAQVSFLLEYLSSLSRLLQSCLLVEPDLVIQDELVKPLITNIIGILTICTKDVLDKELISAFYHTWTHLFNLLAMLLRKAGAITLPSVTVALAKHWTAAIDMFCTCAGLSATCPALYTASLQFLSVLLTEEAKGHLQAKSKTHLCCSPTVASLLDDSQENQKSLEQLSDVILQCYEGKSSKDILKRVAANALMSLLAVSRRAQKHALKANLIDNCMEQMKHINAQLNLDSLRPGKAALKKKEDGVIKELSIAMQLLRNCLYQNEECKEAALEAHLVPVLHSLWPWILMDDSLMQISLQLLCVYTANFPNGCSSLCWSSCGQHPVQATHRGAVSNSLMLCILKLASQMPLENTTVQQMVFMLLSNLALSHDCKGVIQKSNFLQNFLSLALPKGGNKHLSNLTILWLKLLLNISSGEDGQQMILRLDGCLDLLTEMSKYKHKSSPLLPLLIFHNVCFSPANKPKILANEKVITVLAACLESENQNAQRIGAAALWALIYNYQKAKTALKSPSVKRRVDEAYSLAKKTFPNSEANPLNAYYLKCLENLVQLLNSS

SEQ ID NO: 917922 - protein, 407 aa, Homo sapiens
GNVSPEGERRKLMTVLLFSSFTRTHFNKCYEGKSSKDILKRVAANALMSLLAVSRRAQKHALKANLIDNCMEQMKHINAQLNLDSLRPGKAALKKKEDGVIKELSIAMQLLRNCLYQNEECKEAALEAHLVPVLHSLWPWILMDDSLMQISLQLLCVYTANFPNGCSSLCWSSCGQHPVQATHRGAVSNSLMLCILKLASQMPLENTTVQQMVFMLLSNLALSHDCKGVIQKSNFLQNFLSLALPKGGNKHLSNLTILWLKLLLNISSGEDGQQMILRLDGCLDLLTEMSKYKHKSSPLLPLLIFHNVCFSPANKPKILANEKVITVLAACLESENQNAQRIGAAALWALIYNYQKAKTALKSPSVKRRVDEAYSLAKKTFPNSEANPLNAYYLKCLENLVQLLNSS

SEQ ID NO: 917923 - protein, 619 aa, Homo sapiens; identical to SEQ ID NO: 917921

SEQ ID NO: 917924 - protein, 451 aa, Homo sapiens
FVTPSLLSAMCSLLDNLLTIAPRDTAKAFRQAHLIELLCSIADATLIQTCVQELRALLPSSPPAEHTQAQVSFLLEYLSSLSRLLQSCLLVEPDLVIQDELVKPLITNIIGILTICTKDVLDKELISAFYHTWTHLFNLLAMLLRKAGAITLPSVTVALAKHWTAAIDMFCTCAGLSATCPALYTASLQFLSVLLTEEAKGHLQAKSKTHLCCSPTVASLLDDSQENQKSLEQLSDVILQCYEGKSSKDILKRVAANALMSLLAVSRRAQKHALKANLIDNCMEQMKHINAQLNLDSLRPGKAALKKKEDGVIKELSIAMQLLRNCLYQNEECKEAALEAHLVPVLHSLWPWILMDDSLMQISLQLLCVYTANFPNGCSSLCWSSCGQHPVQATHRGAVSNSLMLCILKLASQMPLENTTVQQMVFMLLSNLALSHDCKGVIQKAKINCRS

SEQ ID NO: 917925 - protein, 196 aa, Homo sapiens
MVFMLLSNLALSHDCKGVIQKSNFLQNFLSLALPKGGNKHLSNLTILWLKLLLNISSGEDGQQMILRLDGCLDLLTEMSKYKHKSSPLLPLLIFHNVCFSPANKPKILANEKVITVLAACLESENQNAQRIGAAALWALIYNYQKAKTALKSPSVKRRVDEAYSLAKKTFPNSEANPLNAYYLKCLENLVQLLNSS

SEQ ID NO: 917926 - protein, 186 aa, Homo sapiens
RVRGRVVPLENTTVQQMVFMLLSNLALSHDCKGVIQKSNFLQNFLSLALPKGGNKHLSNLTILWLKLLLNISSGEDGQQMILRLDGCLDLLTEMSKYKHKSSPLLPLLIFHNVCFSPANKPKILANEKVITVLAACLESENQNAQRIGAAALWALIYNYQKAKTALKSPSVKRRVDEAYSLAKKTP

SEQ ID NO: 917927 - protein, 376 aa, Homo sapiens
MEFCMVMTWHLSAVESNARSVSNYSPAHCALKANLIDNCMEQMKHINAQLNLDSLRPGKAALKKKEDGVIKELSIAMQLLRNCLYQNEECKEAALEAHLVPVLHSLWPWILMDDSLMQISLQLLCVYTANFPNGCSSLCWSSCGQHPVQATHRGAVSNSLMLCILKLASQMPLENTTVQQMVFMLLSNLALSHDCKGVIQKSNFLQNFLSLALPKGGNKHLSNLTILWLKLLLNISSGEDGQQMILRLDGCLDLLTEMSKYKHKSSPLLPLLIFHNVCFSPANKPKILANEKVITVLAACLESENQNAQRIGAAALWALIYNYQKAKTALKSPSVKRRVDEAYSLAKKTFPNSEANPLNAYYLKCLENLVQLLNSS

SEQ ID NO: 917928 - protein, 593 aa, Homo sapiens
FVTPSLLSAMCSLLDNLLTIAPRDTAKAFRQAHLIELLCSIADATLIQTCVQELRALLPSSPPAEHTQAQVSFLLEYLSSLSRLLQSCLLVEPDLVIQDELVKPLITNIIGILTICTKDVLDKELISAFYHTWTHLFNLLAMLLRKAGAITLPSVTVALAKHWTAAIDMFCTCAGLSATCPALYTASLQFLSVLLTEEAKGHLQAKSKTHLCCSPTVASLLDDSQENQKSLEQLSDVILQCYEGKSSKDILKRVAANALMSLLAVSRRAQKHALKANLIDNCMEQMKHINAQLNLDSLRPGKAALKKKEDGVIKELSIAMQLLRNCLYQNEECKEAALEAHLVPVLHSLWPWILMDDSLMQISLQLLCVYTANFPNGCSSLCWSSCGQHPVQATHRGAVSNSLMLCILKLASQMPLENTTVQQMVFMLLSNLALSHDCKGVIQKSNFLQNFLSLALPKGGNKHLSNLTILWLKLLLNISSGEDGQQMILRLDGCLDLLTEMSKYKHKSSPLLPLLIFHNVCFSPANKPKILANEKVITVLAACLESENQNAQRIGAAALWALIYNYQKAKTALKSPSVKRRVDEAYSLAKKTP

SEQ ID NO: 917929 - protein, 148 aa, Homo sapiens
QGSTMFSVHEQSAHLGLPKPKGSWQDLSDGAIWQLWSLWEACCCQGEAWKIHCNQCQFPLALCFPPPPSLCPPQARVTAVERLLRRALSHLDPANWRDVDVGLWPQIVTILPCPLPAKGIVTHLCEHHKGDVTLFQNGIVARCSGSCL

SEQ ID NO: 917930 - protein, 124 aa, Homo sapiens
IVIITHCMPTSKYPIYPINICTYKLTCEFNNNHESLDEELHLLIISCRKLFYFKIWAFLDVSFVERILKSQKERQCALRVFKARIYTNRYETNEEDKTLQEIYRKYRKLIESELSYFVIVYSVM

SEQ ID NO: 917931 - protein, 133 aa, Homo sapiens
MWGYLSLMPVFLAVWAISGVWIVFAIAVTNRTVDLSKGFPYISICGSFPPQSCIFSQVLNMGAALAAWICIVRYHQLRDWGVRRWPNQLILWTGLLCALGTSVVGNFQVRPSRRPGSVPAGVWNYNSQHAPWP

SEQ ID NO: 917932 - protein, 290 aa, Homo sapiens
ELQKVLFWVRDLNYKLMTAMSSLPGIFPGWHLSYVDVKDNSRDETFHFQCDCWLSKSEGDGQTVRDFACANNKICDELEETTYEIVIETGNGGETRENVWLILEGRKNRSKEFLMENSSRQRAFRKGTTDTFEFDSIYLGDIASLCVGHLAREDRFIPKRELAWHVKTITITEMEYGNVYFFNCDCLIPLKRKRKYFKVFEVTKTTESFASKVQSLVPVKYEVIVTTGYEPGAGTDANVFVTIFGANGDTGKRELKQKMRNLFERGSTDRFFLETLELVVTRLGLAAECG

SEQ ID NO: 917933 - protein, 477 aa, Homo sapiens
MWFLERLRGSGENGAARGVGSEAGDKASKGPLYSNVLTPDKIPDFFIPPKLPSGPAEGEGQAALGPSTSEQNLASAAPRQTPRSPRLPAKLAAESKSLLKAATRHVIQIESAEDWLSEEATDADPQAQGAMSLPSVPKAQTSYGFAMLAESPHTRRKESLFHSEHGALAQVGSPGAGRRRAAAKANGGDGGPREAGGALMSPGRYFSGGESDTGSSAESSPFGSPLLSRSVSLLKGFAQDSQAKVSQLRHSVGRHGSLSADDSTPDASPGSRRRLTRRAPPEPGPESGQARGEHTVHVGPRGSVRLLAEYEAGQARLRVHLLAAEGLYDRLCDARSINCCVGLCLVPGKLQKQRSTIVKNSRRPVFNEDFFFDGLGPASVRKLALRIKVVNKGSSLKRDTLLGEKELPLTSLLPFLPSHSSLGCTGVCVCVPGERLQALEYSCLCAGVCTCKHNESTVCTSSIPGATERSAPVGAVR

SEQ ID NO: 917934 - protein, 155 aa, Homo sapiens
MQLSPWNVHVHGVETGFHHVSQDGLHLLTLVNYHTQKRQVRSNLVRSSGSDGDFGTEGQSVKSPCQDLISIHERCISQGLPAAVLAILDQAGEQELSLLVFPFSATRVATHAKWRRRACCVRAPDSHRLLFTFPIGSAHYAVGTKTPGVCYGQGR

SEQ ID NO: 917935 - protein, 356 aa, Homo sapiens
MQILSRCQGLMSEECGRTTALAAGRTRKGAGEEGLVSPEGAGDEDSCSSSAPLSPSSSPRSMASGSGCPPGKCVCNSCGLEIVDKYLLKVNDLCWHVRCLSCSVCRTSLGRHTSCYIKDKDIFCKLDYFRRYGTRCSRCGRHIHSTDWVRRAKGNVYHLACFACFSCKRQLSTGEEFALVEEKVLCRVHYDCMLDNLKREVENGNGISVEGALLTEQDVNHPKPAKRARTSFTADQLQVMQAQFAQDNNPDAQTLQKLAERTGLSRRVIQVWFQNCRARHKKHVSPNHSSSTPVTAVPPSRLSPPMLEEMAYSAYVPQDGTMLTALHSYMDAHSPTTLGLQPLLPHSMTQLPISHT

SEQ ID NO: 917936 - protein, 376 aa, Homo sapiens
KSSLNLRHGDCNLGDEASSLRRSQVHCQGLMSEECGRTTALAAGRTRKGAGEEGLVSPEGAGDEDSCSSSAPLSPSSSPRSMASGSGCPPGKCVCNSCGLEIVDKYLLKVNDLCWHVRCLSCSVCRTSLGRHTSCYIKDKDIFCKLDYFRRYGTRCSRCGRHIHSTDWVRRAKGNVYHLACFACFSCKRQLSTGEEFALVEEKVLCRVHYDCMLDNLKREVENGNGISVEGALLTEQDVNHPKPAKRARTSFTADQLQVMQAQFAQDNNPDAQTLQKLAERTGLSRRVIQVWFQNCRARHKKHVSPNHSSSTPVTAVPPSRLSPPMLEEMAYSAYVPQDGTMLTALHSYMDAHSPTTLGLQPLLPHSMTQLPISHT

SEQ ID NO: 917937 - protein, 1156 aa, Homo sapiens
SGSAQPRPPAAPRGPSRPSGRRLLLEPRAPPAPRAPDAMKQLCLCAAASFASQDWGKSDERLLQAVENNDAPRVAALIARKGLVPTKLDPEGKSAFHLAAMRGAASCLEVMIAHGSNVMSADGAGYNALHLAAKYGHPQCLKQLLQASCVVDVVDSSGWTALHHAAAGGCLSCSEVLCSFKAHLNPQDRSGATPLIIAAQMCHTDLCRLLLQQGAAANDQDLQGRTALMLACEGASPETVEVLLQGGAQPGITDALGQDAAHYGALAGDKLILHLLQEAAQRPSPPSALTEDDSGEASSQNSMSSHGKQGAPKKRKAPPPPASIPMPDDRDAYEEIVRLRQERGRLLQKIRGLEQHKEQRQQESPEASSLHILERQVQELQQLLVERQEEKESLGREVESLQSRLSLLENERENTSYDVTTLQDEEGELPDLPGAEVLLSRQLSPSAQEHLASLQEQVAVLTRQNQELMEKVQILENFEKDETQMEVEALAEVIPLALYDSLRAEFDQLRRQHAEALQALRQQETREVPREEGAACGESEVAGATATKNGPTHMELNGSVAPETKVNGAETIDEEAAGDETMEARTMEAEATGAEATGAEATGAKVTETKPTGAEVREMETTEEEANMETKPTGAQATDTETTGVEAMGVEATKTKAEEAEMQAYGVGAGQAEPPVTGTTNMEATGSRATGMESTGVSATGVENPGVEATVPGISAGPILHPGAAEASEKLQVELETRIRGLEEALRQREREAAAELEAALGKCEAAEAEAGRLRERVREAEGSGASGGGGGDTTQLRAALEQAREDLRDRDSRLRELEAASACLDEARASRLLAEEEARGLRAELAQREEARLEQSRELEVLREQLATARATGEQQRTAAAELGRARDAAEARVAELPAACEEARQGLAELREASEALRQSVVPASEHRRLQEEALELRGRAASLEQEVVATGKEAARLRAELERERVCSVALSEHERIVGTLQANVAQLEGQLEELGRRHEKTSAEVFQVQREALFMKSERHAAEAQLATAEQQLRGLRTEAERARQAQSRAQEALDKAKEKDKKITELSKEVFNLKEALKEQPAALATPEVEALRDQVKDLQQQLQEAARDHSSVVALYRSHLLYAIQGQMDEDVQRILSQILQMQRLQAQGR

SEQ ID NO: 917938 - protein, 1117 aa, Homo sapiens
MKTLRARFKKTESQDWGKSDERLLQAVENNDAPRVAALIARKGLVPTKLDPEGKSAFHLAAMRGAASCLEVMIAHGSNVMSADGAGYNALHLAAKYGHPQCLKQLLQASCVVDVVDSSGWTALHHAAAGGCLSCSEVLCSFKAHLNPQDRSGATPLIIAAQMCHTDLCRLLLQQGAAANDQDLQGRTALMLACEGASPETVEVLLQGGAQPGITDALGQDAAHYGALAGDKLILHLLQEAAQRPSPPSALTEDDSGEASSQNSMSSHGKQGAPKKRKAPPPPASIPMPDDRDAYEEIVRLRQERGRLLQKIRGLEQHKEQRQQESPEASSLHILERQVQELQQLLVERQEEKESLGREVESLQSRLSLLENERENTSYDVTTLQDEEGELPDLPGAEVLLSRQLSPSAQEHLASLQEQVAVLTRQNQELMEKVQILENFEKDETQMEVEALAEVIPLALYDSLRAEFDQLRRQHAEALQALRQQETREVPREEGAACGESEVAGATATKNGPTHMELNGSVAPETKVNGAETIDEEAAGDETMEARTMEAEATGAEATGAEATGAKVTETKPTGAEVREMETTEEEANMETKPTGAQATDTETTGVEAMGVEATKTKAEEAEMQAYGVGAGQAEPPVTGTTNMEATGSRATGMESTGVSATGVENPGVEATVPGISAGPILHPGAAEASEKLQVELETRIRGLEEALRQREREAAAELEAALGKCEAAEAEAGRLRERVREAEGSGASGGGGGDTTQLRAALEQAREDLRDRDSRLRELEAASACLDEARASRLLAEEEARGLRAELAQREEARLEQSRELEVLREQLATARATGEQQRTAAAELGRARDAAEARVAELPAACEEARQGLAELREASEALRQSVVPASEHRRLQEEALELRGRAASLEQEVVATGKEAARLRAELERERVCSVALSEHERIVGTLQANVAQLEGQLEELGRRHEKTSAEVFQVQREALFMKSERHAAEAQLATAEQQLRGLRTEAERARQAQSRAQEALDKAKEKDKKITELSKEVFNLKEALKEQPAALATPEVEALRDQVKDLQQQLQEAARDHSSVVALYRSHLLYAIQGQMDEDVQRILSQILQMQRLQAQGR

SEQ ID NO: 917939 - protein, 864 aa, Homo sapiens
AQPNSQNWNSMSSHGKQGAPKKRKAPPPPASIPMPDDRDAYEEIVRLRQERGRLLQKIRGLEQHKEQRQQESPEASSLHILERQVQELQQLLVERQEEKESLGREVESLQSRLSLLENERENTSYDVTTLQDEEGELPDLPGAEVLLSRQLSPSAQEHLASLQEQVAVLTRQNQELMEKVQILENFEKDETQMEVEALAEVIPLALYDSLRAEFDQLRRQHAEALQALRQQETREVPREEGAACGESEVAGATATKNGPTHMELNGSVAPETKVNGAETIDEEAAGDETMEARTMEAEATGAEATGAEATGAKVTETKPTGAEVREMETTEEEANMETKPTGAQATDTETTGVEAMGVEATKTKAEEAEMQAYGVGAGQAEPPVTGTTNMEATGSRATGMESTGVSATGVENPGVEATVPGISAGPILHPGAAEASEKLQVELETRIRGLEEALRQREREAAAELEAALGKCEAAEAEAGRLRERVREAEGSGASGGGGGDTTQLRAALEQAREDLRDRDSRLRELEAASACLDEARASRLLAEEEARGLRAELAQREEARLEQSRELEVLREQLATARATGEQQRTAAAELGRARDAAEARVAELPAACEEARQGLAELREASEALRQSVVPASEHRRLQEEALELRGRAASLEQEVVATGKEAARLRAELERERVCSVALSEHERIVGTLQANVAQLEGQLEELGRRHEKTSAEVFQVQREALFMKSERHAAEAQLATAEQQLRGLRTEAERARQAQSRAQEALDKAKEKDKKITELSKEVFNLKEALKEQPAALATPEVEALRDQVKDLQQQLQEAARDHSSVVALYRSHLLYAIQGQMDEDVQRILSQILQMQRLQAQGR

SEQ ID NO: 917940 - protein, 1146 aa, Homo sapiens
SGSAQPRPPAAPRGPSRPSGRRLLLEPRAPPAPRAPDAMKQLCLCAAASFASQDWGKSDERLLQAVENNDAPRVAALIARKGLVPTKLDPEGKSAFHLAAMRGAASCLEVMIAHGSNVMSADGAGYNALHLAAKYGHPQCLKQLLQRQGLTVLAQAAGGCLSCSEVLCSFKAHLNPQDRSGATPLIIAAQMCHTDLCRLLLQQGAAANDQDLQGRTALMLACEGASPETVEVLLQGGAQPGITDALGQDAAHYGALAGDKLILHLLQEAAQRPSPPSALTEDDSGEASSQNSMSSHGKQGAPKKRKAPPPPASIPMPDDRDAYEEIVRLRQERGRLLQKIRGLEQHKEQRQQESPEASSLHILERQVQELQQLLVERQEEKESLGREVESLQSRLSLLENERENTSYDVTTLQDEEGELPDLPGAEVLLSRQLSPSAQEHLASLQEQVAVLTRQNQELMEKVQILENFEKDETQMEVEALAEVIPLALYDSLRAEFDQLRRQHAEALQALRQQETREVPREEGAACGESEVAGATATKNGPTHMELNGSVAPETKVNGAETIDEEAAGDETMEARTMEAEATGAEATGAEATGAKVTETKPTGAEVREMETTEEEANMETKPTGAQATDTETTGVEAMGVEATKTKAEEAEMQAYGVGAGQAEPPVTGTTNMEATGSRATGMESTGVSATGVENPGVEATVPGISAGPILHPGAAEASEKLQVELETRIRGLEEALRQREREAAAELEAALGKCEAAEAEAGRLRERVREAEGSGASGGGGGDTTQLRAALEQAREDLRDRDSRLRELEAASACLDEARASRLLAEEEARGLRAELAQREEARLEQSRELEVLREQLATARATGEQQRTAAAELGRARDAAEARVAELPAACEEARQGLAELREASEALRQSVVPASEHRRLQEEALELRGRAASLEQEVVATGKEAARLRAELERERVCSVALSEHERIVGTLQANVAQLEGQLEELGRRHEKTSAEVFQVQREALFMKSERHAAEAQLATAEQQLRGLRTEAERARQAQSRAQEALDKAKEKDKKITELSKEVFNLKEALKEQPAALATPEVEALRDQVKDLQQQLQEAARDHSSVVALYRSHLLYAIQGQMDEDVQRILSQILQMQRLQAQGR

SEQ ID NO: 917941 - protein, 186 aa, Homo sapiens
MKTLRARFKKTESQDWGKSDERLLQAVENNDAPRVAALIARKGLVPTKLDPEGKSAFHLAAMRGAASCLEVMIAHGSNVMSADGAGYNALHLAAKYGHPQCLKQLLQASCVVDVVDSSGWTALHHAAAGGCLSCSEVLCSFKAHLNPQDRSGATPLIIAAQMCHTDLCRLLLQQGAAANDQDLQGR

SEQ ID NO: 917942 - protein, 128 aa, Homo sapiens
RKIMWEYLTPYSVVIPLMMDSPEKFIQNKIFILEAIILSKLTQEQKTKHLMFQTPHVPTRKWELNNENTWTQGGEHHTLGPVKGWRNITSVPCSYISDTFLETLRFLTWGYQCLVASADRMDKVECSL

SEQ ID NO: 917943 - protein, 210 aa, Homo sapiens
MTVWTGDVVGGGTDSNIFMTLYGINGSTEEMQLDKKKARFEREQNDTFIMEILDIAPFTKMRIRIDGLGSRPEWFLERILLKNMNTGDLTMFYYGDWLSQRKGKKTLVCEMCAVIDEEEMMEWTSYTVAVKTSDILGAGTDANVFIIIFGENGDSGTLALKQSANWNKFERNNTDTFNFPDMLSLGHLCKLRVWHDNKGSSHSRPEPFTI

SEQ ID NO: 917944 - protein, 152 aa, Homo sapiens
MTVWTGDVVGGGTDSNIFMTLYGINGSTEEMQLDKKKARFEREQNDTFIMEILDIAPFTKMRIRIDGLGSRPEWFLERILLKNMNTGDLTMFYYGDWLSQRKGKKTLVCEMCAVIDEEEMMEWTSYTVAEQALMPTCSSSSSGRTGIVGHWP

SEQ ID NO: 917945 - protein, 210 aa, Homo sapiens; identical to SEQ ID NO: 917943

SEQ ID NO: 917946 - protein, 402 aa, Homo sapiens
QHPFHLQLKIREVPRRSCSHQSHGAACEAEAPPTGPPPNWHHCCPCPYSQPHVTLGQKQWWGSQGSVKSLSQLQDKFEHLKMIQQEEIRKLEEEKKQLEGEIIDFYKMKAASEALQTQLSTDTKKDKHPWSRNFVTLTQQVSVAAWIQKSGLVDLKVQIIDLSTIMYGVLIILATAQLAGPMDGENHSVVSEFLFLGLTHSWEIQLLLLVFSSVLYVASITGNILIVFSVTTDPHLHSPMYFLLVSLSFIDLGACSVTSPKMIYDLFRKRKVISFGGCIAQIFFIHVIGGVEMVLLIAMAFDSYVYSRPCLPGYHQQRLENSQDCCLFLPLEVLSQRGTHQMPARALLYEVPVGTYWEVSPSQDTRGSGTHLRRQSDPYQSSNTVQGDLLLSSEPSGFSKML

SEQ ID NO: 917947 - protein, 401 aa, Homo sapiens [sequence omitted]

SEQ ID NO: 917948 - protein, 136 aa, Homo sapiens
MTPPNHCTSPALQSSHLKNGASGLKVFNAPSGWDIRVLGPLSPGPHESSRSSGRSRVPSFPLLPLLSTQPFLKLALKIPHPGTSVQKETGQDSKPAARLPLGVLPHFGMSVRACWLLCMHAGFCAWVYMKLCIYYS

SEQ ID NO: 917949 - protein, 174 aa, Homo sapiens
MVLAGLIRKLGHQLAEIRERALKSILCKIEHNLICYADLIQERQLFLHLLEWFNFPSVPMKEEVLNLLSRLVKYPPAVQHLVDVGAVEFLSKLRSNVEPNLQAEIDGILDGLFLLPSEVPALSSASYQTNQTELSKNPEILTGYFPQDKSNFQQMEVPPRPVVNQTVKCLKFST

SEQ ID NO: 917950 - protein, 172 aa, Homo sapiens
MVLAGLIRKLGHQLAEIRERALKSILCKIEHNLICYADLIQERQLFLHLLEWFNFPSVPMKEEVLNLLSRLVKYPPAVQHLVDVGAVEFLSKLRSNVEPNLQAEIDGILDGLFLLPSEVPALSSASYQTNQTELSKNPEILTGYFPQDKSNFQQMEVPPRPVGVYMSGSKSC

SEQ ID NO: 917951 - protein, 169 aa, Homo sapiens
MSAPPALQIREANAHLAAVHRRAAELEARLDAAERTVHAQAERLALHDQQLRAALDELGRAKDREIATLQEQLMTSEATVHSLQATVHQRDELIRQLQPRAELLQDICRRRPPLAGLLDALAEAERLGPLPASDPGHPPPGGPGPPLDNSTGEEADRDHLQPAVFGTTV

SEQ ID NO: 917952 - protein, 128 aa, Homo sapiens
FCLSMTLEVAGIPGLCGIFIGKRQIFFKLRNTCSMCFSNREENCRRKVTNTLTEKVTFQPDLEVKGAKTLKRRSQDGQIGTAPVYGSQRERCKRRVISAFPSEFQVKMKISTVSLFMPSLKPGSSFSI

SEQ ID NO: 917953 - protein, 262 aa, Homo sapiens
MSWCSSCLILGTHIRLTLWSLELPCKVTCGGWHQQFWRVCQMSMTRCGAPSAEVAGQNGPKLTGVTVGPRRVCASTGRQGSQQPGRAGGAGGSPEWVGARPHCPESQALHQRSPKAERPGSTCLCESEATLRVRHNRPNAARGPRRPRLPWCWLAVGGERRAGKQLCESSEEPVFAPRLLPQGGRWTRSPTPPSVAWVPRASLPGSKLPLGGAHAGADPRRGPGDLGVHQYVHVLERLLAGSRTSLQTLSGLTIRLMEQAEG

SEQ ID NO: 917954 - protein, 412 aa, Homo sapiens
MLIGYTEKPPTVPNEELSRTNIFLPQPCPRVGAWAYKFLQTPGPPDAGQLVTNNDKHQVPWIQTARCLEAYSMCGEWEPSVFLRASAAEGRPSKEGFSGRGETVQGGLQRQRGDRPRRASAAEGRPSKEGFSGRGETIQGRLNHTAFPHCQGVWDLQLGFNLGSQVLSAWVLFAAACSHSSFPCARSQALHVRQPPSARPRVTRALHARPLRPAGGQGPALGSTLPVGLTPPSRPAAGRSDWPPAPFQPSPLPPSATRAPAVPAVPRGSGEAAPRCAPLPLAARAFVWRQLRPQLPLNVERGREGSLSMGHLSPRQPPPHRRPRPALRLPPRRLPQPRRRPRPRPGAAPQRARAQPPPPPPREEPGWSWSTSAISCFQCLALCETELSEWSTRCCVRCDPSASAFSCIVTPS

SEQ ID NO: 917955 - protein, 310 aa, Homo sapiens
MTVRSELLIVPAVVSDLCATGDHDCEQVCISSPGSYTCACHEGFTLNSDGKTCNVCSGGGGSSATDLVFLIDGSKSVRPENFELVKKFISQIVDTLDVSDKLAQVGLVQYSSSVRQEFPLGRFHTKKDIKAAVRNMSYMEKGTMTGAALKYLIDNSFTVSSGARPGAQKVGIVFTDGRSQDYINDAAKKAKDLGFKMFAVGVGNAVEDELREIASEPVAEHYFYTADFKTINQIGKKLQKKICVEEDPCACESLVKFQAKVEGLLQALTRKHIPSQRGLGLGRGAGQCWGRRGHGPSVVSWAGFSWPAYC

SEQ ID NO: 917956 - protein, 133 aa, Homo sapiens
MSSFSALASHPLLPLVVPNVTCNVFHSVSTDWANHLPGVSGLVPKLPWVKKLGTIADAPQLACSVLLGSIVPWLAFQNLPMLDDRRWDMARSCPGIQMVLSGTMLVLTTSWNTAGFFQSNSQMKTAVGSSLLY

SEQ ID NO: 917957 - protein, 1291 aa, Homo sapiens
VGPVPAAWPERLQRRRNQGPEREAQVQGAGEGRIRTGAQHYSTNRSPQKEPGDAAKAVNRGGGTVGAAGSRGWGETCGHVASMAPACQILRWALALGLGLMFEVTHAFRSQDEFLSSLESYEIAFPTRVDHNGALLAFSPPPPRRQRRGTGATAESRLFYKVASPSTHFLLNLTRSSRLLAGHVSVEYWTREGLAWQRAARPHCLYAGHLQGQASSSHVAISTCGGLHGLIVADEEEYLIEPLHGGPKGSRSPEESGPHVVYKRSSLRHPHLDTACGVRDEKPWKGRPWWLRTLKPPPARPLGNETERGQPGLKRSVSRERYVETLVVADKMMVAYHGRRDVEQYVLAIMNIVAKLFQDSSLGSTVNILVTRLILLTEDQPTLEITHHAGKSLDSFCKWQKSIVNHSGHGNAIPENGVANHDTAVLITRYDICIYKNKPCGTLGLAPVGGMCERERSCSVNEDIGLATAFTIAHEIGHTGGQGTQEGEEGRSWAGPSAPGRADTPFPRFGMNHDGVGNSCGARGQDPAKLMAAHITMKTNPFVWSSCSRDYITSFLEEDAPGCPSERVTLMVGQGTRETIEIRDAPWDPHPAEAPELLICSHLAGQLLFSRGSSGLGLCLNNRPPRQDFVYPTVAPGQAYDADEQCRFQHGGGREGGEPERAPRPQEVCSELWCLSKSNRCITNSIPAAEGTLCQTHTIDKGWCYKRVCVPFGSRPEGVDGAWGPWTPWGDCSRTCGGGVSSSSRHCDSPRPTIGGKYCLGERRRHRSCNTDDCPPGSQDFREVQCSEFDSIPFRGKFYKWKTYRGGGVKACSLTCLAEGFNFYTERAAAVVDGTPCRPDTVDICVSGECKHVGCDRVLGSDLREDKCRVCGGDGSACETIEGVFSPASPGAGYEDVVWIPKGSVHIFIQDLNLSLSHLALKGDQESLLLEGLPGTPQPHRLPLAGTTFQLRQGPDQVQSLEALGPINASLIVMVLARTELPALRYRFNAPIARDSLPPYSWHYAPWTKCSAQCAGGSQVQAVECRNQLDSSAVAPHYCSAHSKLPKRQRACNTEPCPPDWVVGNWSLCSRSCDAGVRSRSVVCQRRVSAAEEKALDDSACPQPRPPVLEACHGPTCPPEWAALDWSEVSRPLPSRPLGCPGGVSTETPLRGLQVSCPLLTSHWGSTLSTKRPFQLQCTPSCGPGLRHRVVLCKSADHRATLPPAHCSPAAKPPATMRCNLRRCPPARWVAGEWGECSAQCGVGQRQRSVRCTSHTGQASHECTEALRPPTTQQCEAKCDSPTPGDGPEGT

SEQ ID NO: 917958 - protein, 1184 aa, Homo sapiens
TARRPRARRRLQRRRNQGPEREAQVQGAGEGRIRTGAQHYSTNRSPQKEPGDAAKAVNRGGGTVGAAGSRGWGETCGHVASMAPACQILRWALALGLGLMFEVTHAFRSQDEFLSSLESYEIAFPTRVDHNGALLAFSPPPPRRQRRGTGATAESRLFYKVASPSTHFLLNLTRSSRLLAGHVSVEYWTREGLAWQRAARPHCLYAGHLQGQASSSHVAISTCGGLHGLIVADEEEYLIEPLHGGPKGSRSPEESGPHVVYKRSSLRHPHLDTACGVRDEKPWKGRPWWLRTLKPPPARPLGNETERGQPGLKRSVSRERYVETLVVADKMMVAYHGRRDVEQYVLAIMNIVAKLFQDSSLGSTVNILVTRLILLTEDQPTLEITHHAGKSLDSFCKWQKSIVNHSGHGNAIPENGVANHDTAVLITRYDICIYKNKPCGTLGLAPVGGMCERERSCSVNEDIGLATAFTIAHEIGHTFGMNHDGVGNSCGARGQDPAKLMAAHITMKTNPFVWSSCSRDYITSFLDSGLGLCLNNRPPRQDFVYPTVAPGQAYDADEQCRFQHGVKSRQCKYGEVCSELWCLSKSNRCITNSIPAAEGTLCQTHTIDKGWCYKRVCVPFGSRPEGVDGAWGPWTPWGDCSRTCGGGVSSSSRHCDSPRPTIGGKYCLGERRRHRSCNTDDCPPGSQDFREVQCSEFDSIPFRGKFYKWKTYRGGGVKACSLTCLAEGFNFYTERAAAVVDGTPCRPDTVDICVSGECKHVGCDRVLGSDLREDKCRVCGGDGSACETIEGVFSPASPGAGYEDVVWIPKGSVHIFIQDLNLSLSHLALKGDQESLLLEGLPGTPQPHRLPLAGTTFQLRQGPDQVQSLEALGPINASLIVMVLARTELPALRYRFNAPIARDSLPPYSWHYAPWTKCSAQCAGGSQVQAVECRNQLDSSAVAPHYCSAHSKLPKRQRACNTEPCPPDWVVGNWSLCSRSCDAGVRSRSVVCQRRVSAAEEKALDDSACPQPRPPVLEACHGPTCPPEWAALDWSECTPSCGPGLRHRVVLCKSADHRATLPPAHCSPAAKPPATMRCNLRRCPPARWVAGEWGECSAQCGVGQRQRSVRCTSHTGQASHECTEALRPPTTQQCEAKCDSPTPGDGPEECKDVNKVAYCPLVLKFQFCSRAYFRQMCCKTCQGH

SEQ ID NO: 917959 - protein, 1314 aa, Homo sapiens
TARRPRARRRLQRRRNQGPEREAQVQGAGEGRIRTGAQHYSTNRSPQKEPGDAAKAVNRGGGTVGAAGSRGWGETCGHVASMAPACQILRWALALGLGLMFEVTHAFRSQDEFLSSLESYEIAFPTRVDHNGALLAFSPPPPRRQRRGTGATAESRLFYKVASPSTHFLLNLTRSSRLLAGHVSVEYWTREGLAWQRAARPHCLYAGHLQGQASSSHVAISTCGGLHGLIVADEEEYLIEPLHGGPKGSRSPEESGPHVVYKRSSLRHPHLDTACGVRDEKPWKGRPWWLRTLKPPPARPLGNETERGQPGLKRSVSRERYVETLVVADKMMVAYHGRRDVEQYVLAIMNIVAKLFQDSSLGSTVNILVTRLILLTEDQPTLEITHHAGKSLDSFCKWQKSIVNHSGHGNAIPENGVANHDTAVLITRYDICIYKNKPCGTLGLAPVGGMCERERSCSVNEDIGLATAFTIAHEIGHTGGQGTQEGEEGRSWAGPSAPGRADTPFPRFGMNHDGVGNSCGARGQDPAKLMAAHITMKTNPFVWSSCSRDYITSFLEEDAPGCPSERVTLMVGQGTRETIEIRDAPWDPHPAEAPELLICSHLAGQLLFSRGSSGLGLCLNNRPPRQDFVYPTVAPGQAYDADEQCRFQHGVKSRQCKYGEVCSELWCLSKSNRCITNSIPAAEGTLCQTHTIDKGWCYKRVCVPFGSRPEGVDGAWGPWTPWGDCSRTCGGGVSSSSRHCDSPRPTIGGKYCLGERRRHRSCNTDDCPPGSQDFREVQCSEFDSIPFRGKFYKWKTYRGGGVKACSLTCLAEGFNFYTERAAAVVDGTPCRPDTVDICVSGECKHVGCDRVLGSDLREDKCRVCGGDGSACETIEGVFSPASPGAGYEDVVWIPKGSVHIFIQDLNLSLSHLALKGDQESLLLEGLPGTPQPHRLPLAGTTFQLRQGPDQVQSLEALGPINASLIVMVLARTELPALRYRFNAPIARDSLPPYSWHYAPWTKCSAQCAGGSQVQAVECRNQLDSSAVAPHYCSAHSKLPKRQRACNTEPCPPDWVVGNWSLCSRSCDAGVRSRSVVCQRRVSAAEEKALDDSACPQPRPPVLEACHGPTCPPEWAALDWSECTPSCGPGLRHRVVLCKSADHRATLPPAHCSPAAKPPATMRCNLRRCPPARWVAGEWGECSAQCGVGQRQRSVRCTSHTGQASHECTEALRPPTTQQCEAKCDSPTPGDGPEGGARHPEPQLAGSPPPALQRAGQRGPRGGGNWEGRVRRSRKLFIGNPPRAPLQHPPLPVHIVRPPLQGGSGEGTAVHPSTL

SEQ ID NO: 917960 - protein, 68 aa, Homo sapiens
AQPPGTALKWVTSQGAPGGSWPEAATEGIGGPDFILELLEPRKCIAVSLPGHPSPSPPCKHLLSATVC

SEQ ID NO: 917961 - protein, 113 aa, Homo sapiens
GQVAKLFQDSSLGSTVNILVTRLILLTEDQVLGDFLPFPFPFIPACPAVPWVVGAHAFPSVHPQPTLEITHHAGKSLDSFCKWQKSIVNHSGHGNAIPENGVANHDTAVLITR

SEQ ID NO: 917962 - protein, 240 aa, Homo sapiens
SDPASAHPGEADISGWGLEWGTVHGADECPPGWTHSFLSPPTQWCYKRVCVPFGSRPEGVDGAWGPWTPWGDCSRTCGGGVSSSSRHCDSPRPTIGGKYCLGERRRHRSCNTDDCPPGSQDFREVQCSEFDSIPFRGKFYKWKTYRGGGVKACSLTCLAEGFNFYTERAAAVVDGTPCRPDTVDICVSGECKHVGCDRVLGSDLREDKCRVCGGDGSACETIEGVFSPASPGAGESLQLP

SEQ ID NO: 917963 - protein, 839 aa, Homo sapiens
MFLGGQVAKLFQDSSLGSTVNILVTRLILLTEDQPTLEITHHAGKSLDSFCKWQKSIVNHSGHGNAIPENGVANHDTAVLITRYDICIYKNKPCGTLGLAPVGGMCERERSCSVNEDIGLATAFTIAHEIGHTFGMNHDGVGNSCGARGQDPAKLMAAHITMKTNPFVWSSCSRDYITSFLDSGLGLCLNNRPPRQDFVYPTVAPGQAYDADEQCRFQHGVKSRQCKYGEVCSELWCLSKSNRCITNSIPAAEGTLCQTHTIDKGWCYKRVCVPFGSRPEGVDGAWGPWTPWGDCSRTCGGGVSSSSRHCDSPRPTIGGKYCLGERRRHRSCNTDDCPPGSQDFREVQCSEFDSIPFRGKFYKWKTYRGGGVKACSLTCLAEGFNFYTERAAAVVDGTPCRPDTVDICVSGECKHVGCDRVLGSDLREDKCRVCGGDGSACETIEGVFSPASPGAGYEDVVWIPKGSVHIFIQDLNLSLSHLALKGDQESLLLEGLPGTPQPHRLPLAGTTFQLRQGPDQVQSLEALGPINASLIVMVLARTELPALRYRFNAPIARDSLPPYSWHYAPWTKCSAQCAGGSQVQAVECRNQLDSSAVAPHYCSAHSKLPKRQRACNTEPCPPDWVVGNWSLCSRSCDAGVRSRSVVCQRRVSAAEEKALDDSACPQPRPPVLEACHGPTCPPEWAALDWSECTPSCGPGLRHRVVLCKSADHRATLPPAHCSPAAKPPATMRCNLRRCPPARWVAGEWGECSAQCGVGQRQRSVRCTSHTGQASHECTEALRPPTTQQCEAKCDSPTPGDGPEECKDVNKVAYCPLVLKFQFCSRAYFRQMCCKTCQGH

SEQ ID NO: 917964 - protein, 1247 aa, Homo sapiens
TARRPRARRRLQRRRNQGPEREAQVQGAGEGRIRTGAQHYSTNRSPQKEPGDAAKAVNRGGGTVGAAGSRGWGETCGHVASMAPACQILRWALALGLGLMFEVTHAFRSQDEFLSSLESYEIAFPTRVDHNGALLAFSPPPPRRQRRGTGATAESRLFYKVASPSTHFLLNLTRSSRLLAGHVSVEYWTREGLAWQRAARPHCLYAGHLQGQASSSHVAISTCGGLHGLIVADEEEYLIEPLHGGPKGSRSPEESGPHVVYKRSSLRHPHLDTACGVRDEKPWKGRPWWLRTLKPPPARPLGNETERGQPGLKRSVSRERYVETLVVADKMMVAYHGRRDVEQYVLAIMNIVAKLFQDSSLGSTVNILVTRLILLTEDQPTLEITHHAGKSLDSFCKWQKSIVNHSGHGNAIPENGVANHDTAVLITRYDICIYKNKPCGTLGLAPVGGMCERERSCSVNEDIGLATAFTIAHEIGHTGGQGTQEGEEGRSWAGPSAPGRADTPFPRFGMNHDGVGNSCGARGQDPAKLMAAHITMKTNPFVWSSCSRDYITSFLEEDAPGCPSERVTLMVGQGTRETIEIRDAPWDPHPAEAPELLICSHLAGQLLFSRGSSGLGLCLNNRPPRQDFVYPTVAPGQAYDADEQCRFQHGVKSRQCKYGEVCSELWCLSKSNRCITNSIPAAEGTLCQTHTIDKGWCYKRVCVPFGSRPEGVDGAWGPWTPWGDCSRTCGGGVSSSSRHCDSPRPTIGGKYCLGERRRHRSCNTDDCPPGSQDFREVQCSEFDSIPFRGKFYKWKTYRGGGVKACSLTCLAEGFNFYTERAAAVVDGTPCRPDTVDICVSGECKHVGCDRVLGSDLREDKCRVCGGDGSACETIEGVFSPASPGAGYEDVVWIPKGSVHIFIQDLNLSLSHLALKGDQESLLLEGLPGTPQPHRLPLAGTTFQLRQGPDQVQSLEALGPINASLIVMVLARTELPALRYRFNAPIARDSLPPYSWHYAPWTKCSAQCAGGSQVQAVECRNQLDSSAVAPHYCSAHSKLPKRQRACNTEPCPPDWVVGNWSLCSRSCDAGVRSRSVVCQRRVSAAEEKALDDSACPQPRPPVLEACHGPTCPPEWAALDWSECTPSCGPGLRHRVVLCKSADHRATLPPARWVAGEWGECSAQCGVGQRQRSVRCTSHTGQASHECTEALRPPTTQQCEAKCDSPTPGDGPEECKDVNKVAYCPLVLKFQFCSRAYFRQMCCKTCQGH

SEQ ID NO: 917965 - protein, 280 aa, Homo sapiens
MATEAPVNIAPPECSTVVSTAVDSLIWQPNSLNMHMIRPKSAKGRTRPSLQKSQGVEVCAHHIPSPPPAIPYELPSSQKPGACAPKSPNQGASDEIPELQQQVPTGASSSLNKYPVLPSINRKNLEEEAVETVAKKASSLQLSSIRALYQDETGTMKTSEEDSRARACAVERKFIVRTKKQGSSRAGNLEEPSDQEPRLLLAVRSPTGQRFVRHFRPTDDLQTIVAVAEQKNKTSYRHCSIETMEVPRRRFSDLTKSLQECRIPHKSVLGISLEDGEGWP

SEQ ID NO: 917966 - protein, 280 aa, Homo sapiens; identical to SEQ ID NO: 917965

SEQ ID NO: 917967 - protein, 320 aa, Homo sapiens; identical to SEQ ID NO: 820635

SEQ ID NO: 917968 - protein, 320 aa, Homo sapiens; identical to SEQ ID NO: 820635

SEQ ID NO: 917969 - protein, 282 aa, Homo sapiens
MSKSESPKEPEQLRKLFIGGLSFETTDESLRSHFEQWGTLTDCVVMRDPNTKRSRGFGFVTYATVEEVDAAMNARPHKVDGRVVEPKRAVSREDSQRPGAHLTVKKIFVGGIKEDTEEHHLRDYFEQYGKIEVIEIMTDRGSGKKRGFAFVTFDDHDSVDKIVIQKYHTVNGHNCEVRKALSKQEMASASSSQRGRSGSGNFGGGRGGGFGGNDNFGRGGNFSGRGMYGFVHVVVTSHHLGYEDCTVRELHSECHLKSKSELELETFSYKVTLVAAVVVMLK

SEQ ID NO: 917970 - protein, 320 aa, Homo sapiens; identical to SEQ ID NO: 820635

SEQ ID NO: 917971 - protein, 320 aa, Homo sapiens; identical to SEQ ID NO: 820635

SEQ ID NO: 917972 - protein, 239 aa, Homo sapiens
MSKSESPKEPEQLRKLFIGGLSFETTDESLRSHFEQWGTLTDCVVMRDPNTKRSRGFGFVTYATVEEVDAAMNARPHKVDGRVVEPKRAVSREDSQRPGAHLTVKKIFVGGIKEDTEEHHLRDYFEQYGKIEVIEIMTDRGSGKKRGFAFVTFDDHDSVDKIVIQKYHTVEVVSVGMTTSVVEETSVVVVALVAAVVVVDMVAVGMAIMDLVMMEAILEVVEATMILGITTISLQILDP

SEQ ID NO: 917973 - protein, 193 aa, Homo sapiens
SEAASVAAEGCGGPGRVADSELHLGFGVRVSGKATRSRGGSGAGGGRLRRSRPMRKLFSFGRRPGRAVLGSIDHEYPGPAYHTRDAELRKIHRAALKGDAAEVERRLARRCRDVDAQDRTVLHLACAHGRVQVVTLLLSRKCQIDICDRLNRTPLMKAVYCQEETCSIILLEHGTSPNIKDVYSNTALHDGKH

SEQ ID NO: 917974 - protein, 178 aa, Homo sapiens
PNEMNQWSFNSEVGVGAPAITNNTRANCESVSVAISLAAAHPITKELNGLEEIHKYIFEAIATIDNDLFDGFVPSKLKTFWKGFTILDAIKNICDSWEKVKISRLTGVWKKLILTLMDDFEGFKTLMKEVTADVVEIARELELEVKLKMFGAWNADLDLETSPDESKNDEATVSMKVG

SEQ ID NO: 917975 - protein, 178 aa, Homo sapiens; identical to SEQ ID NO: 917974

SEQ ID NO: 917976 - protein, 261 aa, Homo sapiens
MVPRGSPLSPRLGAEREGTLLPNPRLGTPRESLPPHLHGIWPPPAPAWLPDIPAVAPLHGESHLLINTFGSRGQGRTASSSVPDSPGSDRMSSMFCQFQQGVLRLFNLCRQTHPPTRAAARSGDCGPLLTVPRGPNTYPPTHTLPVPGKHTLAARGTLRKSHGRGCQYHLGPALTFYPPLLAISRGGCTSDGDSAEWTENLGQTASGFLESQISQTEPSGRQRGSDQWTEKGRLSVSRKCQGLHATANLCQMTNALKGSKG

SEQ ID NO: 917977 - protein, 551 aa, Homo sapiens
MIGSFLRPPQPCRTRALLSGSDAVLKCDHPMALWYFSSILGEDPSLLNSMPDIRKLPGGSLQLTNPQPSQTGLYRCQGNDDTLMVQYEIDFQVVTTLHVTHKSLDQKSLQNETLILDGKVLIFTHWDPRQDCNRCGELGECRRLGYCYIEEPVEKPMPCQLYLRDEKMQFSRMRPELQPQSTMPPMLWLLLHFAAPALGFYFSISCPSGKQCQQALLSGNDILLYCNSSGAHWYYLFTQGKKGRLTSLTNISNMEIMPEGSLLIKDPLPSQTGLYHCWNKNGRQVVQYEIDFQDVTTLHITHKDLGQRPLQNETLHLGSKQLIFTWWEPWQDCNRCEEPGECKRLGYRYIEEPLEEAMPCWLYLGEVLVWSSRLRPELQVEACHVQCTNNTQLRVDYVIFDNFRLDEKTEFVWLDCPLGSMYRPVNWRANDTPLTWESQLSGQDFTTFLDPSTGGRQLQVFQPAVYKCFVQQELVAQFKPAASLETLEAQWRENDAQWREARKALRGRADSVLKGLKLVLLVVTVLALLGALLKCIHPSPGRRSTQVLVVK

SEQ ID NO: 917978 - protein, 181 aa, Homo sapiens
LPCKSWKPQTPGAKQSPGGRMAVSCRLPCRYPSTQFGSLTGLQSLISALFALLQQPLFLAMMGPLQGDPLWVNVGLLLLSLLGFCLPLYLICYRRQLERQLQQRQEDDKLFLKINGSSNQEAFVREPPGLQLGQCPGAILAWGQELVQGHRPTAPPAGGLRGALELMTGEARPPGPPTRPP

SEQ ID NO: 917979 - protein, 324 aa, Homo sapiens
VFTQRVRRQRSRGPSVARASEGLGAGAGAGARRHRSHPGLSAATGGPGFEMASPPRCSPTAHDRECKLPPPSAPASEYCPGKLSWGTMARALGRFKLSIPHTHLLATLDPLALDREPPPHLLPEKHQVPEKLIWGDQDPLSKIPFKILSGHEHAVSTCHFCVDDTKLLSGSYDCTVKLWDPVDGSVVRDFEHRPKAPVVECSITGDSSRVIAASYDKTVRAWDLETGKLLWKVRYDTFIVSCKFSPDGKYVVSGFDVDHGICIMDAENITTVSVIKDHHTRSITSCCFDPDSQRVASVSLDRCIKIWDVTSQATLLTITKFLNL

SEQ ID NO: 917980 - protein, 170 aa, Homo sapiens
QRKAAGHLGLPQHSAEMVESTRSALIMLDTIVQAMAASLPTLHNGPLSAKKISDTILGVSETGYHSGPQCTHSFLERVFIHRNPRNLGQALGLLRGGKTNKQTNKGERRRLRNKERTEEWSKRKEGRETGRNKREADIHILDKAPGRELSEEKKEAGPCRPTSGLSSICW

SEQ ID NO: 917981 - protein, 156 aa, Homo sapiens
LENAIKFLNRNAYIMIAIYGRNFCRSAKDAFNLLMRNVLKVAVTDEVTYFVLFLGKLLVAGSIGVLAFLFFTQRLPVIAQGPASLNYYWVPLLTVIFGSYLIAHGFFSVYAMCVETIFICFLEDLERNDGSTARPYYVSQPLLKIFQEENPQTRKQ

SEQ ID NO: 917982 - protein, 180 aa, Homo sapiens
MVCGRIRARAPGAAGPAPSDRSLFVRGGRWALGVVLGLAGAQTAERTRPQCSCKRPPRAASLVPAPQSLLCPAPADAETGRSCFGPVLLASPEWPLTHWSAIVLVSSVQGAPGLATLPGAPQPCPEEGNQELACTQDPQECGPGPKRFQEKSPSGTTLTLTFAFAGGECAWAWMFTWTGI

SEQ ID NO: 917983 - protein, 147 aa, Homo sapiens
MDYIVKAGHIQALPCGTVRRGLPPSRPQNGRSTNSLHCVPAKATDTQCQPVKAAGRAAVPCKATRVELSKAEVAHLLYQHELKVEVKEPAKLHQNQNGNESDFWSSSLLHSHQRRDSLQMPAQQVNAENCSLLERKPTSKSNTGNQH

SEQ ID NO: 917984 - protein, 151 aa, Homo sapiens [sequence omitted]

SEQ ID NO: 917985 - protein, 178 aa, Homo sapiens
MVVTEQTSQTPVAGPVKICFNFLLMLSSRVWPCVLLSLMRNNNDKDHESSRYHSDNEVPFSVLVILKENGKGASLRDPGPAGLYGLTGKGAYLLGENALCAHIHAIDLEKEFLKSPALTGHLELLTSPTPQHSSRIKGFFHEHEFYKGSQEQAWAWLDCTVQELGNLKEYGVVCAPDN

SEQ ID NO: 917986 - protein, 139 aa, Homo sapiens
SRAAAYYYYIRGRVDHQRIHTGEKPYVCQECGKAFTQSSCLSIHRRVHTGEKPYRCGECGKAFAQKANLTQHQRIHTGEKPYSCNVCGKAFVLSAHLNQHLRVHTQETLYQCQRCQKAFRCHSSLSRHQRVHNKQQYCL

SEQ ID NO: 917987 - protein, 871 aa, Homo sapiens
MAEEFVTLKDVGMDFTLGDWEQLGLEQGDTFWDTALDNCQDLFLLDPPRPNLTSHPDGSEDLEPLAGGSPEATSPDVTETKNSPLMEDFFEEGFSQEIIEMLSKDGFWNSNFGEACIEDTWLDSLLGDPESLLRSDIATNGESPTECKSHELKRGLSPVSTVSTGEDSMVHNVSEKTLTPAKSKEYRGEFFSYSDHSQQDSVQEGEKPYQCSECGKSFSGSYRLTQHWITHTREKPTVHQECEQGFDRNASLSVYPKTHTGYKFYVCNEYGTTFSQSTYLWHQKTHTGEKPCKSQDSDHPPSHDTQPGEHQKTHTDSKSYNCNECGKAFTRIFHLTRHQKIHTRKRYECSKCQATFNLRKHLIQHQKTHAAKTTSECQECGKIFRHSSLLIEHQALHAGEEPYKCNERGKSFRHNSTLKIHQRVHSGEKPYKCSECGKAFHRHTHLNEHRRIHTGYRPHKCQECVRSFSRPSHLMRHQAIHTAEKPYSCAECKETFSDNNRLVQHQKMHTVKTPYECQECGERFICGSTLKCHESVHAREKQGFFVSGKILDQNPEQKEKCFKCNKCEKTFSCSKYLTQHERIHTRGVKPFECDQCGKAFGQSTRLIHHQRIHSRVRLYKWGEQGKAISSASLIKLQSFHTKEHPFKCNECGKTFSHSAHLSKHQLIHAGENPFKCSKCDRVFTQRNYLVQHERTHARKKPLVCNECGKTFRQSSCLSKHQRIHSGEKPYVCDYCGKAFGLSAELVRHQRIHTGEKPYVCQECGKAFTQSSCLSIHRRVHTGEKPYRCGECGKAFAQKANLTQHQRIHTGEKPYSCNVCGKAFVLSAHLNQHLRVHTQETLYQCQRCQKAFRCHSSLSRHQRVHNKQQYCL

SEQ ID NO: 917988 - protein, 871 aa, Homo sapiens; identical to SEQ ID NO: 917987

SEQ ID NO: 917989 - protein, 139 aa, Homo sapiens; identical to SEQ ID NO: 917986

SEQ ID NO: 917990 - protein, 871 aa, Homo sapiens; identical to SEQ ID NO: 917987

SEQ ID NO: 917991 - protein, 587 aa, Homo sapiens
MAEEFVTLKDVGMDFTLGDWEQLGLEQGDTFWDTALDNCQDLFLLDPPRPNLTSHPDGSEDLEPLAGGSPEATSPDVTETKNSPLMEDFFEEGFSQEIIEMLSKDGFWNSNFGEACIEDTWLDSLLGDPESLLRSDIATNGESPTECKSHELKRGLSPVSTVSTGEDSMVHNVSEKTLTPAKSKEYRGEFFSYSDHSQQDSVQEGEKPYQCSECGKSFSGSYRLTQHWITHTREKPTVHQECEQGFDRNASLSVYPKTHTGYKFYVCNEYGTTFSQSTYLWHQKTHTGEKPCKSQDSDHPPSHDTQPGEHQKTHTDSKSYNCNECGKAFTRIFHLTRHQKIHTRKRYECSKCQATFNLRKHLIQHQKTHAAKTTSECQECGKIFRHSSLLIEHQALHAGEEPYKCNERGKSFRHNSTLKIHQRVHSGEKPYKCSECGKAFHRHTHLNEHRRIHTGYRPHKCQECVRSFSRPSHLMRHQAIHTAEKPYSCAECKETFSDNNRLVQHQKMHTVKTPYECQECGERFICGSTLKCHESVHAREKQGFFVSGKILDQNPEQKEKCFKCNKCEKTFSCSKYLTQHERIHTRE

SEQ ID NO: 917992 - protein, 129 aa, Homo sapiens
ILRLQPAFPQVYRDITTLSFRTSLCFSLASIPLSWELGGSGHFYRPSLWGLSTLPFSTGLSWCLSTAPPLSFQTQQGYALHSLSWSLYFPALCSLSVLTLILLLLPPFLQAHFSFLSLGHSRWPHQGVT

SEQ ID NO: 917993 - protein, 944 aa, Homo sapiens
MQVGATSAKGRLTLGLVLLLLDILGARQHGQRVSHGWKGGFLTAPLCFPQPCQPGTRRGRRRSLKEATEPQLAMAEEFVTLKDVGMDFTLGDWEQLGLEQGDTFWDTALDNCQDLFLLDPPRPNLTSHPDGSEDLEPLAGGSPEATSPDVTETKNSPLMEDFFEEGFSQEIIEMLSKDGFWNSNFGEACIEDTWLDSLLGDPESLLRSDIATNGESPTECKSHELKRGLSPVSTVSTGEDSMVHNVSEKTLTPAKSKEYRGEFFSYSDHSQQDSVQEGEKPYQCSECGKSFSGSYRLTQHWITHTREKPTVHQECEQGFDRNASLSVYPKTHTGYKFYVCNEYGTTFSQSTYLWHQKTHTGEKPCKSQDSDHPPSHDTQPGEHQKTHTDSKSYNCNECGKAFTRIFHLTRHQKIHTRKRYECSKCQATFNLRKHLIQHQKTHAAKTTSECQECGKIFRHSSLLIEHQALHAGEEPYKCNERGKSFRHNSTLKIHQRVHSGEKPYKCSECGKAFHRHTHLNEHRRIHTGYRPHKCQECVRSFSRPSHLMRHQAIHTAEKPYSCAECKETFSDNNRLVQHQKMHTVKTPYECQECGERFICGSTLKCHESVHAREKQGFFVSGKILDQNPEQKEKCFKCNKCEKTFSCSKYLTQHERIHTRGVKPFECDQCGKAFGQSTRLIHHQRIHSRVRLYKWGEQGKAISSASLIKLQSFHTKEHPFKCNECGKTFSHSAHLSKHQLIHAGENPFKCSKCDRVFTQRNYLVQHERTHARKKPLVCNECGKTFRQSSCLSKHQRIHSGEKPYVCDYCGKAFGLSAELVRHQRIHTGEKPYVCQECGKAFTQSSCLSIHRRVHTGEKPYRCGECGKAFAQKANLTQHQRIHTGEKPYSCNVCGKAFVLSAHLNQHLRVHTQETLYQCQRCQKAFRCHSSLSRHQRVHNKQQYCL

SEQ ID NO: 917994 - protein, 891 aa, Homo sapiens
MDFTLGDWEQLGLEQGDTFWDTALDNCQDLFLLGFSQESSQPAVSPSSAHQCHTVRQQQGPDSSSDPPRPNLTSHPDGSEDLEPLAGGSPEATSPDVTETKNSPLMEDFFEEGFSQEIIEMLSKDGFWNSNFGEACIEDTWLDSLLGDPESLLRSDIATNGESPTECKSHELKRGLSPVSTVSTGEDSMVHNVSEKTLTPAKSKEYRGEFFSYSDHSQQDSVQEGEKPYQCSECGKSFSGSYRLTQHWITHTREKPTVHQECEQGFDRNASLSVYPKTHTGYKFYVCNEYGTTFSQSTYLWHQKTHTGEKPCKSQDSDHPPSHDTQPGEHQKTHTDSKSYNCNECGKAFTRIFHLTRHQKIHTRKRYECSKCQATFNLRKHLIQHQKTHAAKTTSECQECGKIFRHSSLLIEHQALHAGEEPYKCNERGKSFRHNSTLKIHQRVHSGEKPYKCSECGKAFHRHTHLNEHRRIHTGYRPHKCQECVRSFSRPSHLMRHQAIHTAEKPYSCAECKETFSDNNRLVQHQKMHTVKTPYECQECGERFICGSTLKCHESVHAREKQGFFVSGKILDQNPEQKEKCFKCNKCEKTFSCSKYLTQHERIHTRGVKPFECDQCGKAFGQSTRLIHHQRIHSRVRLYKWGEQGKAISSASLIKLQSFHTKEHPFKCNECGKTFSHSAHLSKHQLIHAGENPFKCSKCDRVFTQRNYLVQHERTHARKKPLVCNECGKTFRQSSCLSKHQRIHSGEKPYVCDYCGKAFGLSAELVRHQRIHTGEKPYVCQECGKAFTQSSCLSIHRRVHTGEKPYRCGECGKAFAQKANLTQHQRIHTGEKPYSCNVCGKAFVLSAHLNQHLRVHTQETLYQCQRCQKAFRCHSSLSRHQRVHNKQQYCL

SEQ ID NO: 917995 - protein, 871 aa, Homo sapiens; identical to SEQ ID NO: 917987

SEQ ID NO: 917996 - protein, 113 aa, Homo sapiens
PGVPNACGWAGGEVLAGPPCSFWRLQHVDSPSWPVASFWRSPVLLDSWLLSLQRQQWRFLRCGLYPSWMVTLFPSLGKLVEGMAQDCLGSGTLTFSVPGPWRPQAMCGPWVSE

SEQ ID NO: 917997 - protein, 136 aa, Homo sapiens
MTLGKASPGLSGSQALGLCVCQSFPQTREEVKELSLRPCLDKTRRRTQSQRPRGRDRGKKKGPPRPQESQGDRRTKRPTQPGTGSSNSPASASRVAGITDILRVGFRLGSASGMYPCEILELTSERVQASNFYQRQ

SEQ ID NO: 917998 - protein, 157 aa, Homo sapiens
STNQCSGMNLYGWPLHSSLPTFKKKSVLLKKVFDKGVTIFYFIKSPPVSSHLFIILSKPLVAAPGISRTSAHRTSERVLPHSDACHRLRFIQTNAEQTMKSLWYFQQYHHRGTVLISLNFSNVEEPLEGSLEHEDRPPSSNHHLTLCEPGTVRMSVL

SEQ ID NO: 917999 - protein, 139 aa, Homo sapiens
STNQCSGMNLYGWPLHSSLPTFKKKSVLLKKVFDKGVTIFYFIKSPPVSSHLFIILSKPLVAAPGISRTSAHRTSERVLPHSDACHRLRFIQTNAEQTMKSLWYFQQYHHRGTVLISLHVQGTGRGNRDGGPMSGDFTV

SEQ ID NO: 918000 - protein, 574 aa, Homo sapiens
AKTLGPPGSLETGVLTFRDVAIEFSLEEWQCLDTAQQNLYRNVMLENYRNLVFVGIAASKPDLITCLEQGKEPWNVKRHEMVAEPPVVCSYFARDLWPKQGKKNYFQKVILRRYKKCGCENLQLRKYCKSMDECKVHKECYNGLNQCLTTTQNKIFQCDKYVKVFHKFSNSNRHTIRHTGKKSFKCKECEKSFCMLSHLAQHKRIHSGEKPYKCKECGKAYNETSNLSTHKRIHTGKKPYKCEECGKAFNRLSHLTTHKIIHTGKKPYKCEECGKAFNQSANLTTHKRIHTGEKPYKCEECGRAFSQSSTLTAHKIIHAGEKPYKCEECGKAFSQSSTLTTHKIIHTGEKFYKCEECGKAFSQLSHLTTHKRIHSGEKPYKCEECGKAFKQSSTLTTHKRIHAGEKFYKCEVCSKAFSRFSHLTTHKRIHTGEKPYKCEECGKAFNLSSQLTTHKIIHTGEKPYKCEECGKAFNQSSTLSKHKVIHTGEKPYKYEECGKAFNQSSHLTTHKMIHTGEKPYKCEECGKAFNNSSILNRHKMIHTGEKLYKPESCNNACDNIAKISKYKRNCAGEK

SEQ ID NO: 918001 - protein, 628 aa, Homo sapiens
DLEGKMQMKIPKFNNRLELAGGKAKSTGPQKLQSPLPLGTQAQGDQSSVPEPLAGVVGVPAEWPHTGVLTFRDVAIEFSLEEWQCLDTAQQNLYRNVMLENYRNLVFVGIAASKPDLITCLEQGKEPWNVKRHEMVAEPPVVCSYFARDLWPKQGKKNYFQKVILRRYKKCGCENLQLRKYCKSMDECKVHKECYNGLNQCLTTTQNKIFQCDKYVKVFHKFSNSNRHTIRHTGKKSFKCKECEKSFCMLSHLAQHKRIHSGEKPYKCKECGKAYNETSNLSTHKRIHTGKKPYKCEECGKAFNRLSHLTTHKIIHTGKKPYKCEECGKAFNQSANLTTHKRIHTGEKPYKCEECGRAFSQSSTLTAHKIIHAGEKPYKCEECGKAFSQSSTLTTHKIIHTGEKFYKCEECGKAFSQLSHLTTHKRIHSGEKPYKCEECGKAFKQSSTLTTHKRIHAGEKFYKCEVCSKAFSRFSHLTTHKRIHTGEKPYKCEECGKAFNLSSQLTTHKIIHTGEKPYKCEECGKAFNQSSTLSKHKVIHTGEKPYKYEECGKAFNQSSHLTTHKMIHTGEKPYKCEECGKAFNNSSILNRHKMIHTGEKLYKPESCNNACDNIAKISKYKRNCAGEK

SEQ ID NO: 918002 - protein, 583 aa, Homo sapiens [sequence omitted]

SEQ ID NO: 918003 - protein, 162 aa, Homo sapiens
MAGDGRRAEAVREGWGVYVTPRAPIREGRGRLAPQNGGSSDAPAYRTPPSRQGRREVRFSDEPPEVYGDFEPLVAKERSPVGKRTRLEEFRSDSAKEEVRESAYYLRSRQRRQPRPQETEEMKTRRTTRLQQQHSEQPPLQPSPVTTRRGLRDSHSSEGPRR

SEQ ID NO: 918004 - protein, 283 aa, Homo sapiens [sequence omitted]

SEQ ID NO: 918005 - protein, 565 aa, Homo sapiens
MAGDGRRAEAVREGWGVYVTPRAPIREGRGRLAPQNGGSSDAPAYRTPPSRQGRREVRFSDEPPEVYGDFEPLVAKERSPVGKRTRLEEFRSDSAKEEVRESAYYLRSRQRRQPRPQETEEMKTRRTTRLQQQHSEQPPLQPSPVTTRRGLRDSHSSEEDEASSQTDLSQTISKKTVRSIQEAPVSEDLVIRLRRPPLRYPRYEATSVQQKVNFSEEGETEEDDQDSSHSSVTTVKARSRDSDESGDKTTRSSSQYIESFWQSSQSQNFTAHDKQRSVLSSGYQKTPQEWAPQTARIRTRMQNDSILKSELGNQSPSTSSRQVTGQPPLASGSFWFFSTPEVETTAVQEFQNQMNQLKNKYQGQDEKLWKRSQTFLEKHLNSSHPRSQPAILLLTAARDAEEALRCLSEQIADAYSSFRSVRAIRIDGTDKATQDSDTVKLEVDQELSNGFKNGQNAAVVHRFESFPAGSTLIFYKYCDHENAAFKDVALVLTVLLEEETLGTSLGLKEVEEKVRDFLKVKFTNSNTPNSYNHMDPDKLNGLWSRISHLVLPVQPENALKRGICL

SEQ ID NO: 918006 - protein, 146 aa, Homo sapiens
MRLGVGVSDANPAEKQVKGVPAVSGWREGPEVQVVSSGRSRPIDRLAGLGLGLRPRLFPLPPLGEARRVGKAGGCLHFAPGSHDREEEELILHRGEEGGGREGLISFLPVVHGFLKPRVRPVFVFPPLCEEGGVERLQRASQIVQT

SEQ ID NO: 918007 - protein, 475 aa, Homo sapiens
MKSGLASKSGNKLQVDAGLSIIHIGETPSEHGKCKKFFSDVSILDLHQQLHSGKISHTCNEYRKRFCYSSALCLHQKVHMGEKRYKCDVCSKAFSQNSQLQTHQRIHTGEKPFKCEQCGKSFSRRSGMYVHCKLHTGEKPHICEECGKAFIHNSQLREHQRIHTGEKPFKCYICGKSFHSRSNLNRHSMVHMQEKSFRCDTCSNSFGQRSALNSHCMDHTKEKLYKCEECGRSFTCRQDLCKHQMDHTGDKPYNCNVCGKGFRWSSCLSRHQRVHNGETTFKCDGCGKRFYMNSQGHSHQRAYREEELYKCQKCGKGYISKFNLDLHQRVHTGERPYNCKECGKSFRWASGILRHKRLHTGEKPFKCEECGKRFTENSKLRFHQRIHTGEKPYKCEECGKGFRWASTHLTHQRLHSREKLFQCEDCGKSSEHSSCLQDQQSDHSGEKTSKCEDCGKRYERRLNLDMILSLFLNDI

SEQ ID NO: 918008 - protein, 151 aa, Homo sapiens
MKIAKVTMERRPAGTLCLLGRMPGPGPLSSQREQWRPPRTWTQPARATASGHSHDHAELTGTPQPADLGAILGLFLCPFFISNYKAAPGFLVSLCHVSKWLFGVRPIRKLTHHASSSIHQCLPPQLLGCKPSLAPVFRTEPSSVPRSFFPY

SEQ ID NO: 918009 - protein, 151 aa, Homo sapiens; identical to SEQ ID NO: 918008

SEQ ID NO: 918010 - protein, 166 aa, Homo sapiens
MGWLLGYGQERSLSFLALLESCRGGLVTMATGSMETCSRPFPGWAWTPAHLLMHCVPWPQHPEEVPGWSLCCLSTHPSTLAGAGRVLKGSRMGFWHAEAIEWLQDPASIQDTETHNSLIFRQIESKSLHGCCSMSCPFCFGVLVCFGPGAAFSSLCFSLAQLFSEF

SEQ ID NO: 918011 - protein, 409 aa, Homo sapiens
LPAPQRPSCSPGSVSAAAVNMEPPDAPAQAAGAPRLLLLAVLLAAHPDAQAEVRLSVPPLVEVMRGKSVILDCTPTGTHDHYMLEWFLTDRSGARPRLASAEMQGSELQVTMHDTRGRSPPYQLDSQGRLVLAEARWRRARLRVRGTAEATARLNVFAKPEATEVSPNKGTLSVMEDSAQEIATCNSRNGNPAPKITWYRNGQRLEVPVEMNPEGYMTSRTVREASGLLSLTSTLYLRLRKDDRDASFHCAAHYSLPEGRHGRLDSPTFHLTLHYPTEHVQFWVGSPSTPAGWVREGDTVQLLCRGDGSPSPEYTLFRLQDEQEEVLNVNLEGNLTLEGVTRGQSGTYGCRVEDYDAADDVQLSKTLELRVAYLTLLCSESAMAPQYPWEKPRCLTMAFKVHLASSTIS

SEQ ID NO: 918012 - protein, 685 aa, Homo sapiens
MGTRSSPEEGTPPPLVPECDVEVQPQGHPEESREQEASEVLAEPSSRGGAEQQAEEEEVGEGSSTESSRDAPEATPPIAMAATPPASTSSREGVRGAARRLQGQQLEALTRVALMEQRVKELQRQRKELRIEMEVEVALLRGELAGERVAARREEEQLRELLEQQAASEQRGRQQREEQRRLSQERDRLEGLRQRLRKAQGQLDSQPEDQRERLLQGVQEMREQLDVAQRAYEDLEFQQLERESRQEEEDRDSPGPQVPDPKVQELQASMAQHRHRIRVLEEQLKSLGEQMAAESRGLSRKKEEALQALSQERSRLLELNCLQGTPGGDFSEPNPALTKLLFTQKTDRQLLVLQDAVAHSAATPTSSCLFSVHSSLQGSIGLQRTGSLPRKRGERGSQRGSPRPLSFHCTGEDPPVPHFLPTSALILQQRMEETRTYACRGEVDRLRPGCIQPCNLVPSTLESLEASALPPAVGDSGRYPLYQLLNCGRGNSCGAIHPDIAHMERLLQQAMAERERLLKAREGTRRGTEGSSGPAVPAITAPPTPPHPPGPRILDLRQHLEGWGHNPENCPHVQVSGCCCRGPLVKMGGRIKTWRKRWFCFDRQARRLAYYADKEETKLKGVIYFQAIEEVYYDHLRCAFKSPNPRLTFCVKTYERLFYMVAPSPEAMRIWMDVIVTAADENHAP

SEQ ID NO: 918013 - protein, 634 aa, Homo sapiens
MGTRSSPEEGTPPPLVPECDVEVQPQGHPEESREQEASEVLAEPSSRGGAEQQAEEEEVGEGSSTESSRDAPEATPPIAMAATPPASTSSREGVRGAARRLQGQQLEALTRVALMEQRVKELQRQRKELRIEMEVEVALLRGELAGERVAARREEEQLRELLEQQAASEQRGRQQREEQRRLSQERDRLEGLRQRLRKAQGQLDSQPEDQRERLLQGVQEMREQLDVAQRAYEDLEFQQLERESRQEEEDRDSPGPQVPDPKVQELQASMAQHRHRIRVLEEQLKSLGEQMAAESRGLSRKKEEALQALSQERSRLLELNCLQGTPGGDFSEPNPALTKLLFTQKTDRQLLVLQDAVAHSAATPTSSCLFSVHSSLQGSIGLQRTGSLPRKRGERGSQRGSPRPLSFHCTESLEASALPPAVGDSGRYPLYQLLNCGRGNSCGAIHPDIAHMERLLQQAMAERERLLKAREGTRRGTEGSSGPAVPAITAPPTPPHPPGPRILDLRQHLEGWGHNPENCPHVQVSGCCCRGPLVKMGGRIKTWRKRWFCFDRQARRLAYYADKEETKLKGVIYFQAIEEVYYDHLRCAFKSPNPRLTFCVKTYERLFYMVAPSPEAMRIWMDVIVTAADENHAP

SEQ ID NO: 918014 - protein, 502 aa, Homo sapiens
MEVEVALLRGELAGERVAARREEEQLRELLEQQAASEQRGRQQREEQRRLSQERDRLEGLRQRLRKAQGQLDSQPEDQRERLLQGVQEMREQLDVAQRAYEDLEFQQLERESRQEEEDRDSPGPQVPDPKVQELQASMAQHRHRIRVLEEQLKSLGEQMAAESRGLSRKKEEALQALSQERSRLLELNCLQGTPGGDFSEPNPALTKLLFTQKTDRQLLVLQDAVAHSAATPTSSCLFSVHSSLQGSIGLQRTGSLPRKRGERGSQRGSPRPLSFHCTESLEASALPPAVGDSGRYPLYQLLNCGRGNSCGAIHPDIAHMERLLQQAMAERERLLKAREGTRRGTEGSSGPAVPAITAPPTPPHPPGPRILDLRQHLEGWGHNPENCPHVQVSGCCCRGPLVKMGGRIKTWRKRWFCFDRQARRLAYYADKEETKLKGVIYFQAIEEVYYDHLRCAFKSPNPRLTFCVKTYERLFYMVAPSPEAMRIWMDVIVTAADENHAP

SEQ ID NO: 918015 - protein, 148 aa, Homo sapiens
GSLAPTQAEPAKPDSQLFPRVGSDFRPSALPPSKFRSLESILPSNPVVQALGLFLGPRRPSPQPWHSLLQMEVEVALLRGELAGERVAARREEEQLRELLEQQNRSVWLTGSSSAVSFLVHGCWCAPSHLRPGVVPIPQRKTFGLLRE

SEQ ID NO: 918016 - protein, 601 aa, Homo sapiens
MGTRSSPEEGTPPPLVPECDVEVQPQGHPEESREQEASEVLAEPSSRGGAEQQAEEEEVGEGSSTESSRDAPEATPPIAMAATPPASTSSREGVRGAARRLQGQQLEALTRVALMEQRVKELQRQRKELRIEMEVEVALLRGELAGERVAARREEEQLRELLEQQAASEQRGRQQREEQRRLSQERDRLEGLRQRLRKAQGQLDSQPEDQRERLLQGVQEMREQLDVAQRAYEDLEFQQLERESRQEEEDRDSPGPQVPDPKVQELQASMAQHRHRIRVLEEQLKSLGEQMAAESRGLSRKKEEALQALSQERSRLLELNCLQGTPGGDFSEPNPALTKLLFTQKTDRQLLVLQDAVAQLRCHPYFFLPLFCPQLPAESLEASALPPAVGDSGRYPLYQLLNCGRGNSCGAIHPDIAHMERLLQQAMAERERLLKAREGTRRGTEGSSGPAVPAITAPPTPPHPPGPRILDLRQHLEGWGHNPENCPHVQVSGCCCRGPLVKMGGRIKTWRKRWFCFDRQARRLAYYADKEETKLKGVIYFQAIEEVYYDHLRCAFKSPNPRLTFCVKTYERLFYMVAPSPEAMRIWMDVIVTAADENHAP

SEQ ID NO: 918017 - protein, 184 aa, Homo sapiens
VTGMWSGGAGYCVRWESLCLEVLLTYLWSAGHWQSLKFLDRSLIPCFKLTVCWLIFTSTHYQLLHRSAPPHAWALNLYAQSPQSSCKDTHLTLLWFCQIMLGCFSTWMSFFSYLGSDIGLVLDHPDMWMPLSAKGCLSPNIPPQETLLYRCSLYPPQILTLLVIMVLELFRRKRKVENKFKKKE

SEQ ID NO: 918018 - protein, 206 aa, Homo sapiens
MTGYLYTCEDLCDMQGCSCGCTDVKVKTTVTSGLQPLAKNAIYLSMGQCDSRCQGMVITERPKISSEFAWNFHPRLFTVKRKNMIPACRLVDFQMLSSKNLEFKHDPLDDMSKEVLTEIPRIVKCQDEVSMTTQSYIPASHFLPGTIYTLPILMMIYLRAAFKDEIILGQNHEGSWDEDIILDYSSGLCVVTMGPGREHKRIENSV

SEQ ID NO: 918019 - protein, 236 aa, Homo sapiens
MTAEFLSLLCLGLCLGYEDEKKNEKPPKPSLHAWPSSVVEAESNVTLKCQAHSQNVTFVLRKVNDSGYKQEQSSAENEAEFPFTDLKPKDAGRYFCAYKTTASHEWSESSEHLQLVVTDKHDELEAPSMKTDTRTIFVAIFSCISILLLFLSVFIIYRCSQHGSSSEESTKRTSHSKLPEQEAAEADLSNMERVSLSTADPQGVTYAELSTSALSEAASDTTQEPPGSHEYAALKV

SEQ ID NO: 918020 - protein, 189 aa, Homo sapiens
TLHAPGRHAGRGNSIIPGSGYKQEQSSAENEAEFPFTDLKPKDAGRYFCAYKTTASHEWSESSEHLQLVVTDKHDELEAPSMKTDTRTIFVAIFSCISILLLFLSVFIIYRCSQHGSSSEESTKRTSHSKLPEQEAAEADLSNMERVSLSTADPQGVTYAELSTSALSEAASDTTQEPPGSHEYAALKV

SEQ ID NO: 918021 - protein, 107 aa, Homo sapiens
EQPITLLCDLLTGCHPYSSILCSLHHLQMQPARCHHAEGIHQENQAFQTSRAEAAEADLSNMERVSLSTADPQGVTYAELSTSALSEAASDTTQEPPGSHEYAALKV

SEQ ID NO: 918022 - protein, 205 aa, Homo sapiens
MTAEFLSLLCLGLCLGYEDEKKNEKPPKPSLHAWPSSVVEAESNVTLKCQAHSQNVTFVLRKVNDSGYKQEQSSAENEAEFPFTDLKPKDAGRYFCAYKTTASHEWSESSEHLQLVVTDKHDELEAPSMKTGSSSEESTKRTSHSKLPEQEAAEADLSNMERVSLSTADPQGVTYAELSTSALSEAASDTTQEPPGSHEYAALKV

SEQ ID NO: 918023 - protein, 433 aa, Homo sapiens
MNSLSEANTKFMFDLFQQFRKSKENNIFYSPISITSALGMVLLGAKDNTAQQIKKVLHFDQVTENTTGKAATYHVDRSGNVHHQFQKLLTEFNKSTDAYELKIANKLFGEKTYLFLQEYLDAIKKFYQTSVESVDFANAPEESRKKINSWVESQTNEKIKNLIPEGNIGSNTTLVLVNAIYFKGQWEKKFNKEDTKEEKFWPNKNTYKSIQMMRQYTSFHFASLEDVQAKVLEIPYKGKDLSMIVLLPNEIDGLQKLEEKLTAEKLMEWTSLQNMRETRVDLHLPRFKVEESYDLKDTLRTMGMVDIFNGDADLSGMTGSRGLVLSGVLHKAFVEVTEEGAEAAAATAVVGFGSSPTSTNEEFHLLCLLGFLCLLLSYLDVCVFEEADNFPVFADWLSLGKSFTSYSIQRFWAGPLGRFAAGVLSKAGLVLSQ

SEQ ID NO: 918024 - protein, 280 aa, Homo sapiens
MSGALDVLQMKEEDVLKFLAAGTHLGGTNLDFQMEQYIYKRKSDGIYIINLKRTWEKLLLAARAIVAIENPADVSVISSRNTGQRAVLKFAAATGATPIAGRFTPGTFTNQIQAAFREPRLLVVTDPRADHQPLTEASYVNLPTIALCNTDSPLRYVDIAIPCNNKGAHSVGLMWWMLAREVLRMRGTISREHPWEVMPDLYFYRDPEEIEKEEQAAAEKAVTKEEFQGEWTAPAPEFTATQPEVADWSEGVQVPSVPIQQFPTEDWSAQPATEDWPLNG

SEQ ID NO: 918025 - protein, 295 aa, Homo sapiens [sequence omitted]

SEQ ID NO: 918026 - protein, 289 aa, Homo sapiens
MSGALDVLQMKEEDVLKFLAAGTHLGGTNLDFQMEQYIYKRKSDGIYIINLKRTWEKLLLAARAIVAIENPADVSVISSRNTGQRAVLKFAAATGATPIAGRFTPGTFTNQIQAAFREPRLLVVTDPRADHQPLTEASYVNLPTIALCNTDSPLRYVDIAIPCNNKGAHSVGLMWWMLAREVLRMRGTISREHPWEVMPDLYFYRDPEEIEKEEQAAAEKAVTKEEFQGEWTAPAPEFTATQPEVADWSEGVQVPSVPIQQFPTEDWSAQPATEDWEGEFEEEAEEEVA

SEQ ID NO: 918027 - protein, 295 aa, Homo sapiens [sequence omitted]

SEQ ID NO: 918028 - protein, 295 aa, Homo sapiens [sequence omitted]

SEQ ID NO: 918029 - protein, 394 aa, Homo sapiens
SPGGIWMRRCVSAGEVELEEYYPAFLDMVRSLLEGSIDPTQYEDTLREMFTIHAYVGFTMDKLVQNIARQLRSDTFASAPSTFPPCARNGSLPITIHSSGHSPGWAPLMGHGFGDSNLACDTRRLDQMLHHLVSDDVCLKVVELYLNEKKRGAAGGNLSSRCVRAARETSYQWKAERCMADENCFKVMFLQRKGQVIMTIELLDTEEAQTEDPVEVQHLARYVEQYVGTEGASSSPTEGFLLKPVFLQRNLKKFRRRWQSEQARALRGEARSSWKRLVGVESACDVDCRFKLSTHKMVFIVNSEDYMYRRGTLCRAKQVQPLVLLRHHQHFEEWQQRWLEDNVTVEAASLVQDWLMGEEDEDMVPCKTLCETVHVHGLPVTRYRVQYSRRPASP

SEQ ID NO: 918030 - protein, 385 aa, Homo sapiens
SPGGIWMRRCVSAGEVELEEYYPAFLDMVRSLLEGSIDPTQYEDTLREMFTIHAYVGFTMDKLVQNIARQLRSDTFASAPSTFPPCARNGSLPITIHSSGHSPGWAPLMGHGFGDSNLACDTRRLDQMLHHLVSDDVCLKVVELYLNEKKRGAAGGNLSSRCVRAARETSYQWKAERCMADENCFKVMFLQRKGQVIMTIELLDTEEAQTEDPVEVQHLARYVEQYVGTEGASSSPTEGFLLKPVFLQREEALRCMLRSFLPGPRECPLCPDGGWTMAHCLGALSRCLLCAEAGPALLRLVVCSGGISNPRTVRCRRGKANPTMRQWVKSECPDWRETLPELVGPGQRRVAVAGPWTTSGRARMAPMGPVGAAGGCSDLGAFLVA

SEQ ID NO: 918031 - protein, 788 aa, Homo sapiens
MNFMVDETAAINSNKESQQLVQKTYTLEKKEAMEEDEAPQHRDADIVQGKGEAALWGEAGAVHEAPLRAWKPTAEQPELAEEFTEKREIPPGIERGAEGAAEAEGVRRLGEGGSDPIGQAAAKDAVGLSKDEAPEKQALMLTVLETDKAASEGEQGLEKAVLANEAAALNLEHLHEVAALREAATSEEGEAEGGVAVSDVGESEEEASIDLEDTGPMEDTASKREDGSEEAILGGEEPAKERKEVMRTETRLSPFTGEAEASRMQVSEGSPEEGSLAKEAFLCKEDVEGEEMVTEAEANREDDRKEILPKELDLARERRKAERPKTSLRKTDSEREEVTRANALKDEDAFKEEQKLKAEEGETETEVRAEEETKAPPNEMGSDAENEAPVEASELSDNPGLLGEDSLKETVVPIFEATPGFEKSLENITALRKEGGGERLSEARDTEHKDREELSSRENRALKEGHRQDGEGALAAPEAEPAGKVQAPEGLIPATGQAEELAAKDHDSCAGLEGRAEGQGGVDVVLRTQEAVAEEDPIMAEKFREEAVDEDPEEEEDKECTLETEAMQDRNSEGDGDMEGEGNTQKNEGMGGGRVVAVEVLHGGGETAETAAEEREVLAGSETAEEKTIANKASSFSDVAEEETWHQQDELVGKTAAAGKVVVEELARSGEEVPAAEEMTVTYTTEAGVGTPGALERKTSGLGQEQEEGSEGQEAATGSGDGRQETGAAEKFRLGLSREGERELSPESLQAMATLPVKPDFTETREKQQHMVQGESETADVSPNNVQV

SEQ ID NO: 918032 - protein, 163 aa, Homo sapiens
TPSGLTCVSLRFSFVMVNSVALNGDGCGICSETEEELIEVSHRLNCSREARGSSRCGPGPLLPTSAPVLLQHYPLYRRSDANCSGEDAAPPEERDIPFKENYDVLSREASQKLLWWLQPRLVLSGHTHSACEVHHGGRVPELSVPSFSWRNRNNPSFIMGTDA

SEQ ID NO: 918033 - protein, 191 aa, Homo sapiens
TPSGLTCVSLRFSFVMVNSVALNGDGCGICSETEEELIEVSHRLNCSREARGSSRCGPGPLLPTSAPVLLQVSWGRKGLMADSSSLWFHDSRLNSSLHPGQHYPLYRRSDANCSGEDAAPPEERDIPFKENYDVLSREASQKLLWWLQPRLVLSGHTHSACEVHHGGRVPELSVPSFSWRNRNNPSFIMVT

SEQ ID NO: 918034 - protein, 249 aa, Homo sapiens
TPSGLTCVSLRFSFVMVNSVALNGDGCGICSETEEELIEVSHRLNCSREARGSSRCGPGPLLPTSAPVLLQVSWGRKGLMADSSSLWFHDSRLNSSLHPGQHYPLYRRSDANCSGEDAAPPEERDIPFKENYDVLSREASQKLLWWLQPRLVLSGHTHSACEVHHGGRVPELSVPSFSWRNRNNPSFIMGSITPTDYTLSKCYLPREDVVLIIYCGVVGFLVVLTLTHFGLLASPFLSGLNLLGKRKTR

SEQ ID NO: 918035 - protein, 90 aa, Homo sapiens
TPSGLTCVSLRFSFVMVNSVALNGDGCGICSETEEELIEVSHRLNCSREARGSSRCGPGPLLPTSAPVLLQVSWGRKGLMADSRQPVVSR

SEQ ID NO: 918036 - protein, 771 aa, Homo sapiens
MAPGPFSSALLSPPPAALPFLLLLWAGASRGQPCPGRCICQNVAPTLTMLCAKTGLLFVPPAIDRRVVELRLTDNFIAAVRRRDFANMTSLVHLTLSRNTIGQVAAGAFADLRALRALHLDSNRLAEVRGDQLRGLGNLRHLILGNNQIRRVESAAFDAFLSTVEDLDLSYNNLEALPWEAVGQMVNLNTLTLDHNLIDHIAEGTFVQLHKLVRLDMTSNRLHKLPPDGLFLRSQGTGPKPPTPLTVSFGGNPLHCNCELLWLRRLTREDDLETCATPEHLTDRYFWSIPEEEFLCEPPLITRQAGGRALVVEGQAVSLRCRAVGDPEPVVHWVAPDGRLLGNSSRTRVRGDGTLDVTITTLRDSGTFTCIASNAAGEATAPVEVCVVPLPLMAPPPAAPPPLTEPGSSDIATPGRPGANDSAAERRLVAAELTSNSVLIRWPAQRPVPGIRMYQVQYNSSVDDSLVYRMIPSTSQTFLVNDLAAGRAYDLCVLAVYDDGATALPATRVVGCVQFTTAGDPAPCRPLRAHFLGGTMIIAIGGVIVASVLVFIVLLMIRYKVYGDGDSRRVKGSRSLPRVSHVCSQTNGAGTGAAQAPALPAQDHYEALREVESQAAPAVAVEAKAMEAETASAEPEVVLGRSLGGSATSLCLLPSEETSGEESRAAVGPRRSRSGALEPPTSAPPTLALVPGGAAARPRPQQRYSFDGDYGALFQSHSYPRRARRTKRHRSTPHLDGAGGGAAGEDGDLGLGSARACLAFTSTEWMLESTV

SEQ ID NO: 918037 - protein, 771 aa, Homo sapiens; identical to SEQ ID NO: 918036

SEQ ID NO: 918038 - protein, 141 aa, Homo sapiens
MKAEVVYTAESCGVGSALATSYFASYGDSVILPGPPSVFQVLPYPWIQGYHPGIPTTYRWELAPCSRPPGAPSGRPAAGLAAETPPAVAPGAARPLVAMAGFAAHLAEVGSAAELKFEHQGAVSAALPAGLHTRPAVLPGQ

SEQ ID NO: 918039 - protein, 193 aa, Homo sapiens
LQEKQQQQYLFVGTETRMLSAHRHGCSIRSKWHICIKPFEKARGKQLKQLIFFPMSISSALAMVFMGAKGNTAAQMSQALCFSKIGGEDGDIHRGFQSLLVAINRTDTEYVLRTANGLFGEKSYDFLTGFTDSCGKFYQATIKQLDFVNDTEKSTTRVNSWVADKTKGENILLFYFDNILNSFIVSSLQNCQI

SEQ ID NO: 918040 - protein, 217 aa, Homo sapiens
LQEKQQQQYLFVGTETRMLSAHRHGCSIRSKWHICIKPFEKARGKQLKQLIFFPMSISSALAMVFMGAKGNTAAQMSQALCFSKIGGEDGDIHRGFQSLLVAINRTDTEYVLRTANGLFGEKSYDFLTGFTDSCGKFYQATIKQLDFVNDTEKSTTRVNSWVADKTKAWKIIQTSLSHLEEPGIASSSCYCKACLPQPLLVHSIPKCNSPVTPHGMW

SEQ ID NO: 918041 - protein, 271 aa, Homo sapiens
LQEKQQQQYLFVGTETRMLSAHRHGCSIRSKWHICIKPFEKARGKQLKQLIFFPMSISSALAMVFMGAKGNTAAQMSQALCFSKIGGEDGDIHRGFQSLLVAINRTDTEYVLRTANGLFGEKSYDFLTGFTDSCGKFYQATIKQLDFVNDTEKSTTRVNSWVADKTKVHKGTKKHHQQRPHGLHDMALWTHQTLSCSASSTLSVPLQAWIRHGFHGAILCLFAPARTVFPTWDICVYNQTPRGQIISFVKDFKPPGICWKFHGGKQAFFIF

SEQ ID NO: 918042 - protein, 576 aa, Homo sapiens
MDSVAFEDVSVSFSQEEWALLAPSQKKLYRDVMQETFKNLASIGEKWEDPNVEDQHKNQGRNLRSHTGERLCEGKEGSQCAENFSPNLSVTKKTAGVKPYECTICGKAFMRLSSLTRHMRSHTGYELFEKPYKCKECEKAFSYLKSFQRHERSHTGEKPYKCKQCGKTFIYHQPFQRHERTHIGEKPYECKQCGKALSCSSSLRVHERIHTGEKPYECKQCGKAFSCSSSIRVHERTHTGEKPYACKECGKAFISHTSVLTHMITHNGDRPYKCKECGKAFIFPSFLRVHERIHTGEKPYKCKQCGKAFRCSTSIQIHERIHTGEKPYKCKECGKSFSARPAFRVHVRVHTGEKPYKCKECGKAFSRISYFRIHERTHTGEKPYECKKCGKTFNYPLDLKIHKRNHTGEKPYECKECAKTFISLENFRRHMITHTGDGPYKCRDCGKVFIFPSALRTHERTHTGEKPYECKQCGKAFSCSSYIRIHKRTHTGEKPYECKECGKAFIYPTSFQGHMRMHTGEKPYKCKECGKAFSLHSSFQRHTRIHNYEKPLECKQCGKAFSVSTSLKKHMRMHNR

SEQ ID NO: 918043 - protein, 169 aa, Homo sapiens
MLLPNGSIWGTARGHLIFLLRLCPEINSLSSNAVVTALPGSLVGVAEMGVAMIRHNTRPREEFCRLGTAGFAVRRRGPSKSLATAAEGDVSRFGRRLSVWSQRSVESGETQDQMSRGLDVAPSERPVGVSEGEPPVLRPCGTPRPGVLSGFTQWRSLALVIGRLALDYI

SEQ ID NO: 918044 - protein, 163 aa, Homo sapiens
MRYFTKEWVFNHHLSRRWATCPRDDSNRELFLAESSEGNQEIRGQGNPTLSVRLCKLHFLLHFPTNIVFLKSKSGCITLLFENANDSLLSMTHSHTGSSGPPGCRLLGPTRENFDGVLQVNSDVCGSDEDGQAMLREFSRLEGVNSFLEDRWKNPKASKTLIL

SEQ ID NO: 918045 - protein, 146 aa, Homo sapiens
MPVELQVTILNQHANWSLRQKQDGKRLPFGFWTQKLPEAGKPYTPFKKKFLACYWALLETEHLCFNHDVFMRPEIPTMTWVMSSTQSHQIGHAQESSIIKWKWYIQDQSKPKPKGLSLLHEGVKNLTAHGLNAPLKRYRIAEWIRI

SEQ ID NO: 918046 - protein, 146 aa, Homo sapiens; identical to SEQ ID NO: 918045

SEQ ID NO: 918047 - protein, 146 aa, Homo sapiens; identical to SEQ ID NO: 918045

SEQ ID NO: 918048 - protein, 146 aa, Homo sapiens; identical to SEQ ID NO: 918045

SEQ ID NO: 918049 - protein, 149 aa, Homo sapiens
PQSSILMYLLSHQSIERSRKSIAFIHEQNNNFLELSCWTQQHERDEEEAGLAEEKLSFNAGPTTLSVLWMSMTGAAFVSIVTMMLLHGSPIPRCSNTAIQDTLPFIIFSQTGKTEGILFNKGVSQNRINVTCFLGPVKYAVHLEALLLK

SEQ ID NO: 918050 - protein, 196 aa, Homo sapiens
MTGDCTPVLVLMAAVLTVTGAVPVARLHGALPDARGCHIAQFKSLSPQELQAFKRAKDALEESLLLKDCRCHSRLFPRTWDLRQLQVRERPMALEAELALTLKVLEATADTDPALVDVLDQPLHTLHHILSQFRACIQPQPTAGPRTRGRLHHWLYRLQEAPKKESPGCLEASVTFNLFRLLTRDLNCVASGDLCV

SEQ ID NO: 918051 - protein, 136 aa, Homo sapiens
MRTHGHKEGNITHQGVSGGQKAPHRRSSGPCTTCCVPSLGSATWKTDGREALSTRALLGEAFQNCCLHTVQAFYTINCASSHLLPLIAAERTMLTTAEQLLNQGRTFLPLQFNSHLKPTCELVQEMMDSDFHTPFL

SEQ ID NO: 918052 - protein, 136 aa, Homo sapiens; identical to SEQ ID NO: 918051

SEQ ID NO: 918053 - protein, 143 aa, Homo sapiens
MPCGQVPKSTGADSLILCPKDPWTFTSIRMFINSQERQLADMSLFIADSWLCYSGIICWKSLEHQAWIAGRNKNQHPAFVKSQDDALKPTNTFQPGRPHTRSCPEGCKSQLCLHGRKRGKHLDESQQRPATLPDAAHIWTFKK

SEQ ID NO: 918054 - protein, 200 aa, Homo sapiens
MGTRSSPEEGTPPPLVPECDVEVQPQGHPEESREQEASEVLAEPSSRGGAEQQAEEEEVGEGSSTESSRDAPEATPPIAMAATPPASTSSREGVRGAARRLQGQQLEALTRVALMEQRVKELQRQRKELRIEMEVEVALLRGELAGERVAARREEEQLRELLEQQAASEQRGRQQREQVCLAHRVFISSVLPGPWMLVCS

SEQ ID NO: 918055 - protein, 200 aa, Homo sapiens; identical to SEQ ID NO: 918054

SEQ ID NO: 918056 - protein, 172 aa, Homo sapiens
MCLEFLLSGGLVVPLASAVKLQTFTASVAALKAAHIKVLQVPLDSGVQLASHSGSRTRAAGGAACQSRAVRPHFSALGWSVGPGAAEQGAALVGEAQAAQEAMAENSSTAPGPGEPSAAAGPGAKPLTAQGRQRQPAAPSAGPRSPHPPGTHAGLQVQRAALVSTSPHLPTS

SEQ ID NO: 918057 - protein, 125 aa, Homo sapiens
MRKWICPQSLQKEGIPAGTMTSAQPCECLVVRVAPDLGERITLSGDKSLIEEVFPEIGDVMCNSVNAGWNHDSTHVIRFPLNGYCHLNSVQMEKCRGARDVGVELRTQRLMCAEHRLSALPWAMA

SEQ ID NO: 918058 - protein, 218 aa, Homo sapiens
MLIAKTMGKMSPGYFRDLHSRPSHHRPGGLGRKNSFFAPGPRPYCSVQPWDMVSCVPAVPAPAVDKRAQGTAQAVASEGARPKPLWLPGGVGPGNARENVGLESPHRVPTGALPSGAMKRGSLPFRPQNHRSTDSLHYAPGKAAGFQCQLVKAVVGLYTAEPQGLSCLWPWEPTPCISVPWVLSPDIYVVHLPVHSGLCSNDTPSRQAYHKRNLLLIN

SEQ ID NO: 918059 - protein, 263 aa, Homo sapiens
MPSISFKATRIFDYICCKQSAAVIKQKGQDNVSLSGPTCISTHRWTETNGKEKLTDFWRTTKTIWIQRLLRIPGNTLKTNYLFVLDGLCNENPRPARPLRFIDLTSPPTKKDTWILPVLPSPGYNGREEQANSLPVKDVTIWSMYTGVGHVGSQIYINFWQHTARKHRCPKGHQLKISSKTKPSLGQMHLSSNHHLSNNLPAVNWKFSFWELQPPSQRSKVLAPTAPAVEPKYGCFMEKAGKEGCAHCLRVATLIDNEGIVAF

SEQ ID NO: 918060 - protein, 263 aa, Homo sapiens; identical to SEQ ID NO: 918059

SEQ ID NO: 918061 - protein, 197 aa, Homo sapiens
VSSVWAWFMSTSCSRHMIGPNSPVLSGTLKPARGSGNSCRMRQKRPALMADEKTAALCSTWKHLWPKLIGTCVAGRTDVKFCGKEIQHKLAEHSNLKNKSESQSWRAHLWVLALIGKSYGFVGVIAADLSSSHRILPEPTLGSTQLMRGFLPRFLTKCSLIVVVVRRRKMLLLKRGFLEAATKALKRINSDHYIATI

SEQ ID NO: 918062 - protein, 667 aa, Homo sapiens
AGWGGEVGPGEGWPRGPAGLGRGAAAMIRAFSFPVSPERGRLRGWLEGSLAGLCELHWLRERQEYRVQQALRLAQPGMGGAEAEDEEDADEDEDAAAARRAAAALEEQLEALPGLVWDLGQQLGDLSLESGGLEQESGRSSGFYEDPSSTGGPDSPPSTFCGDSGFSGSSSYGRLGPSEPRGIYASERPKSLGDASPSAPEVVGARAAVPRSFSAPYPTAGGSAGPEACSSAERRARAGPFLTPSPLHAVAMRSPRPCGRPPTDSPDAGGAGRPLDGYISALLRRRRRRGAGQPRTSPGGADGGPRRQNSVRQRPPDASPSPGSARPAREPSLERVGGHPTSPAALSRAWASSWESEAAPEPAAPPAAPSPPDSPAEGRLVKAQYIPGAQAATRGLPGRAARRKPPPLTRGRSVEQSPPRERPRAAGRRGRMAEASGRRGSPRARKASRSQSETSLLGRASAVPSGPPKYPTAEREEPRPPRPRRGPAPTLAAQAAGSCRRWRSTAEIDAADGRRVRPRAPAARVPGPGPSPSAPQRRLLYGCAGSDSECSAGRLGPLGRRGPAGGVGGGYGESESSASEGESPAFSSASSDSDGSGGLVWPQQLVAATAASGGGAGAGAPAGPAKVFVKIKASHALKKKILRFRSGSLKVMTTVNGEEPCLTQFSF

SEQ ID NO: 918063 - protein, 207 aa, Homo sapiens
AGWGGEVGPGEGWPRGPAGLGRGAAAMIRAFSFPVSPERGRLRGWLEGSLAGLCELHWLRERQEYRVQQALRLAQPGMGGAEAEDEEDADEDEDAAAARRAAAALEEQLEALPGLVWDLGQQLGDLSLESGGLEQESGRSSGFYEDPSSTGGPDSPPSTFCGDSGFSGSSSYGRLGPSEPRGIYASERPKSLGKVGEGGALGPGKGQ

SEQ ID NO: 918064 - protein, 436 aa, Homo sapiens
MRSRDRDPPGQHGETPVSTKNTKISWACAGEDIRETGFYSYSYSYFGGGNVKWYRERGETQSAAGLPSPKQAGELEGGDVPGQAAAPAPQTPGPSLCRAQTKPQPRRSASRWLRERRAGSGATRKPRRSGTWGTSLSQWGETYLALTIAENSLNRPGSCISKMSLSNKLMLDKLDVKGKPVVMRVDFNFPMKNNQVTNNWRIKAAVPSIKFCLDNGSKSVVLISHLGWPDGVPMPDKYSSEPVAVELKSLLGKDVLFLKDCVGPEVEKAWEVYVNDAFGTAHRAHSSMAEVNLPQKAGGFLMKKELNYFAEALESPERPFLAILGRTKVADKIQLIKNMLGKVNEMIIGSGMACTFLKVLSNMEIGTSLFDEEGAKTVKDLMSKAEKNGVKIILPVDFVTAGKFDENTKTGQATVASGIPAGWLGLDCGPESSKKD

SEQ ID NO: 918065 - protein, 38 aa, Homo sapiens
MRHHAQLIFVFLVETGFHHVDQDGLNLLTSLSGCLLLP

SEQ ID NO: 918066 - protein, 185 aa, Homo sapiens
MSLLDLSSTAGGENRLVDLRCSKLAARSRTREASWEDRPGETRKIKATVNHDPIPLLNLNCTAAGERDLVDLRHGKARGEVHQVDLSPTLTADISLKINKQIQQYTGGPPRWEDHPGKTWESEFSVNRECIPLLDLNGTVTSKRHLVNLRRGKLMAKSNTCSRNWLECDRNLKDQLHRAGRSIEK

SEQ ID NO: 918067 - protein, 185 aa, Homo sapiens; identical to SEQ ID NO: 918066

SEQ ID NO: 918068 - protein, 102 aa, Homo sapiens
MGQRVPKRNPGAGQGVGVFSPTIKKTAGGDPDGLLTHPKGGRGGHTGDHNTRGSQGTGINPGGEVNTTTRKQTPRQVERHRAVSKIKKETTGATNKDNTHGH

SEQ ID NO: 918069 - protein, 185 aa, Homo sapiens; identical to SEQ ID NO: 918066

SEQ ID NO: 918070 - protein, 169 aa, Homo sapiens
VHIHFSSALWLQLGSQWPLSVSFRKMIPFSKGSLEEQSPPHQPWEECRLFKGSSWAAGLRRGTCPSQRQCTCTENLFAGLWVVFGFMFLRKPATVGYEGSDILDPGPPCWRGLPDKTQNPGKSEFQINTTDMFLANKGEIKTFSQERQQKEVITRSYSWAHGKNSHNSA

SEQ ID NO: 918071 - protein, 541 aa, Homo sapiens
QDIMLRESSQFSQQQSFVQILQEVNDFAGQRELVAENLSVRVCLELTKYSQEMKQERKMHFQEGRRAQQQLENGFKQLENSKRKFERDCREAEKAAQTAERLDQDINATKADVEKAKQQAHLRSHMAEESKNEYAAQLQRFNRDQAHFYFSQMPQIFDKLQDMDERRATRLGAGYGLLSEAELEVVPIIAKCLEGMKVAANAVDPKNDSHVLIELHKSGFARPGDVEFEDFSQPMNRAPSDSSLGTPSDGRPELRGPGRSRTKRWPFGKKNKPRPPPLSPLGGPVPSALPNGPPSPRSGRDPLAILSEISKSVKPRLASFRSLRGSRGVSEASGQEEVVALACPAAGGGTLGSLPAAGWAPLPWLPNPDLLCSVHGLAVKNHGWGRERNISDGCRVWQARLLDPKFSPLPTLQTVVTEDFSHLPPEQQRKRLQQQLEERSRELQKEVDQREALKKMKDVYEKTPQMGDPASLEPQIAETLSNIERLKLEVQKYEAWLAEAESRVLSNRGDSLSRHARPPDPPASAPPDSSSNSASQDTKER

SEQ ID NO: 918072 - protein, 416 aa, Homo sapiens
MAEESKNEYAAQLQRFNRDQAHFYFSQMPQIFDKLQDMDERRATRLGAGYGLLSEAELEVVPIIAKCLEGMKVAANAVDPKNDSHVLIELHKSGFARPGDVEFEDFSQPMNRAPSDSSLGTPSDGRPELRGPGRSRTKRWPFGKKNKPRPPPLSPLGGPVPSALPNGPPSPRSGRDPLAILSEISKSVKPRLASFRSLRGSRGVSEASGQEEVVALACPAAGGGTLGSLPAAGWAPLPWLPNPDLLCSVHGLAVKNHGWGRERNISDGCRVWQARLLDPKFSPLPTLQTVVTEDFSHLPPEQQRKRLQQQLEERSRELQKEVDQREALKKMKDVYEKTPQMGDPASLEPQIAETLSNIERLKLEVQKYEAWLAEAESRVLSNRGDSLSRHARPPDPPASAPPDSSSNSASQDTKER

SEQ ID NO: 918073 - protein, 603 aa, Homo sapiens
GGGGGGGSSREGGTERGEQGEGRERHTQGRDRGDREGKGGKERTEGEQADAKQRLDRGKKRPKRPAKEPEAKFSQQQSFVQILQEVNDFAGQRELVAENLSVRVCLELTKYSQEMKQERKMHFQEGRRAQQQLENGFKQLENSKRKFERDCREAEKAAQTAERLDQDINATKADVEKAKQQAHLRSHMAEESKNEYAAQLQRFNRDQAHFYFSQMPQIFDKLQDMDERRATRLGAGYGLLSEAELEVVPIIAKCLEGMKVAANAVDPKNDSHVLIELHKSGFARPGDVEFEDFSQPMNRAPSDSSLGTPSDGRPELRGPGRSRTKRWPFGKKNKPRPPPLSPLGGPVPSALPNGPPSPRSGRDPLAILSEISKSVKPRLASFRSLRGSRGVSEASGQEEVVALACPAAGGGTLGSLPAAGWAPLPWLPNPDLLCSVHGLAVKNHGWGREWNISDGCRVWQARLLDPKFSPLPTLQTVVTEDFSHLPPEQQRKRLQQQLEERSRELQKEVDQREALKKMKDVYEKTPQMGDPASLEPQIAETLSNIERLKLEVQKYEAWLAEAESRVLSNRGDSLSRHARPPDPPASAPPDSSSNSASQDTKER

SEQ ID NO: 918074 - protein, 230 aa, Homo sapiens
VVLCLDGGMVLMRKQVPSRFMYPKEWQHLTMFILLTLNGCVDFMSKNVLPQRCVGLEKGTLVLIIYELLLLMVSHVKDSEGVELHVYSLLILVVFLLLLVLTAELWAPNMCHLQLMETFLILMMGSWLMQAGFILYRPVSGYPWQDDDISDIMFVTTFFCWHVMINASFLLGIYGFSSFWYHCFRPSLKLTGPKEAPYYASTPGPLYKLLQEVEQSEKEDQALLLPKSSP

SEQ ID NO: 918075 - protein, 73 aa, Homo sapiens
EGVDGECLPGSPLITELAFNMQRAKQIKGFNGKESSPGGKNKSRDQQIHWEATMEAHAGGDGRFTRVLAMEVW

SEQ ID NO: 918076 - protein, 197 aa, Homo sapiens
EGVDGECLPGSPLITELAFNMQRAKQIKGFNGKESSPGGKNKSRDQQIHWEATMEAHAGGDGRFTRVLAMEEKFTDLGTECNGSIDGMMGIFTGPETGCGFMHQCLFPPGLVNRVLSWDIWSFLSSISYARYLVHPILIILYNGLQETLIHHTDTNMFYLFSGHRVLTFVTGLALTLFIEKPCQELKQHLLGHECSG

SEQ ID NO: 918077 - protein, 253 aa, Homo sapiens
MRLPRPHGTKEEVLMRAHLGVYHAPLPYGESWTELDLMEGKDLMGGEGPGISVMQQPDPVSHPLGVMWVEELLLPKCAKYWSQGYPHYSSPFKYTWHTRWTSYKKTLLSSAFCLEDDRDQMKDGIGESKMRLEAIVRQRDGGKKASQEAVRCGKNLDSKSGRGEGVWEDATLDLDAGWKDLAEYICRIYDLMTSILQSYLMDGYINIFACLRDSSSDKKKIKGGGFSSSTISADFTSQFSDLNSSHFLCKGLR

SEQ ID NO: 918078 - protein, 572 aa, Homo sapiens
SPRPLDVGGPAAGTPGVLSRPCPSTAALAPKPFCAAPRPQPDAPACAGATGGSCADFDSGVDFVRRRSSGLWGPQPPLSPVKNYTEMFQDPVAFKDVAVNFTQEEWALLDISQKNLYREVMLETFWNLTSIGKKWKDQNIEYEYQNPRRNFRSVTEEKVNEIKEDSHCGETFTPVPDDRLNFQKKKASPEVKSCDSFVCEVGLGNSSSNMNIRGDTGHKACECQEYGPKPWKSQQPKKAFRYHPSLRTQERDHTGKKPYACKECGKNIIYHSSIQRHMVVHSGDGPYKCKFCGKAFHCLSLYLIHERTHTGEKPYECKQCGKSFSYSATHRIHERTHIGEKPYECQECGKAFHSPRSCHRHERSHMGEKAYQCKECGKAFMCPRYVRRHERTHSRKKLYECKQCGKALSSLTSFQTHIRMHSGERPYECKTCGKGFYSAKSFQRHEKTHSGEKPYKCKQCGKAFTRSGSFRYHERTHTGEKPYECKQCGKAFRSAPNLQLHGRTHTGEKPYQCKECGKAFRSASQLRIHRRIHTGEKPYECKKCGKAFRYVQNFRFHERTQTHKNALWRKTL

SEQ ID NO: 918079 - protein, 363 aa, Homo sapiens
MNIRGDTGHKACECQEYGPKPWKSQQPKKAFRYHPSLRTQERDHTGKKPYACKECGKNIIYHSSIQRHMVVHSGDGPYKCKFCGKAFHCLSLYLIHERTHTGEKPYECKQCGKSFSYSATHRIHERTHIGEKPYECQECGKAFHSPRSCHRHERSHMGEKAYQCKECGKAFMCPRYVRRHERTHSRKKLYECKQCGKALSSLTSFQTHIRMHSGERPYECKTCGKGFYSAKSFQRHEKTHSGEKPYKCKQCGKAFTRSGSFRYHERTHTGEKPYECKQCGKAFRSAPNLQLHGRTHTGEKPYQCKECGKAFRSASQLRIHRRIHTGEKPYECKKCGKAFRYVQNFRFHERTQTHKNALWRKTL

SEQ ID NO: 918080 - protein, 572 aa, Homo sapiens; identical to SEQ ID NO: 918078

SEQ ID NO: 918081 - protein, 486 aa, Homo sapiens
MFQDPVAFKDVAVNFTQEEWALLDISQKNLYREVMLETFWNLTSIGKKWKDQNIEYEYQNPRRNFRSVTEEKVNEIKEDSHCGETFTPVPDDRLNFQKKKASPEVKSCDSFVCEVGLGNSSSNMNIRGDTGHKACECQEYGPKPWKSQQPKKAFRYHPSLRTQERDHTGKKPYACKECGKNIIYHSSIQRHMVVHSGDGPYKCKFCGKAFHCLSLYLIHERTHTGEKPYECKQCGKSFSYSATHRIHERTHIGEKPYECQECGKAFHSPRSCHRHERSHMGEKAYQCKECGKAFMCPRYVRRHERTHSRKKLYECKQCGKALSSLTSFQTHIRMHSGERPYECKTCGKGFYSAKSFQRHEKTHSGEKPYKCKQCGKAFTRSGSFRYHERTHTGEKPYECKQCGKAFRSAPNLQLHGRTHTGEKPYQCKECGKAFRSASQLRIHRRIHTGEKPYECKKCGKAFRYVQNFRFHERTQTHKNALWRKTL

SEQ ID NO: 918082 - protein, 335 aa, Homo sapiens; identical to SEQ ID NO: 776008

SEQ ID NO: 918083 - protein, 460 aa, Homo sapiens
SLLWAAYSMLFKKPLRHSMDFSLECGKAFKYSCTLTTHKIIHTGEKSHKCEECGKAFNWSSQLAIHKITHTGEQPYKRKECSKAFNHPTTPSSHKKTHTGEKPCKCDKCGKAFIFSSTLSKHEKIHTGEKPYKCEECGKAFRWSSHLTTHKITHTGEKPYKCEECGNGFKYSSTLTEHKIIHTGEKSYKCEECGKAFNWPSQLAIHKITHTGEQPYKCKECGKAFKHPATLSSHNKTHTGEKPYKCDKCGKAFISSSTLSKHEKIHTGEKPYKCEEYGKAFTHSSHLTRHKKIHAGEKPYKCDKCGTAFILSSTLSEHEKIHTGEKLYKCEECGKAFNHFSHLTIHKTIHTGEKCYKWRTHTGEKPYKCEECGKAFTASSTLSEYKTIHTGEKPCKCEECGKAFNWSSDFNKHKRIHSGQKPILDMAIIHAEEELYKPERCDSAVPNTSNVSIHKKIILV

SEQ ID NO: 918084 - protein, 197 aa, Homo sapiens
LHWGFPPMTRSHSSHRFCFWKATRSYLQYRGKKFKDRKSPPKSTDKYPFSSGGQGGRQQPLNDRLGVLASQVTSQACFQTCPSNRDLKLPRNYLPVPVPRRQTRYFEALYTGKAMHGFRVYKALGKKVLVPSSPETIKKGNGLTAQIWQDQTAMGISYSPFRLKGDGKKQRKAETARVTETCCHLYRSLSDTCQRVT

SEQ ID NO: 918085 - protein, 424 aa, Homo sapiens
SGSRLESPGDSDDPWVSSGMRVIASLQVQKSRHRVSRSQACPESTAAGAQARPGNQDLCVLCPCGVFLCSPLPHLSSREEQSLPNSGTADSLPQGTVCSSFPVQAVLRRTGTGPQDRASRVFQVAYVIIKAANAPRPGNWILERSLDGTTFSPWQYYAVSDSECLSRYNITPRRGPPTYRADDEVICTSYYSRLVPLEHGEIHTSLINGRPSADDLSPKLLEFTSARYIRLRLQRIRTLNADLMTLSHREPKELDPIVTRRVSPYEDEPCRPCNCDPVGSLSSVCIKDDLHSDLHNGKQPGQCPCKEGYTGEKCDRCQLGYKDYPTCVSCGCNPVGSASDEPCTGPCVCKENVEGKACDRCKPGFYNLKEKNPRGCSECFCFGVSDVCSSLSWPVGQVGGAICAAGFNEQVVLHKLGTSCVRRK

SEQ ID NO: 918086 - protein, 135 aa, Homo sapiens
MELESLDKSAQFNTCGWDPAVLLPCPCGCNLRRQIPTGNRRAQNSVRQGFPFGTHGLLPSPSLPPGVSWSPDCVLGPAAAKVTRLQALLLQEIQTSCLGSEQWEATHQENWSRQASRCGVGRGGHLYDNKILPLF

SEQ ID NO: 918087 - protein, 135 aa, Homo sapiens
MGLGASEQRAAPVREAGPHGSPQWEGGSGMAGCRSQALPHGEAAEACFLSKLQQKQQKFTTVLELAAQLTLASTFTVTLLFGSDPPATPCEYSAWGLECKGHWGQISCTELSQQSRRQQPPCEQLGTTEKWRCLS

SEQ ID NO: 918088 - protein, 135 aa, Homo sapiens
QGILREGLINIMAVYFCGRRKKVREKGLDGWRMEVKANITEITCSILVVGTWKSIFISSILNAYEPVRLTLIILTDGGRPEIVKGCGVQDPEAGNSSNDKMNLSTFLIMKSASSLEWDPGSRLLSHLAAMWNLFS

SEQ ID NO: 918089 - protein, 518 aa, Homo sapiens
MKETVESHFRDAYPTCEVVDVQLCYNVAKLIYLCKEKKKTEKSLTYYTNLQVKTGQRTLINPKPCGQFCCCEVLGCEWEDAISYYTRMKDRLLERITEEERHVQDQPLGMAFVTFQEKSMATYILKDFNACKCQSLQCKGEPQPSSHSRELYTSKWTVTFAADPEDICWKNLSIQGLRWWLQWLGINFTLFLGLFFLTTPSIILSTMDKFNVTKPIHALNNPIISQFFPTLLLWSFSALLPSIVYYSTLLESHWTKSGENQIMMTKVYIFLIFMVLILPSLGLTSLDFFFRWLFDKTSSEASIRLECVFLPDQGAFFVNYVIASAFIGNGMELLRLPGLILYTFRMIMAKTAADRRNVKQNQAFQYEFGAMYAWMLCVFTVIVAYSITCPIIAPFGLIYILLKHMVDRHNLYFVYLPAKLEKGIHFAAVNQALAAPILCLFWLYFFSFLRLGMKAPATLFTFLVLLLTILVCLAHTCFGCFKHLSPLNYKTEEPASDKGSEAEAHMPPPFTITWQASL

SEQ ID NO: 918090 - protein, 729 aa, Homo sapiens
MPEKETVESHFRDAYPTCEVVDVQLCYNVAKLIYLCKEKKKTEKSLTYYTNLQVKTGQRTLINPKPCGQFCCCEVLGCEWEDAISYYTRMKDRLLERITEEERHVQDQPLGMAFVTFQEKSMATYILKDFNACKCQSLQCKGEPQPSSHSRELYTSKWTVTFAADPEDICWKNLSIQGLRWWLQWLGINFTLFLGLFFLTTPSIILSTMDKFNVTKPIHALNNPIISQFFPTLLLWSFSALLPSIVYYSTLLESHWTKSGENQIMMTKVYIFLIFMVLILPSLGLTSLDFFFRWLFDKTSSEASIRLECVFLPDQGAFFVNYVIASAFIGNGMELLRLPGLILYTFRMIMAKTAADRRNVKQNQAFQYEFGAMYAWMLCVFTVIVAYSITCPIIAPFGLIYILLKHMVDRHNLYFVYLPAKLEKGIHFAAVNQALAAPILCLFWLYFFSFLRLGMKAPATLFTFLVLLLTILVCLAHTCFGCFKHLSPLNYKTEEPASDKGSEAEAHMPPPFTITWQASLLINGREGILVPLGILTCIFETVEEIESCLDSWPSPLVSVPCSLSFSAYLMPALRASDSERLGLGEDSTVSAAAAAADLWCHPQHQRDYPWTVLERTRAVWLLPPRRPEAGSHCSEKTQPEWPGLRPLAEWECVGTAQLSYQVPIFSGPSSGEESTGSLAPPLLTQFPSGTSFQLCSWGDIPSGLSPRPCGGLFAPQTDESGRIYGERDV

SEQ ID NO: 918091 - protein, 795 aa, Homo sapiens
MTCFGGSPGHRRRKLEPSDFLLFTFQRLELGRKPEQYRHTGLWVTSLPAVFPGQVRRTLFITGLPRDARKETVESHFRDAYPTCEVVDVQLCYNVAKLIYLCKEKKKTEKSLTYYTNLQVKTGQRTLINPKPCGQFCCCEVLGCEWEDAISYYTRMKDRLLERITEEERHVQDQPLGMAFVTFQEKSMATYILKDFNACKCQSLQCKGEPQPSSHSRELYTSKWTVTFAADPEDICWKNLSIQGLRWWLQWLGINFTLFLGLFFLTTPSIILSTMDKFNVTKPIHALNNPIISQFFPTLLLWSFSALLPSIVYYSTLLESHWTKSGENQIMMTKVYIFLIFMVLILPSLGLTSLDFFFRWLFDKTSSEASIRLECVFLPDQGAFFVNYVIASAFIGNGMELLRLPGLILYTFRMIMAKTAADRRNVKQNQAFQYEFGAMYAWMLCVFTVIVAYSITCPIIAPFGLIYILLKHMVDRHNLYFVYLPAKLEKGIHFAAVNQALAAPILCLFWLYFFSFLRLGMKAPATLFTFLVLLLTILVCLAHTCFGCFKHLSPLNYKTEEPASDKGSEAEAHMPPPFTITWQASLGINGREGILVPLGILTCIFETVEEIESCLDSWPSPLVSVPCSLSFSAYLMPALRASDSERLGLGEDSTVSAAAAAADLWCHPQHQRDYPWTVLERTRAVWLLPPRRPEAGSHCSEKTQPEWPGLRPLAEWECVGTAQLSYQVPIFSGPSSGEESTGSLAPPLLTQFPSGTSFQLCSWGDIPSGLSPRPCGGLFAPQTDESGRIYGERDV

SEQ ID NO: 918092 - protein, 727 aa, Homo sapiens
MKETVESHFRDAYPTCEVVDVQLCYNVAKLIYLCKEKKKTEKSLTYYTNLQVKTGQRTLINPKPCGQFCCCEVLGCEWEDAISYYTRMKDRLLERITEEERHVQDQPLGMAFVTFQEKSMATYILKDFNACKCQSLQCKGEPQPSSHSRELYTSKWTVTFAADPEDICWKNLSIQGLRWWLQWLGINFTLFLGLFFLTTPSIILSTMDKFNVTKPIHALNNPIISQFFPTLLLWSFSALLPSIVYYSTLLESHWTKSGENQIMMTKVYIFLIFMVLILPSLGLTSLDFFFRWLFDKTSSEASIRLECVFLPDQGAFFVNYVIASAFIGNGMELLRLPGLILYTFRMIMAKTAADRRNVKQNQAFQYEFGAMYAWMLCVFTVIVAYSITCPIIAPFGLIYILLKHMVDRHNLYFVYLPAKLEKGIHFAAVNQALAAPILCLFWLYFFSFLRLGMKAPATLFTFLVLLLTILVCLAHTCFGCFKHLSPLNYKTEEPASDKGSEAEAHMPPPFTITWQASLRINGREGILVPLGILTCIFETVEEIESCLDSWPSPLVSVPCSLSFSAYLMPALRASDSERLGLGEDSTVSAAAAAADLWCHPQHQRDYPWTVLERTRAVWLLPPRRPEAGSHCSEKTQPEWPGLRPLAEWECVGTAQLSYQVPIFSGPSSGEESTGSLAPPLLTQFPSGTSFQLCSWGDIPSGLSPRPCGGLFAPQTDESGRIYGERDV

SEQ ID NO: 918093 - protein, 114 aa, Homo sapiens
MMDSPFLELWQSKAVSIREQLGLGDRPNDSYCYNSAKNSTVLQGVTFGGIPTVLLIDVSCFLFLILVFSIIRRRFWDYGRIALVSEADSESRFQRLSSTSSSGQQDFENELVGI

SEQ ID NO: 918094 - protein, 904 aa, Homo sapiens
MLEQGKEPWTVVSQVKIARNPNCGECMKGVITGISPKCVIKELPPIQNSNTGEKFQAVMLEGHESYDTENFYFREIRKNLQEVDFQWKDGEINYKEGPMTHKNNLTGQRVRHSQGDVENKHMENQLILRFQSGLGELQKFQTAEKIYGCNQIERTVNNCFLASPLQRIFPGVQTNISRKYGNDFLQLSLPTQDEKTHIREKPYIGNECGKAFRVSSSLINHQMIHTTEKPYRCNESGKAFHRGSLLTVHQIVHTRGKPYQCDVCGRIFRQNSDLVNHRRSHTGDKPYNVMNVASPLVKVPTLQFIREFITGEKPYKCNRCGKCFSQSSSLATHQTVHTGDKPYKCNECGKTFKRNSSLTAHHIIHAGKKPYTCDVCGKVFYQNSQLVRHQIIHTGETPYKCNECGKVFFQRSRLAGHRRIHTGEKPYKCNECGKVFSQHSHLAVHQRVHTGEKPYKCNECGKAFNWGSLLTVHQRIHTGEKPYKCNVCGKVFNYGGYLSVHMRCHTGEKPLHCNKCGMVFTYYSCLARHQRMHTGEKPYKCNVCGKVFIDSGNLSIHRRSHTGEKPFQCNECGKVFSYYSCLARHRKIHTGEKPYKCNDCGKAYTQRSSLTKHLVIHTGENPYHCNEFGEAFIQSSKLARYHRNPTGEKPHKCSECGRTFSHKTSLVYHQRRHTGEMPYKCIECGKVFNSTTTLARHRRIHTGEKPYKCNECGKVFRYRSGLARHWSIHTGEKPYKCNECGKAFRVRSILLNHQMMHTGEKPYKCNECGKAFIERSNLVYHQRNHTGEKPYKCMECGKAFGRRSCLTKHQRIHSSEKPYKCNECGKSYISRSGLTKHQIKHAGENLTTKLNVERPLDVVGRETRKRNKRQRQSIEKEKGAPGTGALHMEDLRSWPWSLSSLSIY

SEQ ID NO: 918095 - protein, 962 aa, Homo sapiens
MALPQGSLTFRDVAVEFSQEEWKCLDPVQKALYRDVMLENYRNLGFLGLCLPDLNIISMLEQGKEPWTVVSQVKIARNPNCGECMKGVITGISPKCVIKELPPIQNSNTGEKFQAVMLEGHESYDTENFYFREIRKNLQEVDFQWKDGEINYKEGPMTHKNNLTGQRVRHSQGDVENKHMENQLILRFQSGLGELQKFQTAEKIYGCNQIERTVNNCFLASPLQRIFPGVQTNISRKYGNDFLQLSLPTQDEKTHIREKPYIGNECGKAFRVSSSLINHQMIHTTEKPYRCNESGKAFHRGSLLTVHQIVHTRGKPYQCDVCGRIFRQNSDLVNHRRSHTGDKPYNVMNVASPLVKVPTLQFIREFITGEKPYKCNRCGKCFSQSSSLATHQTVHTGDKPYKCNECGKTFKRNSSLTAHHIIHAGKKPYTCDVCGKVFYQNSQLVRHQIIHTGETPYKCNECGKVFFQRSRLAGHRRIHTGEKPYKCNECGKVFSQHSHLAVHQRVHTGEKPYKCNECGKAFNWGSLLTVHQRIHTGEKPYKCNVCGKVFNYGGYLSVHMRCHTGEKPLHCNKCGMVFTYYSCLARHQRMHTGEKPYKCNVCGKVFIDSGNLSIHRRSHTGEKPFQCNECGKVFSYYSCLARHRKIHTGEKPYKCNDCGKAYTQRSSLTKHLVIHTGENPYHCNEFGEAFIQSSKLARYHRNPTGEKPHKCSECGRTFSHKTSLVYHQRRHTGEMPYKCIECGKVFNSTTTLARHRRIHTGEKPYKCNECGKVFRYRSGLARHWSIHTGEKPYKCNECGKAFRVRSILLNHQMMHTGEKPYKCNECGKAFIERSNLVYHQRNHTGEKPYKCMECGKAFGRRSCLTKHQRIHSSEKPYKCNECGKSYISRSGLTKHQIKHAGENLTTKLNVERPLDVVGRETRKRNKRQRQSIEKEKGAPGTGALHMEDLRSWPWSLSSLSIY

SEQ ID NO: 918096 - protein, 210 aa, Homo sapiens
MGTATENSPASSCGRCKSCQRVKDTPLIRIQSEEFLMVPMTFIISMCTGQVVRMSFPLLIEVGGPLGKHGTVGRMMGKDGAGIKFSMEAVLALTFQKAYLLDGVCHWAAELWMFVSWKLQAVERYGQLAWVMRVLEDVQLDSAIGHKGSLGFSRTGHCKRGTKDIREKGYEYSMTTNWGSRISEPLKDLAPGGLEKTPIGMLGRASCKHL

SEQ ID NO: 918097 - protein, 155 aa, Homo sapiens
NKDLGKDETMGQDFCLLQICPVIFENPTYDEPELGSCPSPHSGVIILSWFGQDFLVLALKGNDHWMDPGTHWTHREVGAGSSLAFTSPYYDGKHNGALCPWISQSIQTLGPIILLVNKHPAGPQRPFSFWPFRERGVPVSGIELGEQAGVHRTLQ

SEQ ID NO: 918098 - protein, 139 aa, Homo sapiens
MAYSNNSHQQFHKGNPFILTRGPVALVKGLRTSEANFYTNVDVAGPRADARFPSCLHSSDRFSGIWYFSSLLLVLGFHIIQTAAATFHRSSSGSKAHLGPFWGCVPVALGRCPLTADEIFFQLNTDVAGFFLTYRMTTE

SEQ ID NO: 918099 - protein, 210 aa, Homo sapiens
ERTWIPQVMVQDSHTIMVLFYGMLLLVPLGELQPGGEISCLFTQCPLPSSAIEPKEELQDNFRNSVLQEARWEVGSHRSLSVDCVLQESVGSTKTSGNLHTANRNCPTAQSCSGNKDFSKAKQHLKTPVVRDNKTSIDPALFNGLLQKKPKVKVRAASLADTELNGESQRKQEKPVLQELPEETEVLPPYVPAYPPLPRPTAPPGTRFRS

SEQ ID NO: 918100 - protein, 838 aa, Homo sapiens
MQVDPPLHGPPNDFLIFQIIPLHSLSIMPRFLWILCFSMEETQGELTSSCGSKTMANVSLAFRDVSIDLSQEEWECLDAVQRDLYKDVMLENYSNLVSLDLEYKYITKNLLSEKNVCKIYLSQLQTGEKSKNTIHEDTIFRNGLQCKHEFERQERHQMGCVSQMLIQKQISHPLHPKIHAREKSYECKECRKAFRQQSYLIQHLRIHTGERPYKCMECGKAFCRVGDLRVHHTIHAGERPYECKECGKAFRLHYHLTEHQRIHSGVKPYECKECGKAFSRVRDLRVHQTIHAGERPYECKECGKAFRLHYQLTEHQRIHTGERPYECKVCGKTFRVQRHISQHQKIHTGVKPYKCNECGKAFSHGSYLVQHQKIHTGEKPYECKECGKSFSFHAELARHRRIHTGEKPYECRECGKAFRLQTELTRHHRTHTGEKPYECKECGKAFICGYQLTLHLRTHTGEIPYECKECGKTFSSRYHLTQHYRIHTGEKPYICNECGKAFRLQGELTRHHRIHTCEKPYECKECGKAFIHSNQFISHQRIHTSESTYICKECGKIFSRRYNLTQHFKIHTGEKPYICNECGKAFRFQTELTQHHRIHTGEKPYKCTECGKAFIRSTHLTQHHRIHTGEKPYECTECGKTFSRHYHLTQHHRGHTGEKPYICNECGNAFICSYRLTLHQRIHTGELPYECKECGKTFSRRYHLTQHFRLHTGEKPYSCKECGNAFRLQAELTRHHIVHTGEKPYKCKECGKAFSVNSELTRHHRIHTGEKPYQCKECGKAFIRSDQLTLHQRNHISEEVAVIKQFCEKPSRLPYYHFPQLGLMSIVNQNVCDLMDPL

SEQ ID NO: 918101 - protein, 210 aa, Homo sapiens
MAEKILEKLDVLDKQAEIILARRTKINRLQSEGRKTTMAIPLTFDFQLEFEEALATSASKAISKIKEDKSCSITKSKMHVSFKCEPEPRKSNFEKSNLRPFFIQTNVKNKESESTEPVEEHLKSRSIRPYLYLKDTTEMENAGPLNVLYSQHRQACRRSLGSTDFSPMFNIQSNAHKKEKDSTLFTAQIEKKPRKPLDSVGLLEGDRNKR

SEQ ID NO: 918102 - protein, 156 aa, Homo sapiens
ADSTSRFMHRSDGSDFGSRTVVHAEIRSTISNCSPSLSASPSLCSAVNSSLDALELLSGIPRENKSVSLNPIQLQPQVPEEYMQDDMQTIHMLFLAKMILSFGPNISANVDSQPKGVHDASPMERAYTSNPQGSPLHSPHGEQTSQNLSGGWSICQ

SEQ ID NO: 918103 - protein, 142 aa, Homo sapiens
MYVRTCSIACTHTMDDYSAIKKNEIMTVPATWMELKTTILGEITQKQSQILHALPYMWELNNVYRQTERGITDIGDWKGGRVAGRDEKLLHGQNVHYSVMVTLKPRLFHHMLCPCNKTACVPCNFINVVKLKRCVYVNTVNM

SEQ ID NO: 918104 - protein, 161 aa, Homo sapiens
CCRQGTVCLQIQMERNTFTPGEKVVFTTEINNQTSKCIKTVVFALYAHIQYEGFTPSAERRSRLDSSELLRQEANTPVTRFNTTKVVSTFNLPLLLSVSSSTQDGEIMHTRYELVTTVHLPWSLTSLKAKVPIIITSASVDSAICQLSEDGVLPVNPDHQN

SEQ ID NO: 918105 - protein, 185 aa, Homo sapiens
MGGSSLVTVAPSVACVFVLRSATPRRRGVLVGCGRVRLPVLMVVARAMEKLQFLYLSDNLLDSIPGPLPLSLRSVHLQSFPPSSLPFSSSSSVPSLSIHPPWGSSSHPCCVALALDASVSPVAPEQAELNNLIETMQRDVFCDPEEHKHTRRQLEDIRLDGNPINLSLFPSAYFCLPRLPIGRFT

SEQ ID NO: 918106 - protein, 185 aa, Homo sapiens; identical to SEQ ID NO: 918105

SEQ ID NO: 918107 - protein, 598 aa, Homo sapiens
MYFIDNLLLGHPRRLKVKPDSEILVIENGTAFPFQVEVLDESDNITAQPKLIVHCKFSGAPNLPVYVVDCSSSGTSILTGSAIQVQNIKKDQTLKARIEIPSCKDVAPVEKTIKLLPSSHVARLQIFSVEGQKAIQIKHQDEVNWIAGDIMHNLIFQMYDEGEREINITSALAEKIKVNWTPEINKEHLLQGLLPDVQVPTSVKDMRYCQVSFQDDHVSLESAFTVRPLPDEPKHLKCEMKGGKTVQMGQELQGEVDQYGNQIQAFSPSSLSSLSIAGVGLDSSNLKTTFQENTQSISVRGIKFIPGPPGNKDLCFTWREFSDFIRVQLISGPPAKLLLIDWPELKESIPVINGRDLQNPIIVQLCDQWDNPAPVQHVKISLTKASNLKVKAIYNKSIIEGPIIKLMILPDPEKPVRLNVKYDKDASFLAGGLFTDDSIIKNINPARISMKMWKLSTSGNRPPANDDYDNHTGIDLVGTIIATIKGSNEEDTDTPLFIGKVRTLEFPFVNDVKKQQQMAALTKEKDQLSQSIVMYKSLFEASQQLLNEMKCQVEEARLKEAQLRNELKIHNIDIPTTQQGIIADHLEVSLVVDWELIV

SEQ ID NO: 918108 - protein, 598 aa, Homo sapiens; identical to SEQ ID NO: 918107

SEQ ID NO: 918109 - protein, 195 aa, Homo sapiens
DLGSGMAAFYLYHPGLGVWVEHFPLFPMLSKSDPVLEGKPEKFSFGLLDLPFRVGVPFNIPLEFQDEFGHTSQLVTDIQPVLEASGLSLHYEEITKGPNCVIRGVTAKGPVNSCQGKNYNLKVTLPGLKEDSQILKIRLLPGHPRRLKVKPDSEILVIENGTAFPFQVEVLDESDNITAQPKLIVHCKVSLLEDI

SEQ ID NO: 918110 - protein, 730 aa, Homo sapiens
DLGSGMAAFYLYHPGLGVWVEHFPLFPMLSKSDPVLEGKPEKFSFGLLDLPFRVGVPFNIPLEFQDEFGHTSQLVTDIQPVLEASGLSLHYEEITKGPNCVIRGVTAKGPVNSCQGKNYNLKVTLPGLKEDSQILKIRLLPGHPRRLKVKPDSEILVIENGTAFPFQVEVLDESDNITAQPKLIVHCKFSGAPNLPVYVVDCSSSGTSILTGSAIQVQNIKKDQTLKARIEIPSCKDVAPVEKTIKLLPSSHVARLQIFSVEGQKAIQIKHQDEVNWIAGDIMHNLIFQMYDEGEREINITSALAEKIKVNWTPEINKEHLLQGLLPDVQVPTSVKDMRYCQVSFQDDHVSLESAFTVRPLPDEPKHLKCEMKGGKTVQMGQELQGEVDQYGNQIQAFSPSSLSSLSIAGVGLDSSNLKTTFQENTQSISVRGIKFIPGPPGNKDLCFTWREFSDFIRVQLISGPPAKLLLIDWPELKESIPVINGRDLQNPIIVQLCDQWDNPAPVQHVKISLTKASNLKVKAIYNKSIIEGPIIKLMILPDPEKPVRLNVKYDKDASFLAGGLFTDDSIIKNINPARISMKMWKLSTSGNRPPANDDYDNHTGIDLVGTIIATIKGSNEEDTDTPLFIGKVRTLEFPFVNDVKKQQQMAALTKEKDQLSQSIVMYKSLFEASQQLLNEMKCQVEEARLKEAQLRNELKIHNIDIPTTQQGIIADHLEVSLVVDWELIV

SEQ ID NO: 918111 - protein, 553 aa, Homo sapiens
VQFYTLIVHCKFSGAPNLPVYVVDCSSSGTSILTGSAIQVQNIKKDQTLKARIEIPSCKDVAPVEKTIKLLPSSHVARLQIFSVEGQKAIQIKHQDEVNWIAGDIMHNLIFQMYDEGEREINITSALAEKIKVNWTPEINKEHLLQGLLPDVQVPTSVKDMRYCQVSFQDDHVSLESAFTVRPLPDEPKHLKCEMKGGKTVQMGQELQGEVDQYGNQIQAFSPSSLSSLSIAGVGLDSSNLKTTFQENTQSISVRGIKFIPGPPGNKDLCFTWREFSDFIRVQLISGPPAKLLLIDWPELKESIPVINGRDLQNPIIVQLCDQWDNPAPVQHVKISLTKASNLKVKAIYNKSIIEGPIIKLMILPDPEKPVRLNVKYDKDASFLAGGLFTDDSIIKNINPARISMKMWKLSTSGNRPPANDDYDNHTGIDLVGTIIATIKGSNEEDTDTPLFIGKVRTLEFPFVNDVKKQQQMAALTKEKDQLSQSIVMYKSLFEASQQLLNEMKCQVEEARLKEAQLRNELKIHNIDIPTTQQGIIADHLEVSLVVDWELIV

SEQ ID NO: 918112 - protein, 656 aa, Homo sapiens
MIQLEIRKIDDPLQHHLQNQSIQKSVKQCHEQNMFGNIVNQNKGHFLLKQDCDTFDLHEKPLKSNLSFENQKRSSGLKNSAEFNRDGKSLFHANHKQFYTEMKFPAIAKPINKSQFIKQQRTHNIENAHVCSECGKAFLKLSQFIDHQRVHTGEKPHVCSMCGKAFSRKSRLMDHQRTHTELKHYECTECDKTFLKKSQLNIHQKTHMGGKPYTCSQCGKAFIKKCRLIYHQRTHTGEKPHGCSVCGKAFSTKFSLTTHQKTHTGEKPYICSECGKGFIEKRRLTAHHRTHTGEKPFICNKCGKGFTLKNSLITHQQTHTGEKLYTCSECGKGFSMKHCLMVHQRTHTGEKPYKCNECGKGFALKSPLIRHQRTHTGEKPYVCTECRKGFTMKSDLIVHQRTHTAEKPYICNDCGKGFTVKSRLIVHQRTHTGEKPYVCGECGKGFPAKIRLMGHQRTHTGEKPYICNECGKGFTEKSHLNVHRRTHTGEKPYVCSECGKGLTGKSMLIAHQRTHTGEKPYICNECGKGFTMKSTLSIHQQTHTGEKPYKCNECDKTFRKKTCLIQHQRFHTGKTSFACTECGKFSLRKNDLITHQRIHTGEKPYKCSDCGKAFTTKSGLNVHQRKHTGERPYGCSDCGKAFAHLSILVKHRRIHR

SEQ ID NO: 918113 - protein, 793 aa, Homo sapiens
SPGAWTSSESLASDDGGAPGILSQGAPSGLLMQPLSPRAPVRNPRVEHTLRETSRRLELAQTHERAPSPGRGVPRSPRGSGRSSPAPNLAPASPRPCPLQLVREQMAAALRRLRELEDQARTLPELQEQVRALRAEKARLLAGRAQPEPDGEAETRPDKLAQLRRLTERLATSERGGRARASPRADSPDGLAAGRSEGALQVLDGEVGSLDGTPQTREVAAEAVPETREAGAQAVPETREAGVEAAPETVEADAWVTEALLGLPAAAERELELLRASLEHQRGVSELLRGRLRELEEAREAAEEAAAGARAQLREATTQTPWSCAEKAAQTESPAEAPSLTQESSPGSMDGDRAVAPAGILKSIMKKRDGTPGAQPSSGPKSLQFVGVLNGELSAFPLLWQLLPGHRLGLEPQLCPSTGSVVWAILSFLIVKWERPHPHRRTPERAHRGGLADTSHPAPRYESSSSEDASDSDGDSENGGAEPPGSSSGSGDDSGGGSDSGTPGPPSGGDIRDPEPEAEAEPQQVAQGRCELSPRLREACVALQRQLSRPRGVASDGGAVRLVAQEWFRVSSQRRSQAEPVARMLEGVRRLGPELLAHVVNLADGNGNTALHYSVSHGNLAIASLLLDTGACEVNRQNRAGYSALMLAALTSVRQEEEDMAVVQRLFCMGDVNAKASQTGQTALMLAISHGRQDMVATLLACGADVNAQDADGATALMCASEYGRLDTVRLLLTQPGCDPAILDNEGTSALAIALEAEQDEVAALLHAHLSSGQPDTQSPERVTPWLPDSHTW

SEQ ID NO: 918114 - protein, 725 aa, Homo sapiens
SPGAWTSSESLASDDGGAPGILSQGAPSGLLMQPLSPRAPVRNPRVEHTLRETSRRLELAQTHERAPSPGRGVPRSPRGSGRSSPAPNLAPASPRPCPLQLVREQMAAALRRLRELEDQARTLPELQEQVRALRAEKARLLAGRAQPEPDGEAETRPDKLAQLRRLTERLATSERGGRARASPRADSPDGLAAGRSEGALQVLDGEVGSLDGTPQTREVAAEAVPETREAGAQAVPETREAGVEAAPETVEADAWVTEALLGLPAAAERELELLRASLEHQRGVSELLRGRLRELEEAREAAEEAAAGARAQLREATTQTPWSCAEKAAQTESPAEAPSLTQESSPGSMDGDRAVAPAGILKSIMKKRDGTPGAQPSSGPKSLQFVGVLNGEYESSSSEDASDSDGDSENGGAEPPGSSSGSGDDSGGGSDSGTPGPPSGGDIRDPEPEAEAEPQQVAQGRCELSPRLREACVALQRQLSRPRGVASDGGAVRLVAQEWFRVSSQRRSQAEPVARMLEGVRRLGPELLAHVVNLADGNGNTALHYSVSHGNLAIASLLLDTGACEVNRQNRAGYSALMLAALTSVRQEEEDMAVVQRLFCMGDVNAKASQTGQTALMLAISHGRQDMVATLLACGADVNAQDADGATALMCASEYGRLDTVRLLLTQPGCDPAILDNEGTSALAIALEAEQDEVAALLHAHLSSGQPDTQSPERVTPWLPDSHTW

SEQ ID NO: 918115 - protein, 168 aa, Homo sapiens
CVLTVMTLWTSACLSLGILTVKSNTEHPDQAPQASPASGIADEEKVKSSVHLWNQLLKSDPWEASLMCGAQSRDSGYTGMAIKGPLPVGTWIDDACQSPGGVGSAASPHADMRMSRPAFLLQGNAPGYNIDTKQFVEKTLDLMSWARAAWQVVGEQPVHASAVAPLAL

SEQ ID NO: 918116 - protein, 135 aa, Homo sapiens
NTAIMAVPSNFVPSQFQQSSLGSSDNGVCHQYTNCLKSGAETTQTRKYEDIDISHLMLIPLTFMSSVPSTKISGELYLRKNGGRVHAWKCYHSCSEIRGKWNYKKTPSDKAHKGEQLLWNTSKIYTSLKKDITQL

SEQ ID NO: 918117 - protein, 172 aa, Homo sapiens
MPAKLPPASTPAQSPVCLQQPLVTLLSPTRTMLGSGGIDTHTEDPLETVMSPGKEESSPLQQAASGVLMAGATEGHQEFPPCSPCERSRLRLAQAIRKAKQRDEPRGRSLLTHDQACPRVTDDEAALALETNQQAWVFPPQSTESSRRCEGQPGWERGNGGRGADRREAAPS

SEQ ID NO: 918118 - protein, 243 aa, Homo sapiens
MPLHSSLGDRASFHLKEKKKRKKFLQHVSSKYKLSTFLKCGKAFNQSSNLTTHKKIHTGEKPYKCEDCGKAFNFSSNLTTHKKIHTEEKPYKCEECGKTFSWSSILITHKMIHTGEKPYKCERCGKAFNHSATFFRIRKFILEGNHTMTPLKFKLDLPSNRPTLPEGKGPLTPMGTFFGGSPGSKKMGTVLQKSMAAVPAVVGDNCCTFYGGCEGPELWKPTLFISDQTNKQVVRTCGCGVNR

SEQ ID NO: 918119 - protein, 232 aa, Homo sapiens
TAHGFQPHASVEPACQAGTWNLKQLSQEGPRRYRRPRTRFLSKQLTALRELLEKTMHPSLATMGKLASKLQLDLSVVKIWFKNQRAKWKRQQRQQMQTRPSLGPANQTTSVKKEETPSAITTANIRPVSPGISDANDHDLREPSGIKNPGGASASARVSSWDSQSYDIEQICLGASNPPWASTLFEIDEFVKIYDLPGEDDTSSLNQYLFPVCLEDCILNPLALEMEGIRHM

SEQ ID NO: 918120 - protein, 235 aa, Homo sapiens
LWFSTQPGSASGVVRSSRWPRGLAGFRSEAADLLGAQLASPSGSRTGAAGGAACQSCAMRSHSSALGRSMGLGALEQGAVLVGKAPQRRWAGIAGGPSAAPGPGAKSLIARGQQGRPAAPSAGPAKLTPIRNSSWPASAARSPGSRSRLSLHTFPQAEGVGSGLGQPRNGLPQCRGGLKGSSSATKVGAQAEEVPRASEGSEDCQHAVTSHRKSLSDISFKDWGQVGSHCNLSWH

SEQ ID NO: 918121 - protein, 237 aa, Homo sapiens
MTHCILELLGSSNPSTSASQVGGTTGAHHHIWLIKKQKTKNPHKHIYILMLPGPTIATSATRPPPASNEVSTSVLSSTITPAPPMSVLSHHTLHITSNSSTSSSSTTSSTSTSSFITSSFTTSTSITSTSSTSSFTTSTATTSTSISITSTSSISSSITSTSTSTTSTSSNSTTSTVTSTSTSTSTTSTITSTSTSTSITSTSSTSTSTSSTFTSTTSTSTTSTSTTSTSTSATSSI

SEQ ID NO: 918122 - protein, 590 aa, Homo sapiens
SLSDYQLTLSLGLYLPSYDSLLAIAPNPVFHTPVAQATPRYAGPLQSLEHRTNQLLPLSWAVVGLPSRKPLPLPPAPCLPVSMQQTCAKSLLSVQYQTFLAQSLWALFTSSLAISLVFAVIPFCRDVKVLASVMALAGLAMGCIDTVANMQLVRMYQKDSAVFLQVLHFFVGFGALLSPLIADPFLSEANCLPANSTANTTSRGHLFHVSRVLGQHHVDAKPWSNQTFPGLTPKDGAGTRVSYAFWIMALINLPVPMAVLMLLSKERLLTCCPQRRPLLLSADELALETQPPEKEDASSLPPKFQSHLGHEDLFSCCQRKNLRGAPYSFFAIHITGALVLFMTDGLTGAYSAFVYSYAVEKPLSVGHKVAGYLPSLFWGFITLGRLLSIPISSRMKPATMVFINVEVLAAVCGAHPSQQLAMSVRKASAGPGPPVFTLVPSCSEPSSQWKAVEARDPTTVGVVVTFLVLLIFSYNVVFLFVGTASLGLFLSSTFPSMLAYTEDSLQYKGCATTVLVTGAGVGEMVLQMLVGSIFQAQGSYSFLVCGVIFGCLAFTFYILLLFFHRMHPGLPSVPTQDRSIGMENSECYQR

SEQ ID NO: 918123 - protein, 599 aa, Homo sapiens
RGPPQPGRPSRGRHSGTGLAGTRSASPSACAMGCDGRVSGLLRRNLQPTLTYWSVFFSFGLCIAFLGPTLLDLLLSDAQLAAQISWVFFSQQLCLLLGSALGGVFKRTLAQSLWALFTSSLAISLVFAVIPFCRDVKVLASVMALAGLAMGCIDTVANMQLVRMYQKDSAVFLQVLHFFVGFGALLSPLIADPFLSEANCLPANSTANTTSRGHLFHVSRVLGQHHVDAKPWSNQTFPGLTPKDGAGTRVSYAFWIMALINLPVPMAVLMLLSKERLLTCCPQRRPLLLSADELALETQPPEKEDASSLPPKFQSHLGHEDLFSCCQRKNLRGAPYSFFAIHITGALVLFMTDGLTGAYSAFVYSYAVEKPLSVGHKVAGYLPSLFWGFITLGRLLSIPISSRMKPATMVFINVEVLAAVCGAHPSQQLAMSVRKASAGPGPPVFTLVPSCSEPSSQWKAVEARDPTTVGVVVTFLVLLIFSYNVVFLFVGTASLGLFLSSTFPSMLAYTEDSLQYKGCATTVLVTGAGVGEMVLQMLVGSIFQAQGSYSFLVCGVIFGCLAFTFYILLLFFHRMHPGLPSVPTQDRSIGMENSECYQR

SEQ ID NO: 918124 - protein, 546 aa, Homo sapiens
RGPPQPGRPSRGRHSGTGLAGTRSASPSACAMGCDGRVSGLLRRNLQPTLTYWSVFFSFGLCIAFLGPTLLDLLLSDAQLAAQISWVFFSQQLCLLLGSALGGVFKRTLAQSLWALFTSSLAISLVFAVIPFCRDVKVLASVMALAGLAMGCIDTVANMQLVRMYQKDSAVFLQVLHFFVGFGALLSPLIADPFLSEANCLPANSTANTTSRGHLFHVSRVLGQHHVDAKPWSNQTFPGLTPKDGAGTRVSYAFWIMALINLPVPMAVLMLLSKERLLTCCPQRRPLLLSADELALETQPPEKEDASSLPPKFQSHLGHEDLFSCCQRKNLRGAPYSFFAIHITGALVLFMTDGLTGAYSAFVYSYAVEKPLSVGHKVAGYLPSLFWGFITLGRLLSIPISSRMKPATMVFINVEVLAAVCGAHPSQQLAMSVRKASAGPGPPVFTLVPSCSEPSSQWKAVEARDPTTVGVVVTFLVLLIFSYNVVFLFVGTASLGLFLSSTFPSMLAYTEDSLQYKGCATTVLVTGAGVGEMVLQMLVGSVCGDL

SEQ ID NO: 918125 - protein, 266 aa, Homo sapiens
LKTRGLMETEPLQAKKGEYNFHARASQDSGLVSKPGLQELGLTLQPKRHILEAWVWSHFRLRNKTTGPGSLEDEGGPYTDCSFNPMPIPTCEQSFHVFTLPKGKPRDTCICQQDWKQVRHTEGEARSCVGGGVAEGRGMPGMRLVCRLAHGHFPRKGQRRRSLTVWKAETSRADCLGAPNIRTAPLGRSEKRTAICFSTGAQDSSQRAPFRLQNPGQLLQLGMHSLHLQPELPTTDPAFFCKLHFIKGNDPYCLTISHVKSVLTFS

SEQ ID NO: 918126 - protein, 252 aa, Homo sapiens
LKTRGLMETEPLQAKKGEYNFHARASQDSGLVSKPGLQELGLTLQPKRHILEAWVWSHFRLRNKTTGPGSLEDEGGPYTDCSFNPMPIPTCEQSFHVFTLPKGKPRDTCICQQDWKQVRHTEGEARSCVGGGVAEGRGMPGMRLVCRLAHGHFPRKGQRRRSLTVWKAETSRADCLGARGTALHRPKEENAIYFSTKYPDSASREVREENRDLFQHRGSGQFPAGSVSSPEPWTAPPAWNALPPPPTRAPHN

SEQ ID NO: 918127 - protein, 134 aa, Homo sapiens
LKTRGLMETEPLQAKKGEYNFHARASQDSGLVSKPGLQELGLTLQPKRHILEAWVWSHFRLRNKTTGPGSLEDEGGPYTDCSFNPMPIPTCEQSFHVFTLPKGKPRDTCICQQDWKQVRHTEGEARSCVGGGVV

SEQ ID NO: 918128 - protein, 228 aa, Homo sapiens
LKTRGLMETEPLQAKKGEYNFHARASQDSGLVSKPGLQELGLTLQPKRHILEAWVWSHFRLRNKTTGPGSLEDEGGPYTDCSFNPMPIPTCEQSFHVFTLPKGKPRDPASANKTGSRKGQRRRSLTVWKAETSRADCLGAPNIRTAPLGRSEKRTAICFSTGAQDSSQRAPFRLQNPGQLLQLGMHSLHLQPELPTTDPAFFCKLHFIKGNDPYCLTISHVKSVLTFS

SEQ ID NO: 918129 - protein, 134 aa, Homo sapiens; identical to SEQ ID NO: 918127

SEQ ID NO: 918130 - protein, 134 aa, Homo sapiens; identical to SEQ ID NO: 918127

SEQ ID NO: 918131 - protein, 134 aa, Homo sapiens; identical to SEQ ID NO: 918127

SEQ ID NO: 918132 - protein, 134 aa, Homo sapiens; identical to SEQ ID NO: 918127

SEQ ID NO: 918133 - protein, 169 aa, Homo sapiens
MPPHAPRYPFNKRELRQRSGYQLGKPLRELFCLFYSFWLSASCVNRIVCAGPSPLPGFTGKVLEAGERSYQHVPPSESSVRRKHVEHVLSICWELVKAVECRWSSCRDRATGAGDGSGSAVGGRWLGPRTLRVAWLRHSSDNCAGYIYSNPVYVISTTAIWGGCTGKKF

SEQ ID NO: 918134 - protein, 394 aa, Homo sapiens
NLLLRKGCKNVDEFKMHKKGYNRHNQCLTTSHSKIFQCDKYVKVFHKFSNSNRHKIRHTSKKPFKCKECGKLFCILSHLAQHKKIHTGEKSYKCEEYGKAFNESSNCTTHKRITEKKPYKCKECGKAFNWFSHFTTHKRIHTGEKPYQCEKCGKFFNQSTNLTTHKRIHTGEKPYKCEECGKAFNQSSNLTEHKKIHTKEQPYKCEKCGKAFKWSSTLTKHKRIHNGEKPYKCEECGKAFNRSSTLNRHKITHTGGKPYKYKECGKAFNQSSTLTIHKIIHTVEKFYKCEECGKAFSRISHLTTHKRIHTGEKPYKCEECGRAFNQSSTLTTHKRIHTGEKPYECEECGKAFNRSSTLTTHKIIHSGEKIYKCKECGKAFRRFSHLTRHKTIHT

SEQ ID NO: 918135 - protein, 183 aa, Homo sapiens
GSEGAGKEGRLQLRMEPETVVEFRVRKICCLDEELNRAKTIVAPTPGFTHKTTWAFVRDSGFKLLEVQMTSGFSAPPEYWLQCLSVHYSSKLMMQGRMNSNPRDPEMRKGCLTYSKKTKEAQRPEKSAGKGRRSEMQSEQWQAPRVCGKDFRFHPEEEDRSLESFDQGSEMKYLRLTKNYSDI

SEQ ID NO: 918136 - protein, 183 aa, Homo sapiens; identical to SEQ ID NO: 918135

SEQ ID NO: 918137 - protein, 183 aa, Homo sapiens; identical to SEQ ID NO: 918135

SEQ ID NO: 918138 - protein, 394 aa, Homo sapiens
GKANSTGILSVRGGVVVRDIGDTTIQLSWSRGFDNHSPIAKYTLQARTPPAGKWKQVRTNPANIEGNAETAQVLGLTPWMDYEFRVIASNILGTGEPSGPSSKIRTREAGESPVCPKKLSSGQRPWHHFIGNAKPAAIMLSSNPAHRVQTLTKQRRTEHQDSAEEVEPPESSSSTGRCRKDHCTALTQTRITSCPPSTHPLPLTRIHAAGPMSREYQNGDGFGYLLSFRRQGSTHWQTARVPGADAQYFVYSNESVRPYTPFEVKIRSYNRRGDGPESLTALVYSAEEEMNVTWEPVQQDMNGILLGYEIRYWKAGDKEAAADRVRTAGLDTSARVSGLHPNTKYHVTVRAYNRAGTGPASPSANATTMKPPPHPGTVISHSVAMLILIGSLEL

SEQ ID NO: 918139 - protein, 553 aa, Homo sapiens
MHYPMGHRLVHGTDPLTLCVPRMLPITDRLLHLLGLEKTAFRIYAVSTLLLFLLFFLFRLLLRFLRLCRSFYITCRRLRCFPQPPRRNWLLGHLGMYLPNEAGLQDEKKVLDNMHHVLLVWMGPVLPLLVLVHPDYIKPLLGASAAIAPKDDLFYGFLKPWLGDGLLLSKGDKWSRHRRLLTPAFHFDILKPYMKIFNQSADIMHAKWRHLAEGSAVSLDMFEHISLMTLDSLQKCVFSYNSNCQEKMSDYISAIIELSALSVRRQYRLHHYLDFIYYRSADGRRFRQACDMVHHFTTEVIQERRRALRQQGAEAWLKAKQGKTLDFIDVLLLARDEDGKELSDEDIRAEADTFMFEGHDTTSSGISWMLFNLAKYPEYQEKCREEIQEVMKGRELEELEWDDLTQLPFTTMCIKESLRQYPPVTLVSRQCTEDIKLPDGRIIPKGIICLVSIYGTHHNPTVWPDSKVYNPYRFDPDNPQQRSPLAYVPFSAGPRNCIGQSFAMAELRVVVALTLLRFRLSVDRTRKVRRKPELILRTENGLWLKVEPLPPRA

SEQ ID NO: 918140 - protein, 158 aa, Homo sapiens
QLFPRLSQFSSSPEVMADEWFIFQLHVFDLHTGGPQLKGKPELWSAVMNINCPVACGQMPSPQGPLAQTQGALVTWAQQVWSREQNTVVMMAAKAHLGPETRGGGGWPDPPQMRRGQLQDKERSDHACSISAGSSSLAPICMVLLIFFIIITLKSFEC

SEQ ID NO: 918141 - protein, 158 aa, Homo sapiens; identical to SEQ ID NO: 918140

SEQ ID NO: 918142 - protein, 1317 aa, Homo sapiens
MLLLASTEPSSLCYVETVDIDGETNLKFRQALMVTHKELATIKKMASFQGTVTCEAPNSRMHHFVGCLEWNDKKYSLDIGNLLLRGCRIRNTDTCYGLVIYAGFDTKIMKNCGKIHLKRTKLDLLMNKLVVVIFISVVLVCLVLAFGFGFSVKEFKDHHYYLSGVHGSSVAAESFFVFWSFLILLSVTIPMSMFILSEFIYLGNSVFIDWDVQMYYKPQDVPAKARSTSLNDHLGQVEYIFSDKTGTLTQNILTFNKCCISGRVYGAAPTPELPAGSSIFKGLRVPENQSHVVETEVSFRPKIARGVGSRATGLACVAAPVAPGSLKLGVRGYGIPNGGPVGAEAGSCVFPQGRIQRPRPDLSGPPTAGPCPRHPQENPYLWNKFADGKLLFHNAALLHLVRTNGDEAVREFWRLLAICHTVMVRESPHQLLYQAASPDEGALVTAARNFGYVFLSRTQDTVTIMELGEERVYQVLAIMDFNSTRKRMSVLVRKPEGAICLYTKGADTVIFERLHRRGAMEFATEEALAAFAQETLRTLCLAYREVAEDIYEDWQQRHQEASLLLQNRAQALQQVYNEMEQDLRLLGATAIEDRLQDGVPETIKCLKKSNIKIWVLTGDKQGSQCGAGRRGAELVCFAETAVNIGFACELLSENMLILEEKEISRILETYWENSNNLLTRESLSQVKLALVINGDFLDKLLVSLRKEPRALAQNVNMDEAWQELGQSRRDFLYARRLSLLCRRFGLPLAAPPAQDSRARRSSEVLQERAFVDLASKCQAVICCRVTPKQKALIVALVKKYHQVVTLAIGDGANDINMIKSGCLCPAAADVGVGLAGQEGMQAVQNSDFVLGQFCFLQRLLLVHGRWSYVRICKFLRYFFYKSMASMMVQVWFACYNGFTGQPLYEGWFLALFNLLYSTLPVLYIGLFEQDVSAEQSLEKPELYVVGQKDELFNYWVFVQAIAHGVTTSLVNFFMTLWISRDTAGPASFSDHQSFAVVVALSCLLSITMEVGKVLTSPGPWTWPMEASSPGDPCFGGIARCPSWTPGAGVLVQAPLGPGFTPPLPVQVILIIKYWTALCVATILLSLGFYAIMTTTTQSFWLFRVSPTTFPFLCEPPWGSGTGDADLSVMSSPSILLVVLLSVSINTFPVLALRVIFPALKELRAKEEKVEEGPSEEIFTMEPLPHVHRESRARRSSYAFSHRQLTLESQPDSSEEKSAFLKPSTPFRKSWQKEPHTPKEGTVPLPDKTHKSQVETLPPSLEESSTSTSEQPMEVELWPAEKQSSSSMEWLLVPGEEQLSLPPEEQSLPSAEGTRVQQ

SEQ ID NO: 918143 - protein, 478 aa, Homo sapiens [sequence omitted]

SEQ ID NO: 918144 - protein, 277 aa, Homo sapiens
MQAASSKMVSAEISENRKRQWPTKSQTDRGASAGKRRCFWLGMEGLETAEGSNSESSDDDSEEAPSTSGMGFHAPKIGSNGVEMAAKFPSGSQRARVVNTDHGSPEQLQIPVTDSGRHILEDSCAELGESKEHMESRMVTETEETQEKKAESKEPIEEEPTGAGLNKDKETEERTDGERVAEVAPEERENVAVAKLQESQPGNAVIDKETIDLLAFTSVAELELLGLEKLKCELMALGLKCGGTLQERAARLFSVRGLAKEQIDPALFAKPLKGKKK

SEQ ID NO: 918145 - protein, 418 aa, Homo sapiens
MLASSRGAGRVAAPGVSERLEVRVVGDMAEAAALVWIRGPGFGCKAVRCASGRCTVRDFIHRHCQDQNVPVENFFVKCNGALINTSDTVQHGAVYSLEPRLCGGKGGFGSMLRALGAQIEKTTNREACRDLSGRRLRDVNHEKAMAEWVKQQAEREAEKEQKRLERLQRKLVEPKHCFTSPDYQQQCHEMAERLEDSVLKGMQAASSKMVSAEISENRKRQWPTKSQTDRGASAGKRRCFWLGMEGLETAEGSNSESSDDDSEEAPSTSGMGFHAPKIGSNGVEMAAKFPSGSQRARVVNTDHGSPEQLQIPVTDSGRHILEDSCAELGESKEHMESRMVTETEETQEKKAESKEPIEEEPTGAGLNKDKETEERTDGERVAEVAPEERENVAVAKLQESQPGNANWSCWVWRSSNVN

SEQ ID NO: 918146 - protein, 377 aa, Homo sapiens
AVPPALQPQPEQQSFSQMHLGHRGHMRRSESTYSVNSTGRRGRGTLGQPPPGRRMEPSDAGHSASKSPCMLVALRPTNVDREGDKFFQSHYTYNPQFEYQEPMPMAVVKYCEASGQFIHQAVGIIEAVLEKFGTYEHFEAATGRQLLTKCQIWSIVEVVVQLSEDLLSQAVMMVENSRPTLAVNLTRARQYWLEGMLWHEIVSAVWAPTTCGAVTTRASRGTTRRAGCGTGYGRRTPRGGPGHPAQRAAPQAAVPVARCAALLCYTSRHAVRLSFRQLFQDLARYVRDADVRWDKDQVYLNGILCILGHRQTIDFPLLTSLGKVSYEDVDHLRPHGVLDNTRMPHLMQDLARYRQQLKHIMATNRLDVAELGRLLPD

SEQ ID NO: 918147 - protein, 221 aa, Homo sapiens
MTETREPAETGGYASLEEDDEDLSPGWKGVAQSWLKCSLELLGSSDPPASASREAGTTGPEHSSDSEYTLSEPDSEEEEDEEEEEEETTDDPEYDPGYKVKQRLGGGRGGPSRRAPRAAQPPAQPCQLCGRSPLGEAPPGTPPCRLCCPATAPQEAPAPEGRALGEEEEEPPRAGEGRPAGREEEEEEEEEGTYHCTECEDSFDNLGELHGHFMLHARGEV

SEQ ID NO: 918148 - protein, 120 aa, Homo sapiens
MTETREPAETGGYASLEEDDEDLSPGPEHSSDSEYTLSEPDSEEEEDEEEEEEETTDDPEYDPGYKVKQRLGGGRGGPSRRAPRAAQPPAQPCQLCGRSPLGEAPPGTPPARALHAACPG

SEQ ID NO: 918149 - protein, 188 aa, Homo sapiens
MTETREPAETGGYASLEEDDEDLSPGPEHSSDSEYTLSEPDSEEEEDEEEEEEETTDDPEYDPGYKVKQRLGGGRGGPSRRAPRAAQPPAQPCQLCGRSPLGEAPPGTPPCRLCCPATAPQEAPAPEGRALGEEEEEPPRAGEGRPAGREEEEEEEEEGTYHCTECEDSFDNLGELHGHFMLHARGEV

SEQ ID NO: 918150 - protein, 416 aa, Homo sapiens
GRTEGKIERGHDFGFGVGVRGMSHARVGALGTSDQQIPDPHTSSPNPQEGPGEWLTLDSQVIMADSEICGTKDPTFHRILLDTRFELPLDIPEEEARYWAKKLEQLNAMRDQDEYSFQDEQDKPLPVPSNQCCNWNYFGWGEQHNDDPDSAVDDRDSDYRSETSNSIPPPYYTTSQPNASVHQYSVRPPPLGSRESYSDSMHSYEEFSEPQALSPTGSSRYASSGELSQGSSQLSEDFDPDEHSLQGSDMEDERDRDSYHSCHSSVSYHKDSPRWDQDEEELEEDLEDFLEEEELPEDEEELEEEEEEVPDDLGSYAQREDVAVAEPKDFKRISLPPAAPGKEDKAPVAPTEAPDMAKVAPKPATPDKVPAAEQIPEAEPPKDEERAKANWLRAFNKVRMQLQEENSLEEMTLKEK

SEQ ID NO: 918151 - protein, 103 aa, Homo sapiens
GRTEGKIERGHDFGFGVGVRGMSHARVGALGTSDQQIPDPHTSSPNPQEGPGEWLTLDSQVIMADSEICGTKDPTFHRILLDTRFELPLGEYRGPGPSPSPSP

SEQ ID NO: 918152 - protein, 135 aa, Homo sapiens
MNPASRSNYLPSSPDARMGEQFRMRPFLLLTYFIIHAHLNVGYKVKGSTPQVIMQTTPVKTLRMLSSQVRAGSCACGQPTPKEEESGKKGRKTPDVCQRIKPQVKSSNHTSVLQDAYLAPSKSNLLSFHSCSKAF

SEQ ID NO: 918153 - protein, 243 aa, Homo sapiens
MHSRRFLSSQAFRGTTEPRVLCMVLPQNPPDPILAQDLCGDGSVIDVLHKLHQGGLGLLIHQALHVLQPERAQGQEGRLQDGFNIHLLQALQDPGDQQGPVRVHVQAPGTSRKNLVAKFQRLAEPSMEAVVKVKPHDKDAKMKYQECNKIVKQKAFERAIAGDEHKRSVVDSLDIESMTIEGEYSGPKLEDDKVTITFMKGLMQWYKDQKKLHQKCAYQVMHLSGTGHPGTLGWHHSTARRGH

SEQ ID NO: 918154 - protein, 237 aa, Homo sapiens
MHSRRFLSSQAFRGTTEPRVLCMVLPQNPPDPILAQDLCGDGSVIDVLHKLHQGGLGLLIHQALHVLQPERAQGQEGRLQDGFNIHLLQALQDPGDQQGPVRVHVQAPGTSRKNLVAKFQRLAEPSMEAVVKVKPHDKDAKMKYQECNKIVKQKAFERAIAGDEHKRSVVDSLDIESMTIEGEYSGPKLEDDKVTITFMKGLMQWYKDQKKLHQKCAYQDFRQKSGIITSQDCVQTT

SEQ ID NO: 918155 - protein, 400 aa, Homo sapiens
MLQFPLLLLPHFLLPPLSKKSLLPPTMILRPYQPCGTVKEFDTNFTYVQQSEFYLEPNIKYVFQVRCQETGKRYWQPWSSPFFHKTPETVPQVTSKAFQHDTWNSGLTVASISTGHLTSDNRGDIGLLLGMIVFAVMLSILSLIGIFNRSFRTGIKRRILLLIPKWLYEDIPNMKNSNVVKMLQENSELMNNNSSEQVLYVDPMITEIKEIFIPEHKPTDYKKENTGPLETRDYPQNSLFDNTTVVYIPDLNTGYKPQISNFLPEGSHLSNNNEITSLTLKPPVDSLDSGNNPRLQKHPNFAFSVSSVNSLSNTIFLGELSLILNQGECSSPDIQNSVEEETTMLLENDSPSETIPEQTLLPDEFVSCLGIVNEELPSINTYFPQNILESHFNRISLLEK

SEQ ID NO: 918156 - protein, 264 aa, Homo sapiens
MEFWANSCFHLYRAPYFWIKRRILLLIPKWLYEDIPNMKNSNVVKMLQENSELMNNNSSEQVLYVDPMITEIKEIFIPEHKPTDYKKENTGPLETRDYPQNSLFDNTTVVYIPDLNTGYKPQISNFLPEGSHLSNNNEITSLTLKPPVDSLDSGNNPRLQKHPNFAFSVSSVNSLSNTIFLGELSLILNQGECSSPDIQNSVEEETTMLLENDSPSETIPEQTLLPDEFVSCLGIVNEELPSINTYFPQNILESHFNRISLLEK

SEQ ID NO: 918157 - protein, 227 aa, Homo sapiens
MKNSNVVKMLQENSELMNNNSSEQVLYVDPMITEIKEIFIPEHKPTDYKKENTGPLETRDYPQNSLFDNTTVVYIPDLNTGYKPQISNFLPEGSHLSNNNEITSLTLKPPVDSLDSGNNPRLQKHPNFAFSVSSVNSLSNTIFLGELSLILNQGECSSPDIQNSVEEETTMLLENDSPSETIPEQTLLPDEFVSCLGIVNEELPSINTYFPQNILESHFNRISLLEK

SEQ ID NO: 918158 - protein, 243 aa, Homo sapiens
GSEDKRGAGTPRQSREIEMQKLPEAVQLIEKASMMYLENGTPDTAAMALERAGKLIENVDPEKAVQLYQQTANVFENEERLRQAVELLGKASRLLVRGRRFDEAALSIQKEKNIYKEIENYPTCYKKTIAQVLVHLHRNDYVAAERCVRESYSIPGFNGSEDCAALEQLLEGYDQQDQDQVSDVCNSPLFKYMDNDYAKLGLSLVVPGGGIKKKSPATPQAKPDGVTATAADEEEDEYSGGLC

SEQ ID NO: 918159 - protein, 418 aa, Homo sapiens
DSAQCCGARASLLGRSAPEDCGGGCLCIGGSLAASLASTCWVPVASLPHLWQPKMSSGEQHRSVENHRPRRAPCVEGTIGLPQKLLGEPLSSGILLSLWAGTVLRSSFDVFLIDSLEKKVKRTNSLKTGFLKWKPDYDSAASEYGKAAVAFKNAKQFEQAKDACLREAVAHENNRALFHAAKAYEQAGMMLKEMQKLPEAVQLIEKASMMYLENGTPDTAAMALERAGKLIENVDPEKAVQLYQQTANVFENEERLRQAVELLGKASRLLVRGRRFDEAALSIQKEKNIYKEIENYPTCYKKTIAQVLVHLHRNDYVAAERCVRESYSIPGFNGSEDCAALEQLLEGYDQQDQDQVSDVCNSPLFKYMDNDYAKLGLSLVVPGGGIKKKSPATPQAKPDGVTATAADEEEDEYSGGLC

SEQ ID NO: 918160 - protein, 204 aa, Homo sapiens
PGPSLTGAALAPGGGGREGSGLRGLGALVPAGLPGLGVLWVTPPGVGVSSAAPREAPWVHPAGSQKKRTRVGGDSAQCCGARASLLGRSAPEDCGGGCLCIGGSLAASLASTCWVPVASLPHLWQPKMSSGEQHRSVENHRPRRAPCVEGTIGLPQKLLGEPLSSGILLSLWAGTVLRSSFDVYVLPPLVQYVVGTLQMFVGLN

SEQ ID NO: 918161 - protein, 283 aa, Homo sapiens
MYDSAASEYGKAAVAFKNAKQFEQAKDACLREAVAHENNRALFHAAKAYEQAGMMLKEMQKLPEAVQLIEKASMMYLENGTPDTAAMALERAGKLIENVDPEKAVQLYQQTANVFENEERLRQAVELLGKASRLLVRGRRFDEAALSIQKEKNIYKEIENYPTCYKKTIAQVLVHLHRNDYVAAERCVRESYSIPGFNGSEDCAALEQLLEGYDQQDQDQVSDVCNSPLFKYMDNDYAKLGLSLVVPGGGIKKKSPATPQAKPDGVTATAADEEEDEYSGGLC

SEQ ID NO: 918162 - protein, 182 aa, Homo sapiens
LAKARAGSLSLQGGMEGEARVRTGAARGTCGPARVPGGRRLGRPRTRSSRPALPAPGNEGLSTRASGCSGRCTRSPSSASPPALRSISRRALAAFPRGRAQDLQPAMPEPPASVGSCAARASPMSAAPCSRAPSPIDHPRAEECERTARDWQAAPPAAPVRDPLGEASWASESGGDVENLCV

SEQ ID NO: 918163 - protein, 151 aa, Homo sapiens
MGRNAHLLLAAQGSLLDYGSKTEGYPTYISTVEHRIMSFSIGEADLREHSKVLCKYEKLRLIHQKQSSQHPKTPDSSEGTLSTLPVGCMESQIHIPATREQTEGLSSSLWPPQKEMRDSRPQDMKSLTWNGMVNKGRLWQWQCIKRSINGN

SEQ ID NO: 918164 - protein, 1093 aa, Homo sapiens
MGESITTGKVVCPKMGERREIGDSGSRPPAPPGQSLSSDPRPLSPGYGLPQRARAGAVARDAEAPSLADFGLLGARVGPGRAESEAAGGSGGRSGWAGALTSDPGPGAGGRSPATSWWPRSQPGRAVRRAAWQPRAQPPGSGRDMELSLESLGGLHSVAHAQAGELLSPGHARSAAAQHRGLVAPGRPGLVAGMASLLDGGGGGGGGGAGGAGGAGSAGGGADFRGELAGPLHPAMGMACEAPGLGGTYTTLTPLQHLPPLAAVADKFHQHAAAAAVAGAHGGHPHAHPHPAAAPPPPPPPQRLAASVSGSFTLMRDERAALASVGHLYGPYGKELPAMGSPLSPLPNALPPALHGAPQPPPPPPPPPLAAYGPPGHLAGDKLLPPAAFEPHAALLGRAEDALARGLPGGGGGTGSGGAGSGSAAGLLAPLGGLAAAGAHGPHGGGGGPGGSGGGPSAGAAAEEINTKEVAQRITAELKRYSIPQAIFAQRILCRSQGTLSDLLRNPKPWSKLKSGRETFRRMWKWLQEPEFQRMSALRLAAGRRPMPGASAPSPARAPRQPGTPYQEARPRSAPLPVCTVAKREKGIVPPPRPPVAASAPFGSAARFFVVRPRDRYPLPLPSGRWQRSPENGGGGAAPGTLGPRRPEAFTPRPGARPAQFGRGSGARAPARLALGDNSRGGWRLIDRFSEHKGEKGGGSGRRPTSKEAEGLAAVPPGSPSRQGGWAKRGQRGRSGNLDDFSLSCSPPHDTYSGTRALTIDRRSYPHTATALEVQCEASDLGATENISQSVTEGQTAGEKSHGGGVGSPQPGQQHPAPALSGHRLLRLHLTLHPGVRGGTGGVSAAPGTPSLPQGAGALRMINPDHAARLLSAGSAAHAVAPPRGPAAAGFTPSTLRTCRVSGALGAASTPPDSAWGAFSSGRCANEKRLSGGKSRRLGGDGRMRPHLHLTRRRPNAGARKGNSAPAPPPHHFNPAAEDSPPFLLRHPHSPLREHRGPPQASSKENFAPRVSRRACPARGGPRVSAGVVRPALRFPLCPSSSKYDDVVGIFHHPANAVPQHPGSCGVGLGPPRCAHRSLAGVWIPERARPPTA

SEQ ID NO: 918165 - protein, 136 aa, Homo sapiens
MNAFLQWKALPSAVRESVVTWTAYSPSTSACSLVGYGPIRVCCLRYMGYHYPKCLHTYPPLTCLPCSGLTQSGKLRLAFALFSSIFNEHVVICSHIISFNPHGPTHYQMGRISSPGLVTHGSLLTTESYNKDTRNS

SEQ ID NO: 918166 - protein, 245 aa, Homo sapiens
MLERGAESAAGATDPSPTGKEPVTKEAPHQGPPQKPSQSAPGPTASAGSPPRPRRRPPPQRPHRCPDCDKAFSYPSKLATHRLAHGGARPHPCPDCPKAFSYPSKLAAHRLTHSGARPHPCPHCPKSFGHRSKLAAHLWTHAPTRPYPCPDCPKSFCYPSKLAAHRHTHHATDARPYPCPHCPKAFSFPSKLAAHRLCHDPPTAPGSQATAWHRCSSCGQAFGQRRLLLLHQRSHHQVEHKGERD

SEQ ID NO: 918167 - protein, 154 aa, Homo sapiens
MVWVLRDEPGQSELSLNQDLEVAGCEPGASFWCQKVKKCFKKGTGGYRKDTGDSLKELLMAKIEEFEQKYEMKLLDPHTALLKKVAVSAAFLFSQASSFHLAIQTQTGPIPKADSALSQDTTPLVGRKKKLSKRLVLTSRKQFFSIIRITSMTD

SEQ ID NO: 918168 - protein, 101 aa, Homo sapiens
ESERGCRDTEMADEIDWLDLPGRWAYGVDGGGRIFFINDEEKSTSWVHPGTKSPIQSGHTSCPGLPKGWEVDSTQEGAVYFINHNERRNTFLHPKTAQVPE

SEQ ID NO: 918169 - protein, 154 aa, Homo sapiens
ESERGCRDTEMADEIDWLDLPGRWAYGVDGGGRIFFINDEEKSTSWVHPGTKSPIQSGHTSCPGLPKGWEVDSTQEGAVYFIKHTGRGSEAGDAAAGQDVEAVGREGVRGVYEGGHHTGGGKASSGGVTFPIPHRQDLPALRSATIYHLHQLSR

SEQ ID NO: 918170 - protein, 155 aa, Homo sapiens
MAFGVQSPTECKNCRIMLLNQRSSGFGVLQDKVGGNVSHYKVALSLQLFIRETGTEEGVSFLGYSSHLPFPGLSAEHCVVVGPGGPRASPEFSKDLAPEDPDVPLKVKQAYKRLMGGELVSVLELPLPWPCPGRISGSMATDQRPDCATDLHIGY

SEQ ID NO: 918171 - protein, 102 aa, Homo sapiens
MFLLPFAGPPDATSTHLPENKTGTEHLLLACVVAGPRRVTQCCRISASHYRSVIHPLPPTDGFAGKSKSKIKQKSIIFCSFLLNSSAGQMEFYNLELNERWL

SEQ ID NO: 918172 - protein, 416 aa, Homo sapiens
MDASRPKSSESQSSLEAPRPGPNPSPNVVNKPLQRDSPGMVADRLPPKTGAVVIDMGTGTCKVGFAGQASPTYTVATILGCQPKKPATSGQSGLQTFIGEAARVLPELTLVQPLRSGIVVDWDAAELIWRHLLEHDLRVATHDHPLLFSDPPFSPATNREKLVEVAFESLRSPAMYVASQSVLSVYAHGRVSGLVVDTGHGVTYTVPVFQGYNLLHATERLDLAGNNLTAFLAEMLLQAGLPLGQQDLDLVENIKHHYCYVASDFQKEQARPEQEYKRTLKLPDGRTVTLGKELFQCPELLFNPPEVPGLSPVGLSTMAKQSLRKLSLEMRADLAQNVLLCGGSSLFTGFEGRFRAELLRALPAETHVVVAAQPTRNFSVWIGGSILASLRAFQSCWVLREQYEEQGPYIVYRKCY

SEQ ID NO: 918173 - protein, 153 aa, Homo sapiens
RNEAKAGMSQLLPGHPPGWGSLTIMVEGKEEQVTSYMDGSRQRESEEDIKVETPDKTIRSCEMYSLLGEKYGGNCLHDSIISHQVPPTTRGNYGSTIQDEIWVETQSQTISCLLSGTSVITIGIQTHTMKHKQTEANKGEDSCLNNTAYLQKS

SEQ ID NO: 918174 - protein, 266 aa, Homo sapiens
MGTATRRKPHLLLVAAVALVSSSAWSSALGSQTTFGPVFEDQPLSVLFPEESTEEQVLLACRARASPPATYRWKMNGTEMKLEPGSRHQLVGGNLVIMNPTKAQDAGVYQCLASNPVGTVVSREAILRFGFLQEFSKEERDPVKAHEGWGVMLPCNPPAHYPGLSYRWLLNEFPNFIPTDGRHFVSQTTGNLYIARTNASDLGNYSCLATSHMDFSTKSVFSKFAQLNLAAEDTRLFAPSIKARFPAETYALVGQQVTLECFAFGK

SEQ ID NO: 918175 - protein, 153 aa, Homo sapiens
SPWSLPPVLQEFSKEERDPVKAHEGWGVMLPCNPPAHYPGLSYRWLLNEFPNFIPTDGRHFVSQTTGNLYIARTNASDLGNYSCLATSHMDFSTKSVFSKFAQLNLAAEDTRLFAPSIKARFPAETYALVGQQVTLECFAFGNPVPRIKWRKV

SEQ ID NO: 918176 - protein, 377 aa, Homo sapiens
TRATQQRWNPFGGAWGPSSQARRVSGEGCSPWQTDSVAWGFGGAREAGANLIGGDTSAVLFPPLGGLLCQQPGGRPGRQSQWYRGLGRAVSGSSGTMSTIQSETDCYDIIEVLGKGTFGEVAKGWRRSTGEMVAIKILKNDAYRNRIIKNELKLLHCMRGLDPEEAHVIRFLEFFHDALKFYLVFELLEQNLFEFQKENNFAPLPARHIRTVTLQVLTALARLKELAIIHADLKPENIMLVDQTRCPFRVKVIDFGSASIFSEVRYVKEPYIQSRFYRAPEILLGLPFCEKVDVWSLGCVMAELHLGWPLYPGNNEYDQVRYICETQGLPKPHLLHAACKAHHFFKRNPHPDAANPWQLKSSADYLAETKVREKLGV

SEQ ID NO: 918177 - protein, 289 aa, Homo sapiens
RAVGVGENPWAEKGAAMLGTAESRSSDALPQGAGAGATLGVVTELMWGLGAWGTDFEDAKPPGLPPGLGSGVTLQDCGGPHPENALESLEALSLGPGNRALTFPTQCHPLRAAHRGGCYCRCTGIGAEGRGAPGQAALGRAAQVGGWLEAQPTELLLRVWAHEAKRASLWPRPVPPSPLCHGRLGFLGMGFASCHKSHCQGFPTDPELCHRGCCPGTGWQRGPEACAWPEEQGLAACEQGPHQVVFTVAKFRPPGPHLLWPCRLSPAAACLPAILLPGLPGLCLPCLLS

SEQ ID NO: 918178 - protein, 86 aa, Homo sapiens
VALPLKGKPAVSFPGLEAWPLLSQAWGHWPGPHLLVSRVHTKSCSQWLSSAPQALTSSGLAACPLLPPVCLPSCCLASLGSASRAY

SEQ ID NO: 918179 - protein, 174 aa, Homo sapiens
MNRSIYDRQLLCVLLASQEFPAHEGRGDEERPIDAKIMTKCLHLMKQLHSYGGGGLCACLVSYESASCKEDSGDVAGLEARQEELGNSVTELQHAELKTICRQFRVTVAKAEGNFSINLTKVLCSLLSSRQPEGSTGPRTLSSDAAYHLLFLMSSWTTSYHQHPLPKVLEPTLE

SEQ ID NO: 918180 - protein, 174 aa, Homo sapiens; identical to SEQ ID NO: 918179

SEQ ID NO: 918181 - protein, 347 aa, Homo sapiens
HSLSRSTVRMSYQRCKSDPVTLLLKILQHLLPPGPKSPPLYYTKLSPDAICNLCTQIKPGPLLSLREAEQSELLFGFSVGTFGFKNALGGEDEGSTFGLRTAGLRVSPFGVTAVFIELTLATLAIVHQAVVTLLLLDGAVQRCLTALQGLVVLITGQRETENLSAQSRALHQESCQYGVKTDEHVSSALWLPRAPRAEKQLPTTLLYPQQADFKPLYSCASAVTTEWASPKLTTSLTLISTSDPLFIPIIPPATSTTVSPEPPPTALLGCMRLKFNLHLPAPCLDSPSSPAAATGHTTVPISKSCHFFQNTSHIPLTVPFYSRGPLTCACLPLPVDTMRHPVTTFLG

SEQ ID NO: 918182 - protein, 111 aa, Homo sapiens
RPLSRRARHPRVAQPTGPDGAAACRARARARPGGGRGALTVAGPSFPSFIYCQIWAASPARHPPSPRRVCTIPRWRFSCFSFLDDINIDRTLLLAPGFLWGPKSAVALGER

SEQ ID NO: 918183 - protein, 266 aa, Homo sapiens
MRASLELHAAASDHSSSGNDRDSVRSGDSSGSGSGGAAPAFPPPSPPAPRPKDGEARRLLQMDSGYASIEGRGAGDDTEPPAAPARPRSPRAWPRRPRRDYSIDEKTDALFHEFLRHDPHFDDTPAAARHRARAHPHARKQWQRGRQHSDPGARAAPALAGTPAPPAGAARPARAPLRRGDSVDGPPDGRTLGGAGDDPAIPVIEEEPGGGGCPGSGLCVLPSGSVLDKLAAGLDERLFPPRLAEPVVATPALVAAAPTSPDHSPA

SEQ ID NO: 918184 - protein, 679 aa, Homo sapiens
MASRLSPGRKAAGDAPGARAGHGGEAAAAILRLRARPPEAAAPPQAAAPAPPPRRSLATRPPSRGLLRTLSTGETSTSRSRDPGARAQPLHPPWRAGSGRSPSTQPWPGGPCQGVAELLGVGVAPHPRDGADRASGVLLEPAAPPWRPHSSECLPCPALSSRAWRYLAGQAAPAVCSCDGYRRTLRGPGLLPRHGDGRWRSRESPRGPLGRAKPGGGCLRLCYLSMSHCPLCGLLLLQGRPSLSAVAPAGEVGLAGADQASSPQGPPPQFRMQPTATMATAATTTTTTTATVALTTSWDNATGRPTAEPDPILDNYVLLVVVMSLFVGGTLVVLSGVLLLCKRCWDVHQRLNRAMEEAEKTTTTYLDNGTHPAQDPDFRGEDPECQDAETERFLSTSSTGRRVSFNEAALFEQSRKTQDKGRRYTLTEGDFHHLKNARLTHLHLPPLKIVTIHECDSGEASSATTPHPATSPKATLAIFQPPGKALTGRSVGPSSALPGDPYNSAAGATDFAEISPSASSDSGEGTSLDAGTRSTKAGGPGAAAGPGEAGPGSGAGTVLQFLTRLRRHASLDGASPYFKVKKWKLEPSQRAASLDTRGSPKRHHFQRQRAASESTEQEEGDAPPSTLRREQNPDGQVQASQALFIAKFGRPRPHGTLRVPAASAPSRDGVSRVFLFWMI

SEQ ID NO: 918185 - protein, 976 aa, Homo sapiens
MASRLSPGRKAAGDAPGARAGHGGEAAAAILRLRARPPEAAAPPQAAAPAPPPRRSLATRPPSRGLLRTLSTGETSTSRSRDPGARAQPLHPPWRAGSGRSPSTQPWPGGPCQGVAELLGVGVAPHPRDGADRASGVLLEPAAPPWRPHSSECLPCPALSSRAWRYLAGQAAPAVCSCDGYRRTLRGPGLLPRHGDGRWRSRESPRGPLGRAKPGGGCLRLCYLSMSHCPLCGLLLLQGRPSLSAVAPAGEVGLAGADQASSPQGPPPQFRMQPTATMATAATTTTTTTATVALTTSWDNATGRPTAEPDPILDNYVLLVVVMSLFVGGTLVVLSGVLLLCKRCWDVHQRLNRAMEEAEKTTTTYLDNGTHPAQDPDFRGEDPECQDAETERFLSTSSTGRRVSFNEAALFEQSRKTQDKGRRYTLTEGDFHHLKNARLTHLHLPPLKIVTIHECDSGEASSATTPHPATSPKATLAIFQPPGKALTGRSVGPSSALPGDPYNSAAGATDFAEISPSASSDSGEGTSLDAGTRSTKAGGPGAAAGPGEAGPGSGAGTVLQFLTRLRRHASLDGASPYFKVKKWKLEPSQRAASLDTRGSPKRHHFQRQRAASESTEQEEGDAPQEDFIQYIARAGDAVAFPHPRPFLASPPPALGRLEAAEAAGGASPDSPPERGAGSAGPEQQQPPLEPDAERDAGPEQAQTSYRDLWSLRASLELHAAASDHSSSGNDRDSVRSGDSSGSGSGGAAPAFPPPSPPAPRPKDGEARRLLQMDSGYASIEGRGAGDDTEPPAAPARPRSPRAWPRRPRRDYSIDEKTDALFHEFLRHDPHFDDTPAAARHRARAHPHARKQWQRGRQHSDPGARAAPALAGTPAPPAGAARPARAPLRRGDSVDGPPDGRTLGGAGDDPAIPVIEEEPGGGGCPGSGLCVLPSGSVLDKLAAGLDERLFPPRLAEPVVATPALVAAAPTSPDHSPA

SEQ ID NO: 918186 - protein, 182 aa, Homo sapiens
WKSEGDLRKMSFSPWLCALGKPLSALLVARLPRRLEERSCPLPFSEHPVSPAVFAAPWLSGCNSNPCLHLHMAVSFLCVSVPKCSSSTEDMGYIVLESTRTTDRIFALLHLQRLYFQIRSHAQVQGLGHQLLSWKNRIQLIQHWRGENKTEREREREREMRGPHMPCSSQNFSRSKSNLQEL

SEQ ID NO: 918187 - protein, 139 aa, Homo sapiens
MCYFKLNSQNGAPDLPSQGRNCLQSQFLTAAQAKALELSLIPVSLISHIQSIGKSSQLFHKYAASDHFSTPTATTLPKPHLLSPELAQQSHYWAYCFHPFCNTRHCGPRLHSWKPVRPGTLRSRKDLPLGEDFSSYFHL

SEQ ID NO: 918188 - protein, 168 aa, Homo sapiens
VCGSNWSQWLRMHFKGEPVDACSDVSGVSSFLWVHGLADFRSEATDLRRVKLQTFTVSVTALKGGASRVVCSSWWVRGLTDFRSEATGLRSVLQLLKVAHLELFVPPGGRVVSLTKGMKPQTSAVSVTAHKGSVGPKKGMEIKNVIHMLSVKCLLRHLFLSASVDITI

SEQ ID NO: 918189 - protein, 259 aa, Homo sapiens
MDRSAEFRKWKAQCLSKADLSRKGSVDEDVVELVQFLNMRDQFFTTSSCAGRILLLDRGINGFEVQKQNCCWLLVTHKLCVKDDVIVALKKANGDATLKFEPFVLHVQCRQLQDAQILHSMAIDSGFRNSGITVGKRGKTMLAVRSTHGLEVPLSHKGKLMVTEEYIDFLLNVANQKMEENKKRIERFYNCLQHALERETMTNLHPKIKEKNNSSYIHKKKRNPEKTRAQCITKESDEELENDDDDDLGINVTIFPEDY

SEQ ID NO: 918190 - protein, 259 aa, Homo sapiens; identical to SEQ ID NO: 918189

SEQ ID NO: 918191 - protein, 259 aa, Homo sapiens; identical to SEQ ID NO: 918189

SEQ ID NO: 918192 - protein, 139 aa, Homo sapiens
MAIDSGFRNSGITVGKRGKTMLAVRSTHGLEVPLSHKGKLMVTEEYIDFLLNVANQKMEENKKRIERFYNCLQHALERETMTNLHPKIKEKNNSSYIHKKKRNPEKTRAQCITKESDEELENDDDDDLGINVTIFPEDY

SEQ ID NO: 918193 - protein, 181 aa, Homo sapiens
FLKMVCPEFVPSDVQMCPEFLPSSGFVVLLTSGVKLQTFAHSMAIDSGFRNSGITVGKRGKTMLAVRSTHGLEVPLSHKGKLMVTEEYIDFLLNVANQKMEENKKRIERFYNCLQHALERETMTNLHPKIKEKNNSSYIHKKKRNPEKTRAQCITKESDEELENDDDDDLGINVTIFPEDY

SEQ ID NO: 918194 - protein, 259 aa, Homo sapiens; identical to SEQ ID NO: 918189

SEQ ID NO: 918195 - protein, 259 aa, Homo sapiens; identical to SEQ ID NO: 918189

SEQ ID NO: 918196 - protein, 259 aa, Homo sapiens; identical to SEQ ID NO: 918189

SEQ ID NO: 918197 - protein, 153 aa, Homo sapiens
PCWNDSLNFHRYHSMAIDSGFRNSGITVGKRGKTMLAVRSTHGLEVPLSHKGKLMVTEEYIDFLLNVANQKMEENKKRIERFYNCLQHALERETMTNLHPKIKEKNNSSYIHKKKRNPEKTRAQCITKESDEELENDDDDDLGINVTIFPEDY

SEQ ID NO: 918198 - protein, 168 aa, Homo sapiens; identical to SEQ ID NO: 918188

SEQ ID NO: 918199 - protein, 112 aa, Homo sapiens
GSLQGCAASCARAFLRTCCARSESGLAVRGTKGVAFGENPRAAGTCSQSPFFPVAPPPGVRLWVLCPDRFTGAFLLRTTLALNVRAGDEGPRRLLRAPRVPSRPSAPLAPAP

SEQ ID NO: 918200 - protein, 412 aa, Homo sapiens
TSRTAELAQHGCSRFTGAFLLRTTLALNVRAGDEGPRRLLRAPRVPSRPSAPLAPAPASTPARRLPPVPMQAPGRGPLGLRLMMPGRRGALREPGGCGSCLGVALALLLLLLPACCPVRAQNDTEPIVLEGKCLVVCDSSPSADGAVTSSLGISVRSGSAKVAFSATRSTNHEPSEMSNRTMTIYFDQVSRSACPPRPQPGERGGDLRARAGVQASWTWSSQALSSPSALLVSFLPFHRTHSYSFPFPHFGFLKTFEMISYLGTWMTESPLRLSKLSKSSNAEDAEFVFPAADEGGSVAGYPRMMKTYTEEGLAIVCCVPSSFSAPRKGIYSFSFHVVKVYNRQTIQVSLMQNGYPVISAFAGDQDVTREAASNGVLLLMEREDKVHLKLERGNLMGGWKYSTFSGFLVFPL

SEQ ID NO: 918201 - protein, 137 aa, Homo sapiens
MARLGSETPGLLLLPNLKKRKREVFVNRSVGTGNPCFRYRKSETTHLQGAKLRSQCGGLQKSRNRTQGSRAGMLVVLSAQEIGETGSSGLAAHYNYPVKEDVQILLYKEVQGLYIENYETLLEEVKDLKKWKDIPCS

SEQ ID NO: 918202 - protein, 385 aa, Homo sapiens
LTTLFTLIRFLSSVSPFMYSNGTGTTKRLTTLFTFIGFLPSVSPFMHSKGTGTTEGFTTLFTFIGFLSSVSPFMHPKGTRKTKGFTTLFTFIGFLSSVNSFMHSKGTGTTEGFTTLFTFIGFLSSVSPFMYSNRTGTTEGFTTLFTFMGFLSSVSSFMHSKGTGTTEGFTTLFTFIGFLSSVSSFMDLKRTRTIKGFPTFLAFIRSISSVHYHMSSIAWKRNECFPTFLTIIGFLSCMNSFMFSKGTRKTEGFPTFFTFIGFFSSVNPFMTSKGCGTTKSFTTLLTLIGFFPSVSPFMYLKSLVISESFSTLFTFIGFLSRVSSFMISKRTGMTERFPAFFTFIGFLSSMSSFMYLKGTGPTESLTTLFTFIGFLSSVSSFMYSK

SEQ ID NO: 918203 - protein, 262 aa, Homo sapiens
MPEAADSADPSPLLGADFNLSPGFYPDPDTDSTPDPDSGPDSDPHPDPDSSPDSVSSRDFPSGPDSCSSPDSHSGPHSRSGPDPPSGSASCSGLDPYSGADSRSRPEPNSGPDSGSDPDSSRIRAALPVLDSYLAPALPLDPPPEPAPELPLLPEEDPEPAPSLKLIPSVSSEAGPAPGPLPTRTPLAANSPGPTLDFTFRADPSAIGLADPPIPSPVPSPILGTIPSAISLQNCTETFPSSSENFALDKRVLIRVTYCTFY

SEQ ID NO: 918204 - protein, 131 aa, Homo sapiens
MTVPLIKEAAFRIAASEGQELFKAETQHPVKRKLPCFFQLSFHHFVLFRHSQAPAAVGPITASPPLLRAPRITGHTQFCPFTNASCGLFEDLRFRSDDAFHVCPAARESFTGEKSRASEQILVHLSFQSTP

SEQ ID NO: 918205 - protein, 155 aa, Homo sapiens
ELLHMNVMVPIQNPVTSALVTQDSPVFLKAHYDFSLSQASACAIFSALQTLSLARQIHTCSHIKDDLLCEAFANASALYHMPCFGVQFEMPKALTENLSQSTKYGSENPSHNGFSYSFIILGLINPSDYIAGRTELTFERILHPWLLRFISKEAE

SEQ ID NO: 918206 - protein, 349 aa, Homo sapiens
MILRLPQPCETPFAPDLDSYASPSGVRLVGGLHRCEGRVEVEQKGQWGTVCDDGWDIKDVAVLCRELGCGAASGTPSGILYEPPAEKEQKVLIQSVSCTGTEDTLAQCEQEEVYDCSHDEDAGASCENPESSFSPVPEGVRLADGPGHCKGRVEVKHQNQWYTVCQTGWSLRAAKVVCRQLGCGRAVLTQKRCNKHAYGRKPIWLSQMSCSGREATLQDCPSGPWGKNTCNHDEDTWVECEDPFDLRLVGGDNLCSGRLEVLHKGVWGSVCDDNWGEKEDQVVCKQLGCGKSLSPSFRDRKCYGPGVGRIWLDNVRCSGEEQSLEQCQHRFWGFHDCTHQEDVAVICSG

SEQ ID NO: 918207 - protein, 378 aa, Homo sapiens
GITPPNSVDTMGCQMAGRGGGSSTLSLEPNLLLPEQNRGTLRLTTRLFAASPSGVRLVGGLHRCEGRVEVEQKGQWGTVCDDGWDIKDVAVLCRELGCGAASGTPSGILYEPPAEKEQKVLIQSVSCTGTEDTLAQCEQEEVYDCSHDEDAGASCENPESSFSPVPEGVRLADGPGHCKGRVEVKHQNQWYTVCQTGWSLRAAKVVCRQLGCGRAVLTQKRCNKHAYGRKPIWLSQMSCSGREATLQDCPSGPWGKNTCNHDEDTWVECEDPFDLRLVGGDNLCSGRLEVLHKGVWGSVCDDNWGEKEDQVVCKQLGCGKSLSPSFRDRKCYGPGVGRIWLDNVRCSGEEQSLEQCQHRFWGFHDCTHQEDVAVICSG

SEQ ID NO: 918208 - protein, 221 aa, Homo sapiens
MPLALTLLLLSGLGAPGGWGCLQCDPLVLEALGHLRSALIPSRFQLEQLQARAGAVLMGMEGPFFRDYALNVFVGKVETNQLDLVASFVKNQTQHLMGNSLKDEPLLEELVTLRANVIKEFKKVLISYELKACNPKLCRLLKEEVLDCLHCQRITPKCIHKKYCFVDRQPRVALQYQMDSKYPRNQALLGILISVSLAVFVFVVIVVSACTYRQNRKLLLQ

SEQ ID NO: 918209 - protein, 90 aa, Homo sapiens
QGTSRKRRRESAPPPPLPQAAEWTGGVGMGLRRGGDVEVGAVSPPAPVDRQPRVALQYQMDSKYPRNQALLGILISVSLAVFVFVVIVVS

SEQ ID NO: 918210 - protein, 212 aa, Homo sapiens
MVHFLHPGHTPRNIVPPDAQKDALGCCVVQEEASPYTLVNICLNVLIANLEKLCSERPDGTLCLPEHWSFPQEVAERFLRVMTWQGCWRSQYESDFRSTEPIQEQIMFCEGSPPQAVHRDIFNGGNHACYFKACGYRNEESPIGFASAVHSQCLRSQPNTPGPGQGDACSPVVRGHLSTFQGSEKFPPLPAGRGPCGLPQCLCPWVLEIREW

SEQ ID NO: 918211 - protein, 136 aa, Homo sapiens
ATPKMDPVSGAKLPQGTGTRTEATETGPLKHTHSKELALLDKWQFPKLSCSDVIQRHAGDKSTAGSAYSLCGNLGFAAQACQPGPKNQARLPLHKHCNAATIDLTMLPSPGHLKQTPHSEAPGSKQDELPTQLALT

SEQ ID NO: 918212 - protein, 136 aa, Homo sapiens; identical to SEQ ID NO: 918211

SEQ ID NO: 918213 - protein, 141 aa, Homo sapiens
MPLPLLVATCTAWLVVLSSVFQAYYSDFCFRRHITFPLTKTLVKNQACLGTQDHLPTSSSFTQSHLQSPFCHLRNGVWHLANQPGKVQKALHLIKDAFSTGFYFRANGISCFVESKKAQLPCFNNMVDSTALILGDSGFTF

SEQ ID NO: 918214 - protein, 320 aa, Homo sapiens
FFCRYISYMEAGNQTGFLEFILLGLSEDPELQPFIFGLFLSMYLVTVLGNLLIILAISSDSHLHTPMYFFLSNLSWVDICFSTCIVPKMLVNIQTENKAISYMDCLTQVYFSMFFPILDTLLLTVMAYDRFVAVCHPLHYMIIMNPHLCGLLVFVTWLIGVMTSLLHISLMMHLIFCKDFEIPHFFCELTYILQLACSDTFLNSTLIYFMTGVLGVFPLLGIIFSYSRIASSIRKMSSSGGKQKALSTCGSHLSVVSLFYGTGIGVHFTSAVTHSSQKISVASVMYTVVTPMLNPFIYSLRNKDVKGALGSLLSRAASCL

SEQ ID NO: 918215 - protein, 632 aa, Homo sapiens
MAAAALRDPAQGCVTFEDVTIYFSQEEWVLLDEAQRLLYCDVMLENFALIASLGLISFRSHIVSQLEMGKEPWVPDSVDMTSAMARGAYGRPGSDFCHGTEGKDLPSEHNVSVEGVAQDRSPEATLCPQKTCPCDICGLRLKDILHLAEHQTTHPRQKPFVCEAYVKGSEFSANLPRKQVQQNVHNPIRTEEGQASPVKTCRDHTSDQLSTCREGGKDFVATAGFLQCEVTPSDGEPHEATEGVVDFHIALRHNKCCESGDAFNNKSTLVQHQRIHSRERPYECSKCGIFFTYAADLTQHQKVHNRGKPYECCECGKFFSQHSSLVKHRRVHTGESPHVCGDCGKFFSRSSNLIQHKRVHTGEKPYECSDCGKFFSQRSNLIHHKRVHTGRSAHECSECGKSFNCNSSLIKHWRVHTGERPYKCNECGKFFSHIASLIQHQIVHTGERPHGCGECGKAFSRSSDLMKHQRVHTGERPYECNECGKLFSQSSSLNSHRRLHTGERPYQCSECGKFFNQSSSLNNHRRLHTGERPYECSECGKTFRQRSNLRQHLKVHKPDRPYECSECGKAFNQRPTLIRHQKIHIRERSMENVLLPCSQHTPEISSENRPYQGAVNYKLKLVHPSTHPGEVP

SEQ ID NO: 918216 - protein, 436 aa, Homo sapiens
MEAFSRRRCEALKLMVQAWPFRRLPLRPLIKMPCLEAFQAVLDGLDALLTQGVRPRRWKLQVLDLQDVCENFWMVWSEAMAHGCFLNAKRNKTPVQDCPRMRERQPLTVFVELWLKNRTLDEYLTCLLLWVKQRRDLLHLCCKKLKILGMPFRNIRSILKMVNLDCIQEVEVNCKWILPILTQFTPYLGHLRNLQKLVLSHMDVSRYVSPEQKKEIVTQFTTQFLKLRCLQKLYMNSVSFLEGHLDQLLSCLKTSLKVLTITNCVLLESDLKHLSQCPSISQLKTLDLSGIRLTNYSLVPLQILLEKVAATLEYLDLDDCGIIDSQVNAILPALSRCFELNTFSFCGNPICMATLENLLSHTIILKNLCLELYPAPQESYGADGTLCWSRFAQIRAELMKKVRHLRHPKRILFCTDNCPDHGDRSFYDLEADQYCC

SEQ ID NO: 918217 - protein, 305 aa, Homo sapiens
GKEKGREEGWQMAQPLCRDAERDDVGILHVGPLEGDHLEAPALAVRAAGLHLDAPGPRQPAQRQRQQQPPVGAPGPESPHCRLLSAGLGRACRGGSRLGWADARGWDPARTRRAPVPVPATVRSPPAGVAFNPAAPSRPGAEPARPRRALASADTAAAPGTPAPPAHAHPALPGAHPPPEPAAWRSGRSRQERARDCAAAFLGRGEHSAGQRDRRFRAAPGMPGQLWVRSPQPSFINAGPGAAQTPQGGPRVHRGPRCVFTQPLAIVFSRNLHSTAGPATYQNSGAPRPCVVRWKAKFPPDQCVP

SEQ ID NO: 918218 - protein, 350 aa, Homo sapiens
GHMDTPKELWRMITGNMALIQVQATVVGFLASIAAVVFGWIPDGHFSIPHAFLLCASSVATAFIASLVLGMIMIGVIIGSRKIGINPDNVATPIAASLGDLITLALLSGISWGLYLELNHWRYIYPLVCAFFVALLPVWVVLARRSPATREVLYSGWEPVIIAMAISSVGGLILDKTVSDPNFAGMAVFTPVINGVGGNLVAVQASRISTFLHMNGMPGENSEQAPRRCPSPCTTFFSPDVNSRSARVLFLLVVPGHLVFLYTISCMQGGHTTLTLIFIIFYMTAALLQVLILLYIADWMVHWMWGRGLDPDNFSIPYLTALGDLLGTGLLALSFHVLWLIGDRDTDVGD

SEQ ID NO: 918219 - protein, 350 aa, Homo sapiens; identical to SEQ ID NO: 918218

SEQ ID NO: 918220 - protein, 350 aa, Homo sapiens; identical to SEQ ID NO: 918218

SEQ ID NO: 918221 - protein, 282 aa, Homo sapiens
MGVRGSDEGFVGSSQVANILLNGVKYESELTGSSERAEQPLSVGRLCSTICNMPKALRTLCVNHFLGWLSFEGMLLFYTDFMGEVVFQGDPKAPHTSEAYQKYNSGVTMGCWGMCIYAFSAAFYSAILEKLEEFLSVRTLYFIAYLAFGLGTGLATLSRNLYVVLSLCITYGILFSTLCTLPYSLLCDYYQSKKFAGSSADGTRRGMGVDISLLSCQYFLAQILVSLVLGPLTSAVGSANGVMYFSSLVSFLGCLYSSLFVIYEIPPSDAADEEHRPLLLNV

SEQ ID NO: 918222 - protein, 380 aa, Homo sapiens
KNGPTAFGVLLPGTQTLSLSPFGGGFGYVLGGIHWDKTGFGRALGGQFRVLFTAVTLVTTVLTLVSIPERPLRPPSEKRAAMKSPSLPLPPSPPVLPEEGPGDSLPSHTATNFSSPISPPSPLTPKYGSFISRDSSLTGISEFASSFGTANIDSVLIDCFTGGHDSYLAIPGSVPRPPISVSFPRAPDGFYRQDRGLLEGREGALTSGCDGDILRVGSLDTSKPRSSGILKRPQTLAIPDAAGGGGPETSRRRNVTFSQQVANILLNGVKYESELTGSSERAEQPLSVGRLCSTICNMPKALRTLCVNHFLGWLSFEGMLLFYTDFMGEVVFQGDPKAPHTSEAYQKYNSGVTMGCWGMCIYAFSAAFYSAVLNEIETAP

SEQ ID NO: 918223 - protein, 527 aa, Homo sapiens
KNGPTAFGVLLPGTQTLSLSPFGGGFGYVLGGIHWDKTGFGRALGGQFRVLFTAVTLVTTVLTLVSIPERPLRPPSEKRAAMKSPSLPLPPSPPVLPEEGPGDSLPSHTATNFSSPISPPSPLTPKYGSFISRDSSLTGISEFASSFGTANIDSVLIDCFTGGHDSYLAIPGSVPRPPISVSFPRAPDGFYRQDRGLLEGREGALTSGCDGDILRVGSLDTSKPRSSGILKRPQTLAIPDAAGGGGPETSRRRNVTFSQQVANILLNGVKYESELTGSSERAEQPLSVGRLCSTICNMPKALRTLCVNHFLGWLSFEGMLLFYTDFMGEVVFQGDPKAPHTSEAYQKYNSGVTMGCWGMCIYAFSAAFYSAILEKLEEFLSVRTLYFIAYLAFGLGTGLATLSRNLYVVLSLCITYGILFSTLCTLPYSLLCDYYQSKKFAGSSADGTRRGMGVDISLLSCQYFLAQILVSLVLGPLTSAVGSANGVMYFSSLVSFLGCLYSSLFVIYEIPPSDAADEEHRPLLLNV

SEQ ID NO: 918224 - protein, 110 aa, Homo sapiens
AAGAPGLVLTTLCLLLLGAQPLWPCDLPPGSLEMGLLTFRDVAIEFSLEEWQCLDTAQKNLYRNVMLENYRNLAFLGIAVSKPDLIICLEKEKEPWNMKRDEMVDEPPGR

SEQ ID NO: 918225 - protein, 110 aa, Homo sapiens; identical to SEQ ID NO: 918224

SEQ ID NO: 918226 - protein, 571 aa, Homo sapiens
MELLQGPQERPRSEACHHGYKWRSSSRPLEGQDPRCPLAPKTVAVKSLGWLQIILRRFEKCGHENLQLRKGCKSVDECKVHKEGYNGLNQCFTTTQGKASQCGKYLKVFYKFINLNRYKIRHTRKKPFKCKNCVKSFCMFSHKTQHKSIYTTEKSYKCKECGKTFNWSSTLTNHKKTHTEEKPYKCEEYGKAFNQSSNYTTHKVTHTGEKPYKCEECGKAFSQSSTLTIHKRIHTGEKPCKCEECGKAFSQPSALTIHKRMHIGEKPYKCEECGKAFVWSSTLTRHKRLHSGEKPYKCEECAKAFSQFGHLTTHRIIHTGEKPYKCEECGKAFIWPSTLTKHKRIHTGEKPYKCEECGKAFHRSSNLTKHKIIHTGEKPYKCEECGKAFIWSSNLTEHKKIHTREKPYKCEECSKAFSRSSALTTHKRMHTGEKPYKCEECGKAFSQSSTLTAHKIIHTGEKPYKCEECGKAFILSSTLSKHKRIHTGEKPYKCEECGKTFNQSSNLSTHKIIHTGEKPYKCEECGKAFNRSSNLSTHKIIHTGEKPYKCDECGKSFIWSSTLFKHKRIHT

SEQ ID NO: 918227 - protein, 122 aa, Homo sapiens
AAGAPGLVLTTLCLLLLGAQPLWPCDLPPGSLEMGLLTFRDVAIEFSLEEWQCLDTAQKNLYRNVMLENYRNLAFLGIAVSKPDLIICLEKEKEPWNMKRDEMVDEPPDGVSLCHPGWSAVA

SEQ ID NO: 918228 - protein, 1155 aa, Homo sapiens
FFSLSLSIQYFGYHLQRSMGGSKRNWIPFTHIYTVFLLTLITSVWASAAELKPPGVRADAECPGMLESAEQLLVEDLYNRVREKMDDTSLYNTPCVLDLQRALVQDRQEAPWNEVDEVWPNVFIAEKYRSIHLTVTKNPGIARSVAVNKGRLKRLGITHILNAAHGTGVYTGPEFYTGLEIQYLGVEVDDFPEVDISQHFRKASEFLDEALLTYRGKVLVSSEMGISRSAVLVVAYLMIFHNMAILEALMTVRKKRAIYPNEGFLKQLRELNEKLMEEREEDYGREGGSAEAEEGEGTGSMLGARVHALTVEEEDDSASHLSGSSLGKATQASKPLTLIDEEEEEKLYEQWKKGQGLLSDKVPQDGGGWRSASSGQGGEELEDEDVERIIQEWQSRNERYQAEGYRRWGREEEKEEESDAGSSVGRRRRTLSESSAWESVSSHDIWVLKQQLELNRPDHGRRRRADSMSSESTWDAWNERLLEIEKEASRRYHAKSKREEAADRSSEAGSRVREDDEDSVGSEASSFYNFCSRNKDKLTALERWKIKRIQFGFHKKDLGAGDSSGEPGAEEAVGEKNPSDVSLTAYQAWKLKHQKKVGSENKEEVVELSKGEDSALAKKRQRRLELLERSRQTLEESQSMASWEADSSTASGSIPLSAFWSADPSVSADGDTTSVLSTQSHRSHLSQAASNIAGCSTSNPTTPLPNLPVGPGDTISIASIQNWIANVVSETLAQKQNEMLLLSRSPSVASMKAVPAASCLGDDQVSMLSGHSSSSLGGCLLPQSQARPSSDMQSVLSCNTTLSSPAESCRSKVRGTSKPIFSLFADNVDLKELGRKEKEMQMELREKMSEYKMEKLASDNKRSSLFKKKKVKEDEDDGVGDGDEDTDSAIGSFRYSSRSNSQKPETDTCSSLAVCDHYASGSRVGKEMDSSINKWLSGLRTEEKPPFQSDWSGSSRGKYTRSSLLRETESKSSSYKFSKSQSEEQDTSSYHEANGNSVRSTSRFSSSSTREGREMHKFSRSTYNETSSSREESPEPYFFRRTPESSEREESPEPQRPNWARSRDWEDVEESSKSDFSEFGAKRKFTQSFMRSEEEGEKERTENREEGRFASGRRSQYRRSTDREEEEEMDDEAIIAAWRRRQEETRTKLQKRRED

SEQ ID NO: 918229 - protein, 158 aa, Homo sapiens
ESTVYGPMPGHPFPISQSLIPENIFSLLASAAWCDAIPIFPSLYGYLTAKSQHPIGLALKKQRELVTKRKKDERTLEQRKEDFAKSKPETFLWVQFNRLQVTFPHKHVPRTEDARHCSRRLLDEDMAKATTTMQLCDSSTSVFHWLNSAEHYRVKKPR

SEQ ID NO: 918230 - protein, 361 aa, Homo sapiens
RVPDCAKASGDLSLSVHGLVADSGAQTVAGESFIVWCPSYTEPQNLTGVSEFLLLGLSEDPELQPVLAGLFLSMYLVTVLGNLLIILAVSSDSHLHTPMYFFLSNLSLADIGFTSTTVPKMIVDMQTHSRVISYEGCLTQMSFFVLFACMDDMLLSVMAYDRFVAICHPLHYRIIMNPRLCGFLILLSFFISLLDSQLHNLIMLQLTCFKDVDISNFFCDPSQLLHLRCSDTFINEMVIYFMGAIFGCLPISGILFSYYKIVSPILRVPTSDGKYKAFSTCGSHLAVVCLFYGTGLVGYLSSAVLPSPRKSMVASVMYTVVTPMLNPFIYSLRNKDIQSALCRLHGRIIKSHHLHPFCYMG

SEQ ID NO: 918231 - protein, 476 aa, Homo sapiens
MDAVAFEDVAVNFTQEEWALLGPSQKNLYRYVMQETIRNLDCIRMIWEEQNTEDQYKNPRRNLRCHMVERFSESKDSSQCGETFSLIRDSIVNNSICPGEDPCQSAECEEVIMGHLSLNSHIRVDSGHKPHEYQEYGEKPHTHKQRGKAFSYHHSFQSRGRPHTGKKRYECKECGKTFSSRRNLRRHMVVQGGNRPYKCKLCGKAFFWPSLLRMHERTHTGEKPYECKQCSKAFPFYSSYRRHERMHTGEKPYECKQCSKALPDSSSYIRHERTHTGEKPYTCKQCGKAFSVSSSLRRHETTHSAEKPYECKQCGKTFHHLGSFQIHMKRHTGDRPHKCKICGKGFDRPSLVRYHERIHTGEKPYECKQCGKTLSHSSSFRRHMIMHTGGGPHKCKICGKAFVYPSVCQRHEKSHSGEKPYECKQCGKALSHSSSFRRHMVMHTGDGPNKCKVCGKAFVYPSVCQRHEKTHWRETI

SEQ ID NO: 918232 - protein, 388 aa, Homo sapiens
MQETIRNLDCIRMIWEEQNTEDQYKNPRRNLSHIRVDSGHKPHEYQEYGEKPHTHKQRGKAFSYHHSFQSRGRPHTGKKRYECKECGKTFSSRRNLRRHMVVQGGNRPYKCKLCGKAFFWPSLLRMHERTHTGEKPYECKQCSKAFPFYSSYRRHERMHTGEKPYECKQCSKALPDSSSYIRHERTHTGEKPYTCKQCGKAFSVSSSLRRHETTHSAEKPYECKQCGKTFHHLGSFQIHMKRHTGDRPHKCKICGKGFDRPSLVRYHERIHTGEKPYECKQCGKTLSHSSSFRRHMIMHTGGGPHKCKICGKAFVYPSVCQRHEKSHSGEKPYECKQCGKALSHSSSFRRHMVMHTGDGPNKCKVCGKAFVYPSVCQRHEKTHWRETI

SEQ ID NO: 918233 - protein, 226 aa, Homo sapiens [sequence omitted]

SEQ ID NO: 918234 - protein, 143 aa, Homo sapiens
MGGESCLDIEDGSEREAQSLTDQTPPPLSGDETERESEVIQTRQGTLRGVAGPGVKLAEVVAREEQLVRCWILGVEWELRGEAHRVQPDAGERPLERVAEKACASPGREEVQQRANGEVQRSDPSRTRAHSVAGVRLPAALSR

SEQ ID NO: 918235 - protein, 67 aa, Homo sapiens
AQGRLHSHGDGLLARIMTVVFLAVAIAFGFYIQIGSRGFFLSLFEGSHPLDPQSAWRPLSNPLLVLL

SEQ ID NO: 918236 - protein, 184 aa, Homo sapiens
MRTKKDSEFYVCHFRLVKNHCWGASGLVWRCSGPWGSLKERLQQGDMPQPFWNGPSEGSSPHFHPGPRTSQRSAKASASRRCIEIPGAWPSMAALCWSCPVNKRSQAPCCLKACLCLLPRKILQTIHKSMGDVGSPVARIPEVHDKCESSFIHFFPRNHSGSGASSSIQEMKKFSKYFKKGKRD

SEQ ID NO: 918237 - protein, 385 aa, Homo sapiens
MMPSDLTQVTEVLVIVGNGEGPSSEAAHPGGTPREQDGAMDPARKAGAQAMIWTAGWLLLLLLRGGAQALECYSCVQKADDGCSPNKMKTVKCAPGVDVCTEAVGAVETIHGQFSLAVRGCGSGLPGKNDRGLDLHGLLAFIQLQQCAQDRCNAKLNLTSRALDPAGNESAYPPNGVECYSCVGLSREACQGTSPPVVSCYNASDHVYKGCFDGNVTLTAANVTVSLPVRGCVQDEFCTRDGVTGPGFTLSGSCCQGSRCNSDLRNKTYFSPRIPPLVRLPPPEPTTVASTTSVTTSTSAPVRPTSTTKPMPAPTSQTPRQGVEHEASRDEEPRLTGGAAGHQDRSNSGQYPAKGGPQQPHNKGCVAPTAGLAALLLAVAAGVLL

SEQ ID NO: 918238 - protein, 385 aa, Homo sapiens; identical to SEQ ID NO: 918237

SEQ ID NO: 918239 - protein, 351 aa, Homo sapiens
RGLVRLRRYGPAPPCFGRSFRSERLFGGVHPPIPACRSCGVGLFEAPPLPDPTQLWATPHLRPRPQLIPPLSLSLVHGQFSLAVRGCGSGLPGKNDRGLDLHGLLAFIQLQQCAQDRCNAKLNLTSRALDPAGNESAYPPNGVECYSCVGLSREACQGTSPPVVSCYNASDHVYKGCFDGNVTLTAANVTVSLPVRGCVQDEFCTRDGVTGPGFTLSGSCCQGSRCNSDLRNKTYFSPRIPPLVRLPPPEPTTVASTTSVTTSTSAPVRPTSTTKPMPAPTSQTPRQGVEHEASRDEEPRLTGGAAGHQDRSNSGQYPAKGGPQQPHNKGCVAPTAGLAALLLAVAAGVLL

SEQ ID NO: 918240 - protein, 104 aa, Homo sapiens
SAPRPWGRWRPVSGDPRATHTTAGSSGPAPPPYSPFWIWPRPFNAAPPLPFSLAGTLRHSLAGQAFSINNYKREEQRVENWVGRTGRARVWNEVTSYALFLLHQ

SEQ ID NO: 918241 - protein, 385 aa, Homo sapiens; identical to SEQ ID NO: 918237

SEQ ID NO: 918242 - protein, 229 aa, Homo sapiens
HLFFLSAPLAGNESAYPPNGVECYSCVGLSREACQGTSPPVVSCYNASDHVYKGCFDGNVTLTAANVTVSLPVRGCVQDEFCTRDGVTGPGFTLSGSCCQGSRCNSDLRNKTYFSPRIPPLVRLPPPEPTTVASTTSVTTSTSAPVRPTSTTKPMPAPTSQTPRQGVEHEASRDEEPRLTGGAAGHQDRSNSGQYPAKGGPQQPHNKGCVAPTAGLAALLLAVAAGVLL

SEQ ID NO: 918243 - protein, 520 aa, Homo sapiens
MVSRVRKGPQMAEGVAEARRHSRGRGGAQESGEAEQREEDGAHVGGQPRPEQCLAVGQKAGLLDVEDEQQLDDLHRVEERRERAPPARSESARRVHHQEPIQHGFLPALALQGAHPAALPVVAQCPQDGQLEDEVPADGHVQLQHRGVMQLQGGQAKARVGAPQVEGADHQRQDQQRGLLASSLRILHHELREDVDGHSAAQRSPQTQEPHEPQHGRLPQPPAHAPGALPQLLLGPAAPSPVAVIHDDVGEAACVFEELQARADAGRARRGGREGGLRAHNEGHEQQQQEGVEGQQGLKEEEVGEHVGAELAPDALQDSSASPRLCKASTQTYLSQPQQEQTLPWPRRLLHFPLWVRLFSRRPRFSARLRGIPRSTWSRCATARPWSSFTRRLRFSSSSSQDVGSSFRSYRRRLCREERTKSASRGRPMVRLGMLARTQSVAVLWVPSGPKSVCWPLAVATTPLPLLQLQPLLGLPAALLLDEQVEGVVHFSLINLLNMKEGIYSKTSIKPHTLMCEECF

SEQ ID NO: 918244 - protein, 139 aa, Homo sapiens
RNKVDAQPRKSHTEMETPASLSLKALGFLALSRLIRDSCTNEACSLSNVQTYVVGSEWGYGLASTGVSLWRHMILVCFARRKPDPIFFLPFSLCFQLVCSPEIAHRERKVKVHKNLIFLDAELYVQLMFKTFKALVSET

SEQ ID NO: 918245 - protein, 139 aa, Homo sapiens; identical to SEQ ID NO: 918244

SEQ ID NO: 918246 - protein, 125 aa, Homo sapiens
MMYGQQSLPYTFKSKSLEEPEKLLGKLCEQNKVVREQDRLVQQLRAEKESLESALMGTHQELEMFGSQPAYPEKLRHKKDSLQNQLINIRVELSQATTVTQGAGFVHPTSSALGSRATTSQLVLS

SEQ ID NO: 918247 - protein, 746 aa, Homo sapiens
MKRNPNAPVTKAGWLFKQASSGVKQWNKRWFVLVDRCLFYYKDEKEESILGSIPLLSFRVAAVQPSDNISRKHTFKVTVCWVDEAEASSTRCLSPQAEHAGVRTYFFSAESPEEQEAWIQAMGEAARVQIPPAQKSVPQAVRHSHEKPDSENVPPSKHHQQPPHNSLPKPEPEAKTRGEGDGRGCEKAERRPERPEVKKEPPVKANGLPAGPEPASEPGSPYPEGPRVPGGGEQPAQPNGWQYHSPSRPGSTAFPSQDGETGGHRRSFPPRTNPDKIAQRKSSMNQLQQWVNLRRGVPPPEDLRSPSRFYPVSRRVPEYYGPYSSQYPDDYQYYPPGVRPESICSMPAYDRISPPWALEDKRHAFRNGGGPAYQLREWKEPASYGRQDATVWIPSPSRQPVYYDELDAASSSLRRLSLQPRSHSVPRSPSQGSYSRARIYSPVRSPSARFERLPPRSEDIYADPAAYVMRRSISSPKVPPYPEVFRDSLHTYKLNEQDTDKLLGKLCEQNKVVREQDRLVQQLRAEKESLESALMGTHQELEMFGSQPAYPEKLRHKKDSLQNQLINIRVELSQATTALTNSTIEYEHLESEVSALHDDLWEQLNLDTQNEVLNRQIQKEIWRIQDVMEGLRKNNPSRGTDTAKHRGGLGPSATYSSNSPASPLSSASLTSPLSPFSLVSGSQGSPTKPGSNEPKANYEQSKKDPHQTLPLDTPRDISLVPTRQEVEAEKQAALNKGGYLCKLMQA

SEQ ID NO: 918248 - protein, 817 aa, Homo sapiens
SCAGQFCQGWCVVGNSAGVQSLHPETGKLCSLAGLGSGTASHWAGQAVHLALLGPRGKDCPALRLAPVQLGGHVAFTVVFCLSLWCLVDLFSASPPSDRVRTPPLDRSSLLGSRPQYLLAATNKVTVCWVDEAEASSTRCLSPQAEHAGVRTYFFSAESPEEQEAWIQAMGEAARVQIPPAQKSVPQAVRHSLAPPAPLHAGLESLTASPLASCSHEKPDSENVPPSKHHQQPPHNSLPKPEPEAKTRGEGDGRGCEKAERRPERPEVKKEPPVKANGLPAGPEPASEPGSPYPEGPRVPGGGEQPAQPNGWQYHSPSRPGSTAFPSQDGETGGHRRSFPPRTNPDKIAQRKSSMNQLQQWVNLRRGVPPPEDLRSPSRFYPVSRRVPEYYGPYSSQYPDDYQYYPPGVRPESICSMPAYDRISPPWALEDKRHAFRNGGGPAYQLREWKEPASYGRQDATVWIPSPSRQPVYYDELDAASSSLRRLSLQPRSHSVPRSPSQGSYSRARIYSPVRSPSARFERLPPRSEDIYADPAAYVMRRSISSPKVPPYPEVFRDSLHTYKLNEQDTDKLLGKLCEQNKVVREQDRLVQQLRAEKESLESALMGTHQELEMFGSQPAYPEKLRHKKDSLQNQLINIRVELSQATTALTNSTIEYEHLESEVSALHDDLWEQLNLDTQNEVLNRQIQKEIWRIQDVMEGLRKNNPSRGTDTAKHRGGLGPSATYSSNSPASPLSSASLTSPLSPFSLVSGSQGSPTKPGSNEPKANYEQSKKDPHQTLPLDTPRDISLVPTRQEVEAEKQAALNKGGYLCKLMQA

SEQ ID NO: 918249 - protein, 590 aa, Homo sapiens
MKRNPNAPVTKAGWLFKQASSGVKQWNKRWFVLVDRCLFYYKDEKEESILGSIPLLSFRVAAVQPSDNISRKHTFKVTVCWVDEAEASSTRCLSPQAEHAGVRTYFFSAESPEEQEAWIQAMGEAARVQIPPAQKSVPQAVRHSHEKPDSENVPPSKHHQQPPHNSLPKPEPEAKTRGEGDGRGCEKAERRPERPEVKKEPPVKANGLPAGPEPASEPGSPYPEGPRVPGGGEQPAQPNGWQYHSPSRPGSTAFPSQDGETGGHRRSFPPRTNPDKIAQRKSSMNQLQQWVNLRRGVPPPEDLRSPSRFYPVSRRVPEYYGPYSSQYPDDYQYYPPGVRPESICSMPAYDRISPPWALEDKRHAFRNGGGPAYQLREWKEPASYGRQDATVWIPSPSRQPVYYDELDAASSSLRRLSLQPRSHSVPRSPSQGSYSRARIYSPVRSPSARFERLPPRSEDIYADPAAYVMRRSISSPKVPPYPEVFRDSLHTYKLNEQDTDKLLGKLCEQNKVVREQDRLVQQLRAEKESLESALMGTHQELEMFGSQPAYPEKLRHKKDSLQNQLINIRVELSQATTDWPVVVAHTCSPR

SEQ ID NO: 918250 - protein, 604 aa, Homo sapiens
MKRNPNAPVTKAGWLFKQASSGVKQWNKRWFVLVDRCLFYYKDEKEESILGSIPLLSFRVAAVQPSDNISRKHTFKVTVCWVDEAEASSTRCLSPQAEHAGVRTYFFSAESPEEQEAWIQAMGEAARVQIPPAQKSVPQAVRHSHEKPDSENVPPSKHHQQPPHNSLPKPEPEAKTRGEGDGRGCEKAERRPERPEVKKEPPVKANGLPAGPEPASEPGSPYPEGPRVPGGGEQPAQPNGWQYHSPSRPGSTAFPSQDGETGGHRRSFPPRTNPDKIAQRKSSMNQLQQWVNLRRGVPPPEDLRSPSRFYPVSRRVPEYYGPYSSQYPDDYQYYPPGVRPESICSMPAYDRISPPWALEDKRHAFRNGGGPAYQLREWKEPASYGRQDATVWIPSPSRQPVYYDELDAASSSLRRLSLQPRSHSVPRSPSQGSYSRARIYSPVRSPSARFERLPPRSEDIYADPAAYVMRRSISSPKVPPYPEVFRDSLHTYKLNEQDTDKLLGKLCEQNKVVREQDRLVQQLRAEKESLESALMGTHQELEMFGSQPAYPEKLRHKKDSLQNQLINIRVELSQATTVTQGAGFVHPTSSALGSRATTSQLVLS

SEQ ID NO: 918251 - protein, 125 aa, Homo sapiens
QGMWNELRSLEQKLPEVTDHGLWQEHSGIVMLASYPCIPSSCPCCSNRPHVPAGPSIPRSVPGQPPHLQVKRARHRCKSSAPCSLPPLQPPAAVLCGGLSLHPSLFLCGGCLSISLSPSGGFSYL

SEQ ID NO: 918252 - protein, 140 aa, Homo sapiens
MKRNPNAPVTKAGWLFKQASSGVKQWNKRWFVLVDRCLFYYKDEKEESILGSIPLLSFRVAAVQPSDNISRKHTFKAEHAGVRTYFFSAESPEEQEAWIQAMGEAARVQIPPAQKSVPQAVRHSPEKPDTETVPPTTTLS

SEQ ID NO: 918253 - protein, 769 aa, Homo sapiens
MKRNPNAPVTKAGWLFKQASSGVKQWNKRWFVLVDRCLFYYKDEKEESILGSIPLLSFRVAAVQPSDNISRKHTFKVTVCWVDEAEASSTRCLSPQAEHAGVRTYFFSAESPEEQEAWIQAMGEAARVQIPPAQKSVPQAVRHSLAPPAPLHAGLESLTASPLASCSHEKPDSENVPPSKHHQQPPHNSLPKPEPEAKTRGEGDGRGCEKAERRPERPEVKKEPPVKANGLPAGPEPASEPGSPYPEGPRVPGGGEQPAQPNGWQYHSPSRPGSTAFPSQDGETGGHRRSFPPRTNPDKIAQRKSSMNQLQQWVNLRRGVPPPEDLRSPSRFYPVSRRVPEYYGPYSSQYPDDYQYYPPGVRPESICSMPAYDRISPPWALEDKRHAFRNGGGPAYQLREWKEPASYGRQDATVWIPSPSRQPVYYDELDAASSSLRRLSLQPRSHSVPRSPSQGSYSRARIYSPVRSPSARFERLPPRSEDIYADPAAYVMRRSISSPKVPPYPEVFRDSLHTYKLNEQDTDKLLGKLCEQNKVVREQDRLVQQLRAEKESLESALMGTHQELEMFGSQPAYPEKLRHKKDSLQNQLINIRVELSQATTALTNSTIEYEHLESEVSALHDDLWEQLNLDTQNEVLNRQIQKEIWRIQDVMEGLRKNNPSRGTDTAKHRGGLGPSATYSSNSPASPLSSASLTSPLSPFSLVSGSQGSPTKPGSNEPKANYEQSKKDPHQTLPLDTPRDISLVPTRQEVEAEKQAALNKGGYLCKLMQA

SEQ ID NO: 918254 - protein, 797 aa, Homo sapiens
MSNKTGGKRPATTNSDIPNHNMVSEVPPERPSVRATRTARKAVAFGKRSHSMKRNPNAPVTKAGWLFKQASSGVKQWNKRWFVLVDRCLFYYKDEKEESILGSIPLLSFRVAAVQPSDNISRKHTFKVTVCWVDEAEASSTRCLSPQAEHAGVRTYFFSAESPEEQEAWIQAMGEAARVQIPPAQKSVPQAVRHSHEKPDSENVPPSKHHQQPPHNSLPKPEPEAKTRGEGDGRGCEKAERRPERPEVKKEPPVKANGLPAGPEPASEPGSPYPEGPRVPGGGEQPAQPNGWQYHSPSRPGSTAFPSQDGETGGHRRSFPPRTNPDKIAQRKSSMNQLQQWVNLRRGVPPPEDLRSPSRFYPVSRRVPEYYGPYSSQYPDDYQYYPPGVRPESICSMPAYDRISPPWALEDKRHAFRNGGGPAYQLREWKEPASYGRQDATVWIPSPSRQPVYYDELDAASSSLRRLSLQPRSHSVPRSPSQGSYSRARIYSPVRSPSARFERLPPRSEDIYADPAAYVMRRSISSPKVPPYPEVFRDSLHTYKLNEQDTDKLLGKLCEQNKVVREQDRLVQQLRAEKESLESALMGTHQELEMFGSQPAYPEKLRHKKDSLQNQLINIRVELSQATTALTNSTIEYEHLESEVSALHDDLWEQLNLDTQNEVLNRQIQKEIWRIQDVMEGLRKNNPSRGTDTAKHRGGLGPSATYSSNSPASPLSSASLTSPLSPFSLVSGSQGSPTKPGSNEPKANYEQSKKDPHQTLPLDTPRDISLVPTRQEVEAEKQAALNKGGYLCKLMQA

SEQ ID NO: 918255 - protein, 177 aa, Homo sapiens
MGACYTHHTLTACTHAHAHTHTCSTAIRLCEVSAAPLALLVFCRQLFPPPALLFPGPPGHRRLHSGIHCSTRSRGWPDLEFKQQRSPPWSERRPGLQIRRACLLVAKVLQGSSEGWRAAQPPPEDTGRRHRRILKRGDTPFLQRRIASHDKASRVSPHTPQKGDDPPQAALTLNPCC

SEQ ID NO: 918256 - protein, 521 aa, Homo sapiens
MRVFIVPCEKAKPKITEPTASQLAFSEESSFQELLAQRSSRDSRLGQARDEEKLIKIQEGNLRPGTNPHKEICPEKLSYKHDDLEPDDSLGLRVLQERVTPQDALHECDSQGPGKDPMTDARNNPYTCTECGKGFSKKWALVRHQQIHAGVKPYECNECGKACRYMADVIRHMRLHTGEKPYKCIECGKAFKRRFHLTEHQRIHTGDKPYECKECGKAFTHRSSFIQHNMTHTREKPFLCKECGKAFYYSSSFAQHMRIHTGKKLYECGECGKAFTHRSTFIQHNVTHTGEKPFLCKECGKTFCLNSSFTQHMRIHTGEKPYECGECGKAFTHRSTFIRHKRTHTGEKPFECKECGKAFCDSSSLIQHMRIHTGEKPYECSECGKAFTHHSVFIRHNRTHSGQKPLECKECAKAFYYSSSFTRHMRIHTGEKPYVCRECGKAFTQPANFVRHNRIHTGEKPFECKECEKAFCDNFALTQHMRTHTGEKPFECNECGKTFSHSSSLEPYTVPENNRGERPGG

SEQ ID NO: 918257 - protein, 191 aa, Homo sapiens
EDLMPEYKGRTVLVRDAQEGSVTLQILDVRLEDQGSYRCLIQVGNLSKEDTVILQVAGGAWGESGERTSSINSCPCSSQEAMGEEGHGQDHTLAEALLASGLLLRHHRNCFAPVDSAQGKEVAACSSRADISGDTPMVHSWDLLLLQTLLGKFQGIAIEYLSAHGWDGTVALWEGLYIEALLLICQIVFIL

SEQ ID NO: 918258 - protein, 223 aa, Homo sapiens
GTCQSPVFPWQQERPKSAVFPGEGKVKMSVEEQIDRMRRHQSGSMREKRRSLQLPASPAPDPSPRPAYKVVRRHRSIHEVDISNLEAALRAEEPGGHAYETPREEIARLRKMELEPQHYDVDINKELSTPDKVLIPERYIDLEPDTPLSPEELKEKQKKVERIKTLIAKSSMQNVVPIGEGDSVDVPQDSESQLQEQEKRIEISCALATEASRRGRMLSGGIW

SEQ ID NO: 918259 - protein, 236 aa, Homo sapiens
MCADPKGSKRVLSCWGDSWPRMIVAAILAIAGIVMMTYADGFHSHSVIGIALVVASASMSALYKVLFKLLLGSAKFGEAALFLSILGVFNILFITCIPIILYFTKVEYWSSFDDIPWGNLCGFSVLLLTFNIVLNFGIAVTYPTLMSLGIVLSIPVNAVIDHYTSQIVFNGVRVIAIIIIGLGFLLLLLPEEWDVWLIKLLTRLKVRKKEEPAEGAADLSSGPQSKNRRARPSFAR

SEQ ID NO: 918260 - protein, 153 aa, Homo sapiens
MSSPAQREASSVKTICACAVQSPVCTVSSVSQRLLRTASRGDQMRRDKLPAWLGTDPLGMLLSGRAAVEAPASIHIQTPFPFLHRCFPSDGPQDLPLIQVFSLGRREKEEAFQVWEVQLQTHQVKTHQHTLPCFWATSLQCTCRRPLWMHRVS

SEQ ID NO: 918261 - protein, 153 aa, Homo sapiens; identical to SEQ ID NO: 918260

SEQ ID NO: 918262 - protein, 215 aa, Homo sapiens
MEKNPPDDTGPVHVPLGHIVANEKWRGSQLAQEMQGKIKLIFEDGLTPDFYLSNRCCILYVTEADLVAGNGYRKRLVRVRNSNNLKGIVVVEKTRMSEQYFPALQKFTVLDLGMVLLPVASQMEASCLVIQLVQEQTKEPSKNPLLGKKRALLLSEPSLLRTVQQIPGVGKVKAPLLLQKFPSIQQLSNASIGELEQVVGQAVAQQIHAFFTQPR

SEQ ID NO: 918263 - protein, 258 aa, Homo sapiens
GLVRGWCESAEVGFLPAVFGPWTGLRSYGADPAGVSGARWRPSMEKNPPDDTGPVHVPLGHIVANEKWRGSQLAQEMQGKIKLIFEDGLTPDFYLSNRCCILYVTEADLVAGNGYRKRLVRVRNSNNLKGIVVVEKTRMSEQYFPALQKFTVLDLGMVLLPVASQMEASCLVIQLVQEQTKEPSKNPLLGKKRALLLSEPSLLRTVQQIPGVGKVKAPLLLQKFPSIQQLSNASIGELEQVVGQAVAQQIHAFFTQPR

SEQ ID NO: 918264 - protein, 120 aa, Homo sapiens
MSEQYFPALQKFTVLDLGMVLLPVASQMEASCLVIQLVQEQTKEPSKNPLLGKKRALLLSEPSLLRTVQQIPGVGKVKAPLLLQKFPSIQQLSNASIGELEQVVGQAVAQQIHAFFTQPR

SEQ ID NO: 918265 - protein, 215 aa, Homo sapiens; identical to SEQ ID NO: 918262

SEQ ID NO: 918266 - protein, 120 aa, Homo sapiens; identical to SEQ ID NO: 918264

SEQ ID NO: 918267 - protein, 172 aa, Homo sapiens
MARVTAGAGDARCCILYVTEADLVAGNGYRKRLVRVRNSNNLKGIVVVEKTRMSEQYFPALQKFTVLDLGMVLLPVASQMEASCLVIQLVQEQTKEPSKNPLLGKKRALLLSEPSLLRTVQQIPGVGKVKAPLLLQKFPSIQQLSNASIGELEQVVGQAVAQQIHAFFTQPR

SEQ ID NO: 918268 - protein, 146 aa, Homo sapiens
LPLMQSQSELAVGAAGSSRSAHERTLPTGGRAGWFCPAAAAHKPRGGALRLPGFRRRAQQGPDYALAGVARQPAGTCRRRCNRSHCRAEAPQWPTPAAAPAAHSPHLSLGKSGLGKLTLINSLFLTDLYSPEYPGPSQRIKKPVQV

SEQ ID NO: 918269 - protein, 135 aa, Homo sapiens
LPLMQSQSELAVGAAGSSRSAHERTLPTGGRAGWFCPAAAAHKPRGGALRLPGFRRRAQQGPDYALAGVARQPAGTCRRRCNRSHCRAEAPQWPTPAAAPAAHSPHLSLALFTERAWELQHLNSNKHTCYLELGF

SEQ ID NO: 918270 - protein, 67 aa, Homo sapiens
RAEAPQWPTPAAAPAAHSPHLSLGTCGPQRLPQPGPGDPREVPGYLAPLILGRVGPLRLPGMRELHP

SEQ ID NO: 918271 - protein, 118 aa, Homo sapiens
LPLMQSQSELAVGAAGSSRSAHERTLPTGGRAGWFCPAAAAHKPRGGALRLPGFRRRAQQGPDYALAGVARQPAGTCRRRCNRSHCRAEAPQWPTPAAAPAAHSPHLSLEGKHEQITF

SEQ ID NO: 918272 - protein, 173 aa, Homo sapiens
MKFKPNQTRTYDREGFKKRAACLCFRSEQEDEVLLVSSSRYPDQWIVPGGGMEPEEEPGGAAVREVYEEAGVKGKLGRLLGIFEQNQDRKHRTYVYVLTVTEILEDWEDSVNIGRKREWFKVEDAIKVLQCHKPVHAEYLEKLKLGCSPANGNSTVPSLRIIMPCFDDRITVE

SEQ ID NO: 918273 - protein, 390 aa, Homo sapiens
MPDKAMGGGTLAGTGSGLLQYQTQNSPRNTECKEAFHIGEGYHRCSECGKAFSHRNRLCEHQRVHSRERPYKCSECGKFFSHNSSLTVHQRVHMGLKPYGCSECGKAYRKSSHLVQHKKVHAGERPYGCSECGKAYSRSTHLVRHKNLHTGERAYRCSECGKAYSSKHTLIQHQRVHTGEMEPGLMNAVNVGNPLDKAMALLNTREFTLGQSLISVVNVGNASAAKSHLLGIGESTLEKGLISALNVGRFLAKSLALLHIREFTLVKGCECTECGKSFSQRSSLILHQRVHTGERPYVCSECGKAFSVKSILVQHLRVHTRKRPYECSECRKLFSHKSNLIKYKKKITLEKRLKPTAYVVPESSPWRKALERREDAVCLVHIVGDTGQKL

SEQ ID NO: 918274 - protein, 176 aa, Homo sapiens
MKNPIQRTKRQDTLCPCRDDGASCVGPEETARLRPLEPQAVCAGTRAPLEVLQQRRHLGTRLPWETTISFQPRCASWQTRADEGHVGDERTRSPSPIEERLYKGCTKPAIFFVTQIDSCAMQPFDETLAFTRCKLISRRQLEIVCWMCPFIYMNITISLDASKDTQHEIHFISTSL

SEQ ID NO: 918275 - protein, 198 aa, Homo sapiens
MVKVGVTLVRWHWTPFRASPVLCTLQTVPICAEAVLGLCLRAFSAPLPQTNPKCPHEQPSTKEGQESVNMHLSLLTSPRNFKKIFLMNYSKANTSVTIGGTLRELSGVLGNELQLPTVVTCSLSDTRFTGLLFWISFSHSFQDHLPNKPYTQILISGVYAEDTKQALGHSNPECVWSRKQPMVAGPQGEMAWESQAGA

SEQ ID NO: 918276 - protein, 142 aa, Homo sapiens
MVNVNPHESSSHCWKRKTDFHSMSSQLLGSLLHGKTPHNYGSCCQENNGNKEKRNSYYGVCPEIHPYYVTANDTIDSLKLGPGDFFERRCGWTKQSRALTSHQLAELSWLAFAVPAFVEFEICMLGVRRAGSCTTVSLWALE

SEQ ID NO: 918277 - protein, 333 aa, Homo sapiens
MLVRKLRHRPLHAFTLTCLKIPAAGKAALWALGLGGGICVCSLGTPGVSNAQQQWGALCFMEPIVQMGKQSLRGKVTPKDPQVLWAPVSASSMTWLPSDDWFLRVPPCRQGVLQSSGVGARVPGSPVPPALSGMRPQTLPQGGPILEERSLPQLPGTREIPAQPHQDYLNSFLENVKHPHKCSREQPRSPREYPGGRASSAGISTCCFHTLGPLQTMGLPGSLFCPKTNATRPKSNPRAGLPALLCGKDTDTPGGWRGLDRAAWRHVCLLGLPWPFCRILLHPGLGPTIKSCIGTAAWGQGGAGSSFPLHIRLHFPQRRDHLETYKSLAGLPA

SEQ ID NO: 918278 - protein, 236 aa, Homo sapiens
GPWVRKQDLLILDSTAVLGKETEVGGGHREPGQAAGSLETQRSRHSPPSTPPPLPPRPRSLHSQHIHLSITQAPRNRQVMASLCVAARLGMGVSVLPSPKLRVACSQGAGFLFGWQPGVWSAGAGQAALGALGDLAGGRRCRPSGTRASLQAWLGNSRAPHHSSACASGASASLSWKESLPVTGEAGHQPAQLHLRPLPTPPSKLPWQDPCKAAADHREAAAYSARHFLYPTPTPF

SEQ ID NO: 918279 - protein, 166 aa, Homo sapiens
LWQPWTDIRGHLAMSGDNFGCHNWKVFGIVPALNKSKQLQFSGLNSGHLSCSYTVYLCLSTQFIHQSGSVGQTRQVVPRVRSSAVDHDGTLENEREVTAQGHLRNFQEESNKELSHTLELESAPSTPTPLHSLSALHDPAAGYCSLEELRQRRQTWGGRITIINRP

SEQ ID NO: 918280 - protein, 151 aa, Homo sapiens
MEPKLLCRIRSPSYGSPSWCTQNFSILVGMRAEYKRGIRGVPTREAVHVASLVKPPGAVTVLRGLPSPPESSDAVLTPWHIRGSEPAVHTGWEKQQPGKRTTNRGRQPPTKRTCGTRQHAIWKASLYGSGHYHGKEKEWENLRFKKDPMLF

SEQ ID NO: 918281 - protein, 151 aa, Homo sapiens; identical to SEQ ID NO: 918280

SEQ ID NO: 918282 - protein, 205 aa, Homo sapiens
MFQDALGGRSRGSREESPAPSRAPASASLWRRLVVVEAKMAAQAAAAAQAAAAQAAQAEAADSWYLALLGFAEHFRTSSPPKIRLCVHCLQAVFPFKPPQRIEARTHLQLGSVLYHHTKNSEQARSHLEKAVSAGRAAREESRAPCKIWADGSRPRRVGGRSSATWGRDLRQSRRTPTRLCRTPKPPASQGTRKPRPPRLISRFW

SEQ ID NO: 918283 - protein, 556 aa, Homo sapiens
MPQVTFNDVAIDFTHEEWGWLSSAQRDLYKDVMVQNYENLVSVAGLSVTKPYVITLLEDGKEPWMMEKKLSKGMIPDWESRWENKELSTKKDNYDEDSPQTVIIEKVVKQSYEFSNSKKNLEYIEKLEGKHGSQVDHFRPAILTSRESPTADSVYKYNIFRSTFHSKSTLSEPQKISAEGNSHKYDILKKNLPKKSVIKNEKVNGGKKLLNSNKSGAAFSQGKSLTLPQTCNREKIYTCSECGKAFGKQSILNRHWRIHTGEKPYECRECGKTFSHGSSLTRHLISHSGEKPYKCIECGKAFSHVSSLTNHQSTHTGEKPYECMNCGKSFSRVSHLIEHLRIHTQEKLYECRICGKAFIHRSSLIHHQKIHTGEKPYECRECGKAFCCSSHLTRHQRIHTMEKQYECNKCLKVFSSLSFLVQHQSIHTEEKPFECQKCRKSFNQLESLNMHLRNHIRLKPYECSICGKAFSHRSSLLQHHRIHTGEKPYECIKCGKTFSCSSNLTVHQRIHTGEKPYKCNECGKAFSKGSNLTAHQRVHNGEKPNSVIPEDEKYLI

SEQ ID NO: 918284 - protein, 556 aa, Homo sapiens; identical to SEQ ID NO: 918283

SEQ ID NO: 918285 - protein, 209 aa, Homo sapiens
MAWVCGLIWWTFWHSPSSRLLHLKLFKTAFPFCQIALCAQCSCFSLRSEMGPHWLWLHLALVLLPPPALLLPSCEKGVLRVPLPLPRQAQEVSQQCPRRSPPPVESTVWVAPREPQPCRPRFTGGCGYCKHLNLAPPPMGRVGSSSVCPWDVFRFTLLFCSHAHMLELSCMECRSPCTYEISQQSCLLPYSVFISATLFLENIVFVLFL

SEQ ID NO: 918286 - protein, 140 aa, Homo sapiens
MMLRREPQRKSDRSLWAHIVYASLMNTKHISFSVLDKGSVERNSGSLHHYPPKPGLIYCREEMCRTIEVDPSGKGKNAIFQDGADLASTWSRWKPHGEETRNRNGKTRFCPTMEEPRRKYSASISQTMQPRDNTCDKTGF

SEQ ID NO: 918287 - protein, 171 aa, Homo sapiens
LTEELGLRPVAFLLALMSVCCGCRCFNILEALKITNYAQLTLYSSHNFQNLFSSSQLTHILSAPQLLQLYSLFVEPPTITIVPGPDFNPGSRIIPDTTPDPHDYISLIHLTFTPFPHISFFLVPHSNHTWFIDGSSTRPTCRSSAKAGYAIVSSTSIIEATTLPPPPALSK

SEQ ID NO: 918288 - protein, 268 aa, Homo sapiens
MGILLHNSPRSELLLISLKSYGRSPAGSSLTAVVMDSFIMNSYHNSQSALDNVASQVAAFAPPQRRGAQELAGSHISSHNSHVGPEATIKDVVPLRARCPWMPNEVLSGHPLPLPGNKQAMIPSGRCSFCPGPRLLGCWALTCLTRGKFSGTKAHGCPLFFFFLFLLLLFLLLLLLLLFLLLLLLQLLSPPPPPPAFLLHVPSLTAFTRRTEKPLPRVDITSSEAAAGLQDQVHRRRLGGPLHRPLCFATRSGREAQKTSPGAMTLVA

SEQ ID NO: 918289 - protein, 150 aa, Homo sapiens
HRNEQRQLACEARTKMESAMSDFSDCHNFAKRPPGRTTEQGFGKPERLERSPQKLRGRRPSPSRLRSQGEAERLVGSRDGSSRSLCRLHPVKEPVSTLLSRFWAAAELPLPSSDPVFPTGAPPGQGWCRMGKWRENLKEPQTRGPIAPQE

SEQ ID NO: 918290 - protein, 72 aa, Homo sapiens
HRNEQRQLACEARTKMESAMSDFSDCHNFAKRPPGRTTEQGFGKPERLERRMGKWRENLKEPQTRGPIAPQE

SEQ ID NO: 918291 - protein, 110 aa, Homo sapiens
MKNLFCGRPRVTTAATSSFQEQKQCSELIYSINDVLLLHMHAESFHFFKDGFGLFTLLLVQDTGSWAFLCQLTPNLAVGRAMTVCRNLCQLNTLRTKAKSWTWRVSEASL

SEQ ID NO: 918292 - protein, 155 aa, Homo sapiens
MTGCTHEVSYSKDNGTFKWFRNFLIKNTLIISPKECGAGKCPRCEEAVEKRPEGGVRVGLWLLEKEHFGRGPKVGRLPGVLEEQQGVRAAAAIALAAARRDPLPGPEPLPLCYPGPVSSLLPTASVGRCGEEVDSPRRSLPLGAPWSLLPWEPPR

SEQ ID NO: 918293 - protein, 559 aa, Homo sapiens
LLQVYPMSPERGTCGARLIPAPLALQLPEVVVVLRRLTLPMADKMVRTPKCSRCRNHGFLVPVKGHAGKCRWKQCLCEKCYLISERQKIMAAQKVLKTQAAEEEQEAALCAQGPKQASGAAAAAPAPVPVPAASLRPLSPGTPSGDADPGPEGRAAACFFEQPPRGRNPGPRALQPVLGGRSHVEPSERAAVAMPSLAGPPFGAEAAGSGYPGPLDLRRPMRTVPGPLFTDFGKSWPWSRGRLPELAAQASPDGELAEGFGVERSFSTGNGPSALRNPSSNRDLDWVTFRKKETRNRKEWAVQRAFNISAVVCAIPACKNKMASSRLSSASSSGGGFEEPSPTALAHLFPPFPWAGGSSSRITEFSCRHVSARTPAHSSLPVRGREAPPLSSALAQCACAPLPSVSPRAVRPLNINPDRALGPEYPGGSSMHPYCPFPLGYLDAPPGVPLQQGFRHVSRSQYQGGGLVSEPGGDFQPSYYLPPPPPPLPPLPPLPPQPQFLPPGYLSALHFLPPPPPPPPPSSFSLTVLFDTDKENTDDQDAEVLSGEPSQPSSQEQSD

SEQ ID NO: 918294 - protein, 382 aa, Homo sapiens
LLQVYPMSPERGTCGARLIPAPLALQLPEVVVVLRRLTLPMADKMVRTPKCSRCRNHGFLVPVKGHAGKCRWKQCLCEKCYLISERQKIMAAQKVLKTQAAEEEQEAALCAQGPKQASGAAAAAPAPVPVPAASLRPLSPGTPSGDADPGPEGRAAACFFEQPPRGRNPGPRALQPVLGGRSHVEPSERAAVAMPSLAGPPFGAEAAGSGYPGPLDLRRPMRTVPGPLFTDFVRPLNINPDRALGPEYPGGSSMHPYCPFPLGYLDAPPGVPLQQGFRHVSRSQYQGGGLVSEPGGDFQPSYYLPPPPPPLPPLPPLPPQPQFLPPGYLSALHFLPPPPPPPPPSSFSLTVLFDTDKENTDDQDAEVLSGEPSQPSSQEQSD

SEQ ID NO: 918295 - protein, 254 aa, Homo sapiens
VSLEVDSAPETPWLPPFRALRQRMPKLSHIWIPDPQKLSGIYVPEFGFPRPTAQNPGSRIQAPRDPGFRIRAPSDPSSESGLPEIQVPESGLLEIQAPESELPQIQVPESGLPEIQAPESELPQNQALESGLLQIQVPESGLQARIPGWEPATAVRLRFLKSGAKIHSPGGSGGAGWSSRGKEGPAFESRLRYAPGADSPTAPPKLRAGRGKAPGPTHGKRGAFWDLESSPWGSRGDGSGHPKPLPSAETGGLG

SEQ ID NO: 918296 - protein, 149 aa, Homo sapiens
LSLIPALVCQSSAEHLIFSRPLIMEAKDPAQTSWRPHPGSANPTGHSWGPLVAQPLQPCRDALTPHKDSGLSSRSTGGILKADLKLEEASCIPQVGVDIKQAPACLSSMALDMKEAKEWSTDPDEEPALSANHELDSPLGKCNDKRNKR

SEQ ID NO: 918297 - protein, 150 aa, Homo sapiens
MRIHSLENVDKALQFLKEQRVHLENVGSHDIVDGNHRLTLGLVWTIILRFQIQVIKIETEDNRETRSAKDALLLWCQMKTAGYPEVNIQNFTTSWRDGLAFNALIHRHRPDLVDFSKLTKSNANYNLQRAFRTAEQHLGLARLLDPEVYP

SEQ ID NO: 918298 - protein, 150 aa, Homo sapiens
MSQCIWPPYFLLLAQCNGSISGTANERDAQDKVMELAKVLREEHCRLSQQDKGIRRKLSGVSEALEGGQWSKEMERSQRGGQGVAGLGSVQIVATELEVSSRRVKGNFICISSPSHRLHDHLSSMSCQISSSIRFSQEHKLCCEVCMRGI

SEQ ID NO: 918299 - protein, 150 aa, Homo sapiens; identical to SEQ ID NO: 918298

SEQ ID NO: 918300 - protein, 1575 aa, Homo sapiens
MGDAADPREMRKTFIVPAIKPFDHYDFSRAKIACNLAWLVAKAFGTDKVTGSQINLHKIKHLASDVFCMSDSEAFAYYSIPFCRVTVLSAENVPEELQEPFYTDQYDQEHIKPPVVNLLLSAELYCRAGSLILKSDAAKPLLGHDAVIQALAQKGLYVTDQEKLVTERDLHKKPIQMEDNKPGHKSLKTGSRLEKEMVDSKARLTKQLIRKKERNFTSFKEFRLRYVENESAHLAMIDTLMMAYTVEMVSIEKVIACAQQYSAFFQATDLPYDIEDAVMYWINKVNEHLKDIMEQEQKLKEHHTVEAPGGQKARYRKEQTLLKQLPCIPLVENLLKDGTDGCALAALIHFYCPDVVRLEDICLKETMSLADSLYNLQLIQEFCQEYLNQCCHFTLEDMLYAASSIKSNYLVFMAELFWWFEVVKPSFVQPRVVRPQGAEPVKDMPSIPVLNAAKRNVLDSSSDFPSSGEGATFTQSHHHLPSRYSRPQAHSSASGGIRRSSSMSYVDGFIGTWPKEKRSSVHGVSFDISFDKEDSVQRSTPNRGITRSISNEGLTLNNSHVSKHIRKNLSFKPINGEEEAESIEEELNIDSHSDLKSCVPLNTNELNSNENIHYKLPNGALQNRILLDEFGNQIETPSIEEALQIIHDTEKSPHTPQPDQIANGFFLHSQEMSILNSNIKLNQSSPDNVTDTKGALSPITDNTEVDTGIHVPSEDIPETMDEDSSLRDYTVSLDSDMDDASKFLQDYDIRTGNTREALSPCPSTVSTKSQPGSSASSSSGVKMTSFAEQKFRKLNHTDGKSSGSSSQKTTPEGSELNIPHVVAWAQIPEETGLPQGRDTTQLLASEMVHLRMKLEEKRRAIEAQKKKMEAAFTKQRQKMGRTAFLTVVKKKGDGISPLREEAAGAEDEKVYTDRAKEKESQKTDGQRSKSLADIKESMENPQAKWLKSPTTPIDPEKQWNLASPSEETLNEGEILEYTKSIEKLNSSLHFLQQEMQRLSLQQEMLMQMREQQSWVISPPQPSPQKQIRDFKPSKQAGLSSAIAPFSSDSPRPTHPSPQSSNRKSASFSVKSQRTPRPNELKITPLNRTLTPPRSVDSLPRLRRFSPSQVPIQTRSFVCFGDDGEPQLKESKPKEEVKKEELESKGTLEQRGHNPEEKEIKPFESTVSEVLSLPVTETVCLTPNEDQLNQPTEPPPKPVFPPTAPKNVNLIEVSLSDLKPPEKADVPVEKYDGESDKEQFDDDQKVCCGFFFKDDQKAENDMAMKRAALLEKRLRREKETQLRKQQLEAEMEHKKEETRRKTEEERQKKEDERARREFIRQEYMRRKQLKLMEDMDTVIKPRPQVVKQKKQRPKSIHRDHIESPKTPIKGPPVSSLSLASLNTGDNESVHSGKRTPRSESVEGFLSPSRCGSRNGEKDWENASTTSSVASGTEYTGPKLYKEPSAKSNKHIIQNALAHCCLAGKVNEGQKKKILEEMEKSDANNFLILFRDSGCQFRSLYTYCPETEEINKLTGIGPKSITKKMIEGLYKYNSDRKQFSHIPAKTLSASVDAITIHSHLWQTKRPVTPKKLLPTKA

SEQ ID NO: 918301 - protein, 1209 aa, Homo sapiens
MSLADSLYNLQLIQEFCQEYLNQCCHFTLEDMLYAASSIKSNYLVFMAELFWWFEVVKPSFVQPRVVRPQGAEPVKDMPSIPVLNAAKRNVLDSSSDFPSSGEGATFTQSHHHLPSRYSRPQAHSSASGGIRRSSSMSYVDGFIGTWPKEKRSSVHGVSFDISFDKEDSVQRSTPNRGITRSISNEGLTLNNSHVSKHIRKNLSFKPINGEEEAESIEEELNIDSHSDLKSCVPLNTNELNSNENIHYKLPNGALQNRILLDEFGNQIETPSIEEALQIIHDTEKSPHTPQPDQIANGFFLHSQEMSILNSNIKLNQSSPDNVTDTKGALSPITDNTEVDTGIHVPSEDIPETMDEDSSLRDYTVSLDSDMDDASKFLQDYDIRTGNTREALSPCPSTVSTKSQPGSSASSSSGVKMTSFAEQKFRKLNHTDGKSSGSSSQKTTPEGSELNIPHVVAWAQIPEETGLPQGRDTTQLLASEMVHLRMKLEEKRRAIEAQKKKMEAAFTKQRQKMGRTAFLTVVKKKGDGISPLREEAAGAEDEKVYTDRAKEKESQKTDGQRSKSLADIKESMENPQAKWLKSPTTPIDPEKQWNLASPSEETLNEGEILEYTKSIEKLNSSLHFLQQEMQRLSLQQEMLMQMREQQSWVISPPQPSPQKQIRDFKPSKQAGLSSAIAPFSSDSPRPTHPSPQSSNRKSASFSVKSQRTPRPNELKITPLNRTLTPPRSVDSLPRLRRFSPSQVPIQTRSFVCFGDDGEPQLKESKPKEEVKKEELESKGTLEQRGHNPEEKEIKPFESTVSEVLSLPVTETVCLTPNEDQLNQPTEPPPKPVFPPTAPKNVNLIEVSLSDLKPPEKADVPVEKYDGESDKEQFDDDQKVCCGFFFKDDQKAENDMAMKRAALLEKRLRREKETQLRKQQLEAEMEHKKEETRRKTEEERQKKEDERARREFIRQEYMRRKQLKLMEDMDTVIKPRPQVVKQKKQRPKSIHRDHIESPKTPIKGPPVSSLSLASLNTGDNESVHSGKRTPRSESVEGFLSPSRCGSRNGEKDWENASTTSSVASGTEYTGPKLYKEPSAKSNKHIIQNALAHCCLAGKVNEGQKKKILEEMEKSDANNFLILFRDSGCQFRSLYTYCPETEEINKLTGIGPKSITKKMIEGLYKYNSDRKQFSHIPAKTLSASVDAITIHSHLWQTKRPVTPKKLLPTKA

SEQ ID NO: 918302 - protein, 1557 aa, Homo sapiens
MGDAADPREMRKTFIVPAIKPFDHYDFSRAKIACNLAWLVAKAFGTDKVTGSQINLHKIKHLASDVFCMSDSEAFAYYSIPFCRVTVLSAENVPEELQEPFYTDQYDQEHIKPPVVNLLLSAELYCRAGSLILKSDAAKPLLGHDAVIQALAQKGLYVTDQEKLVTERDLHKKPIQMEDNKPGHKSLKTGSRLEKEMVDSKARLTKQLIRKKERNFTSFKEFRLRYVENESAHLAMIDTLMMAYTVEMVSIEKVIACAQQYSAFFQATDLPYDIEDAVMYWINKVNEHLKDIMEQEQKLKEHHTVEAPGGQKARYRKEQTLLKQLPCIPLVENLLKDGTDGCALAALIHFYCPDVVRLEDICLKETMSLADSLYNLQLIQEFCQEYLNQCCHFTLEDMLYAASSIKSNYLVFMAELFWWFEVVKPSFVQPRVVRPQGAEPVKDMPSIPVLNAAKRNVLDSSSDFPSSGEGATFTQSHHHLPSRYSRPQAHSSASGGIRRSSSMSYVDGFIGTWPKEKRSSVHGVSFDISFDKEDSVQRSTPNRGITRSISNEGLTLNNSHVSKHIRKNLSFKPINGEEEAESIEEELNIDSHSDLKSCVPLNTNELNSNENIHYKLPNGALQNRILLDEFGNQIETPSIEEALQIIHDTEKSPHTPQPDQIANGFFLHSQEMSILNSNIKLNQSSPDNVTDTKGALSPITDNTEVDTGIHVPSEDIPETMDEDSSLRDYTVSLDSDMDDASKFLQDYDIRTGNTREALSPCPSTVSTKSQPGSSASSSSGVKMTSFAEQKFRKLNHTDGKSSGSSSQKTTPEGSELNIPHVVAWAQIPEETGLPQGRDTTQLLASEMVHLRMKLTKQRQKMGRTAFLTVVKKKGDGISPLREEAAGAEDEKVYTDRAKEKESQKTDGQRSKSLADIKESMENPQAKWLKSPTTPIDPEKQWNLASPSEETLNEGEILEYTKSIEKLNSSLHFLQQEMQRLSLQQEMLMQMREQQSWVISPPQPSPQKQIRDFKPSKQAGLSSAIAPFSSDSPRPTHPSPQSSNRKSASFSVKSQRTPRPNELKITPLNRTLTPPRSVDSLPRLRRFSPSQVPIQTRSFVCFGDDGEPQLKESKPKEEVKKEELESKGTLEQRGHNPEEKEIKPFESTVSEVLSLPVTETVCLTPNEDQLNQPTEPPPKPVFPPTAPKNVNLIEVSLSDLKPPEKADVPVEKYDGESDKEQFDDDQKVCCGFFFKDDQKAENDMAMKRAALLEKRLRREKETQLRKQQLEAEMEHKKEETRRKTEEERQKKEDERARREFIRQEYMRRKQLKLMEDMDTVIKPRPQVVKQKKQRPKSIHRDHIESPKTPIKGPPVSSLSLASLNTGDNESVHSGKRTPRSESVEGFLSPSRCGSRNGEKDWENASTTSSVASGTEYTGPKLYKEPSAKSNKHIIQNALAHCCLAGKVNEGQKKKILEEMEKSDANNFLILFRDSGCQFRSLYTYCPETEEINKLTGIGPKSITKKMIEGLYKYNSDRKQFSHIPAKTLSASVDAITIHSHLWQTKRPVTPKKLLPTKA

SEQ ID NO: 918303 - protein, 1461 aa, Homo sapiens
MGDAADPREMRKTFIVPAIKPFDHYDFSRAKIACNLAWLVAKAFGTDKVTGSQINLHKIKHLASDVFCMSDSEAFAYYSIPFCRVTVLSAENVPEELQEPFYTDQYDQEHIKPPVVNLLLSAELYCRAGSLILKSDAAKPLLGHDAVIQALAQKGLYVTDQEKLVTERDLHKKPIQMEDNKPGHKSLKTGSRLEKEMVDSKARLTKQLIRKKERNFTSFKEFRLRYVENESAHLAMIDTLMMAYTVEMVSIEKVIACAQQYSAFFQATDLPYDIEDAVMYWINKVNEHLKDIMEQEQKLKEHHTVEAPGGQKARYRKEQTLLKQLPCIPLVENLLKDGTDGCALAALIHFYCPDVVRLEDICLKETMSLADSLYNLQLIQEFCQEYLNQCCHFTLEDMLYAASSIKSNYLVFMAELFWWFEVVKPSFVQPRVVRPQGAEPVKDMPSIPVLNAAKRNVLDSSSDFPSSGEGATFTQSHHHLPSRYSRPQAHSSASGGIRRSSSMSYVDGFIGTWPKEKRSSVHGVSFDISFDKEDSVQRSTPNRGITRSISNEGLTLNNSHVSKHIRKNLSFKPINGEEEAESIEEELNIDSHSDLKSCVPLNTNELNSNENIHYKLPNGALQNRILLDEFGNQIETPSIEEALQIIHDTEKSPHTPQPDQIANGFFLHSQEMSILNSNIKLNQSSPDNVTDTKGALSPITDNTEVDTGIHVPSEDIPETMDEDSSLRDYTVSLDSDMDDASKFLQDYDIRTGNTREALSPCPSTVSTKSQPGSSASSSSGVKMTSFAEQKFRKLNHTDGKSSGSSSQKTTPEGSELNIPHVVAWAQIPEETGLPQGRDTTQLLASEMVHLRMKLTKQRQKMGRTAFLTVVKKKGDGISPLREEAAGAEDEKVYTDRAKEKESQKTDGQRSKSLADIKESMENPQAKWLKSPTTPIDPEKQWNLASPSEETLNEGEILEYTKSIEKLNSSLHFLQQEMQRLSLQQEMLMQMREQQSWVISPPQPSPQKQIRDFKPSKQAGLSSAIAPFSSDSPRPTHPSPQSSNRKSASFSVKSQRTPRPNELKITPLNRTLTPPRSVDSLPRLRRFSPSQVPIQTRSFVCFGDDGEPQLKESKPKEEVKKEELESKGTLEQRGHNPEEKEIKPFESTVSEVLSLPVTETVCLTPNEDQLNQPTEPPPKPVFPPTAPKNVNLIEVSLSDLKPPEKADVPVEKYDGESDKEQFDDDQKVCCGFFFKDDQKAENDMAMKRAALLEKRLRREKETQLRKQQLEAEMEHKKEETRRKTEEERQKKEDERARREFIRQEYMRRKQLKLMEDMDTVIKPRPQVVKQKKQRPKSIHRDHIESPKTPIKGPPVSSLSLASLNTGDNESVHSGKRTPRSESVEGFLSPSRCGSRNGEKDWENASTTSSVASGTEYTGPKLYKEPSAKSNKHIIQNALAHCCLAGKVNEGQKKKILEVSMFA

SEQ ID NO: 918304 - protein, 1063 aa, Homo sapiens
MGDAADPREMRKTFIVPAIKPFDHYDFSRAKIACNLAWLVAKAFGTDKVTGSQINLHKIKHLASDVFCMSDSEAFAYYSIPFCRVTVLSAENVPEELQEPFYTDQYDQEHIKPPVVNLLLSAELYCRAGSLILKSDAAKPLLGHDAVIQALAQKGLYVTDQEKLVTERDLHKKPIQMEDNKPGHKSLKTGSRLEKEMVDSKARLTKQLIRKKERNFTSFKEFRLRYVENESAHLAMIDTLMMAYTVEMVSIEKVIACAQQYSAFFQATDLPYDIEDAVMYWINKVNEHLKDIMEQEQKLKEHHTVEAPGGQKARYRKEQTLLKQLPCIPLVENLLKDGTDGCALAALIHFYCPDVVRLEDICLKETMSLADSLYNLQLIQEFCQEYLNQCCHFTLEDMLYAASSIKSNYLVFMAELFWWFEVVKPSFVQPRVVRPQGAEPVKDMPSIPVLNAAKRNVLDSSSDFPSSGEGATFTQSHHHLPSRYSRPQAHSSASGGIRRSSSMSYVDGFIGTWPKEKRSSVHGVSFDISFDKEDSVQRSTPNRGITRSISNEGLTLNNSHVSKHIRKNLSFKPINGEEEAESIEEELNIDSHSDLKSCVPLNTNELNSNENIHYKLPNGALQNRILLDEFGNQIETPSIEEALQIIHDTEKSPHTPQPDQIANGFFLHSQEMSILNSNIKLNQSSPDNVTDTKGALSPITDNTEVDTGIHVPSEDIPETMDEDSSLRDYTVSLDSDMDDASKFLQDYDIRTGNTREALSPCPSTVSTKSQPGSSASSSSGVKMTSFAEQKFRKLNHTDGKSSGSSSQKTTPEGSELNIPHVVAWAQIPEETGLPQGRDTTQLLASEMVHLRMKLTKQRQKMGRTAFLTVVKKKGDGISPLREEAAGAEDEKVYTDRAKEKESQKTDGQRSKSLADIKESMENPQAKWLKSPTTPIDPEKQWNLASPSEETLNEGEILEYTKSIEKLNSSLHFLQQEMQRLSLQQEMLMQMREQQSWVISPPQPSPQKQIRDFKPSKQAGLSSAIAPFSSDSPRPTHPSPQSSNRKSASFSVKSQRTPRPNELK

SEQ ID NO: 918305 - protein, 495 aa, Homo sapiens
MGDAADPREMRKTFIVPAIKPFDHYDFSRAKIACNLAWLVAKAFGTDKVTGSQINLHKIKHLASDVFCMSDSEAFAYYSIPFCRVTVLSAENVPEELQEPFYTDQYDQEHIKPPVVNLLLSAELYCRAGSLILKSDAAKPLLGHDAVIQALAQKGLYVTDQEKLVTERDLHKKPIQMEDNKPGHKSLKTGSRLEKEMVDSKARLTKQLIRKKERNFTSFKEFRLRYVENESAHLAMIDTLMMAYTVEMVSIEKVIACAQQYSAFFQATDLPYDIEDAVMYWINKVNEHLKDIMEQEQKLKEHHTVEAPGGQKARYRKEQTLLKQLPCIPLVENLLKDGTDGCALAALIHFYCPDVVRLEDICLKETMSLADSLYNLQLIQEFCQEYLNQCCHFTLEDMLYAASSIKSNYLVFMAELFWWFEVVKPSFVQPRVVRPQGAEPVKDMPSIPVLNAAKRNVLDSSSDFPSSGEGATFTQSHHHLPSRYSRPQAHSSASG

SEQ ID NO: 918306 - protein, 1575 aa, Homo sapiens; identical to SEQ ID NO: 918300

SEQ ID NO: 918307 - protein, 1138 aa, Homo sapiens
RYPSFLLQPRVVRPQGAEPVKDMPSIPVLNAAKRNVLDSSSDFPSRYSRPQAHSSASGGIRRSSSMSYVDGFIGTWPKEKRSSVHGVSFDISFDKEDSVQRSTPNRGITRSISNEGLTLNNSHVSKHIRKNLSFKPINGEEEAESIEEELNIDSHSDLKSCVPLNTNELNSNENIHYKLPNGALQNRILLDEFGNQIETPSIEEALQIIHDTEKSPHTPQPDQIANGFFLHSQEMSILNSNIKLNQSSPDNVTDTKGALSPITDNTEVDTGIHVPSEDIPETMDEDSSLRDYTVSLDSDMDDASKFLQDYDIRTGNTREALSPCPSTVSTKSQPGSSASSSSGVKMTSFAEQKFRKLNHTDGKSSGSSSQKTTPEGSELNIPHVVAWAQIPEETGLPQGRDTTQLLASEMVHLRMKLEEKRRAIEAQKKKMEAAFTKQRQKMGRTAFLTVVKKKGDGISPLREEAAGAEDEKVYTDRAKEKESQKTDGQRSKSLADIKESMENPQAKWLKSPTTPIDPEKQWNLASPSEETLNEGEILEYTKSIEKLNSSLHFLQQEMQRLSLQQEMLMQMREQQSWVISPPQPSPQKQIRDFKPSKQAGLSSAIAPFSSDSPRPTHPSPQSSNRKSASFSVKSQRTPRPNELKITPLNRTLTPPRSVDSLPRLRRFSPSQVPIQTRSFVCFGDDGEPQLKESKPKEEVKKEELESKGTLEQRGHNPEEKEIKPFESTVSEVLSLPVTETVCLTPNEDQLNQPTEPPPKPVFPPTAPKNVNLIEVSLSDLKPPEKADVPVEKYDGESDKEQFDDDQKVCCGFFFKDDQKAENDMAMKRAALLEKRLRREKETQLRKQQLEAEMEHKKEETRRKTEEERQKKEDERARREFIRQEYMRRKQLKLMEDMDTVIKPRPQVVKQKKQRPKSIHRDHIESPKTPIKGPPVSSLSLASLNTGDNESVHSGKRTPRSESVEGFLSPSRCGSRNGEKDWENASTTSSVASGTEYTGPKLYKEPSAKSNKHIIQNALAHCCLAGKVNEGQKKKILEEMEKSDANNFLILFRDSGCQFRSLYTYCPETEEINKLTGIGPKSITKKMIEGLYKYNSDRKQFSHIPAKTLSASVDAITIHSHLWQTKRPVTPKKLLPTKA

SEQ ID NO: 918308 - protein, 1557 aa, Homo sapiens; identical to SEQ ID NO: 918302

SEQ ID NO: 918309 - protein, 1235 aa, Homo sapiens
MGDAADPREMRKTFIVPAIKPFDHYDFSRAKIACNLAWLVAKAFGTDKVTGSQINLHKIKHLASDVFCMSDSEAFAYYSIPFCRVTVLSAENVPEELQEPFYTDQYDQEHIKPPVVNLLLSAELYCRAGSLILKSDAAKPLLGHDAVIQALAQKGLYVTDQEKLVTERDLHKKPIQMEDNKPGHKSLKTGSRLEKEMVDSKARLTKQLIRKKERNFTSFKEFRLRYVENESAHLAMIDTLMMAYTVEMVSIEKVIACAQQYSAFFQATDLPYDIEDAVMYWINKVNEHLKDIMEQEQKLKEHHTVEAPGGQKARYRKEQTLLKQLPCIPLVENLLKDGTDGCALAALIHFYCPDVVRLEDICLKETMSLADSLYNLQLIQEFCQEYLNQCCHFTLEDMLYAASSIKSNYLVFMAELFWWFEVVKPSFVQPRVVRPQGAEPVKDMPSIPVLNAAKRNVLDSSSDFPSSGEGATFTQSHHHLPSRYSRPQAHSSASGGIRRSSSMSYVDGFIGTWPKEKRSSVHGVSFDISFDKEDSVQRSTPNRGITRSISNEGLTLNNSHVSKHIRKNLSFKPINGEEEAESIEEELNIDSHSDLKSCVPLNTNELNSNENIHYKLPNGALQNRILLDEFGNQIETPSIEEALQIIHDTEKSPHTPQPDQIANGFFLHSQEMSILNSNIKLNQSSPDNVTDTKGALSPITDNTEVDTGIHVPSEDIPETMDEDSSLRDYTVSLDSDMDDASKFLQDYDIRTGNTREALSPCPSTVSTKSQPGSSASSSSGVKMTSFAEQKFRKLNHTDGKSSGSSSQKTTPEGSELNIPHVVAWAQIPEETGLPQGRDTTQLLASEMVHLRMKLTKQRQKMGRTAFLTVVKKKGDGISPLREEAAGAEDEKVYTDRAKEKESQKTDGQRSKSLADIKESMENPQAKWLKSPTTPIDPEKQWNLASPSEETLNEGEILEYTKSIEKLNSSLHFLQQEMQRLSLQQEMLMQMREQQSWVISPPQPSPQKQIRDFKPSKQAGLSSAIAPFSSDSPRPTHPSPQSSNRKSASFSVKSQRTPRPNELKITPLNRTLTPPRSVDSLPRLRRFSPSQVPIQTRSFVCFGDDGEPQLKESKPKEEVKKEELESKGTLEQRGHNPEEKEIKPFESTVSEVLSLPVTETVCLTPNEDQLNQPTEPPPKPVFPPTAPKNVNLIEVSLSDLKPPEKADVPVEKYDGESDKEQFDDDQKVCCGFFFKV

SEQ ID NO: 918310 - protein, 510 aa, Homo sapiens
MKNSKIFQCDKYMKIFHKFSNLNGHKVRHTRKKPFKYKEFGKSFCIFSNLTQHKIICTRVNFYKCEDCGKAFNGSSIFTKHKRIHIGEKSYICEECGKACNQFTNLTTHKIIYTRDKLYKREECSKAFNLSSHITTHTIIHTGENPYKREECDKAFNQSLTLTTHKIIHTREKLNEYKECGKAFNQSSHLTRHKIIHTGEKPYKCEECGKAFNQSSHLTRHKIIHTGEKPYRCEECGKAFRQSSHLTTHKIIHTGEKPYKCEECGKAFNKSSHLTRHKSIHTGEKPYQCEKCGKASNQSSNLTEHKNIHTEEKPYKCEECGKAFNQFSNLTTHKRIHTGEKPYKCEECGKAFNQSSILTTHKRIHTGEKSYKCEECGKAFYRSSKLTEHKKIHTGEKPYTCEECGKAFNHSSHLATHKVIHTGEKPYQCEECGKAFNQSSHLTRHKRIHTGEKPYQCEKCGKAFNQSSNLTGHKKIHTGEKLYKPKRCNSDFENTSKFSKHKRNYAGEKS

SEQ ID NO: 918311 - protein, 126 aa, Homo sapiens
HLLHGRYTYREYLEAHLKFLAFFLQEATLYLGWNRAKEIWECLVTGQDVCELDREMCFEWFTKGQHDLESDVQQQLFKEKILKLESYEITMNGFNLFKTFFENVNLCDHRLKRQGAQLVSTLFSNL

SEQ ID NO: 918312 - protein, 571 aa, Homo sapiens
MIVRLPQPRGTILWGWDSDSSLSLLHDTENLSWKTKSGDDLMTVGWTHVKAPPLAFRGWLSNETLKNDENGNCSGEGIEFPTTNLYELESRVLTDHWSIPYKREESLGKCLLASTYLARLGCSPLVPALRCISFLSHPVPPGVDVLFSCKWTLTVTRALQLPVGESGFRAFLPVSQDSCFLFFGELGGFAAIQAKLHSEDIELGRLVSIPELLSAVKLLCMRFQPDLVTIVDDLRLDILLRMLKSPHFSAKMNSLKEVTKLIEDSTLSKSVKNAIDTDRLLDWLVENSVLSIALEGNIDQAQYCDRIKGIIELLGSKLSLDELTKIWKIQSGQSSTVIENIHTIIAAAAVKFNSDQLNHLFVLIQKQALEEHLTILSDAYAVKEAIKRSYIIKCIEDIKRLNNPQFVWVVPALRQLHEITRSFIKQTYQKQDKSIIQDLKKNFEIVKLVTGSLIACHRLAAAVAGPGGLSGSTLVDGRYTYREYLEAHLKFLAFFLQEATLYLGWNRAKEIWECLVTGQDVCELDREMCFEWFTKGQHDLESDVQQQLFKEKILKLESYEITMNDKELSCM

SEQ ID NO: 918313 - protein, 145 aa, Homo sapiens
MSNAVCYVCRVAAEQRDKGKKKLKWVQRKVCMDNGMAEENNGWHLQNAVIGLNESFPISIQNHRNITLKRAFTKCPWECPVGHITEIAELYLTAGLLPCRFPSGSQLLAVQAKNFKMICQKGHKVLSPNITRVGKRSSLILFCGS

SEQ ID NO: 918314 - protein, 145 aa, Homo sapiens; identical to SEQ ID NO: 918313

SEQ ID NO: 918315 - protein, 424 aa, Homo sapiens
MKQVRTPLPGSSGTELGQHSATLTGRRVGEKEGRGGEEEEDEDEEEKEKEKKKKKKEEKEKEEEASRPMKSILQDLESQESMVAFLTSAVASADGEQARLRGQLKEQRLRCRCLAHLLAWAQKQPEAAAPAPGTGMDSVCGGTHRALQGAMEKLQSCFMQLMQEKVDLKERVEELEHRCIQLSGETDTIGGAAQWVKGTQRLSPVLSQESTLPSLSQGAALKEQHREEEEHIHRLAQDKEEMKAGRMAAEHPLLQVKLLELQELVLRLVGDRTEGHGRFLAAAQSPAHEPAPGDPSPPELRAADKQDLCQVTLTSSVEPAQGEAGEGSPLDNPSAQQIMQLFGEMQNPQERPGLGSIPCILFSHQADKNHQAPSHVVTATFPYTTMLSIWVAACHIHSALDTYIKVMHRPGVCVLGTARSLGWS

SEQ ID NO: 918316 - protein, 374 aa, Homo sapiens
LLKPSFTPRTAQAQAEALWSRRDPLAWAVVWADSRGRFTTLCPAPRPLTWPWMIPSRPPSAAGEKRGPRRQQTLGGGCGGGQRGVRLGPVPAAVRPGRDAELRLTHTAIVSLHLVKCRMQVDPGWYKGVLSGFGVTVHSDGLCGLARGCAQTFFGYSLQGFFKFGLYEVFKIRSAELLGPEKAYGWRAGLYLFAWASAEFFPDVSLEPMEAVKHPASHGVQDVGRGGPVGLLQGRGAAVAEADPLHHDEVRLLRAHGRGPLQVCRAQAPEPVHQGQAAGHHLRGVFCAVVSHPADSVVSVLNKEKGIAALGVLRRLGFTGVWKGVVARIGLFAHIPMIGTLTALQWFIYDLVKVYFKLPRPPVAQAPEPLKKKK

SEQ ID NO: 918317 - protein, 478 aa, Homo sapiens
MLENYRNLVFLGIALTKPDLITCLEQGKEPWNIKRHEMVAKPPVICSHFPQDLWAEQDIKDSFQEAILKKYGKYGHDNLQLQKGCKSVDECKVHKEHDNKLNQCLITTQSNIFQCDPSAKVFHTFSNSNRHKIRHTRKKPFKCKKCEKSFCMLLHLTQHKRFHITENSYQCKDCGKAFNWFSTLTTHRRIHTGEKPYKCEECGKAFNRSSHLTTHKIIHTGEKPYRCEECGKAFNRSSHLTTHKRIHTGVKPYKCTECGKAFNRSSHLTTHRIIHTGEKPYKCEECGKAFNQSSTLTTHKITHAGEKPYKCEECGKAFYRFSYLTKHKTSHTGEKFYKCEECGKGFNWSSALTKHKRIHTGEKPYKCEECGKAFNESSNLTTHKMIHTGEKPYKCDECGKAFNRSSQLTAHKMIHTGEKPYKCEECGKAFNRSSTLTKHKITHTGEKSYKWEECGKDFNQSLSLIKQNNSYWRETLQM

SEQ ID NO: 918318 - protein, 390 aa, Homo sapiens
MLENYRNLVFLGIALTKPDLITCLEQGKEPWNIKRHEMVAKPPVICSHFPQDLWAEQDIKDSFQEAILKKYGKYGHDNLQLQKGCKSVDECKVHKEHDNKLNQCLITTQSNIFQCDPSAKVFHTFSNSNRHKIRHTRKKPFKCKKCEKSFCMLLHLTQHKRFHITENSYQCKDCGKAFNWFSTLTTHRRIHTGEKPYKCEECGKAFNRSSHLTTHKIIHTGEKPYRCEECGKAFNRSSHLTTHKRIHTGVKPYKCTECGKAFNRSSHLTTHRIIHTGEKPYKCEECGKAFNQSSTLTTHKITHAGEKPYKCEECGKAFYRFSYLTKHKTSHTGEKFYKCEECGKGFNWSSALTKHKRIHTGEKPYKSERCDSALKTPQTFQNINHSVEKS

SEQ ID NO: 918319 - protein, 141 aa, Homo sapiens
MRLRKNSTGEGLGQGMRHDEKGFVVLEKWPVQLEQGAAGKEVTSENEASARATGAAVEAGRPTGSPCGRPGRHRGLVTVQPWRDTRETEAGAALTAPAVELNMGRGCGEKGNQNDLITFGLEQLAGCDATAEKVKPGEEQV

SEQ ID NO: 918320 - protein, 368 aa, Homo sapiens
KLTEFKWNGSGMHLNGLGMDWNGMEWNGTERNGTDPEWNGTDPEWNGTEWNGMEWNEVDSNGMEWNGIDSNEMGWTRMEWNGMESTRVEWNGMEWNRMELTQFKWNEDWNEMEWNGLKWNGMEWNGLKWNGLKWNGMEWTRIEWNGMDCNGKEWNGTEWTRMEWKGLEWNGMEWNGLEWNGVEYSNGMEWNGMEWNGMEWNGMEWNGMDSNEMEWTRMKWNGLEWNGMEWNGMEWNGMEWNGMEWNRLEWNGMDSKEMECSGMDSNGMQWNGIDSNGMEWNGMEWNGTGMDANEMEWNGMDSDGTERNGTEWNGIYSNGMEWNGIYSNGMEWNGLKWNSMEWNGLECNGMEWTRVEWNGLERSGVEWI

SEQ ID NO: 918321 - protein, 138 aa, Homo sapiens
MLRGLDWEAGWISTKTRESVGRGARAEGAQGKICDYERDLKKTFPTDWQEKMTVSLNVFCNIKNGIQIYGTISVIHNQNYPFKTDGSDCCTFGYYICIPGGRKGDGKRIQGILLEKFTSYSGKKVFLKDFHLQLIGQS

SEQ ID NO: 918322 - protein, 301 aa, Homo sapiens
MERHMVRGQLYKHFDLERKNAKQAEARLDQRLQRLKVICLYHVKLLTWEQRQLQKELQRLQQETMKKKFSSYLGNGFQKRPEDVLVFSPQGRQKHRAPQAKKMRALATRMAQDTCKSKSQVPPSHDAGLKDPMKSKKQPLSQNNRTACFIKEQPQAQEKDSVNPSKDVDPSKGISVPCQNQEVSTNTIEQGPSSSPASDSGMACADETRSKDVALKPDGNTGKQIPPKHMECAGSFEGEFTKPTFLELLSKARNAHYLRHRVPPESERLLSIGEIFGHGESSSSRAGKECENRVPSKFLPL

SEQ ID NO: 918323 - protein, 215 aa, Homo sapiens
MDFEDDYTHSACRNTYQGFNGMDRDYGPGSYGGMDRDYGHGSYGGQRSMDSYLNQSYGMDNHSGGGGGSRFGPYESYDSRSSLGGRDLYRSGYGFNEPEQSRFGGSYGGRFESSYRNSLDSFGGRNQGGSSWEAPYSRSKLRPGFMEDRGRENYSSYSSFSSPHMKPAPVGSRGRGTPAYPESTFGSRNYDAFGGPSTGRGRGRGEVIFCKLLLK

SEQ ID NO: 918324 - protein, 146 aa, Homo sapiens
MDFEDDYTHSACRNTYQGFNGMDRDYGPGSYGGLTFKDIYLKILLLSASKHMGDFGSIHRPGIVVDYQNKSTNVTVAAARGIKRKMMQPFNKPSGTFIKKPKLAKPMEKISLSKSPTKTDPKNEEEEKRRIEARREKQRRRREKKQ

SEQ ID NO: 918325 - protein, 212 aa, Homo sapiens
MDFEDDYTHSACRNTYQGFNGMDRDYGPGSYGGMDRDYGHGSYGGQRSMDSYLNQSYGMDNHSGGGGGSSFSSPHMKPAPVGSRGRGTPAYPESTFGSRNYDAFGGPSTGRGRGRGHMGDFGSIHRPGIVVDYQNKSTNVTVAAARGIKRKMMQPFNKPSGTFIKKPKLAKPMEKISLSKSPTKTDPKNEEEEKRRIEARREKQRRRREKKQ

SEQ ID NO: 918326 - protein, 301 aa, Homo sapiens [sequence omitted]

SEQ ID NO: 918327 - protein, 209 aa, Homo sapiens
MGRTAVGIPGSDANASLADLYFYKDSSACGHVQNQATHCHPQAVTTLGHIVRIYLMEDLDSGLSAILCCILLKPQACFLRYSHPDQNQDIRTDTVLFTNVQALFTFPLFSSSVPFLFQDLVLDPVLHEKGQLATFWETKLTGKLRICWGSGVFHEPGRGSGESIQEGFPKEVPIKAAAPWGPTQRALEAHDGLRTSSGLFFPGAPSPML

SEQ ID NO: 918328 - protein, 471 aa, Homo sapiens
SSRRGRQRGVGGRRGSRHRRALGPPTPGAAAATAVAAAACRDWSAPSAADKTLASGRSSPIMPRERRERDAKERDTMKEDGGAEFSARSRKRKANVTVFLQDPDEEMAKIDRTARDQCGSQPWDNNAVCADPCSLIPTPDKEDDDRVYPNSTCKPRIIAPSRGSPLPVLSWANREEVWKIMLNKEKTYLRDQHFLEQHPLLQPKMRAILLDWLMEVCEVYKLHRETFYLAQDFFDRYMATQENVVKTLLQLIGISSLFIAAKLEEIYPPKLHQFAYVTDGACSGDEILTMELMIMKALKWRLSPLTIVSWLNVYMQVAYLNDLHEVLLPQYPQQIFIQIAELLDLCVLDVDCLEFPYGILAASALYHFSSSELMQKVSGYQWCDIENCVKWMVPFAMVIRETGSSKLKHFRGVADEDAHNIQTHRDSLDLLDKARAKKAMLSEQNRASPLPSGLLTPPQSGKKQSSGPEMA

SEQ ID NO: 918329 - protein, 410 aa, Homo sapiens
MPRERRERDAKERDTMKEDGGAEFSARSRKRKANVTVFLQDPDEEMAKIDRTARDQCGSQPWDNNAVCADPCSLIPTPDKEDDDRVYPNSTCKPRIIAPSRGSPLPVLSWANREEVWKIMLNKEKTYLRDQHFLEQHPLLQPKMRAILLDWLMEVCEVYKLHRETFYLAQDFFDRYMATQENVVKTLLQLIGISSLFIAAKLEEIYPPKLHQFAYVTDGACSGDEILTMELMIMKALKWRLSPLTIVSWLNVYMQVAYLNDLHEVLLPQYPQQIFIQIAELLDLCVLDVDCLEFPYGILAASALYHFSSSELMQKVSGYQWCDIENCVKWMVPFAMVIRETGSSKLKHFRGVADEDAHNIQTHRDSLDLLDKARAKKAMLSEQNRASPLPSGLLTPPQSGKKQSSGPEMA

SEQ ID NO: 918330 - protein, 361 aa, Homo sapiens
MPRERRERDAKERDTMKEDGGAEFSARSRKRKANVTVFLQDPDEEMAKIDRTARDQCGSQPWDNNAVCADPCSLIPTPDKEDDDRVYPNSTCKPRIIAPSRGSPLPVLSWANREEVWKIMLNKEKTYLRDQHFLEQHPLLQPKMRAILLDWLMEEIYPPKLHQFAYVTDGACSGDEILTMELMIMKALKWRLSPLTIVSWLNVYMQVAYLNDLHEVLLPQYPQQIFIQIAELLDLCVLDVDCLEFPYGILAASALYHFSSSELMQKVSGYQWCDIENCVKWMVPFAMVIRETGSSKLKHFRGVADEDAHNIQTHRDSLDLLDKARAKKAMLSEQNRASPLPSGLLTPPQSGKKQSSGPEMA

SEQ ID NO: 918331 - protein, 414 aa, Homo sapiens
VLTRPGATRVHRDAKERDTMKEDGGAEFSARSRKRKANVTVFLQDPDEEMAKIDRTARDQCGSQPWDNNAVCADPCSLIPTPDKEDDDRVYPNSTCKPRIIAPSRGSPLPVLSWANREEVWKIMLNKEKTYLRDQHFLEQHPLLQPKMRAILLDWLMEVCEVYKLHRETFYLAQDFFDRYMATQENVVKTLLQLIGISSLFIAAKLEEIYPPKLHQFAYVTDGACSGDEILTMELMIMKALKWRLSPLTIVSWLNVYMQVAYLNDLHEVLLPQYPQQIFIQIAELLDLCVLDVDCLEFPYGILAASALYHFSSSELMQKVSGYQWCDIENCVKWMVPFAMVIRETGSSKLKHFRGVADEDAHNIQTHRDSLDLLDKARAKKAMLSEQNRASPLPSGLLTPPQSGKKQSSGPEMA

SEQ ID NO: 918332 - protein, 291 aa, Homo sapiens [sequence omitted]

SEQ ID NO: 918333 - protein, 426 aa, Homo sapiens
SSRRGRQRGVGGRRGSRHRRALGPPTPGAAAATAVAAAACRDWSAPSAADKTLASGRSSPIMPRERRERDAKERDTMKEDGGAEFSARSRKRKANVTVFLQDPDEEMAKIDRTARDQCGSQPWDNNAVCADPCSLIPTPDKEDDDRVYPNSTCKPRIIAPSRGSPLPVLSWANREEVWKIMLNKEKTYLRDQHFLEQHPLLQPKMRAILLDWLMEVCEVYKLHRETFYLAQDFFDRYMATQENVVKTLLQLIGISSLFIAAKLEEIYPPKLHQFAYVTDGACSGDEILTMELMIMKLLDLCVLDVDCLEFPYGILAASALYHFSSSELMQKVSGYQWCDIENCVKWMVPFAMVIRETGSSKLKHFRGVADEDAHNIQTHRDSLDLLDKARAKKAMLSEQNRASPLPSGLLTPPQSGKKQSSGPEMA

SEQ ID NO: 918334 - protein, 179 aa, Homo sapiens
MEDCGEPWRPRQGFLVEIWALTLTSCVILNASSRRLIAVRDLNLNSTMKKLIASQIHRSTNPKEKLYQAACENIFNRNEWTRNKFYSYSMAVFSLAEARPSFTSQLRGDVHRNCVIWFHTRSSDAGFCLSQPWPWLTRGPGTLEQRDLLVLGVSCKADSGGTSLTGLLQRLHEILLNKY

SEQ ID NO: 918335 - protein, 213 aa, Homo sapiens
TPARPAAAGVEGHQLERAPLLLGIKRGGPDCRQPWGGPLLLLLTHPMMCGWPSLRSSEATQKVAGLPWFYRRRLDQLLQLLANDRPGIDGRRVQGTWTNLSTAAAGWPVSWCPNTKPKSWKQCGRHLPLKTDASDSPIFLTQASEDPLLPSQENEKAGGAAGLPPEAHIGPGLCTLTGPTGSSAFQKGVPPTAPHICPVLQAITRTGLCGRGL

SEQ ID NO: 918336 - protein, 305 aa, Homo sapiens
MPCIITLLSSCTWGGLAAKVLVSGVPLGNEPACLTFVLSSPQDGVRTDIYRQLFHPEQLISGVEDAANNCARGHYTAGKEIIDLTAFMVDEAIYDLCCHNLRPTYTNLNWLISQIVSSITASLCFDGALNVDLTEFQTNLVPYPRIHFPLVTYSPIISAKKAYHEQLSVAEISSVYFEPSNQMAKCDPRHGKYMACCLLYCGEVVPKDENATIATIKTKQIFVGINYQSPTVVPGGAVAKVQRAVCVLNNTTAITEAWARLNQKFDLMYAKRAFMHCYVDRGMEEVPIVPKRQGPQPTVSFVLIR

SEQ ID NO: 918337 - protein, 305 aa, Homo sapiens; identical to SEQ ID NO: 918336

SEQ ID NO: 918338 - protein, 196 aa, Homo sapiens
MATWWLLCGLLVYLVTLQIQISPHPTLPHHASPPPPHHRKLVSLEEPQGSESRGRTWLRVTREDRREIQEQHRANAWATPAPRKPGQHHLTSTRVLMQHLHRARRPVRLDLPSRERKSSLRKEAANIPLRSPKWGKGKNKEGRSSCISPSSLPFLDPTGSGGEATKADWHPERRLTKGWSEAGNGDPDEQNKSLAA

SEQ ID NO: 918339 - protein, 525 aa, Homo sapiens
MCFHFAQDLCPEQSLKDSFQKVIVTRYEKREYGNLELKKGCESVDEGKVHKRGYNGLNQCLTATQSKVFQCDTYVKVSHIFSNSNRHKIRDTGKKPFKCIECGKAFNQSSTLATHKKIHTGEITCKCEECGKAFNRSSHLTSHKRIHTGEKRYKCEDCGKELKYSSTLTAHKRIHTGEKRYKCEDCGKELKYSSTLTAHKRIHTGEKPYKCDKCGRAFISSSILYVHKISHTEEKPYKCEECGKAFKLSSILSTHKRIHTGEKPYKCEECGKAFRRSLVLRTHKRIHTGEKPYKCDKCGKAFISSSLLYKHKISHSEKKPYKCEECGKAFKRSSTLTIHKISHTEEKPYKCQECDKVFKRSSALSTHKIIHSGEKPYKCEECGKAFKRSSNLTTHKISHTEEKLYKCQECDKAFKYSSALSTHKIIHSGENPYKCEECGKAFKRSSVLSKHKIIHTGAKPYKCEECGKAFKRSSQLTSHKISHTGEKPYKCEECGKAFNLSSDLNTHKRIHIGQKAYIVKNMANL

SEQ ID NO: 918340 - protein, 381 aa, Homo sapiens
MQPLQALAPTPAPEPKPVPAPGLETTTEPAADCPGGDDYTLKAYGTLQVHAGKSLGSRSGSRIGKGGASVFEEPCAWLSFTQYATQYATGAGWELESVTHKDTWCGVKTLRAANSVKTKTSAHMGFPQSVTVEPNAWSPNTAGKSRPRQSQWLSEEIPFKSVKAQQASLRVAVHFSTLPRDHLLNSWAQVIPFHFDPWIKGAGARRGKVESFHASARCPLWLCLRSPSACYCTVGALLWAGRGRSQLPLLVGRCRGRGVGRNRSCAGRLRAARVPGGRRLGGPCTRSGQPALLALDSEGLSTRAKSCGGCTGSPSTADLPVPCFNSRQASAQPPPQGAGLGTCSSPCLSSPARHGLPLDPSLPDGHCPLLRGAWSHRPPKG

SEQ ID NO: 918341 - protein, 381 aa, Homo sapiens; identical to SEQ ID NO: 918340

SEQ ID NO: 918342 - protein, 143 aa, Homo sapiens
ERNILGAFHSPIMFYNRFVETEFIYHEIHSFKVSNSVVFSIFTKLCAITTNSRTLSSHPKETLYPLAVTPHSTLPPSPTTPAPDSAHLHTSEINSHVAHTKPVWWSLHMDAHKIWCHDSDWRTSLGRSIPCPPVLCSMKKIHL

SEQ ID NO: 918343 - protein, 138 aa, Homo sapiens
MERFTGQNDQVQIQALPLLINCVTLENFPKFSEPYFLHLENGNSHILYRHIHLTGLLSTKEIAKTVSGSQVQGNDTGTGFSSIIKSPLVGNGRSRFSGGEEKGFAKAYQTKSMALTPVHVGVAAEWEKATEFQSQVHG

SEQ ID NO: 918344 - protein, 138 aa, Homo sapiens; identical to SEQ ID NO: 918343

SEQ ID NO: 918345 - protein, 161 aa, Homo sapiens
LSCLTCKMQGCDPLNSMVPTELKIFGIQGCQRCPRRRRVKNHPVGHKGDQSKQEKSKQGVILGNTWGQFGITAFVPSPRMNNHQEKRGRAVTVGPETAFRMETSYEDAGAERFMLADCLGGPSRSSREPTSRAPLLEKEITLSLSSLWCCYSGFSAMCRQN

SEQ ID NO: 918346 - protein, 202 aa, Homo sapiens
MNWFVIGLTAALIITSETGGPLVLPTRSVSHQRRCGRLCPFLGADPRQALIPYVNHALMTAATTLLQKSSSVQVIAVTTDSPVTVQLMRPVEGGACCRGAPGGVGGACCHGACLVEEVSRGAPGGVGGACCHGACLVEEVSRGAPGGVGGACCRGACLVEEVSRGAPGGVGGACCRGACLVEEVSLRFWICLNSSEKAEGNL

SEQ ID NO: 918347 - protein, 146 aa, Homo sapiens [sequence omitted]

SEQ ID NO: 918348 - protein, 241 aa, Homo sapiens
APFPVHLSRAWYDTQHIAETAMELPPEASKAPFTHSVYLLKGPFSSLTFPEDWMPLTTAIPTMLQATRRHRVIFQLRPPLSEMESEMSKASRYQKGLAVSCISETGASVRAEGRLLHQSHLSTCVQEQLLIEQTLLGAQTDTQPAPAEYTALASAKLMADCLPQPLTHYAAGEADAPQAGTYIVPHTDAAAADPLTHSQLQEEEGDPDDDQQHQSRCSSMNDVAIRVAYHTAAHPDPPSPP

SEQ ID NO: 918349 - protein, 1222 aa, Homo sapiens
LGFSDEQILTVKTSGSGTPSGSSADSSTSSSSSSSGVFSSSYAMEQEKSLPGVVMALVCNVFDMLYQLANLEEPRITLRVRKLLLLIPTDPAIQEALDQLDSLGRKKEVGIPFPLGEVGMDTSSKHEQRMVEGIPEGRSGTEKLGRDLEEVEGMGNREMMAKRIPKYRRRGAASAHPCVGTCLVPAEATGGQCDEDLTKDGIEALSSRPFRNVSRQTSRQMSLCGTPEKSSYRQLSVSDRSSIRVEEIIPAARVAIQTMEVSDFTSTVACFMRLSWAAAAGRLDLVGSSQPIKESNSLCPAGIRNRLSSSGSNCSSGSEGEPVALHAGICVRQQSVSTKDSLIAGEALSLLVTCLQLRSQQLASFYNLPCVADFIIDILLGSPSAEIRRVACDQLYTLSQTDTSAHPDVQKPNQFLLGVILTAQLPLWSPTSIMRGVNQRLLSQCMEYFDLRCQLLDDLTTSEMEQLRISPATMLEDEITWLDNFEPNRTAECETSEADNILLAGHLRLIKTLLSLCGAEKEMLGSSLIKPLLDDFLFRASRIILNSHSPAGSAAISQQDFHPKCSTANSRLAAYEVLVMLADSSPSNLQIIIKELLSMHHQPDPALTKEFDYLPPVDSRSSSGFVGLRNGGATCYMNASLLSVDDDTDNPDDSVFYQVQSLFGHLMESKLQYYVPENFWKIFKMWNKELYVREQQDAYEFFTSLIDQMDEYLKKMGRDQIFKNTFQGIYSDQKICKDCPHRYEREEAFMALNLGVTSCQSLEISLDQFVRGEVLEGSNAYYCEKCKEKFPWMLNMEPYTVSGMARQDSSSEVGENGRSVDQGGGGSPRKKVALTENYELVGVIVHSGQAHAGHYYSFIKDRRGCGKGKWYKFNDTVIEEFDLNDETLEYECFGGEYRPKVYDQNCQDKKNFYLQMCFLMSCYKANPYTDVRRRYWNAYMLFYQRVSDQNSPVLPKKSRVSVVRQEAEDLSLSAPSSPEISPQSSPRPHRPNNDRLSILTKLVKKGEKKGLFVEKMPARIYQTKLKHPYYPCMAKVSLQLAIQFLFQTYLRTKKKLRVDTEEWIATIEALLSKSFDACQWLVEYFISSEGRELIKIFLLECNVREVRVAVATILEKTLDSALFYQDKLKSLHQLLEVLLALLDKDVPENCKNCAQYFFLFNTFVQKQGIRAGDLLLRHSALRHMISFLLGASRQNNQPRSRPPGPAQPATHQGPRGSFDAPQ

SEQ ID NO: 918350 - protein, 138 aa, Homo sapiens
HSGMGTSSVVIEHSPQLHFLSAFHAISLILQALLGDRCSFPYVRDEKTETRKLARDLDLGYPLSTIPVLSNHAPGFLETQVTASICMDHSFKSFGYEEKWNERAHKRSGEEEQMVTNGGCGHCLADLGSLEANCAEHF

SEQ ID NO: 918351 - protein, 118 aa, Homo sapiens; identical to SEQ ID NO: 799972

SEQ ID NO: 918352 - protein, 285 aa, Homo sapiens
MAQSQSESHKNIPRVGTQLLLEACVQATVPIFIYTSTLEVARPNSYKEIIQNGHEEEPLENTWYAPYPHSKKLAEKAVLAANGLTLKNGGTLYTCAVRPMFIYGEGSPILSAGINEALNNHGILSSFSKFSRVNPVYVGNIAWAHILALRALREPKKAPSVRGQFYYISDDTPHQSYDNLSYTLSKEFGLCLDSSWSLPLSLTYWIGFLLEIVSFLPRPVYTCRPPFNHHRVTLSNSVFTFSYKKAQQDLAYKSLYSWEEAKQKTMEWVGSLVDWHKETLKSKTQ

SEQ ID NO: 918353 - protein, 193 aa, Homo sapiens
MPEPAKFAPAPKKGSKKAVTKAQKKDGKKRKRSRKESYSIYVYKVLKRVHPDTGIWCKAMGIMNSFLNDIFERIAGEASRLAHYNKRSTITSRRSRRPCACCCPASWPSTPCPRAPRRSPSTPAPSESLPGPGARSLPPSLPPRVAGCFVSKGSFQGHLTTSVKESFLCCQSQLMFLASRLVNFRRAHNTKHR

SEQ ID NO: 918354 - protein, 1365 aa, Homo sapiens
MFLLLLTSSAVHKWGTEIHEGIYNMLMLLIELVAERIKQDPIPIGLLGVLTMAFNPDNEYHFKNRMKVSQRNWAEVFGEGNMFAVSPVSTFQKEPHGWVVDLVNKFGELGGFAAIQAKLHSEDIELGAVSALIQPLGVCAEYLNSSVVQPMLDPVILTTIQDVRSVEEKDLKDKRLVSIPELLSAVKLLCMRFQPDLVTIVDDLRLDILLRMLKSPHFSAKMNSLKEVTKLIEDSTLSKSVKNAIDTDRLLDWLVENSVLSIALEGNEAALGGAFTLSAGTVKEVLLPPRFPESLAATASICIHSEPKPDVLHPSSCHSSPSASSHWQNSGQSSTVIENIHTIIAAAAVKFNSDQLNHLFVLIQKLHEITRSFIKQTYQKQDKSIIQDLKKNFEIVKLVTGSLIACHRLAAAVAGPGGLSGSTLVDGRYTYREEKSLPGVVMALVCNVFDMLYQLANLEEPRITLRVRKLLLLIPTDPAIQEALDQLDSLGRKKEVGIPFPLGEVGMDTSSKHEQRMVEGIPEGRSGTEKLGRDLEEVEGMGNREMMAKRIPKYRRRGAASAHPCVGTCLVPAEATGGQCDEDLTKDGIEALSSRPFRNVSRQTSRQMSLCGTPEKSSYRQLSVSDRSSIRVEEIIPAARVAIQTMEVSDFTSTVACFMRLSWAAAAGRLDLVGSSQPIKESNSLCPAGIRNRLSSSGSNCSSGSEGEPVALHAGICVRQQSVSTKDSLIAGEALSLLVTCLQLRSQQLASEMEQLRISPATMLEDEITWLDNFEPNRTAECETSEADNILLAGHLRLIKTLLSLCGAEKEMLGSSLIKPLLDDFLFRASRIILNSHSPAGSAAISQQDFHPKYGKCTCSTANSRLAAYEVLVMLADSSPSNLQIIIKELLSMHHQPDPALTKEFDIFKMWNKELYVREQQDAYEFFTSLIDQMDEYLKGIYSDQKICKDCPHRYEREEAFMALNLGVTSCQSLEISLDQFVRGEVLEGSNAYYCEKCKEKFPWMLNMEPYTVSGMARQDSSSEVGENGRSVDQGGGGSPRKKVALTENYELVGVIVHSGQAHAGHYYSFIKDRRGCGKGKWYKFNDTVIEEFDLNDETLEYECFGGEYRPKVYDQNCQDKKNFYLQMCFLMSCYKANPYTDVRRRYWNAYMLFYQRVSDQNSPVLPKKSRVSVVRQEAEDLSLSAPSSPEISPQSSPRPHRPNNDRLSILTKLVKKGEKKGLFVEKMPARIYQTKLKHPYYPCMAKKRKSLPTRRSQSAALMHHSNHVDSSRCYQCVKFLVTLAQKCPAAKEYFKENSHHWSWAVQWLQKKMSEHYWTPQSNVSNETSTGKTFQRTISAQASGPTEGQMKGSLPWRLLLPLNGP

SEQ ID NO: 918355 - protein, 155 aa, Homo sapiens
HNCEVRKALSKQEMASVSSSQRGEVVLETLVVVVEVVSVGMTTLVVEETLVVMVALVAAVMSVDMVAVGMVIMGLAIMVVMEEVALVTLEEAEAMEVVDRVMETRAVAMAGVAAMTAITIEVEVALAVAVEAVLEVVEATVIWAIKTISFQILDP

SEQ ID NO: 918356 - protein, 148 aa, Homo sapiens
GALTIMVEDEGSERDILHGSRQEDETICIFQEACEISTNSFGMQRKVTAEKKSLNLQCNSGSCYIKALKSDYSQIIVVEWKTMLMNPQKTSITIAMAAFLMSSLEKETDQHSQYNAKVHFFTCVLCVFKFSALQFDSKSSLSPLNGFI

SEQ ID NO: 918357 - protein, 133 aa, Homo sapiens
MVVWRMDWRRAGAEGRPPRAYCNTECLGESTESGPGACCQKNRTQIPILLLTFVSYWARNTGGLTKAGAATMGRAGGHKNHFSGCDNEREGYDSELCNLADGLNINGVKGHRRKKELRNMEGGGVVWLWTGQI

SEQ ID NO: 918358 - protein, 138 aa, Homo sapiens
MSKSRSFEQILVKSIKRQDSFPGESYIIVGSPMSSLKGLLVPTPEFLSQEDREAREEQTWPFGDSKKQSVSCLDLEKAAESVWLPNSVPKHLDNWCDQYSTLLLADDREETGVRVSEKKNSIEKRSLFPYFSGKEVED

SEQ ID NO: 918359 - protein, 138 aa, Homo sapiens
MLPWLRINNDFFSLMFLHRKDQNVLSPVNCWNLLLNQVKRESRDHTTLSDIYLNNIIPRFVQVSEDSGRLFKKRKTRLDNLIASPDLRDAYTEGSQIAKSRVFLALQVPYAHFTKEPIGGIQLQSCLGSSFQDLRNST

SEQ ID NO: 918360 - protein, 147 aa, Homo sapiens
PVVWLDGQGLGRGMIRKLVTKKFGEEANLATATAECPIGQQQLPTLSPRYGTIPRDDQLASWWQVDYIGFLPSWKGQRFVLTGIYPYSGYGFAYPACNASAKTAIHGPTQCLIYRHSIPQSIASDQGTHFMAKELKQWAHAHGIHWS

SEQ ID NO: 918361 - protein, 480 aa, Homo sapiens
MCPLHLESAPYSPSVFSACRPLPDMVDAHGPSCASWLCPLPLAPGRSALLACLQDLDLNLCTPQPAPLGTDLQGLQEDALSMKHEPPGLQASSTDDKKFTVKYPQNKDKLGKQPERAGEGAPCPAFSSHNSSSPPPLQNRKSPSPLAFCPCPPVNSISKELPFLLHAFYPGYPLLLPPPHLFTYGALPSDQCPHLLMLPQDPSYPTMAMPSLLMMVNELGHPSARWETLLPYPGAFQASGQALPSQARNPGAGAAPTDSPGLERGGMASPAKRVPLSSQTGTAALPYPLKKKNGKILYECNICGKSFGQLSNLKVHLRVHSGERPFQCALCQKSFTQLAHLQKHHLVHTGERPHKCSVCHKRFSSSSNLKTHLRLHSGARPFQCSVCRSRFTQHIHLKLHHRLHAPQPCGLVHTQLPLASLACLAQWHQGALDLMAVASEKHMGYDIDEVKVSSTSQGKARAVSLSSAGTPLVMGQDQNN

SEQ ID NO: 918362 - protein, 500 aa, Homo sapiens
MCPLHLESAPYSPSVFSACRPLPDMVDAHGPSCASWLCPLPLAPGRSALLACLQDLDLNLCTPQPAPLGTDLQGLQEDALSMKHEPPGLQASSTDDKKFTVKYPQNKDKLGKQPERAGEGAPCPAFSSHNSSSPPPLQNRKSPSPLAFCPCPPVNSISKELPFLLHAFYPGYPLLLPPPHLFTYGALPSDQCPHLLMLPQDPSYPTMAMPSLLMMVNELGHPSARWETLLPYPGAFQASGQALPSQARNPGAGAAPTDSPGLERGGMASPAKRVPLSSQTGTAALPYPLKKKNGKILYECNICGKSFGQLSNLKVHLRVHSGERPFQCALCQKSFTQLAHLQKHHLVHTGERPHKCSIPWVPGRNHWKSFQAWREREVCHKRFSSSSNLKTHLRLHSGARPFQCSVCRSRFTQHIHLKLHHRLHAPQPCGLVHTQLPLASLACLAQWHQGALDLMAVASEKHMGYDIDEVKVSSTSQGKARAVSLSSAGTPLVMGQDQNN

SEQ ID NO: 918363 - protein, 138 aa, Homo sapiens
MHSLREPCTPVVPAGSIAMSDEAPGWSQWNNGRAKKGRGHVQPIRCTNCARCVPKDKAIKTFVIRNIVKAAAVRDISEASVFDAYVLPKLYVKLHYCVSCAIHSKVVRNRSREARKDRTPPSRFRPAGAAPRPPPKPM

SEQ ID NO: 918364 - protein, 164 aa, Homo sapiens
AENVIPKIGLAWWFMPVTLALWEAEEGRSLEIRKAGYPSQLCPVNHMTPEICNSGGIAFQGLSAVLCGGHVQSRLQPSQTAVLSLEDCLTMDPRLLLSLAACLYYTKATSHYLLHMLFPLPSTPVTHLNPFSLFPIFLWLAPPHSLGLSVDSTTIRKESRHCQA

SEQ ID NO: 918365 - protein, 164 aa, Homo sapiens; identical to SEQ ID NO: 918364

SEQ ID NO: 918366 - protein, 482 aa, Homo sapiens
MFFLVTSDESNKTWGRNTVFRQEEFEDVKRNFKKKGCTWGPNSIQMKDRTDCKERIRPLSDGNSPWSTILIKNQKTMPLASLFVDQPGSCEEPKLSPDGLEHRKPKQIKLPSQAYIDLPLGKDAQRENPAEAESWEEAASANAATVSIEMTPTNSLSRSPQRKKTESALYGCTVLLASVALGLDLRELHKAQAAEEPLPKEEKKKREGIFQRASKSRRSASPPTSLPSTCGEASSPPSLPLSSALGILSTPSFSTKCLLQMDSEDPLVDSAPVTCDSEMLTPDFCPTAPGSGREPALMPRLDTDCSVSRNLPSSFLQQTCGNVPYCASSKHRPSHHRRTMSDGNPTPTGATIISATGASALPLCPSPAPHSHLPREVSPKKHSTVHIVPQRRPASLRSRSDLPQAYPQTAVSQLAQTACVVGRPGPHPTQFLAAKERTKSHVPSLLDADVEGQSRDYTVPLCRMRSKTSRPSIYELEKEFLS

SEQ ID NO: 918367 - protein, 576 aa, Homo sapiens
MRREQQLAEREIDVLERELNILIFQLNQEKPKVKKRKGKFKRSRLKLKDGHRISLPSDFQHKITVQASPNLDKRRSLNSSSSSPPSSPTMMPRLRAIQLTSDESNKTWGRNTVFRQEEFEDVKRNFKKKGCTWGPNSIQMKDRTDCKERIRPLSDGNSPWSTILIKNQKTMPLASLFVDQPGSCEEPKLSPDGLEHRKPKQIKLPSQAYIDLPLGKDAQRENPAEAESWEEAASANAATVSIEMTPTNSLSRSPQRKKTESALYGCTVLLASVALGLDLRELHKAQAAEEPLPKEEKKKREGIFQRASKSRRSASPPTSLPSTCGEASSPPSLPLSSALGILSTPSFSTKCLLQMDSEDPLVDSAPVTCDSEMLTPDFCPTAPGSGREPALMPRLDTDCSVSRNLPSSFLQQTCGNVPYCASSKHRPSHHRRTMSDGNPTPTGATIISATGASALPLCPSPAPHSHLPREVSPKKHSTVHIVPQRRPASLRSRSDLPQAYPQTAVSQLAQTACVVGRPGPHPTQFLAAKERTKSHVPSLLDADVEGQSRDYTVPLCRMRSKTSRPSIYELEKEFLS

SEQ ID NO: 918368 - protein, 149 aa, Homo sapiens
PRLSWKTGWSTTDWNEELRSREEELTRAALQQKSQEELLKRREQQLAEREIDVLERELNILIFQLNQEKPKVKKRKGKFKRSRLKLKDGHRISLPSDFQHKITVQASPNLDKRRSLNSSSSSPPSSPTMMPRLRAIQCELSALPRGLLC

SEQ ID NO: 918369 - protein, 799 aa, Homo sapiens
MFSNSTGRLPGQPTEEIQQYKVLVHSQERELTQLKEKLREGRDASRSLNEHLQALLTPDEPDKSQGQDLQEQLAEGCRLAQHLVQKLSPENDEDEDEDVQVEEDEKVLESSAPREVQKAEESKVAEDSLEECAITCSNSHGPCDSNQPHKNIKITFEEDEVNSTLVVDRESSHDECQDALNILPVPGPTSSATNVSMVVSAGPLSSEKAEMNILEINEKLRPQLAEKKQQFRNLKEKCFLTQLAGFLANQQNKYKYEECKDLIKSMLRNERQFKEEKLAEQLKQAEELRQYKVLVHAQERELTQLREKLREGRDASRSLNEHLQALLTPDEPDKSQGQDLQEQLAEGCRLAQHLVQKLSPENDNDDDEDVQVEVAEKVQKSSAPREMQKAEEKEVPEDSLEECAITCSNSHGPYDSNQPHRKTKITFEEDKVDSTLIGSSSHVEWEDAVHIIPENESDDEEEEEKGPVSPRNLQESEEEEVPQESWDEGYSTLSIPPEMLASYKSYSSTFHSLEEQQVCMAVDIGRHRWDQVKKEDHEATGPRLSRELLDEKGPEVLQDSLDRCYSTPSGCLELTDSCQPYRSAFYILEQQRVGLAVDMDEIEKYQEVEEDQDPSCPRLSRELLDEKEPEVLQDSLGRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPSVCCCKKKKTFSA

SEQ ID NO: 918370 - protein, 113 aa, Homo sapiens
EEDQNPPCPRLSRELLDEKGPEVLQDSLDRCYSTPSGCLELTDSCQPYRSAFYILEQQRVGLAVDMDEIEKYQEVEEDQDPSCPRLSGELLDEKEPEVLQESLDRCYSTPSGC

SEQ ID NO: 918371 - protein, 86 aa, Homo sapiens
MVVSAGPWSSEKAEMNILEINEKLRPQLAENKQQFGNLKERCFLTQLAGFLANRQKKYKYEECKDLIKFMLRNERQFKEEKLAEQL

SEQ ID NO: 918372 - protein, 610 aa, Homo sapiens
MFSNSTGRLPGQPTEEIQQYKVLVHSQERELTQLKEKLREGRDASRSLNEHLQALLTPDEPDKSQGQDLQEQLAEGCRLAQHLVQKLSPENDEDEDEDVQVEEDEKVLESSAPREVQKAEESKVAEDSLEECAITCSNSHGPCDSNQPHKNIKITFEEDEVNSTLVVDRESSHDECQDALNILPVPGPTSSATNVSMVVSAGPLSSEKAEMNILEINEKLRPQLAEKKQQFRNLKEKCFLTQLAGFLANQQNKYKYEECKDLIKSMLRNERQFKEEKLAEQLKQAEELRQYKVLVHAQERELTQLREKLREGRDASRSLNEHLQALLTPDEPDKSQGQDLQEQLAEGCRLAQHLVQKLSPENDNDDDEDVQVEVAEKVQKSSAPREMQKAEEKEVPEDSLEECAITCSNSHGPYDSNQPHRKTKITFEEDKVDSTLIGSSSHVEWEDAVHIIPENESDDEEEEEKGPVSPRNLQESEEEEVPQESWDEGYSTLSIPPEMLASYKSYSSTFHSLEEQQVCMAVDIGRHRWDQVKKEDHEATGPRLSRELLDEKGPEVLQDSLDRCYSTPSGCLELTDSCQPYRSAFYVLEQQRVGLAVNMDEIEKYQEINS

SEQ ID NO: 918373 - protein, 136 aa, Homo sapiens
ISGETMSKLSKRDCEQYLGNTKKRDDKEGMTSPCRPGPSATQNKQQDQKKAVCLVKFLCKALNQLIEYHKRNSGLKSYEVISDTSRQFVLIKFSLVEFHSTLEEHFSWKGSSKWTPSRVTSSVKPSMVSYHPSLSE

SEQ ID NO: 918374 - protein, 173 aa, Homo sapiens
MAKLDLNPDSLPRSSRYQDLQAILEHLCNNIFISFRNRFRNRSDNLTGVHTELQNKTKLTVLEGDILDESCLKRACQDMSVIIHTTSIIDIIGVTHRESIMNINVKRTVAWGGDEARWGIKDHKEGQEGKRSLSTEHLLCSGPSVFADHYQLGEFKAAIFSFLHEETSATDGK

SEQ ID NO: 918375 - protein, 173 aa, Homo sapiens; identical to SEQ ID NO: 918374

SEQ ID NO: 918376 - protein, 145 aa, Homo sapiens
MVKDGCQQLLLLHVPKEEEEEQGGEGDTGRRQGVTLFPYIQDDLDHPLSATLQQNSPSLQAKSEVLSTQFKARISQSSLCSLRMPDPFQKLCPDHTVASSETASPCFHVKLSCLIKTQLMLSPPKSFLNPFLPQKKDIIAPSILL

SEQ ID NO: 918377 - protein, 153 aa, Homo sapiens
MARSRHFRILFGVSRTDSSRADFAGFCVMQFFMTGAGHLDLIMTPPSSGDDGPFPVTKGMAVKLKFLRFSDSHQSKTKLADTHHRLVGGKYLHPAIQGRSPWVHVSVAPLSLSPTWVTNMKAITCRSSEHSVTNRECLGLPFHCSNTTTELLQ

SEQ ID NO: 918378 - protein, 153 aa, Homo sapiens; identical to SEQ ID NO: 918377

SEQ ID NO: 918379 - protein, 138 aa, Homo sapiens
MATLLIDGLAKSSKLSSLLLAPPQREDETGVLQMLPACFLPAKAHSKKEQASKVLSSDGAAMTKYYRLSGLNNRHLFLIVLEAVKSKIKVPATLVSGEELCQLWSQEIAQLAFQGPDGLLLQRNFFPVGGFRKWQAHQ

SEQ ID NO: 918380 - protein, 135 aa, Homo sapiens
MNFIKYLYNIYSLPGFIQVVCKHLIHGSCNNPGQPIFPGPVGTPVLLLAHCGNRQKAILGGGSGRFRESLLQSHDQRVSEVWVGHWALRDILSPIPQPDAGPWLGSHMDLDLTLNRSFHLSVYSGNDNIRLTELW

SEQ ID NO: 918381 - protein, 155 aa, Homo sapiens
MLRPRKCSWLVDPSPNHMADTKVMKKHESYCELCVPDDLRWNSYLPKPSPLHPRIVEKLLYTKTIPKCQKGGKGHVFCEKDLDAKQATLSPINFLLRAISSSSAECICDIPTPGGNLVTLSCETKLLLQRPGLQLYFSFYMGSKTLRGRNTSFEY

SEQ ID NO: 918382 - protein, 143 aa, Homo sapiens
MSQSLFLLMFECVRSFFLLVGLWSCWLRSEAADLRGGVSGVVHSSWWVRGLSLASGVKLQTFAASVTAHKGSVDPKSEQQQDLLQGAKEQSFHSVEVDPSRLPLLARVACFFSFIWPHPHPTRLIGRRDLPGLNETVNLRLLG

SEQ ID NO: 918383 - protein, 114 aa, Homo sapiens
TAQTRGRGPRQGSYQKDMFDEINYRIKKYILKNANTTIYKTMLECNGAILAHCNLRLLGSNDSPASASQVAGTTDRNQLLFLPIERNPGCTCSFISCVENIYRLEALSLHFQGF

SEQ ID NO: 918384 - protein, 142 aa, Homo sapiens
MSQVLFLVFSFARYFLIPLLVASLLFIFPNKNLKTNVEKAALHLLLVFTTGENRSSLCVQEIHGAGEFIEGHAYRSVRSDISHFTLCKHSQPNVHRYMNIYVWKRTNKLLPQSSTCQGILLALHVASAVLFRDILCMGSAPV

SEQ ID NO: 918385 - protein, 138 aa, Homo sapiens
MLPQNSAPCHQEAVNTGLHSYAYPYSNSSYMYFFRRGNKTARWEGVSGKLHLACALGWNLRKLMTFVAGSSLAPPLPVWNLKFHRLGRKRSSRDSGFAEHPCFPVFPFSPNKTLLHSPFKPSASLNFCGCGTDKDAFS

SEQ ID NO: 918386 - protein, 138 aa, Homo sapiens; identical to SEQ ID NO: 918385

SEQ ID NO: 918387 - protein, 138 aa, Homo sapiens; identical to SEQ ID NO: 918385

SEQ ID NO: 918388 - protein, 378 aa, Homo sapiens
MVTVLSHGPPGARAGIISTMAGLLTNCLEEGVRNFKELRAKFQNLDAPPLPGPIKFPAGVSPKGDIGGTQSTQILANGKPLSSNHKQRTPYCSSSESQPLQPQKIKLAQKSEIPKCSNSPGPLGKSTVCSATSSQKASLLLEVTQSNVEIITKEKVMVANSFRNKLWNWEKVSSQKSEMSSALLLANYGSKAIHLEGQKGMGLTPEEPRKKLETKGAQTLPSQKHVVAPKILHNVSEDPSFVISQHIRKSWENPPPERSPASSPCQPIYECELASQAPEKQPDVRHHHLPKTKPLPSIDSLGPPPPKPSRPPIVNLQAFQRQPAAVPKTQGEVTVEEGSLSPERGLHSCCCRSHFTAQDTWAQKVCHLLSHDSNPDVP

SEQ ID NO: 918389 - protein, 110 aa, Homo sapiens
MELLSSLNMQRAMSYNNNAFSCVRADPLIFQITSLEGIYFEKWQSNGLTGACRSSSDSSKEQIWEMRQNVGELNFPGSSVKNGLGTKGLEVFAVIQKRQDDPVKTEKECD

SEQ ID NO: 918390 - protein, 110 aa, Homo sapiens; identical to SEQ ID NO: 918389

SEQ ID NO: 918391 - protein, 137 aa, Homo sapiens
MLAFDWPQRGACAVAGEGSGYAERRRCWSPTPGTRASFFHPGQLGPRDDLRNKDSDADSTVNWPYSRVNERPGENQTRMGQALTRGDPKTVICIRKRTSQPVPGSARSRGALFKPWVRSLVSKYEVFAEGLEDVKGD

SEQ ID NO: 918392 - protein, 137 aa, Homo sapiens; identical to SEQ ID NO: 918391

SEQ ID NO: 918393 - protein, 136 aa, Homo sapiens
MINWDLSWTTQGLEFPSLQDVILTSERRKCYIKIEGHVLRYLWKAETWDRMLETGEITFLQGVHSLKYQPWSTMSPGMFTKGQQKHQKGQSSTESGIPHSVWNTRMNPDGSRWLLGNVCLVQSGSHHNGSFANRSW

SEQ ID NO: 918394 - protein, 136 aa, Homo sapiens; identical to SEQ ID NO: 918393

SEQ ID NO: 918395 - protein, 144 aa, Homo sapiens
MCMPFSPINLPFFSSFSMNLQRMKGKAVLAHPCTRGYPHLPETHANSISQMNWISSRKPCAFFLTRPLVFKMVVPVISVPFFCWTLRAAAVLAPCTAICDHCRTISWRDSLDYMEGGDKDKVKNTQEPVPPPGTMQLQAASISC

SEQ ID NO: 918396 - protein, 321 aa, Homo sapiens
FCSAAVEMDGTNGSTQTHFILLGFSDRPHLERILFVVILIAYLLTLVGNTTIILVSRLDPHLHTPMYFFLAHLSFLDLSFTTSSIPQLLYNLNGCDKTISYMGCAIQLFLFLGLGGVECLLLAVMAYDRCVAICKPLHYMVIMNPRLCRGLVSVTWGCGVANSLAMSPVTLRLPRCGHHEVDHFLREMPALIRMACVSTVAIEGTVFVLKKGVVLSPLVFILLSYSYIVRAVLQIRSASGRQKAFGTCGSHLTVVSLFYGNIIYMYMQPGASSSQDQGMFLMLFYNIVTPLLNPLIYTLRNREVKGALGRLLLGKRELGKE

SEQ ID NO: 918397 - protein, 189 aa, Homo sapiens
CALGSPDALSGTLRSQLAQAMGWAAVETAAVLGGVVNAVLLGTRDGRPVAPGAGRGAAHGCRLDGKLRFTAKSTQRFRGEGAAPGRGAELRLSQVLLRATEGEAGWGVGRACVPAPPRLKFHAFDSSLAAAARSPHLLGAGEETRWRVFCGIPGGGGTSSFGGTSSCILWRTLTPHPTLEARNQLPLGT

SEQ ID NO: 918398 - protein, 136 aa, Homo sapiens
MGSYGLQRSPPSVSEVKAPRQAGGRWSGTRGYTAGQLRLSQVLLRATEGEAGWGVGRACVPAPPRLKFHAFDSSLAAAARSPHLLGAGEETRWRVFCGIPGGGGTSSFGGTSSCILWRTLTPHPTLEARNQLPLGT

SEQ ID NO: 918399 - protein, 112 aa, Homo sapiens
MQAKVPGDPGSHLTVPYRPPEGVLELQCCVFLASTLGVPPTPTVQGFQWTLRGTDVETSPFGAPRATSHGVGRMKSCQIPQKVIDNSKATLLKCLKYPSLSSSGGKGSGTAT

SEQ ID NO: 918400 - protein, 136 aa, Homo sapiens; identical to SEQ ID NO: 918398

SEQ ID NO: 918401 - protein, 136 aa, Homo sapiens; identical to SEQ ID NO: 918398

SEQ ID NO: 918402 - protein, 136 aa, Homo sapiens; identical to SEQ ID NO: 918398

SEQ ID NO: 918403 - protein, 136 aa, Homo sapiens; identical to SEQ ID NO: 918398

SEQ ID NO: 918404 - protein, 341 aa, Homo sapiens
MRETTFGVGEREGLCDWVKGLSAGTLFSGFSTTMDTGNKTLPQDFLLLGFPGSQTLQLSLFMLFLVMYILTVSGNVAILMLVSTSHQLHTPMYFFLSNLSFLEIWYTTAAVPKALAILLGRSQTISFTSCLLQMYFVFSLGCTEYFLLAAMAYDRCLAICYPLHYGAIMSSLLSAQLALGSWVCGFVAIAVPTALISGLSFCGPRAINHFFCDIAPWIALACTNTQAVELVAFVIAVVVILSSCLITFVSYVYIISTILRIPSASGRSKAFSTCSSHLTVVLIWYGSTVFLHVRTSIKDALDLIKAVHVLNTVVTPVLNPFIYTLRNKEVRETLLKKWKGK

SEQ ID NO: 918405 - protein, 145 aa, Homo sapiens
GCAFQLLLMTSFSAGEIFILTAMSYDRYVAICCPLNYEVIHVPIESLRSTAWKPLLPSMSTILRIPSASGRSKAFSTCSSHLTVVLIWYGSTVFLHVRTSIKDALDLIKAVHVLNTVVTPVLNPFIYTLRNKEVRETLLKKWKGK

SEQ ID NO: 918406 - protein, 253 aa, Homo sapiens
FPKMENSEEAASHFLKDFCATWLLSTESTKIIKLIPCPQHTHKPQLRSENEGMRRKWNWTESLAFESWLLHVLANDSTHLSLSFFSNAVGTITSTPQSCYEDSKDTLSCGLVPKLVSLGLSLVLVMGVATPYLLLQPFQREGSFSVSTLKHLLTDLKPPQKLHQGPFCCPAHWIPLLKKKGSRITQTHSWGGLLGVPGRCSCPKVGDSGTWALRHPTPSSHLVCSGRVLALSKLVTKTFLIHLTNLYTGPPLT

SEQ ID NO: 918407 - protein, 167 aa, Homo sapiens
MGLREEDRKKKEKKGEEETTGWPSSKITCFHCGAQALKGTQPNHTSSLASSALPWHRACLLILHLTSLSSAQLQACRLQTKALKRLHVSLTLTDSTCFWTQREPQGMPRPPSACFKALPSKITGNELAGPREPAGGMISRNHHPFQEPPFKGLRMALSSPANCSLIL

SEQ ID NO: 918408 - protein, 322 aa, Homo sapiens
CRNMKSDNHSFLGDSPKAFILLGVSDRPWLELPLFVVLLLSYVLAMLGNVAIILASRVDPQLHSPMYIFLSHLSFLDLCYTTTTVPQMLVNMGSSQKTISYGGCTEQYATFHWLGCTEGIVLAAMALDRYVAICKPLHYAVLMHRALCQQLVALAWLSGFGNSFVQVVLTVQLPFCGRQVLNNFFCEVPAVIKLSCADTAVNDTILAVLVAFFVLVPLALILLSYGFIARAVLRIQSSKGRHKAFGTCSSHLMIVSLFYLPAIYMYLQPPSSYSQEQGKFISLFYSIITPTLNPFTYTLRNKDMKGALRRLLARIWRLLYTR

SEQ ID NO: 918409 - protein, 181 aa, Homo sapiens
VPSQHLDMNILGTEANFTSKVSLDSVSTSLSPLLSRSTISEKHIFQLIVNEAYRAAWGREIIHNLSKYLFFLREEYESRDAAVGLIETLNGDTSNNSHNTPGTCLLQPLSQPNEMIHLGVTKMFHVLQSCCHMVPIKVLPKFPYISLPSMLLDVHSALVFNKSPVLKSEDMSWGGLEGAEH

SEQ ID NO: 918410 - protein, 256 aa, Homo sapiens
MEGSHITIWCNVSGSQGPPEQNFQWSIYLPSSPEREVQIVSTMDPSFPYAIYTQRVRGGKIFIERVQGNPTLLHITDLQARDAGEYECHTPSTDKQYFGSYSAKMNLVGKEKLSSRRQHSLQTTAMPQTLHRVEQDPLELTCEVASETVQHSHLSVAWLWQKVGEKPVEVISLSRDFMLHSGSEYAQRQSLGEVRLDKLGRTTFCLTIFHLQPSDQGEFYCEAAEWIQDPDGSWYAMTRKRSEGAVVNVQPTGQSL

SEQ ID NO: 918411 - protein, 78 aa, Homo sapiens
RRPGRVDCYNMDVMLSEINQFRKDKYTHFHLYGVSNVKLRRTKYCGICHKLVEEKMSCSMGIECQPRKMEKLLLQFLL

SEQ ID NO: 918412 - protein, 296 aa, Homo sapiens
MAEIHNGGELCDFMENGEIFSEHSCLNAHMGTENTGDTYDCDEYGENFPMLHNSAPAGETLSVLNQCRKAFSLPPNVHQRTWIGDKSFEYSDCEEAFVDQSHLQANRITHNGETLYEQKQCGRAFTYSTSHAVSVKMHTVEKPYECKECGKFFRYSSYLNSHMRTHTGEKPYECKECGKCFTVSSHLVEHVRIHTGEKPYQCKECGRAFAGRSGLTKHVRIHTGEKPYECNECGKAYNRFYLLTEHFKTHTEEKPFECKVCGKSFRSSSCLKNHFRIHTGIKPYKCKECGKAFKLT

SEQ ID NO: 918413 - protein, 296 aa, Homo sapiens; identical to SEQ ID NO: 918412

SEQ ID NO: 918414 - protein, 419 aa, Homo sapiens
MAGSGCAWGAEPPRFLEAFGRLWQVQSRLGSGSSASVYRVRCCGNPGSPPGALKQFLPPGTTGAAASAAEYGFRKERAALEQLQGHRNIVTLYGVFTIHFSPNVPSRCLLLELLDVSVSELLLYSSHQGCSMWMIQHCARDVLEALAFLHHEGYVHADLKPRNILWSAENECFKLIDFGLSFKEGNQDVKYIQTDGYRAPEAELQNCLAQAGLQSDTECTSAVDLWSLGIILLEMFSGMKLKHTVRSQEWKANSSAIIDHIFASKAVVNAAIPAYHLRDLIKSMLHDDPSRRIPAEMALCSPFFSIPFAPHIEDLVMLPTPVLRLLNVLDDDYLENEEEYEDVVEDVKEECQKYGPVVSLLVPKENPGRGQVFVEYANAGDSKAAQKLLTGRMFDGKFVVATFYPLSAYKRGYLYQTLL

SEQ ID NO: 918415 - protein, 345 aa, Homo sapiens
MFLTRPKVCVDLNRRVTLYGVFTIHFSPNVPSRCLLLELLDVSVSELLLYSSHQGCSMWMIQHCARDVLEALAFLHHEGYVHADLKPRNILWSAENECFKLIDFGLSFKEGNQDVKYIQTDGYRAPEAELQNCLAQAGLQSDTECTSAVDLWSLGIILLEMFSGMKLKHTVRSQEWKANSSAIIDHIFASKAVVNAAIPAYHLRDLIKSMLHDDPSRRIPAEMALCSPFFSIPFAPHIEDLVMLPTPVLRLLNVLDDDYLENEEEYEDVVEDVKEECQKYGPVVSLLVPKENPGRGQVFVEYANAGDSKAAQKLLTGRMFDGKFVVATFYPLSAYKRGYLYQTLL

SEQ ID NO: 918416 - protein, 143 aa, Homo sapiens
PLWACTHSPTSADEMNQVPWCCIISDLSFIPSGSHASKVCQLGVKLERERELQKKLTLKRGFLVLTTCVSAVLGSQHIGLHGSGGLCTLVLSFIAGTKWSQEKMKVRKIITNVWDIFQPLLFGLVGAEVSVSLLESNIVGKNN

SEQ ID NO: 918417 - protein, 106 aa, Homo sapiens
KKKTPPQEKGIKKNNPKKLTLKRGFLVLTTCVSAVLGSQHIGLHGSGGLCTLVLSFIAGTKWSQEKMKVRKIITNVWDIFQPLLFGLVGAEVSVSLLESNIVGKNN

SEQ ID NO: 918418 - protein, 1942 aa, Homo sapiens
FALLVNKVHIYCQKMSTLLENIFAIINLFKQYSKKDKNTDTLSKKELKELLEKEFRQILKNPDDPDMVDVFMDHLDIDHNKKIDFTEFLLMVFKLAQAYYESTRKENLPISGHKHRKHSHHDKHEDNKQEENKENRKRPSSLERRNNRKGNKGRSKSPRETGGKRHESSSEKKERKGYSPTHREEEYGKNHHNSSKKEKNKTENTRLGDNRKRLSERLEEKEDNEEGVYDYENTGRMTQKWIQSGHIATYYTIQDEAYDTTDSLLEENKIYERSRSSDGKSSSQVNRSRHENTSQVPLQESRTRKRRGSRVSQDRDSEGHSEDSERHSGSASRNHHGSAWEQSRDGSRHPRSHDEDRASHGHSADSSRQSGTRHAETSSRGQTASSHEQARSSPGERHGSGHQQSADSSRHSATGRGQASSAVSDRGHRGSSGSQASDSEGHSENSDTQSVSGHGKAGLRQQSHQESTRGRSGERSGRSGSSLYQVSTHEQPDSAHGRTGTSTGGRQGSHHEQARDSSRHSASQEGQDTIRGHPGSSRGGRQGSHHEQSVNRSGHSGSHHSHTTSQGRSDASHGQSGSRSASRQTRNEEQSGDGTRHSGSRHHEASSQADSSRHSQVGQGQSSGPRTSRNQGSSVSQDSDSQGHSEDSERWSGSASRNHHGSAQEQSRDGSRHPRSHHEDRAGHGHSADSSRKSGTRHTQNSSSGQAASSHEQARSSAGERHGSRHQLQSADSSRHSGTGHGQASSAVRDSGHRGSSGSQATDSEGHSEDSDTQSVSGHGQAGHHQQSHQESARDRSGERSRRSGSFLYQDTIRGHPGSSRRGRQGSHHEQSVDRSGHSGSHHSHTTSQGRSDASRGQSGSRSASRTTRNEEQSRDGSRHSGSRHHEASSHADISRHSQAGQGQSEGSRTSRRQGSSVSQDSDSEGHSEDSERWSGSASRNHRGSAQEQSRHGSRHPRSHHEDRAGHGHSADSSRQSGTPHAETSSGGQAASSHEQARSSPGERHGSRHQQSADSSRHSGIPRRQASSAVRDSGHWGSSGSQASDSEGHSEESDTQSVSGHGQDGPHQQSHQESARDWSGGRSGRSGSFIYQVSTHEQSESAHGRTRTSTGRRQGSHHEQARDSSRHSASQEGQDTIRAHPGSRRGGRQGSHHEQSVDRSGHSGSHHSHTTSQGRSDASHGQSGSRSASRQTRKDKQSGDGSRHSGSRHHEAASWADSSRHSQVGQEQSSGSRTSRHQGSSVSQDSDSERHSDDSERLSGSASRNHHGSSREQSRDGSRHPGFHQEDRASHGHSADSSRQSGTHHTESSSHGQAVSSHEQARSSPGERHGSRHQQSADSSRHSGIGHRQASSAVRDSGHRGSSGSQVTNSEGHSEDSDTQSVSAHGQAGPHQQSHKESARGQSGESSGRSRSFLYQVSSHEQSESTHGQTAPSTGGRQGSRHEQARNSSRHSASQDGQDTIRGHPGSSRGGRQGSYHEQSVDRSGHSGYHHSHTTPQGRSDASHGQSGPRSASRQTRNEEQSGDGSRHSGSRHHEPSTRAGSSRHSQVGQGESAGSKTSRRQGSSVSQDRDSEGHSEDSERRSESASRNHYGSAREQSRHGSRNPRSHQEDRASHGHSAESSRQSGTRHAETSSGGQAASSQEQARSSPGERHGSRHQQSADSSTDSGTGRRQDSSVVGDSGNRGSSGSQASDSEGHSEESDTQSVSAHGQAGPHQQSHQESTRGQSGERSGRSGSFLYQVSTHEQSESAHGRTGPSTGGRQRSRHEQARDSSRHSASQEGQDTIRGHPGSSRGGRQGSHYEQSVDSSGHSGSHHSHTTSQERSDVSRGQSGSRSVSRQTRNEKQSGDGSRHSGSRHHEASSRADSSRHSQVGQGQSSGPRTSRNQGSSVSQDSDSQGHSEDSERWSGSASRNHLGSAWEQSRDGSRHPGSHHEDRAGCVIP

SEQ ID NO: 918419 - protein, 1852 aa, Homo sapiens
GRLLLLNSRPRRPRKENLPISGHKHRKHSHHDKHEDNKQEENKENRKRPSSLERRNNRKGNKGRSKSPRETGGKRHESSSEKKERKGYSPTHREEEYGKNHHNSSKKEKNKTENTRLGDNRKRLSERLEEKEDNEEGVYDYENTGRMTQKWIQSGHIATYYTIQDEAYDTTDSLLEENKIYERSRSSDGKSSSQVNRSRHENTSQVPLQESRTRKRRGSRVSQDRDSEGHSEDSERHSGSASRNHHGSAWEQSRDGSRHPRSHDEDRASHGHSADSSRQSGTRHAETSSRGQTASSHEQARSSPGERHGSGHQQSADSSRHSATGRGQASSAVSDRGHRGSSGSQASDSEGHSENSDTQSVSGHGKAGLRQQSHQESTRGRSGERSGRSGSSLYQVSTHEQPDSAHGRTGTSTGGRQGSHHEQARDSSRHSASQEGQDTIRGHPGSSRGGRQGSHHEQSVNRSGHSGSHHSHTTSQGRSDASHGQSGSRSASRQTRNEEQSGDGTRHSGSRHHEASSQADSSRHSQVGQGQSSGPRTSRNQGSSVSQDSDSQGHSEDSERWSGSASRNHHGSAQEQSRDGSRHPRSHHEDRAGHGHSADSSRKSGTRHTQNSSSGQAASSHEQARSSAGERHGSRHQLQSADSSRHSGTGHGQASSAVRDSGHRGSSGSQATDSEGHSEDSDTQSVSGHGQAGHHQQSHQESARDRSGERSRRSGSFLYQDTIRGHPGSSRRGRQGSHHEQSVDRSGHSGSHHSHTTSQGRSDASRGQSGSRSASRTTRNEEQSRDGSRHSGSRHHEASSHADISRHSQAGQGQSEGSRTSRRQGSSVSQDSDSEGHSEDSERWSGSASRNHRGSAQEQSRHGSRHPRSHHEDRAGHGHSADSSRQSGTPHAETSSGGQAASSHEQARSSPGERHGSRHQQSADSSRHSGIPRRQASSAVRDSGHWGSSGSQASDSEGHSEESDTQSVSGHGQDGPHQQSHQESARDWSGGRSGRSGSFIYQVSTHEQSESAHGRTRTSTGRRQGSHHEQARDSSRHSASQEGQDTIRAHPGSRRGGRQGSHHEQSVDRSGHSGSHHSHTTSQGRSDASHGQSGSRSASRQTRKDKQSGDGSRHSGSRHHEAASWADSSRHSQVGQEQSSGSRTSRHQGSSVSQDSDSERHSDDSERLSGSASRNHHGSSREQSRDGSRHPGFHQEDRASHGHSADSSRQSGTHHTESSSHGQAVSSHEQARSSPGERHGSRHQQSADSSRHSGIGHRQASSAVRDSGHRGSSGSQVTNSEGHSEDSDTQSVSAHGQAGPHQQSHKESARGQSGESSGRSRSFLYQVSSHEQSESTHGQTAPSTGGRQGSRHEQARNSSRHSASQDGQDTIRGHPGSSRGGRQGSYHEQSVDRSGHSGYHHSHTTPQGRSDASHGQSGPRSASRQTRNEEQSGDGSRHSGSRHHEPSTRAGSSRHSQVGQGESAGSKTSRRQGSSVSQDRDSEGHSEDSERRSESASRNHYGSAREQSRHGSRNPRSHQEDRASHGHSAESSRQSGTRHAETSSGGQAASSQEQARSSPGERHGSRHQQSADSSTDSGTGRRQDSSVVGDSGNRGSSGSQASDSEGHSEESDTQSVSAHGQAGPHQQSHQESTRGQSGERSGRSGSFLYQVSTHEQSESAHGRTGPSTGGRQRSRHEQARDSSRHSASQEGQDTIRGHPGSSRGGRQGSHYEQSVDSSGHSGSHHSHTTSQERSDVSRGQSGSRSVSRQTRNEKQSGDGSRHSGSRHHEASSRADSSRHSQVGQGQSSGPRTSRNQGSSVSQDSDSQGHSEDSERWSGSASRNHLGSAWEQSRDGSRHPGSHHEDRAGCVIP

SEQ ID NO: 918420 - protein, 117 aa, Homo sapiens
GLEEDCFSGFSSNKVCPAGLGAVPWSFSPIIFSLDTPLVIMATLGASPGLSWSTGHLFSAEDSVESRSVTQAGVQWCHLGSLQPLPPTRHHAWVIFVFLVETEFHHVGEDGLNLLTS

SEQ ID NO: 918421 - protein, 243 aa, Homo sapiens
WFRRRLFFWIQLQQSLSCRSWCCAMVLLANNIQPGYPAGHNGYTRSQPRALLEHRTPVQCRGLSGVSLCHPGWSAVVPSWLTATSASHTPPCLGNFCIFSRDRVSPCWRGWSQSPDFMIYLPRPPKSAAIIGMSHSAQPRLQAFRIASLSLSLSLSLSFSVWASFLLLQIRKMTTWKPKAHHIPAEPPPLKETQLLPQASTHPSRPELHLTLVRHASTPRWTTEAREFSIMMGTSGVMGLPCS

SEQ ID NO: 918422 - protein, 202 aa, Homo sapiens
TSYLAPPITALFLLAIFCKRVTEPGAFWGLVFGLGVGLLRMILEFSYPAPACGEVDRRPAVLKDFHYLYFAILLCGLTAILTRLTWWTRNCPLSELEKEAHESTPEISERPAGECPAGGGAAENSSLGQEQPEAPSRSWGKLLWSWFCGLSGTPEQALSPAEKAALEQKLTSIEEEPLWRHVCNINAVLLLAINIFLWGYFA

SEQ ID NO: 918423 - protein, 202 aa, Homo sapiens; identical to SEQ ID NO: 918422

SEQ ID NO: 918424 - protein, 202 aa, Homo sapiens; identical to SEQ ID NO: 918422

SEQ ID NO: 918425 - protein, 373 aa, Homo sapiens
MYTYVTKLHVVHVSEKFVITDFLKPTSVSSSKSFSILLCSIAGEELRSFGGEGMNLQESEEEEVPQESWDEGYSTLSIPPERLASYQSYSSTFHSLEEQQVCMAVDIGRHRWDQVKKEDQEATGPRLSRELLDEKEPEVLQDSLDRCYSTPSVYLGLTDSCQPYRSAFYVLEQQRIGLAVDMDEIEKYQEVEEDQDPSCPRLSRELLAEKEPEVLQDSLDRCYSTPSGYLELPDLGQPYRSAVYSLEEQYLGLALDVDRIKKDQEEEEDQGPPCPRLSRELLEVVEPEVLQDSLDVIQLLPVVLNSLTPASPTEVPFMHWRKNMLAFLLTWEKLKRRGRGRKEGEEDQRRKEEGEEKKGKKIKTHHAPGSAAC

SEQ ID NO: 918426 - protein, 598 aa, Homo sapiens
MEEERKTAELQKNRIQDSVVFEDVAVDFTQEEWALLDLAQRNLYRDVMLENFQNLASLGYPLHTPHLISQWEQEEDLQTVKRELIQGIFMGEHREGKNPWEKLFWLGEKINLKNHMVENIYECYEENQDGQTFSQVPNLDSLKRNTEVKSCECHECGKAFVDHSSLKSHIRSHTGSKPYQCKECGKAFHFLACFKKHMKTPTEEKPYECKECTKAFSCSSFFRAHMKIHIGKTNYECKECGKGFSCSSSLTEHKRIHSGDKPYECKECGKAFSCSSSLSKHKRIHSGDKPYECKECGKAFSSSSHLIIHIRIHTGEKPYECKECGKAFSESSKLTVHGRTHTGEKPYKCKECGKAYNCPSSLSIHMRKHTGEKPYECLECGKAFYLPTSLNTHVKNQSREKPYECKECGKAFSCPSSFRAHVRDHTGKIQYECKECGKTFSRSSSLTEHLRTHSGEKPYECKECGKAFISSSHLTVHIRTHTGEKPYECKKCGKAFIYPSALRIHMRTHTGEKPYECKECGKAFRHSSYLTVHARMHTGEKPFECLECGKAFSCPSSFRRHVRSHTGEKPYECKECGKAFVCPAYFRRHVKTHTRENI

SEQ ID NO: 918427 - protein, 667 aa, Homo sapiens
KKLDAMTLIKEVTWASVIADMSIFGHCPAHDDFYLVVCNHCSQVVKPQAFQKHCAPASSQKCHVVNGQGPACRAPGSTKTSSREKGQGSRSRGHQPPEKTQKDNLCQPGGLTKDSPGKPPMAPPSKEPPGRENIEIIPSEGSSHWAEGSPPEKEPSGTRLPPKTHRKMARKECDLNRQCGVINPETKKICTRLLTCKIHSVHQRREVQGRAKDFDVLVAELKANSRKGESPKEKSPGRKEQVLERPSQELPSSVQVVAAVAAPSSTFSVRAKQTYPYCALPRSRASSESELDDEGPCGGDGDPGLFPFPMPRGGTQASSEESEEEGTSDDLHPPPDCHYATRPPRPQAFCTFGSRLVSPGCYVFSRRLDRFCSALSSMLERHLSTHMWKKIPPAAEPPAHLVNSPLSAPLSPSSTGTCPRLPGPTLRPACSASMPPTKDNLVPSYPAGSPSVAAACSQAECMGGSQAITSPLPANTPSPSFSKLPPSKASKSSKGKDGVEVEAPSRKRKLSPGPTTLKRTCILEPTGKGKPSGCRGLSAKTKTALSMGLNGTMGPRVKRAGPLDCRGSPHQLPTPVKASQLENRGAAGHPAKALPTNCLSEEEVAKKRKNLATYCRPVKAKHCQAGAPADVACSVRRKKPGPALAFEEKCSTLKVLELPLFPEGKGV

SEQ ID NO: 918428 - protein, 658 aa, Homo sapiens
KKLDAMTLIKEVTWASVIADMSIFGHCPAHDDFYLVVCNHCSQVVKPQAFQKHCAPASSQKCHVVNGQGPACRAPGSTKTSSREKGQGSRSRGHQPPEKTQKDNLCQPGGLTKDSPGKPPMAPPSKEPPGRENIEIIPSEGSSHWAEGSPPEKEPSGTRLPPKTHRKMARKECDLNRQCGVINPETKKICTRLLTCKIHSVHQRREVQGRAKDFDVLVAELKANSRKGESPKEKSPGRKEQVLERPSQELPSSVQVVAAVAAPSSTFSVRAKQTYPYCALPRSRASSESELDDEGPCGGDGDPGLFPFPMPRGGTQASSEESEEEGTSDDLHPPPDCHYATRPPRPQAFCTFGSRLVSPGCYVFSRRLDRFCSALSSMLERHLSTHMWKKIPPAAEPPAHLVNSPLSAPLSPSSTGTCPRLPGPTLRPACSASMPPTKDNLVPSYPAGSPSVAAACSQAECMGGSQAITSPLPANTPSPSFSKLPPSKASKSSKGKDGVEVEAPSRKRKLSPGPTTLKRTCILEPTGKGKPSGCRGLSAKTKTALSMGLNGTMGPRVKRAGPLDCRGSPHQLPTPVKASQLENRGAAGHPAKALPTNCLSEEEVAKKRKNLATYCRPVKAKHCQAGAPADVACSVRRKKPGPALAFEEKCSTLKSKAH

SEQ ID NO: 918429 - protein, 72 aa, Homo sapiens; identical to SEQ ID NO: 753331

SEQ ID NO: 918430 - protein, 144 aa, Homo sapiens
LHLMPQAQGHTPQLRPCSHRGAGTWEHGEQHGQASPPWKPSTSSILCPSSAPPSIWRGWVVSGGVSEHEGPCTPGSASPRGTRPSSPQPGGYYCIQSVPLHLTNTPSYNQYSSIQSIFLHQHLSIQPIVLHLINAPPSNQYSAI

SEQ ID NO: 918431 - protein, 294 aa, Homo sapiens
QGSQGLSGQVAPRYRPSTCSTQDTASMNWAFLQGLLSGVNKYSTVLSRIWLSVVFIFRVLVYVVAAEEVWDDEQKDFVCNTKQPGCPNVCYDEFFPVSHVRLWALQLILVTCPSLLVVMHVAYREERERKHHLKHGPNAPSLYDNLSKKRGGLWWTYLLSLIFKAAVDAGFLYIFHRLYKDYDMPRVVACSVEPCPHTVDCYISRPTEKKVFTYFMVTTAAICILLNLSEVFYLVGKRCMEIFGPRHRRPRCRECLPDTCPPYVLSQGGHPEDGNSVLMKAGSAPVDAAQVPDR

SEQ ID NO: 918432 - protein, 324 aa, Homo sapiens
MSSPLASLSKTRKVPLPSEPMNPGRRGIRIYGDEDEVDMLSDGCGSEEKISVPSCYGGIGAPVSRQVPASHDSELMAFMTRKLWDLEQQVKAQTDEILSKDQKIAALEDLVQTLRPHPAEATLQRQEELETMCVQLQRQVREMERFLSDYGLQWVGEPMDQEDSESKTVSEHGERDWMTAKKFWKPGDSLAPPEVDFDRLLASLQDLSELVVEGDTQVTPVPGGARLRTLEPIPLKLYRNGIMMFDGPFQPFYDPSTQRCLRDILDGFFPSELQRLYPNGVPFKVISCSSNHTFGDFEGSGDTQPPQTPPILRGSRCTPWGTPV

SEQ ID NO: 918433 - protein, 324 aa, Homo sapiens; identical to SEQ ID NO: 918432

SEQ ID NO: 918434 - protein, 286 aa, Homo sapiens [sequence omitted]

SEQ ID NO: 918435 - protein, 249 aa, Homo sapiens
MAFMTRKLWDLEQQVKAQTDEILSKDQKIAALEDLVQTLRPHPAEATLQRQEELETMCVQLQRQVREMERFLSDYGLQWVGEPMDQEDSESKTVSEHGERDWMTAKKFWKPGDSLAPPEVDFDRLLASLQDLSELVVEGDTQVTPVPGGARLRTLEPIPLKLYRNGIMMFDGPFQPFYDPSTQRCLRDILDGFFPSELQRLYPNGVPFKVISCSSNHTFGDFEGSGDTQPPQTPPILRGSRCTPWGTPV

SEQ ID NO: 918436 - protein, 249 aa, Homo sapiens; identical to SEQ ID NO: 918435

SEQ ID NO: 918437 - protein, 437 aa, Homo sapiens
MAFMTRKLWDLEQQVKAQTDEILSKDQKIAALEDLVQTLRPHPAEATLQRQEELETMCVQLQRQVREMERFLSDYGLQWVGEPMDQEDSESKTVSEHGERDWMTAKKFWKPGDSLAPPEVDFDRLLASLQDLSELVVEGDTQVTPVPGGARLRTLEPIPLKLYRNGIMMFDGPFQPFYDPSTQRCLRDILDGFFPSELQRLYPNGVPFKVSDLRNQVYLEDGLDPFPGEGRVVGRQRMHKALDRVEEHPGSRMTAEKFLNRLPKFVIRQGEVIDIRGPIRDTLQNCCPLPARIQEIVVETPTLAAERERSQESPNTPAPPLSMLRIKSENGEQAFLLMMQPDNTIGDVRALLAQARVMDASAFEIFSTFPPTLYQDDTLTLQAAGLVPKAALLLRARRAPKSSLKFSPGPCPGPGPGPSPGPGPGSSPCPGPSPSPQ

SEQ ID NO: 918438 - protein, 324 aa, Homo sapiens; identical to SEQ ID NO: 918432

SEQ ID NO: 918439 - protein, 570 aa, Homo sapiens
MSSPLASLSKTRKVPLPSEPMNPGRRGIRIYGDEDEVDMLSDGCGSEEKISVPSCYGGIGAPVSRQVPASHDSELMAFMTRKLWDLEQQVKAQTDEILSKDQKIAALEDLVQTLRPHPAEATLQRQEELETMCVQLQRQVREMERFLSDYGLQWVGEPMDQEDSESKTVSEHGERDWMTAKKFWKPGDSLAPPEVDFDRLLASLQDLSELVVEGDTQVTPVPGGARLRTLEPIPLKLYRNGIMMFDGPFQPFYDPSTQRCLRDILDGFFPSELQRLYPNGVPFKVSDLRNQVYLEDGLDPFPGEGRVVGRQRMHKALDRVEEHPGSRMTAEKFLNRLPKFVIRQGEVIDIRGPIRDTLQNCCPLPARIQEIVVETPTLAAERERSQESPNTPAPPLSMLRIKSENGEQAFLLMMQPDNTIGDVRALLAQARVMDASAFEIFSTFPPTLYQDDTLTLQAAGLVPKAALLLRARRAPKSSLKFSPGPCPGPGPGPSPGPGPGSSPCPGPSPSPVPVPVPAPSLSWTQSQPPIKHPPPQPAAPPGSWVGHLARHVGKAWDQLGQGGGGADPPL

SEQ ID NO: 918440 - protein, 200 aa, Homo sapiens
MHKALDRVEEHPGSRMTAEKFLNRLPKFVIRQGEVIDIRGPIRDTLQNCCPLPARIQEIVVETPTLAAERERSQESPNTPAPPLSMLRIKSENGEQAFLLMMQPDNTIGDVRALLAQARVMDASAFEIFSTFPPTLYQDDTLTLQAAGLVPKAALLLRARRAPKSSLKFSPGPCPGPGPGPSPGPGPGSSPCPGPSPSPQ

SEQ ID NO: 918441 - protein, 354 aa, Homo sapiens
MDQEDSESKTVSEHGERDWMTAKKFWKPGDSLAPPEVDFDRLLASLQDLSELVVEGDTQVTPVPGGARLRTLEPIPLKLYRNGIMMFDGPFQPFYDPSTQRCLRDILDGFFPSELQRLYPNGVPFKVSDLRNQVYLEDGLDPFPGEGRVVGRQRMHKALDRVEEHPGSRMTAEKFLNRLPKFVIRQGEVIDIRGPIRDTLQNCCPLPARIQEIVVETPTLAAERERSQESPNTPAPPLSMLRIKSENGEQAFLLMMQPDNTIGDVRALLAQARVMDASAFEIFSTFPPTLYQDDTLTLQAAGLVPKAALLLRARRAPKSSLKFSPGPCPGPGPGPSPGPGPGSSPCPGPSPSPQ

SEQ ID NO: 918442 - protein, 187 aa, Homo sapiens
MSSPLASLSKTRKVPLPSEPMNPGRRGIRIYGDVPASHDSELMAFMTRKLWDLEQQVKAQTDEILSKDQKIAALEDLVQTLRPHPAEATLQRQEELETMCVQLQRQVREMERFLSDYGLQWVGEPMDQEDSESKTVSEHGERDWMTAKKFWKPGDSLAPPEVDFDRLQALCPKQHCCCGHAEPRSPA

SEQ ID NO: 918443 - protein, 286 aa, Homo sapiens [sequence omitted]

SEQ ID NO: 918444 - protein, 291 aa, Homo sapiens
MSSPLASLSKTRKVPLPSEPMNPGRRGIRIYGDVPASHDSELMAFMTRKLWDLEQQVKAQTDEILSKDQKIAALEDLVQTLRPHPAEATLQRQEELETMCVQLQRQVREMERFLSDYGLQWVGEPMDQEDSESKTVSEHGERDWMTAKKFWKPGDSLAPPEVDFDRLLASLQDLSELVVEGDTQVTPVPGGARLRTLEPIPLKLYRNGIMMFDGPFQPFYDPSTQRCLRDILDGFFPSELQRLYPNGVPFKVISCSSNHTFGDFEGSGDTQPPQTPPILRGSRCTPWGTPV

SEQ ID NO: 918445 - protein, 512 aa, Homo sapiens
MSSPLASLSKTRKVPLPSEPMNPGRRGIRIYGDEDEVDMLSDGCGSEEKISVPSCYGGIGAPVSRQVPASHDSELMAFMTRKLWDLEQQVKAQTDEILSKDQKIAALEDLVQTLRPHPAEATLQRQEELETMCVQLQRQVREMERFLSDYGLQWVGEPMDQEDSESKTVSEHGERDWMTAKKFWKPGDSLAPPEVDFDRLLASLQDLSELVVEGDTQVTPVPGGARLRTLEPIPLKLYRNGIMMFDGPFQPFYDPSTQRCLRDILDGFFPSELQRLYPNGVPFKVSDLRNQVYLEDGLDPFPGEGRVVGRQRMHKALDRVEEHPGSRMTAEKFLNRLPKFVIRQGEVIDIRGPIRDTLQNCCPLPARIQEIVVETPTLAAERERSQESPNTPAPPLSMLRIKSENGEQAFLLMMQPDNTIGDVRALLAQARVMDASAFEIFSTFPPTLYQDDTLTLQAAGLVPKAALLLRARRAPKSSLKFSPGPCPGPGPGPSPGPGPGSSPCPGPSPSPQ

SEQ ID NO: 918446 - protein, 291 aa, Homo sapiens; identical to SEQ ID NO: 918444

SEQ ID NO: 918447 - protein, 505 aa, Homo sapiens
MSSPLASLSKTRKVPLPSEPMNPGRRGIRIYGDEDEVDMLSDGCGSEEKISVPSCYGGIGAPVSRQVPASHDSELMAFMTRKLWDLEQQVKAQTDEILSKDQKIAALEDLVQTLRPHPAEATLQRQEELETMCVQLQRQVREMERFLSDYGLQWVGEPMDQEDSESKTVSEHGERDWMTAKKFWKPGDSLAPPEVDFDRLLASLQDLSELVVEGDTQVTPVPGGARLRTLEPIPLKLYRNGIMMFDGPFQPFYDPSTQRCLRDILDGFFPSELQRLYPNGVPFKVYLEDGLDPFPGEGRVVGRQRMHKALDRVEEHPGSRMTAEKFLNRLPKFVIRQGEVIDIRGPIRDTLQNCCPLPARIQEIVVETPTLAAERERSQESPNTPAPPLSMLRIKSENGEQAFLLMMQPDNTIGDVRALLAQARVMDASAFEIFSTFPPTLYQDDTLTLQAAGLVPKAALLLRARRAPKSSLKFSPGPCPGPGPGPSPGPGPGSSPCPGPSPSPQ

SEQ ID NO: 918448 - protein, 200 aa, Homo sapiens; identical to SEQ ID NO: 918440

SEQ ID NO: 918449 - protein, 320 aa, Homo sapiens
MMFDGPFQPFYDPSTQRCLRDILDGFFPSELQRLYPNGVPFKVSDLRNQVYLEDGLDPFPGEGRVVGRQRMHKALDRVEEHPGSRMTAEKFLNRLPKFVIRQGEVIDIRGPIRDTLQNCCPLPARIQEIVVETPTLAAERERSQESPNTPAPPLSMLRIKSENGEQAFLLMMQPDNTIGDVRALLAQARVMDASAFEIFSTFPPTLYQDDTLTLQAAGLVPKAALLLRARRAPKSSLKFSPGPCPGPGPGPSPGPGPGSSPCPGPSPSPSLSWTQSQPPIKHPPPQPAAPPGSWVGHLARHVGKAWDQLGQGGGGADPPL

SEQ ID NO: 918450 - protein, 270 aa, Homo sapiens [sequence omitted]

SEQ ID NO: 918451 - protein, 84 aa, Homo sapiens
PCSSSNFISIPGTPILLPPPHNSASALGLGSKDFVCLEVPASHDSELMAFMTRKLWDLEQQVKAQTDEILSKVGLQVGEGQGLV

SEQ ID NO: 918452 - protein, 188 aa, Homo sapiens
YFKKIENMFRWVALFCVTRLTEENPTLTPKAFESSSGKGRVCFSLCPTSPQAACATFRSHLLGVGVKRGAPVSQPLLELNDVHHAVPIAIQHEALHPEQHGWVQRLRGPLGHPASTAALAAASSTPGCARQGVPAVRQLLQLSSGAAAVRSPRGPSHPRLRALGRHGKAAPPCGTSGRGATRQLRRQM

SEQ ID NO: 918453 - protein, 343 aa, Homo sapiens
MFSLPSLPSWLPGLPSLEWGSSLLDSLLQGLIGALGVLVLNSLLKVYFFVGCANDPQRRPEKERLRAQWASLETVHLAGLALFLTVVGSRVAALVVLEFSLRAVSTLLSLGKGSQGAAERLQLYLLCQYSLGCGLTCGLSFLQEGAPHRTLNLLLSLGLATLLGLGARRLHRHVCRLYELHSSQRYCGVCLGLLAHAHGLPQLLGRALAIAFAVGDLAAVALINQDFLTTSEAMRFWTPLTICYTLLVIYMQEEQRQHPGLQSQVQTVLVRMGGLFVLLLTVGRWLDLLGILVSLLGELWCLVGVRTLLDLCQIQDFPSQRPPVSTPSQPLPSAPQSQSSAPS

SEQ ID NO: 918454 - protein, 446 aa, Homo sapiens
MRLLAKIICLMLWAICVAEDCNELPPRRNTEILTGSWSDQTYPEGTQAIYKCRPGYRSLGNIIMVCRKGEWVALNPLRKCQKRPCGHPGDTPFGTFTLTGGNVFEYGVKAVYTCNEGYQLLGEINYRECDTDGWTNDIPICEVVKCLPVTAPENGKIVSSAMEPDREYHFGQAVRFVCNSGYKIEGDEEMHCSDDGFWSKEKPKCVEISCKSPDVINGSPISQKIIYKENERFQYKCDMGYEYSERGDAVCTESGWRPLPSCEEKSCDNPYIPNGDYSPLRIKHRTGDEITYQCRNGFYPATRGNTAKCTSTGWIPAPRCTYIKHGGLYHENMRRPYFPVAVGKYYSYYCDEHFETPSGSYWDHIHCTQDGWSPAVPCLRKCYFPYLENGYNQNHGRKFVQGKSIDVACHPGYALPKAQTTVTCMENGWSPTPRCIRVSKYTTLKS

SEQ ID NO: 918455 - protein, 148 aa, Homo sapiens
MAWKNQPQCPQYFLVAPSLESFTAPETDSSWLQFSSRSKPHNLPATCASIKAALLPVYSEQYVPPSLKPSSASRKYLCSSLLLLNPLLQAYGQGVSGLCSQQVHGPPLCLWHPETLTPVVSMSCGSIEIERTFIASFHPRNLSQFMQK

SEQ ID NO: 918456 - protein, 117 aa, Homo sapiens
MLAITVITARPVNERVLPYPYSILNTICCTSKYLDKAIVVVVTENAGVAKRKIMQRLADSVHSDSPKVSTADISSNKDDEENSVLDMVVLFSSSDKFTLNQVCLVQTLWSNICRSKM

SEQ ID NO: 918457 - protein, 765 aa, Homo sapiens
LPFFSPVPGPTSSATNVSMVVSAGPLSSEKAEMNILEINEKLHPQLAEKKQQFRNLKEKCFLTQLAGFLANQQNKYKYEECKDLIKSMLRNERQFKEEKLAEQLKQAEELRQYKVLVHTQERELTQLREKLREGRDASRSLNEHLQALLTPDEPDKSQGQDLQEQLAEGCRLAQHLVQKLSPENDNDDDEDVQVEVAEKVQKSSAPREMQKAEEKEVPEDSLEECAITYSNSHGPYDSNQPHRKTKITFEEDKVDSALIGSSSHVEWEDAVHIIPENESDDEEEEEKGPVSPSSEKFVITDFLKPTSVSSSKSFSILLCSIAGEELRSFGGEGMNLQESEEEEVPQESWDEGYSTLSIPPEMLASYKSYSSTFHSLEEQQVCMAVDIGSEYSIVKVIKLQFMAQSHAMPVPTWTDCHDIELKAGHRWDQVKKEDQEATGHRLSRELLDEKGPEVLQDSLDRCYSTPSGCLELTDSCQPYRSAFYILEQQRVGLAVDMDEIEKYQEVEEDQDPSCPRLSRELLDEKEPEVLQDSLDRCYSTPSGYLELPDLGQPYSSAVYSLEEQYLGLVLDVDRIKKDQEEEEDQGPPCPRLSRELLEVVEPEVLQDSLDRCYSTPSSCLEQPDSCQPYGSSFYALEEKHVGFSLDVGEIEKKGKGKIRRGRRSKKKRRRGRKEGEEDQNPPCPRLNGVLMEVEEPEVLQDSLDRCYSTPSMYCELRDSFQHYRSVFYSFEEQHISFALDMDNRFFTLTVTSLYLVFQMGVIFPQ

SEQ ID NO: 918458 - protein, 165 aa, Homo sapiens
MIQALAGFFTYFVILAENGFRPVDLLGIRLHWEDKYLNDLEDSYGQQWTYEQRKVVEFTCQTAFFVTIVVVQWADLIISKTRRNSLFQQGMRNKVLIFGILEETLLAAFLSYTPGMDVALRMYPLKITWWLCAIPYSILIFVYDEIRKLLIRQHPDGWVERETYY

SEQ ID NO: 918459 - protein, 502 aa, Homo sapiens
MMEIANVSSPEVFVLLGFSTRPSLETVLFIVVLSFYMVSILGNGIIILVSHTDVHLHTPMYFFLANLPFLDMSFTTSIVPQLLANLWGPQKTISYGGCVVQFYISHWLGATECVLLATMSYDRYAAICRPLHYTVIMHPQLCLGLALASWLGGLTTSMVGSTLTMLLPLCGNNCIDHFFCEMPLIMQLACVDTSLNEMEMYLASFVFVVLPLGLILVSYGHIARAVLKIRSAEGRRKAFNTCSSHVAVVSLFYGSIIFMYLQPAKSTSHEQGKFIALFYTVVTPALNPLIYTLRNTEVKSALRHMDAPWIINFDDAESARGDRSRPVPQSPRSPPSPQACAWGELSPGLRLAGSGTLAVAPPLGPGLEAAANLFLPYLGDLVAAAASPSLDPAGRGSPGPTPPTQTKTAPSRRDSAPSGGGGKRGGNMAPPKCARRPLGCGGRGRRSRGGRQVHVLGDRSVAVGRDLPSPDGSYFQDIFIFYPLFCVHFITSVYRGNNAKLF

SEQ ID NO: 918460 - protein, 354 aa, Homo sapiens
MVPVDSPGPGDSKDGIPLFSLGALSQSALVHSRSRNAIQESSLGIRGLKSPFSALPPSPTVAMPGLGVLQLACDECCQDRVLPFKATDSLLAKGVSRNVIQELIDIGESIAIPDEFTEQEKQSGDWWKRLVSAGIASAVARTCTAPLDRLKYKKLLSFDGVHLGILERFIFGSLAGVTAQTCIYPMEVLKTRLAIGKTGEYSGIIDCGKKLLKQEGVRSFFKGYTPNLLGIVPYAGIDLAVYEILKNFWLENYAGNSVNPGIMILVGCSTLSNTCGQLASFSVNLIRTRMQASAPVEKGKTTSMIQLIQEIYTKEGKLGFYRGFTSNIIKVLPAVGVGCVAYEKVKPLFGLTWK

SEQ ID NO: 918461 - protein, 149 aa, Homo sapiens
MDSDGSMTVDWDEWKYYFLLHPATNITEMIHFWKHSTGASRGLEQSSGDWHPSTDFDADDSPDRVIQLALTRPTCTYSSAHLELKSRASVGTLGSPCCSKAGAEFLSLFQVDRPAGGPTPTGPSVWNRLLSSLMLESRPVSGFGEGCSI

SEQ ID NO: 918462 - protein, 230 aa, Homo sapiens
VFGVRGVAPTLDHKCLKITQLIYKHASYKKLLSFDGVHLGILERFIFGSLAGVTAQTCIYPMEVLKTRLAIGKTGEYSGIIDCGKKLLKQEGVRSFFKGYTPNLLGIVPYAGIDLAVYEILKNFWLENYAGNSVNPGIMILVGCSTLSNTCGQLASFSVNLIRTRMQASAPVEKGKTTSMIQLIQEIYTKEGKLGFYRGFTSNIIKVLPAVGVGCVAYEKVKPLFGLTWK

SEQ ID NO: 918463 - protein, 240 aa, Homo sapiens [sequence omitted]

SEQ ID NO: 918464 - protein, 400 aa, Homo sapiens
KSSRGTQPAKEMRSPHTQVLKSKLEEVVVSSQDQQIVALVLTRLKKAQRIRELQQQAAKAWEELKRSDQKVQMTLERERRLLLRQSQEQWQEKEQRKTLQSPEQRGLRRDSQRKNVPPGESRWKEQPEDQESPRQEKLEKARAQAEHRKQCQVRRLREQEKMLRNLREQHSLQLQRRLVEACRKRHLHAVEGQKKVQDTNLSSLINYQARKVLMDCQAKAEELLRQLSLEQSFQRSQEIHQGLRKERQRELREKAQKEEEQLQQARWRAGESEEQRKMRKRILVELADEKIRQARSHVHKTTRDKVQHLRELNHLREKNHHILKLKAEKEEKCHIEGIKEAIKKKEQRVQHISQGKDPNFQEFQKLPQASRREERAPPNSSLDQMVLEAQLRACQQNRGY

SEQ ID NO: 918465 - protein, 183 aa, Homo sapiens
RGKRDTGGSRRAPAPQLAGCLLGPQFLLVFLMSLPSLQGRAPLRMVLWVPSEQHKVDACRTLPPRTECARGGRRAAVGTRASRDEQELLESDPESIGRHFASNSSSVAAAILVPFIALIIAGFVLYLYKHRRRPKVPFNGYAGHENTNVRATFENPMYDRNIQPTDIMASEAEFTVSTVCTAV

SEQ ID NO: 918466 - protein, 147 aa, Homo sapiens
DGRMTLSESINLSGPHFLSVSVNGKTSAGSLFTQLCFVMQMLMDGVSGEISSANPGSTPVFSIGLLRASPVHDASPVREDSVSFPNAIHFVNLVWWNSCYCFTGVHSHYLRNSNLTDLEVFTIFCSKAWVAISKIFCEKHCSRLQFK

SEQ ID NO: 918467 - protein, 141 aa, Homo sapiens
MKRGHPWERWQEEHCRQRQCKYKGPARQRACHIMEGLTVALYSHGVRPWESIQYQSQSLLNHTGGQSQSLLNHTGGQSQSLLNHTGGSSKWEAMAKDWKVGERVLQVISPAVTVPPPWLQLLLDIPSLRGPSTHWQSQLWC

SEQ ID NO: 918468 - protein, 174 aa, Homo sapiens
MGCSETLPFPHLSAALGIQQQFISSFPVLRLLTPAGGHYKHGLSNTTQLPFPHGPHLVHRKHVCPGKLWECSPFPITQHSGFRFLKHEPVRSPLCPSNFRRHILSSTDGSIKDRILGTQYFPPQKSFSKVFLISNSASLYAISVGNHLRNEVIIQVERKTSLTMLAAIFGDHLP

SEQ ID NO: 918469 - protein, 138 aa, Homo sapiens
CIESLGSTFLGSLVQPSLSTPQAVSLPVFLRRRVPNKRSTTLRSGEVLLGPTKATQVKEWMALPQLWLRSPLQDDILLGDGHQRQGHGRRCQEEAQRKGYGSTKQESGLLQARKRGLPRNQLYQHIDLGLLASRTLRK

SEQ ID NO: 918470 - protein, 149 aa, Homo sapiens
MFVSRLGRKGLGGTKQQGGKEKTSTSEARTFHRLTLDTGPETRSWRLSLKQPVGLLGLCVSTYLALKPARLLSSLLSDPCNTKRPEEDTLKRKAPRSSGFTPVFIYSFPQRSLYGFPMSHRSYRIGGLRAADKSLSGREEEFQTKDLLP

SEQ ID NO: 918471 - protein, 1780 aa, Homo sapiens
PPPPPPPREACHPLGGKMKEICRICARELCGNQRRWIFHTASKLNLQVLLSHVLGKDVPPDGKAEFACSKCAFMLDRIYRFDTVIARIEALSIERLQKLLLEKDRLKFCIASMYRKNNDDSGVEIKAGNGTVDMSVLPDARYSTLLQEDFAYSGFECWVENEDQIQEPHSCHGSEGPGNRPRRCRGCAALRVADSDYEAICKVPRKVARSISCGPSSRWSTSICTEEPALSEVGPPDLASTKVPPDGESMEEETPGSSVESLDASVQASPPQQEDEETERSAKELGKCDCCSDDQAPQHGCNHKLELALSMIKGLDYKPIQSPRGSRLPIPVKSSLPGAKPGPSMTDGVSSGFLNRSLKPLYKTPVSYPLELSDLQELWDDLCEDYLPLRVQPMTEELLKQQKLNSHETTITQQSVSDSHLAELQEKIQQTEATNKILQEKLNEMSYELKCAQELSQKQDGTIQNLKETLKSRERETEELYQVIEGQNDTMAKLREMLHQSQLGQLHSSEGTSPAQQQVALLDLQSALFCSQLEIQKLQRVVRQKERQLADAKQCVQFVEAAAHESEQQKEASWKHNQELRKALQQLQEVLQNKSQQLRAWEAEKYNEIRTQEQNIQHLNHSLSHKEQLLQEFRELLQYRDNSDKTLEANEMLLEKLRQRIRDKAVALERAIDEKFSALEEKEKELRQLRLAGSMQIPSRDDSTSLTAKEDVSIPRSTLGDLDTVAGLEKELSNAKEELELMAKKERESQPCRLGRISSPCIWRKEEIRVSGQKEYNLTCCLEAICEGNHFSFLDLFPGAAAGDDTEDTSTEFTDSIEEEAAHHSHQQENGPLKVDFELLLVMSLEGKFLPDTKFPSYSKHSYAFPNRHIPPCLSSKLVKVALEKSLATVETQNPSFSPPSPMGGDSNRCLQEEMLHLRAEIHQHLEEKRKAEEELKELKAQIEEAGFSSVSHIRNTMLSLCLENAELKEQMGETMSDGWEIEEDKEKGEVMVETVVTKEGLSESSLQAEFRKLQGKLKNAHNIINLLKEQLVLSSKEGNSKLTPELLVHLTSTIERINTELVGSPGKHQHQEEGNVTVRPFPRPQSLDLGATFTVDAHQANELEKYRVMLSESLVKQDSKQIQVDFQDLGYETCGRSENEAEREETTSPECEEHNSLKEMVLMEGLCSEQGRRGSTLASSSERKPLENQLGKQEEFRVYGKSENILVLRKDIEDLKAQLQNANKVIQNLKSRVRSLSVTSDYSSSLERPRKLRAVGTLEGSSPHSVPDEDEGWLSDGTGAFYSPGLQAKKDLESLIQRVSQLEAQLPENGLEEKLAEELRSASWPGKYDSLIQDQARELSYLRQKIREGRGICYLITQHAKDTVKSFEDLLRSNDIDYYLGQSFREQLAQGSQLTERLTSKLSTKDHKSEKDQAGLEPLALRLSRELQEKEKVIEVLQAKLDARSLTPSSSRALSDSHRSPSSTSFLSDELEACSDMDIVSEYTHYEEKKASPSHSDSIHHSSHSAVLSSKPSSTSASQGAKAESNSNPISLPTPQNTPKEANQAHSGTSTVPPASTATLLSNDLEADSSYYLNSAQPHSPPRGTIELGRILEPGYLGSSGKWDVMRPQKGSVSGDLSSGSSVYQLNSKPTGADLLEEHLGEIWNLRQRLEESICINDCLREQLEHRLTSTARGRGSTSNFYSQGLESIPQLCNENRVLREENRRLQAQLSHVSREHSQETESLREALLSSRSHLQELEKELEHQKVERQQLLEDLREKQQEVLHFREERLSLQENDSR

SEQ ID NO: 918472 - protein, 645 aa, Homo sapiens
EDPQRSLYRGETPSPECEEHNSLKEMVLMEGLCSEQGRRGSTLASSSERKPLENQLGKQEEFRVYGKSENILVLRKDIEDLKAQLQNANKVIQNLKSRVRSLSVTSDYSSSLERPRKLRAVGTLEGSSPHSVPDEDEGWLSDGTGAFYSPGLQAKKDLESLIQRVSQLEAQLPENGLEEKLAEELRSASWPGKYDSLIQDQARELSYLRQKIREGRGICYLITQHAKDTVKSFEDLLRSNDIDYYLGQSFREQLAQGSQLTERLTSKLSTKDHKSEKDQAGLEPLALRLSRELQEKEKVIEVLQAKLDARSLTPSSSRALSDSHRSPSSTSFLSDELEACSDMDIVSEYTHYEEKKASPSHSDSIHHSSHSAVLSSKPSSTSASQGAKAESNSNPISLPTPQNTPKEANQAHSGTSTVPPASTATLLSNDLEADSSYYLNSAQPHSPPRGTIELGRILEPGYLGSSGKWDVMRPQKGSVSGDLSSGSSVYQLNSKPTGADLLEEHLGEIWNLRQRLEESICINDCLREQLEHRLTSTARGRGSTSNFYSQGLESIPQLCNENRVLREENRRLQAQLSHVSREHSQETESLREALLSSRSHLQELEKELEHQKVERQQLLEDLREKQQEVLHFREERLSLQENDSR

SEQ ID NO: 918473 - protein, 140 aa, Homo sapiens [sequence omitted]

SEQ ID NO: 918474 - protein, 164 aa, Homo sapiens
GTRKKFARFEGISSSGKTKFPPRLRIPFLMAQSLVFHRPQGVLDPGPRTCSKTLLHYVRQAGPASALLPTQKVEQRVWWKDPITKGCETGQNQQPIWVPSRYLKPYYEPDNEEEVLGGSQTPTGGSIVQVDAEDDPQLSRATLIESSHLPGDRSRSCHRWWKKT

SEQ ID NO: 918475 - protein, 290 aa, Homo sapiens
MVTHQIQPVFLRLEHLQLLKVKLITFFSGHLEQLISYVLLFRISLEPLGALLEKIAATLKTLIFEGCQIHYCQLSAILPGLSRCSQLTTFYFGRNCMSTDTLKDLLRHTSGLSKLSLETYPAPEESLNSLHGGVCSHCVVPPGTCCNFGVELGSSMYAVAAQMSVCMLSAGLWMLLDASDLGAMGGGGRQTDSWMGRRGYLVRLYLVTKGGLKPVGWSTSAMDQSGNMWCLFCACQWLPMTQAAHTSFPMMPQQPQTQGKHQDEQWQSETTHSWDDFPADKQSTLGPFLY

SEQ ID NO: 918476 - protein, 798 aa, Homo sapiens
FYPAPVQDGVAVVHTSLTKIQGYSESPDLEFEYADTDKWAAELSELYSYTEGPEFLMNRKCFEEDFRIHVTDKKWTELDTNQHRTHAMRLLDGLEVTAREKRLKVARAILYVAQGTFGECSSEAEVQSWMRYNIFLLLEVGTFNALVELLNMEIDNSAACSSAVRKPAISLADSTDLRVLLNIMYLIVETVHQECEGDKAEWRTMRQTFRAELGSPLYNNEPFAIMLFGMVTKFCSGHAPHFPMKKVLLLLWKTVLCTLGGFEELQSMKAEKRSILGLPPLPEDSIKVIRNMRAASPPASASDLIEQQQKRGRREHKALIKQDNLDAFNERDPYKADDSREEEEENDDDNSLEGETFPLERDEVMPPPLQHPQTDRLTCPKGLPWAPKVREKDIEMFLESSRSKFIGYTLGSDTNTVVGLPRPIHESIKTLKQHKYTSIAEVQAQMEEEYLRSPLSGGEEEVEQVPAETLYQGLLPSLPQYMIALLKILLAAAPTSKAKTDSINILADVLPEEMPTTVLQSMKLGVDVNRHKEVIVKAISAVLLLLLKHFKLNHVYQFEYMAQHLVFANCIPLILKFFNQNIMSYITAKNSISVLDYPHCVVHELPELTAESLEAGDSNQFCWRNLFSCINLLRILNKLTKWKHSRTMMLVVFKSAPILKRALKVKQAMMQLYVLKLLKVQTKYLGRQWRKSNMKTMSAIYQKVRHRLNDDWAYGNDLDARPWDFQAEECALRANIERFNARRYDRAHSNPDFLPVDNCLQSVLGQRVDLPEDFQMNYDLWLEREVFSKPISWEELLQ

SEQ ID NO: 918477 - protein, 216 aa, Homo sapiens [sequence omitted]

SEQ ID NO: 918478 - protein, 544 aa, Homo sapiens
MQCTLGGFEELQSMKAEKRSILGLPPLPEDSIKVIRNMRAASPPASASDLIEQQQKRGRREHKALIKQDNLDAFNERDPYKADDSREEEEENDDDNSLEGETFPLERDEVMPPPLQHPQTDRLTCPKGLPWAPKVREKDIEMFLESSRSKFIGYTLGSDTNTVVGLPRPIHESIKTLKQHKYTSIAEVQAQMEEEYLRSPLSGGEEEVEQVPAETLYQGLLPSLPQYMIALLKILLAAAPTSKAKTDSINILADVLPEEMPTTVLQSMKLGVDVNRHKEVIVKAISAVLLLLLKHFKLNHVYQFEYMAQHLVFANCIPLILKFFNQNIMSYITAKNSISVLDYPHCVVHELPELTAESLEAGDSNQFCWRNLFSCINLLRILNKLTKWKHSRTMMLVVFKSAPILKRALKVKQAMMQLYVLKLLKVQTKYLGRQWRKSNMKTMSAIYQKVRHRLNDDWAYGNDLDARPWDFQAEECALRANIERFNARRYDRAHSNPDFLPVDNCLQSVLGQRVDLPEDFQMNYDLWLEREVFSKPISWEELLQ

SEQ ID NO: 918479 - protein, 151 aa, Homo sapiens
MMLVVFKSAPILKRALKVKQAMMQLYVLKLLKVQTKYLGRQWRKSNMKTMSAIYQKVRHRLNDDWAYGNDLDARPWDFQAEECALRANIERFNARRYDRAHSNPDFLPVDNCLQSVLGQRVDLPEDFQMNYDLWLEREVFSKPISWEELLQ

SEQ ID NO: 918480 - protein, 540 aa, Homo sapiens
RDLITVRENIKDRISRGIGQPRWLLTLAATLNMAAREISWRKSRESCITAAVRELSWGCGAAKMEPAVGGPGPLIVNNKQPQPPPPPPPAAAQPPPGAPRAAAGLLPGGKAREFNRNQRKDSEGYSESPDLEFEYADTDKWAAELSELYSYTEGPEFLMNRKCFEEDFRIHVTDKKWTELDTNQHRTHAMRLLDGLEVTAREKRLKVARAILYVAQGTFGECSSEAEVQSWMRYNIFLLLEVGTFNALVELLNMEIDNSAACSSAVRKPAISLADSTDLRVLLNIMYLIVETVHQECEGDKAEWRTMRQTFRAELGSPLYNNEPFAIMLFGMVTKFCSGHAPHFPMKKVLLLLWKTVLCTLGGFEELQSMKAEKRSILGLPPLPEDSIKVIRNMRAASPPASASDLIEQQQKRGRREHKALIKQDNLDAFNERDPYKADDSREEEEENDDDNSLEGETFPLERDEVMPPPLQHPQTDRLTCPKGLPWAPKVREKDIEMFLESSRSKFIGYTLGSDTNTVVGLPRPIHESIKTLKQVSGFG

SEQ ID NO: 918481 - protein, 164 aa, Homo sapiens
RDLITVRENIKDRISRGIGQPRWLLTLAATLNMAAREISWRKSRESCITAAVRELSWGCGAAKMEPAVGGPGPLIVNNKQPQPPPPPPPAAAQPPPGAPRAAAGLLPGGKAREFNRNQRKDSEGYSESPDLEFEYADTDKWAAELSGNAQTFVLFGGGFFLIGL

SEQ ID NO: 918482 - protein, 900 aa, Homo sapiens
RDLITVRENIKDRISRGIGQPRWLLTLAATLNMAAREISWRKSRESCITAAVRELSWGCGAAKMEPAVGGPGPLIVNNKQPQPPPPPPPAAAQPPPGAPRAAAGLLPGGKAREFNRNQRKDSEGYSESPDLEFEYADTDKWAAELSELYSYTEGPEFLMNRKCFEEDFRIHVTDKKWTELDTNQHRTHAMRLLDGLEVTAREKRLKVARAILYVAQGTFGECSSEAEVQSWMRYNIFLLLEVGTFNALVELLNMEIDNSAACSSAVRKPAISLADSTDLRVLLNIMYLIVETVHQECEGDKAEWRTMRQTFRAELGSPLYNNEPFAIMLFGMVTKFCSGHAPHFPMKKVLLLLWKTVLCTLGGFEELQSMKAEKRSILGLPPLPEDSIKVIRNMRAASPPASASDLIEQQQKRGRREHKALIKQDNLDAFNERDPYKADDSREEEEENDDDNSLEGETFPLERDEVMPPPLQHPQTDRLTCPKGLPWAPKVREKDIEMFLESSRSKFIGYTLGSDTNTVVGLPRPIHESIKTLKQHKYTSIAEVQAQMEEEYLRSPLSGGEEEVEQVPAETLYQGLLPSLPQYMIALLKILLAAAPTSKAKTDSINILADVLPEEMPTTVLQSMKLGVDVNRHKEVIVKAISAVLLLLLKHFKLNHVYQFEYMAQHLVFANCIPLILKFFNQNIMSYITAKNSISVLDYPHCVVHELPELTAESLEAGDSNQFCWRNLFSCINLLRILNKLTKWKHSRTMMLVVFKSAPILKRALKVKQAMMQLYVLKLLKVQTKYLGRQWRKSNMKTMSAIYQKVRHRLNDDWAYGNDLDARPWDFQAEECALRANIERFNARRYDRAHSNPDFLPVDNCLQSVLGQRVDLPEDFQMNYDLWLEREVFSKPISWEELLQ

SEQ ID NO: 918483 - protein, 711 aa, Homo sapiens
MRLLDGLEVTAREKRLKVARAILYVAQGTFGECSSEAEVQSWMRYNIFLLLEVGTFNALVELLNMEIDNSAACSSAVRKPAISLADSTDLRVLLNIMYLIVETVHQECEGDKAEWRTMRQTFRAELGSPLYNNEPFAIMLFGMVTKFCSGHAPHFPMKKVLLLLWKTVLCTLGGFEELQSMKAEKRSILGLPPLPEDSIKVIRNMRAASPPASASDLIEQQQKRGRREHKALIKQDNLDAFNERDPYKADDSREEEEENDDDNSLEGETFPLERDEVMPPPLQHPQTDRLTCPKGLPWAPKVREKDIEMFLESSRSKFIGYTLGSDTNTVVGLPRPIHESIKTLKQHKYTSIAEVQAQMEEEYLRSPLSGGEEEVEQVPAETLYQGLLPSLPQYMIALLKILLAAAPTSKAKTDSINILADVLPEEMPTTVLQSMKLGVDVNRHKEVIVKAISAVLLLLLKHFKLNHVYQFEYMAQHLVFANCIPLILKFFNQNIMSYITAKNSISVLDYPHCVVHELPELTAESLEAGDSNQFCWRNLFSCINLLRILNKLTKWKHSRTMMLVVFKSAPILKRALKVKQAMMQLYVLKLLKVQTKYLGRQWRKSNMKTMSAIYQKVRHRLNDDWAYGNDLDARPWDFQAEECALRANIERFNARRYDRAHSNPDFLPVDNCLQSVLGQRVDLPEDFQMNYDLWLEREVFSKPISWEELLQ

SEQ ID NO: 918484 - protein, 344 aa, Homo sapiens
MLKGEEEVEQVPAETLYQGLLPSLPQYMIALLKILLAAAPTSKAKTDSINILADVLPEEMPTTVLQSMKLGVDVNRHKEVIVKAISAVLLLLLKHFKLNHVYQFEYMAQHLVFANCIPLILKFFNQNIMSYITAKNSISVLDYPHCVVHELPELTAESLEAGDSNQFCWRNLFSCINLLRILNKLTKWKHSRTMMLVVFKSAPILKRALKVKQAMMQLYVLKLLKVQTKYLGRQWRKSNMKTMSAIYQKVRHRLNDDWAYGNDLDARPWDFQAEECALRANIERFNARRYDRAHSNPDFLPVDNCLQSVLGQRVDLPEDFQMNYDLWLEREVFSKPISWEELLQ

SEQ ID NO: 918485 - protein, 721 aa, Homo sapiens
RDLITVRENIKDRISRGIGQPRWLLTLAATLNMAAREISWRKSRESCITAAVRELSWGCGAAKMEPAVGGPGPLIVNNKQPQPPPPPPPAAAQPPPGAPRAAAGLLPGGKAREFNRNQRKDSEGYSESPDLEFEYADTDKWAAELSELYSYTEGPEFLMNRKCFEEDFRIHVTDKKWTELDTNQHRTHAMRLLDGLEVTAREKRLKVARAILYVAQGTFGECSSEAEVQSWMRYNIFLLLEVGTFNALVELLNMEIDNSAACSSAVRKPAISLADSTDLRVLLNIMYLIVETVHQECEGDKAEWRTMRQTFRAELGSPLYNNEPFAIMLFGMVTKFCSGHAPHFPMKKVLLLLWKTVLCTLGGFEELQSMKAEKRSILGLPPLPEDSIKVIRNMRAASPPASASDLIEQQQKRGRREHKALIKQDNLDAFNERDPYKADDSREEEEENDDDNSLEGETFPLERDEVMPPPLQHPQTDRLTCPKGLPWAPKVREKDIEMFLESSRSKFIGYTLGSDTNTVVGLPRPIHESIKTLKQHKYTSIAEVQAQMEEEYLRSPLSGGEEEVEQVPAETLYQGLLPSLPQYMIALLKILLAAAPTSKAKTDSINILADVLPEEMPTTVLQSMKLGVDVNRHKEVIVKAISAVLLLLLKHFKLNHVYQFEYMAQHLVFANCIPLILKFFNQNIMSYITAKNSISVLDYPHCVVHELPELTAESLVSGWAL

SEQ ID NO: 918486 - protein, 88 aa, Homo sapiens
EELQSMKAEKRSILGLPPLPEDSIKVIRNMRAASPPASASDLIEQQQKRGRREHKVRTTEVPVTPEGPQGACLQQHSPWRSRAAGNDL

SEQ ID NO: 918487 - protein, 422 aa, Homo sapiens
ETPTWKAPKQLNWKMWKGDWGRGLFLRSGSSTNSKGNLGKLQTLCALVLSSAKQNHPINYLDPFQGALGRAQITDGIGQCVEMVQQDEGSPTTLTMSLILPDRYLVHWLLPPSLLSESELQAVPSALSSGIPVPVFAVKDSKVLCRVHQLFLNLPGSTSSATNVSMVVSADPLSSERAEMNILEINQELRSQLAESNQQFRDLKEKFLITQATAYSLANQLKKYKCEEYKDIIDSVLRDELQSMEKLAEKLRQAEELRQYKALVHSQAKELTQLREKLREGRDASRWLNKHLKTLLTPDDPDKSQGQDLREQLAEGHRLAEHLVHKLSPENDEDEDEDEDDKDEEVEKVQESPAPREVQKTEEKEVPQDSLEECAVTCSNSHNPSNSNQPHRSTKITFKEHEVDSALVVESEHPHDEEEEAL

SEQ ID NO: 918488 - protein, 788 aa, Homo sapiens
MGLWGKKGTVAPHDQSPRRRPKKGLIKKKMVKREKQKRNMEELKKEVVMDDHKLTLEELSTKYSVDLTKGHSHQRAKEILTRGGPNTVTPPPTTPEWVKFCKQLFGGFSLLLWTGAILCFVAYSIQIYFNEEPTKDNLYLSIVLSVVVIVTGCFSYYQEAKSSKIMESFKNMVPQQALVIRGGEKMQINVQEVVLGDLVEIKGGDRVPADLRLISAQGCKVDNSSLTGESEPQSRSPDFTHENPLETRNICFFSTNCVEGTARGIVIATGDSTVMGRIASLTSGLAVGQTPIAAEIEHFIHLITVVAVFLGVTFFALSLLLGYGWLEAIIFLIGIIVANVPEGLLATVTVCLTLTAKRMARKNCLVKNLEAVETLGSTSTICSDKTGTLTQNRMTVAHMWFDMTVYEADTTEEQTGKTFTKSSDTWFMLARIAGLCNRADFKANQEILPIAKRATTGDASESALLKFIEQSYSSVAEMREKNPKVAEIPFNSTNKYQMSIHLREDSSQTHVLMMKGAPERILEFCSTFLLNGQEYSMNDEMKEAFQNAYLELGGLGERVLGFCFLNLPSSFSKGFPFNTDEINFPMDNLCFVGLISMIDPPRAAVPDAVSKCRSAGIKVIMVTGDHPITAKAIAKGVGIISEGTETAEEVAARLKIPISKVDASAAKAIVVHGAELKDIQSKQLDQILQNHPEIVFARTSPQQKLIIVEGCQRLGAVVAVTGDGVNDSPALKKADIGIAMGISGSDVSKQAADMILLDDNFASIVTGVEEGEEAGCPWWRLQPWTQGD

SEQ ID NO: 918489 - protein, 150 aa, Homo sapiens
MEPCLLLAQQSEINLIVGYIYIYICGMLHHKNKNVKRTSFFCNPKRSSLRIKSHCSKKGAQGPAGRRKLAPQYRLRTSFFGREQMREAGEKKGRGRRHFPLPAPAADEPAQGLLLRHMLLRHEGVPVPWERVQDRWFCLLQKRILGVSVS

SEQ ID NO: 918490 - protein, 500 aa, Homo sapiens
MFPSPCHDSTGLDQALCWGRLSTLPSYSLYHGGQAGFYVTLVVNRWWSQYTSIPLPDQLMCVISASVHGVDQRGRLLRRTLIRYANLASVLVLRSVSTRVLKRFPTMEHVVDAGAPPAGSLWGSGPQPDAGTRNRESWDSRWTRGRGARRRNSSLPWRQRVQLHPTCFTPSGFMSQEERKKFESLKSDFNKYWVPCVWFTNLAAQARRDGRIRDDIALCLLLEELNKYRAKCSMLFHYDWISIPLVVTIAVYSFFALSLVGRQFVEPEAGAAKPQKLLKPGQEPAPALGDPDMYVPLTTLLQFFFYAGWLKVAEQIINPFGEDDDDFETNQLIDRNLQVSLLSVDEMYQNLPPAEKDQYWDEDQPQPPYTVATAAESLRPSFLGSTFNLRRSRVPAPALCPGSARPPARSMSDDPEQSLQVEASPGSGRPAPAAQTPLLGRFLGVGAPSPAISLRNFGRVRGTPRPPHLLRFRAEEGGDPEAAARIEEESAESGDEALEP

SEQ ID NO: 918491 - protein, 180 aa, Homo sapiens
MVAAMGGGGGPAFAQTAVGRWGGGAVGRPRRLQGVGVSRGTFMKPARWRLGAERFARLARFRGAVGRRRARALRLDRSPRRAGHRRGKSQKHSPTLPLTLLDTLASSPPPQTQTQKNCGKLGACRPGFLALTLCDPEQESMTCGRYDTNLCWDHFFPEPSPHTFYLANSSSLIIMEEDGS

SEQ ID NO: 918492 - protein, 131 aa, Homo sapiens
MWSSSHLLSKCPVRYRIDCRDIAMLVFKSPLFDLIMAPKCKSSHASNLDMAKRSHKVLSLNEKWTSIYCAFTAAITIASSKTVSSAPSSGWMGNCNCRPLISSHGGEQGARATLISLMRENPIHEASTHVT

SEQ ID NO: 918493 - protein, 131 aa, Homo sapiens; identical to SEQ ID NO: 918492

SEQ ID NO: 918494 - protein, 135 aa, Homo sapiens
MGNYLLRKLSCLGENQKKPKKGNPDEERKRQEMTTFERKLQDQDKKSQEVSSTSNQENENGSGSEEVCYTVINHIPHQRSSLSSNDDGYENIDSLTRKVRQFRERSETEYALLRTSVSRPCSCTHEHDYEVVFPH

SEQ ID NO: 918495 - protein, 197 aa, Homo sapiens
VCLEMANMGNFMLYELVTHTFVGNLGVFLVLLALPGKNALPTRSGSSPPPLQACKAPSSTLDFVPVTGRSVVYQPEHLPAEVSAPLGPAGRFSGSQLYKPQALGGEGEVYTHKVLGKSLGERFCRPQPEAYSADCAQFLKVGTEEKARGGRGGGTQALHSTQGASGSRKEATHQSWGLVPWGCLASGGLLRARALSG

SEQ ID NO: 918496 - protein, 358 aa, Homo sapiens
MLLPPSSLSRPRTFSSQPLQTKLMTHNGLFRPIPYLTAVSADEPTASQQPPQAQLHRYNGLFRPSSCLPAFSPGPELSQVDLTRPSSCFFAASPGPAPASWWHLQAQPLPPVGLYNPNICLTADSSGPASASLPSVCCFASSPGPGLPPVGLSRPSSSSRRPLQAQTVVKSACPGPAPASRRPLQAQVVLKLASPGPATASRRPFRVQNRFGRPSSRLPVASSGPWGSFLTTAFPGPVFPFRRPLRAQNLLKSASPDPLAASGRPLWAQLFLPAALQARLLPLNNLFGLSAYPSPGGLGRPTASSSQAPQAQVRPHGGLSRMSSCPPMASAGPKWSPVGGLLHAKLGPPGDLCRPKLS

SEQ ID NO: 918497 - protein, 358 aa, Homo sapiens; identical to SEQ ID NO: 918496

SEQ ID NO: 918498 - protein, 365 aa, Homo sapiens
MCLNLLAQLLPPSSLSRPRTFSSQPLQTKLMTHNGLFRPIPYLTAVSADEPTASQQPPQAQLHRYNGLFRPSSCLPAFSPGPELSQVDLTRPSSCFFAASPGPAPASWWHLQAQPLPPVGLYNPNICLTADSSGPASASLPSVCCFASSPGPGLPPVGLSRPSSSSRRPLQAQTVVKSACPGPAPASRRPLQAQVVLKLASPGPATASRRPFRVQNRFGRPSSRLPVASSGPWGSFLTTAFPGPVFPFRRPLRAQNLLKSASPDPLAASGRPLWAQLFLPAALQARLLPLNNLFGLSAYPSPGGLGRPTASSSQAPQAQVRPHGGLSRMSSCPPMASAGPKWSPVGGLLHAKLGPPGDLCRPKLS

SEQ ID NO: 918499 - protein, 137 aa, Homo sapiens
MDLGDVSVEKVMESTDGMSSPQMCGDILHIHQLSGLEVTVEERDPVSSNTKNRDILNVAIEVSKAEGSEGRGCAWQNPSGFLAEAVLWAAMFVGHLICSRRSDLLVRPAKGRDRKPSGGAGSAVVADASAFGIRIIN

SEQ ID NO: 918500 - protein, 186 aa, Homo sapiens
PRTAPLLPELGRRRSSRMAPSEDPRDWRANLKGTIRETGLETSSGGKLAGHQKTVPTAHLTFVIDCTHGKQLSLAATASPPQAPSPNRGLVTPPMKTYIVFCGENWPHLTRVTPMGGGCLAQARATLPLCRGSVASASFPVSPLCPQEVPEAKGKPVKAAPVRSSTWGTVKDSLKALSSCVCGQAD

SEQ ID NO: 918501 - protein, 1764 aa, Homo sapiens
RLALSVSMPQLWLQSYFAACEDEIPAIRNHDKVLQRLCEHLDHALLYGLQDLSSGYWVLVVHFTRREAIKQIEVLQHVATNLGRSRAWLYLALNENSLESYLRLFQENLGLLHKYYVKNALVCSHDHLTLFLTLVSGLEFIRFELDLDAPYLDLAPYMPDYYKPQYLLDFEDRLPSSVHGSDSLSLNSFNSVTSTNLEWDDSAIAPSSEDYDFGDVFPAVPSVPSTDWEDGDLTDTVSGPRSTASDLTSSKASTRSPTQRQNPFNEEPAETVSSSDTTPVHTTSQEKEEAQALDPPDACTELEVIRVTKKKKIGKKKKSRSDEEASPLHPACSQKKCAKQGDGDSRNGSPSLGRDSPDTMLASPQEEGEGPSSTTESSERSEPGLLIPEMKDTSMERLGQPLSKVIDQLNGQLDPSTWCSRAEPPDQSFRTGSPGDAPERPPLCDFSEGLSAPMDFYRFTVESPSTVTSGGGHHDPAGLGQPLHVPSSPEAAGQEEEGGGGEGQTPRPLEDTTREAQELEAQLSLVREGPVSEPEPGTQEVLCQLKRDQPSPCLSSAEDSGVDEGQGSPSEMVHSSEFRVDNNHLLLLMIHVFRENEEQLFKMIRMSTGHMEGNLQLLYVLLTDCYVYLLRKGATEKPYLVEEAVSYNELDYVSVGLDQQTVKLVCTNRRKQFLLDTADVALAEFFLASLKSAMIKGCREPPYPSILTDATMEKLALAKFVAQESKCEASAVTVRFYGLVHWEDPTDESLGPTPCHCSPPEGTITKEGMLHYKAGTSYLGKEHWKTCFVVLSNGILYQYPDRTDVIPLLSVNMGGEQCGGCRRANTTDRPHAFQVILSDRPCLELSAESEAEMAEWMQHLCQAVSKGVIPQGVAPSPCIPCCLVLTDDRLFTCHEDCQTSFFRSLGTAKLGDISAVSTEPGKEYCVLEFSQDSQQLLPPWVIYLSCTSELDRLLSALNSGWKTIYQVDLPHTAIQEASNKKKFEDALSLIHSAWQRSDSLCRGRASREPLVLRQSWLASLVGRKGRHASRQAHCHGCCHAVGSLQSTPALGGRTTECGLRQGPSTPGIQIRCPAPLGILPDRKRMEVAGGRGSEPCGLCGCTPSSRASASVCRISAEWHREHHPSKDEQKNQEGGTPLFLSWVGGWGPECPAILVQCLNTLLATWGSGNTGCLRMFPPPSSITAHTAACLARCRGAGSPPWLPGGSACPQSCPACPLNPAVPVAPRSKGGGWGAWRRAEPTSLASMLTSSDCPLLGWSQALPQSFVKSLLGKGSGGLGFVFENKIDMLYCQGLSLALFEQGRGRELSKSLGPFSANLPPSSALCLTQGTHGTCRTRSATAAGRTHRLQTLRPWEFLGPTFALRPVPVCCSSQGRSSHQLKPQGTSAPPPTICSPPRGRTLLPPQPRGPVRPGPLPSRHGLGPLQTPAPVALRGYRQPKRHHHRACAVPLTRAQKATGPEAMETVPPAVDLVLGASACCLACVFTNPLEVVKTRLQLQGELQARGTYPRPYHGFIASVAAVARADGLWGLQKGLAAGLLYQGLMNGVRFYCYSLACQAGLTQQPGGTVVAGAVAGALGAFVGSPAYLIKTQLQAQTVAAVAVGHQHNHQTVLGALETIWRQQGLLGLWQGVGGAVPRVMVGSAAQLATFASAKAWVQKQQWLPEDSWLVALAGGMISSIAVVVVMTPFDVVSTRLYNQPVDTAGRGQLYGGLTDCMVKIWRQEGPLALYKGLGPAYLRLGPHTILSMLFWDELRKLAGRAQHKGT

SEQ ID NO: 918502 - protein, 1159 aa, Homo sapiens
MLESVDIQQNCEVVQSVPLYILYPVFPIDTFILVWCIITINEPILIYWYYTKVHTLFRFPWILPSVCTSMPHRIPRYFWSLCCFRLLLVQFFILSLFLMILDSLEEYYVVRYFVERTLRGKKEYLSEFFFMIRVELRILGRKTTEIKCRFHYILPGICSIDLTFDFDLDHLAEVAFVSLRHCRAPPFPFHTVLVTGTSLGTTQTYRRGEPRSTSLKEEYLICKLFGIPLNRRFVFYLYQYVFVHNLFYISSYNPILLYVLAQNILTFGLQGTFSVDFCVRLTYPHHCRVVFVFSLAPPHFLALQDASGLFFMFPAHILEAAISSMCPVFFYWRIVLEIGEFRNWRIVLENKIGHYFMFIANEFSLLLGPMKVLTFKFFKLLRAAILSNYFCKCWWPKVLNKKFKICFSLGKECCIVVTVENCQKENLKRTILRRTFLKTFLRIDIIVSVNLLLLFFKIIFNDFIQSSDSLGNDCEDFAFCASLLQWIFHLFNYGLELEMQIRQQLNLPLGILLFAGHLLSELHKGKKTRSSVCTQELLSSSLITSTVQALISQNRKFRNNQETISDVFWANITPAQAYKNCQKSLKYWLINNDEVEKKFKHDISVIFLQKGGFFLNKEVTVKLIFTSFKDSIILCIVRYYSEKHPFILSGERQPIITGSQPLQQLVIDKGSDPFWLKMKQKSECSYGLPNLRLSYMEEPFTHYNNPGMRCCITVTCRVMTYERHSLSTQGKLTQKVKFRRKVNGYNILSVRVCVCVCARARTFVCIYLYIPSATCHMVYESLGDFWFWRIGCECTSETDRMMYYLVGHWSRVQMCLSIYEKLPIVTEAPYHMSPGDFKGNLTKIELYFRYSIFCGLIMTLYLLKEFFALIIKTISLFSDFTVTSFLYFLGKQNLSSINLVLSLPRGSHFIWANKFPGNYKYYVIMCKNVMSFLIQTFARHSREVQDVVSVCKRLELSEAKYSVETGSGENLAAGTREHTYMDCSYSFSVSELIFIVRGTQCNSSDVFVENLREGDFRSLLCRRISLIMEMFSLCCAIWQSVAVFMYQTLEDALNVTEELNFKFNFNDVLNLNSYMWLVTTFWIAQLKMARFGMSTREIMSVKNCGMQPGAVADACNPSTFGGLSRRNTRSGVRDQPGRYSETLSLLKIQKLAGHDGTCP
